US012624385B2

(12) United States Patent
Soenksen Martinez et al.

(10) Patent No.: US 12,624,385 B2
(45) Date of Patent: May 12, 2026

(54) RIBOREGULATORS AND METHODS OF USE THEREOF

(71) Applicants: President and Fellows of Harvard College, Cambridge, MA (US); Massachusetts Institute of Technology, Cambridge, MA (US)

(72) Inventors: Luis Ruben Soenksen Martinez, Boston, MA (US); Nicolaas Angenent-Mari, Somerville, MA (US); Alexander S. Garruss, Cambridge, MA (US); James J. Collins, Newton, MA (US); George M. Church, Cambridge, MA (US); Katherine Collins, Cambridge, MA (US); Diogo M. Camacho, Cambridge, MA (US)

(73) Assignees: President and Fellows of Harvard College, Cambridge, MA (US); Massachusetts Institute of Technology, Cambridge, MA (US)

( * ) Notice: Subject to any disclaimer, the term of this patent is extended or adjusted under 35 U.S.C. 154(b) by 902 days.

(21) Appl. No.: 17/784,899

(22) PCT Filed: Dec. 11, 2020

(86) PCT No.: PCT/US2020/064695
§ 371 (c)(1),
(2) Date: Jun. 13, 2022

(87) PCT Pub. No.: WO2021/194580
PCT Pub. Date: Sep. 30, 2021

(65) Prior Publication Data
US 2023/0022775 A1    Jan. 26, 2023

Related U.S. Application Data

(60) Provisional application No. 62/948,175, filed on Dec. 13, 2019.

(51) Int. Cl.
*C12Q 1/6816* (2018.01)
*C12N 15/10* (2006.01)
(Continued)

(52) U.S. Cl.
CPC ....... *C12Q 1/6816* (2013.01); *C12N 15/1089* (2013.01); *C12N 15/11* (2013.01);
(Continued)

(58) Field of Classification Search
None
See application file for complete search history.

(56) References Cited

U.S. PATENT DOCUMENTS 9,550,987 B2    1/2017   Green et al.
9,593,338 B2    3/2017   Liu et al.
(Continued)

FOREIGN PATENT DOCUMENTS

EP         2 221 371 A1    8/2010
WO    WO 2004/046321 A2    6/2004
(Continued)

OTHER PUBLICATIONS

ZNF175 [online]. GTEX Portal; 2025 [retrieved on Jul. 16, 2025]. Retrieved from the Internet: https://gtexportal.org/home/gene/ZNF17 (Year: 2025).*
(Continued)

*Primary Examiner* — Anne M. Gussow
*Assistant Examiner* — Emma R Hoppe
(74) *Attorney, Agent, or Firm* — Wolf, Greenfield & Sacks, P.C.

(57) ABSTRACT

This disclosure provides riboregulators specific for particular viruses or for particular human transcription factors. The viral-specific riboregulators may be used to detect the presence of the particular virus, and this may enable diagnosis of an infection. The transcription factor specific riboregulators
(Continued)

Synthetic biology RNA tool (e.g. Toehold Switch)

may be used to detect the presence and/or measure the level of the particular transcription factor, and this may enable diagnosis or prognosis of a particular condition such as cancer.

23 Claims, 39 Drawing Sheets

Specification includes a Sequence Listing.

(51) Int. Cl.

| | |
|---|---|
| *C12N 15/11* | (2006.01) |
| *C12Q 1/6886* | (2018.01) |
| *C12Q 1/6897* | (2018.01) |
| *C12Q 1/70* | (2006.01) |
| *C12Q 1/6806* | (2018.01) |

(52) U.S. Cl.
CPC ........... *C12Q 1/6886* (2013.01); *C12Q 1/701* (2013.01); *C12Q 1/6806* (2013.01); *C12Q 1/6897* (2013.01); *C12Q 2600/158* (2013.01)

(56) References Cited

U.S. PATENT DOCUMENTS

| | | | |
|---|---|---|---|
| 11,124,846 | B2 | 9/2021 | Green et al. |
| 11,788,156 | B2 | 10/2023 | Green et al. |
| 2007/0072215 | A1 | 3/2007 | Seelig et al. |
| 2008/0268452 | A1 | 10/2008 | Kaplan et al. |
| 2014/0154744 | A1 | 6/2014 | Soll et al. |
| 2015/0275203 | A1 | 10/2015 | Green et al. |
| 2016/0244846 | A1 | 8/2016 | Weller et al. |
| 2017/0175111 | A1 | 6/2017 | Green et al. |
| 2017/0204477 | A1 | 7/2017 | Green et al. |
| 2022/0170116 | A1 | 6/2022 | Green et al. |

FOREIGN PATENT DOCUMENTS

| | | | | |
|---|---|---|---|---|
| WO | WO 2006/088165 | A1 | 8/2006 | |
| WO | WO 2009/066758 | A1 | 5/2009 | |
| WO | WO 2014/074648 | A2 | 5/2014 | |
| WO | WO 2016/011089 | A1 | 1/2016 | |
| WO | WO-2017205668 | A1 * | 11/2017 | ........... C12Q 1/6816 |
| WO | WO 2019/166816 | A1 | 9/2019 | |

OTHER PUBLICATIONS

Rakhra G and Rakhra G. Zinc finger proteins: insights into the transcriptional and post transcriptional regulation of immune response. Mol Biol Rep. Jul. 2021;48(7):5735-5743. Epub Jul. 24, 2021 (Year: 2021).*

Expression of ZNF175 in cancer [online]. Human Protein Atlas; 2025 [retrieved Jul. 17, 2025]. Retrieved from the Internet: https://www.proteinatlas.org/ENSG00000105497-ZNF175/cancer (Year: 2025).*

Goodman et al., Causes and effects of N-terminal codon bias in bacterial genes. Science. Oct. 25, 2013;342(6157):475-9. doi: 10.1126/science.1241934. Epub Sep. 26, 2013.

Meyer, The role of mRNA structure in bacterial translational regulation. Wiley Interdiscip Rev RNA. Jan. 2017;8(1). doi: 10.1002/wrna.1370. Epub Jun. 14, 2016.

Sauerwine et al., Kinetic Monte Carlo method applied to nucleic acid hairpin folding. Phys Rev E Stat Nonlin Soft Matter Phys. Dec. 2011;84(6 Pt 1):061912. doi: 10.1103/PhysRevE.84.061912. Epub Dec. 19, 2011.

Zuallaert et al., Interpretable convolutional neural networks for effective translation initiation site prediction. 2017 IEEE International Conference on Bioinformatics and Biomedicine (BIBM). 2017:1233-1237. doi: 10.1109/BIBM.2017.8217833.

Invitation to Pay Additional Fees mailed Aug. 27, 2021 for Application No. PCT/US2020/064695.

International Search Report and Written Opinion mailed Nov. 22, 2021 for Application No. PCT/US2020/064695.

International Preliminary Report on Patentability mailed Jun. 23, 2022 for Application No. PCT/US2020/064695.

Alley et al., Unified rational protein engineering with sequence-only deep representation learning. bioRxiv. Mar. 26, 2019. doi: 10.1101/589333. 52 pages.

Angenent-Mari et al., A deep learning approach to programmable RNA switches. Nat Commun. Oct. 7, 2020;11(1):5057. doi: 10.1038/s41467-020-18677-1.

Angermueller et al., Deep learning for computational biology. Mol Syst Biol. Jul. 29, 2016;12(7):878. doi: 10.15252/msb.20156651.

Aoki et al., Convolutional neural networks for classification of alignments of non-coding RNA sequences. Bioinformatics. Jul. 1, 2018;34(13):i237-i244. doi: 10.1093/bioinformatics/bty228.

Ausländer et al., Programmable single-cell mammalian biocomputers. Nature. Jul. 5, 2012;487(7405):123-7. doi: 10.1038/nature11149. Abstract only.

Babendure et al., Control of mammalian translation by mRNA structure near caps. RNA. May 2006;12(5):851-61. Epub Mar. 15, 2006.

Badelt et al., Thermodynamic and kinetic folding of riboswitches. Methods Enzymol. 2015;553:193-213. doi: 10.1016/bs.mie.2014.10.060. Epub Feb. 12, 2015.

Baek et al., LncRNAnet: long non-coding RNA identification using deep learning. Bioinformatics. Nov. 15, 2018;34(22):3889-3897. doi: 10.1093/bioinformatics/bty418.

Bailey et al., Dreme: motif discovery in transcription factor ChIP-seq data. Bioinformatics. Jun. 15, 2011;27(12):1653-9. doi: 10.1093/bioinformatics/btr261. Epub May 4, 2011.

Barrick et al., Quantitative analysis of ribosome binding sites in *E.coli*. Nucleic Acids Res. Apr. 11, 1994;22(7):1287-95.

Bashor et al., Using engineered scaffold interactions to reshape Map kinase pathway signaling dynamics. Science. Mar. 14, 2008;319(5869):1539-43. doi: 10.1126/science.1151153. Abstract only.

Bonnet et al., Amplifying genetic logic gates. Science. May 3, 2013;340(6132):599-603. doi: 10.1126/science.1232758. Epub Mar. 28, 2013. Abstract only.

Borujeni et al., Precise quantification of translation inhibition by mRNA structures that overlap with the ribosomal footprint in N-terminal coding sequences. Nucleic Acids Res. May 19, 2017;45(9):5437-5448. doi: 10.1093/nar/gkx061.

Borujeni et al., Translation Initiation is Controlled by RNA Folding Kinetics via a Ribosome Drafting Mechanism. J Am Chem Soc. Jun. 8, 2016;138(22):7016-23. doi: 10.1021/jacs.6b01453. Epub May 26, 2016.

Borujeni et al., Translation rate is controlled by coupled trade-offs between site accessibility, selective RNA unfolding and sliding at upstream standby sites. Nucleic Acids Res. Feb. 2014;42(4):2646-59. doi: 10.1093/nar/gkt1139. Epub Nov. 14, 2013.

Callura et al., Genetic switchboard for synthetic biology applications. Proc Natl Acad Sci U S A. Apr. 10, 2012;109(15):5850-5.

Camacho et al., Next-Generation Machine Learning for Biological Networks. Cell. Jun. 14, 2018;173(7):1581-1592. doi: 10.1016/j.cell.2018.05.015. Epub Jun. 7, 2018.

Cameron et al., A brief history of synthetic biology. Nat Rev Microbiol. May 2014;12(5):381-90. doi: 10.1038/nrmicro3239. Epub Apr. 1, 2014. Abstract only.

Canton et al., Refinement and standardization of synthetic biological parts and devices. Nat Biotechnol. Jul. 2008;26(7):787-93. doi: 10.1038/nbt1413. Abstract only.

Chuai et al., DeepCRISPR: optimized CRISPR guide RNA design by deep learning. Genome Biol. Jun. 26, 2018;19(1):80. doi: 10.1186/s13059-018-1459-4. 18 pages.

Culler et al., Reprogramming cellular behavior with RNA controllers responsive to endogenous proteins. Science. Nov. 26, 2010;330(6008):1251-5. doi: 10.1126/science.1192128.

Daniel et al., Synthetic analog computation in living cells. Nature. May 30, 2013;497(7451):619-23. doi: 10.1038/nature12148. Epub May 15, 2013. Abstract only.

(56) References Cited

OTHER PUBLICATIONS

Danino et al., A synchronized quorum of genetic clocks. Nature. Jan. 21, 2010;463(7279):326-30. doi: 10.1038/nature08753.

Delebecque et al., Organization of intracellular reactions with rationally designed RNA assemblies. Science. Jul. 22, 2011;333(6041):470-4. doi: 10.1126/science.1206938. Epub Jun. 23, 2011. Abstract only.

Dhawan et al., Pan-cancer characterisation of microRNA across cancer hallmarks reveals microRNA-mediated downregulation of tumour suppressors. Nat Commun. Dec. 7, 2018;9(1):5228. doi: 10.1038/s41467-018-07657-1.

Dirks et al., Paradigms for computational nucleic acid design. Nucleic Acids Res. Feb. 27, 2004;32(4):1392-403. doi: 10.1093/nar/gkh291.

Elowitz et al., A synthetic oscillatory network of transcriptional regulators. Nature. Jan. 20, 2000;403(6767):335-8. Abstract only.

Fiannaca et al., nRC: non-coding RNA Classifier based on structural features. BioData Min. Aug. 1, 2017;10:27. doi: 10.1186/s13040-017-0148-2.

Frosst et al., Distilling a Neural Network Into a Soft Decision Tree. Google Brain Team. arXiv Preprint. Nov. 27, 2017. arXiv:1711.09784v1 [cs.LG]. 8 pages.

Gardner et al., Construction of a genetic toggle switch in *Escherichia coli*. Nature. Jan. 20, 2000;403(6767):339-42. Abstract only.

Grabow et al., RNA modularity for synthetic biology. F1000Prime Rep. Nov. 1, 2013;5:46. doi: 10.12703/P5-46. eCollection 2013.

Green et al., Complex cellular logic computation using ribocomputing devices. Nature. Aug. 3, 2017;548(7665):117-121. doi: 10.1038/nature23271. Epub Jul. 26, 2017.

Green et al., Toehold switches: de-novo-designed regulators of gene expression. Cell. Nov. 6, 2014;159(4):925-39. doi: 10.1016/j.cell.2014.10.002. Epub Oct. 23, 2014.

Hunt et al., Ensembl variation resources. Database (Oxford). Jan. 1, 2018;2018:bay119. doi: 10.1093/database/bay119.

Isaacs et al., Engineered riboregulators enable post-transcriptional control of gene expression. Nat Biotechnol. Jul. 2004;22(7):841-7. Epub Jun. 20, 2004.

Isaacs et al., RNA synthetic biology. Nat Biotechnol. May 2006;24(5):545-54. doi: 10.1038/nbt1208.

Jäschke, Genetically encoded RNA photoswitches as tools for the control of gene expression. FEBS Lett. Jul. 16, 2012;586(15):2106-11. doi: 10.1016/j.febslet.2012.05.040. Epub May 31, 2012.

Jurtz et al., An introduction to deep learning on biological sequence data: examples and solutions. Bioinformatics. Nov. 15, 2017;33(22):3685-3690. doi: 10.1093/bioinformatics/btx531.

Khalil et al., A synthetic biology framework for programming eukaryotic transcription functions. Cell. Aug. 3, 2012;150(3):647-58.

Kim et al., Deep learning improves prediction of CRISPR-Cpf1 guide RNA activity. Nat Biotechnol. Mar. 2018;36(3):239-241. doi: 10.1038/nbt.4061. Epub Jan. 29, 2018.

Kim et al., De-Novo-Designed Translation-Repressing Riboregulators for Multi-Input Cellular Logic. Nat Chem Biol. Dec. 2019;15(12):1173-82. doi:10.1038/s41589-019-0388-1. Author Manuscript.

Kim et al., Modulating Responses of Toehold Switches by an Inhibitory Hairpin. ACS Synth Biol. Mar. 15, 2019;8(3):601-605. doi: 10.1021/acssynbio.8b00488. Epub Feb. 15, 2019.

Koo et al., Representation learning of genomic sequence motifs with convolutional neural networks. PLoS Comput Biol. Dec. 19, 2019;15(12):e1007560. doi: 10.1371/journal.pcbi.1007560.

Krishnamurthy et al., Tunable Riboregulator Switches for Post-transcriptional Control of Gene Expression. ACS Synth Biol. Dec. 18, 2015;4(12):1326-34. doi: 10.1021/acssynbio.5b00041. Epub Jul. 27, 2015. 31 pages.

Kudla et al., Coding-sequence determinants of gene expression in *Escherichia coli*. Science. Apr. 10, 2009;324(5924):255-8.

Lebars et al., LNA derivatives of a kissing aptamer targeted to the trans-activating responsive RNA element of HIV-1. Blood Cells, Molecules and Diseases. 2007;38:204-9.

Liu et al., An adaptor from translational to transcriptional control enables predictable assembly of complex regulation. Nat Methods. Nov. 2012;9(11):1088-94. doi: 10.1038/nmeth.2184. Epub Sep. 30, 2012. Abstract only.

Liu et al., Prediction of Long Non-Coding RNAs Based on Deep Learning. Genes (Basel). Apr. 3, 2019;10(4):273. doi: 10.3390/genes10040273.

Lorenz et al., ViennaRNA Package 2.0. Algorithms Mol Biol. Nov. 24, 2011;6:26. doi: 10.1186/1748-7188-6-26.

Lucks et al., Versatile RNA-sensing transcriptional regulators for engineering genetic networks. Proc Natl Acad Sci U S A. May 24, 2011;108(21):8617-22. doi: 10.1073/pnas.1015741108. Epub May 9, 2011.

Luo et al., Prediction of activity and specificity of CRISPR-Cpf1 using convolutional deep learning neural networks. BMC Bioinformatics. Jun. 13, 2019;20(1):332. doi: 10.1186/s12859-019-2939-6. 10 pages.

Ma et al., Low-cost detection of norovirus using paper-based cell-free systems and synbody-based viral enrichment. Synth Biol (Oxf). 2018;3(1):ysy018. doi: 10.1093/synbio/ysy018. Epub Sep. 19, 2018. 11 pages.

Matthews et al., Expanded sequence dependence of thermodynamic parameters improves prediction of RNA secondary structure. J Mol Biol. May 21, 1999;288(5):911-40. Abstract only.

Moon et al., Genetic programs constructed from layered logic gates in single cells. Nature. Nov. 8, 2012;491(7423):249-53.

Mutalik et al., Rationally designed families of orthogonal RNA regulators of translation. Nat Chem Biol. Mar. 25, 2012;8(5):447-54. doi: 10.1038/nchembio.919.

Narita et al., Cis-regulatory hairpin-shaped mRNA encoding a reporter protein: catalytic sensing of nucleic acid sequence at single nucleotide resolution. Nat Protoc. 2007:2(5):1105-16. Epub May 3, 2007.

Narita et al., Highly sensitive genotyping using artificial riboregulator system. Nucleic Acids Symp Ser No. 49. 2005;271-2.

Oberacker et al., Bio-On-Magnetic-Beads (BOMB): Open platform for high-throughput nucleic acid extraction and manipulation. PLoS Biol. Jan. 10, 2019;17(1):e3000107. doi: 10.1371/journal.pbio.3000107.

Pardee et al., Paper-based synthetic gene networks. Cell. Nov. 6, 2014;159(4):940-54 and Supplemental Info. doi: 10.1016/j.cell.2014.10.004. Epub Oct. 23, 2014. 22 pages.

Pardee et al., Rapid, Low-Cost Detection of Zika Virus Using Programmable Biomolecular Components. Cell. May 19, 2016;165(5):1255-1266 and Supplemental Info. doi: 10.1016/j.cell.2016.04.059. Epub May 6, 2016. 23 pages.

Qian et al., Neural network computation with DNA strand displacement cascades. Nature. Jul. 20, 2011;475(7356):368-72.

Qian et al., Scaling up digital circuit computation with DNA strand displacement cascades. Science. Jun. 3, 2011;332(6034):1196-201.

Reeve et al., Predicting translation initiation rates for designing synthetic biology. Front Bioeng Biotechnol. Jan. 20, 2014;2:1. doi: 10.3389/fbioe.2014.00001.

Rinaudo et al., A universal RNAi-based logic evaluator that operates in mammalian cells. Nat Biotechnol. Jul. 2007;25(7):795-801. Epub May 21, 2007.

Rodrigo et al., De novo automated design of small RNA circuits for engineering synthetic riboregulation in living cells. Proc Natl Acad Sci U S A. Sep. 18, 2012;109(38):15271-6. Epub Sep. 4, 2012.

Ruder et al., Synthetic biology moving into the clinic. Science. Sep. 2, 2011;333(6047):1248-52. doi: 10.1126/science.1206843. Abstract only.

Salis et al., Automated design of synthetic ribosome binding sites to control protein expression. Nat Biotechnol. Oct. 2009;27(10):946-50. doi: 10.1038/nbt.1568. Epub Oct. 4, 2009.

Sando et al., Doubly catalytic sensing of HIV-1-related CCR5 sequence in prokaryotic cell-free translation system using riboregulator-controlled luciferase activity. J Am Chem Soc. 2005;127:5300-1.

Simonyan et al., Deep Inside Convolutional Networks: Visualising Image Classification Models and Saliency Maps. Visual Geometry Group, University of Oxford. arXiv Preprint. 2013. arXiv:1312.6034v2 [cs.CV]. 8 pages.

(56) References Cited

OTHER PUBLICATIONS

Takahashi et al., A low-cost paper-based synthetic biology platform for analyzing gut microbiota and host biomarkers. Nat Commun. Aug. 21, 2018;9(1):3347. doi: 10.1038/s41467-018-05864-4.

Takahashi et al., A modular strategy for engineering orthogonal chimeric RNA transcription regulators. Nucleic Acids Res. Aug. 2013;41(15):7577-88.

Tamsir et al., Robust multicellular computing using genetically encoded NOR gates and chemical 'wires'. Nature. Jan. 13, 2011;469(7329):212-5. doi: 10.1038/nature09565. Epub Dec. 8, 2010.

To et al., A comprehensive web tool for toehold switch design. Bioinformatics. Aug. 15, 2018;34(16):2862-2864. doi: 10.1093/bioinformatics/bty216.

Vimberg et al., Translation initiation region sequence preferences in *Escherichia coli*. BMC Mol Biol. Oct. 31, 2007;8:100, 13 pages.

Wainberg et al., Deep learning in biomedicine. Nat Biotechnol. Oct. 2018;36(9):829-838. doi: 10.1038/nbt.4233. Epub Sep. 6, 2018.

Webb, Deep learning for biology. Nature. Feb. 2018;554(7693):555-557. doi: 10.1038/d41586-018-02174-z.

Win et al., Higher-order cellular information processing with synthetic RNA devices. Science. Oct. 17, 2008;322(5900):456-60. doi: 10.1126/science.1160311.

Xie et al., Multi-input RNAi-based logic circuit for identification of specific cancer cells. Science. Sep. 2, 2011;333(6047):1307-11. doi: 10.1126/science.1205527. Abstract only.

Yang et al., STAT3 overexpression promotes metastasis in intrahepatic cholangiocarcinoma and correlates negatively with surgical outcome. Oncotarget. Jan. 31, 2017;8(5):7710-7721. doi: 10.18632/oncotarget.13846.

Zadeh et al., Nucleic acid sequence design via efficient ensemble defect optimization. J Comput Chem. Feb. 2011;32(3):439-52. doi: 10.1002/jcc.21633. Epub Aug. 17, 2010. Abstract only.

Zadeh et al., Nupack: Analysis and design of nucleic acid systems. J Comput Chem. Jan. 15, 2011;32(1):170-3. doi: 10.1002/jcc.21596. Abstract only.

Zhang et al., Control of DNA strand displacement kinetics using toehold exchange. J Am Chem Soc. Dec. 2, 2009;131(47):17303-14. doi: 10.1021/ja906987s. Abstract only.

Zhang et al., Dynamic DNA nanotechnology using strand-displacement reactions. Nature Chemistry 3, 103-113 (2011) doi:10.1038/nchem.957. Abstract only.

Zhang et al., Titer: predicting translation initiation sites by deep learning. Bioinformatics. Jul. 15, 2017;33(14):1234-1242. doi: 10.1093/bioinformatics/btx247. 9 pages.

Zhang et el., Function of hexameric RNA in packaging of bacteriophage phi 29 DNA in vitro. Mol Cell. Jul. 1998;2(1):141-7.

Cambray et al., Evaluation of 244,000 synthetic sequences reveals design principles to optimize translation in *Escherichia coli*. Nat Biotechnol. Nov. 2018;36(10):1005-1015. doi: 10.1038/nbt.4238. Epub Sep. 24, 2018. With supplemental information.

Groher et al. Tuning the Performance of Synthetic Riboswitches using Machine Learning. ACS Synth Biol. Jan. 18, 2019;8(1):34-44. doi: 10.1021/acssynbio.8b00207. Epub Jan. 8, 2019.

Höllerer et al., Large-scale DNA-based phenotypic recording and deep learning enable highly accurate sequence-function mapping. Nat Commun. Jul. 15, 2020;11(1):3551. doi: 10.1038/s41467-020-17222-4.

Kelley et al., Basset: learning the regulatory code of the accessible genome with deep convolutional neural networks. Genome Res. Jul. 2016;26(7):990-9. doi: 10.1101/gr.200535.115. Epub May 3, 2016.

Kinney et al., Massively Parallel Assays and Quantitative Sequence-Function Relationships. Annu Rev Genomics Hum Genet. Aug. 31, 2019;20:99-127. doi: 10.1146/annurev-genom-083118-014845. Epub May 15, 2019.

Kinney et al., Using deep sequencing to characterize the biophysical mechanism of a transcriptional regulatory sequence. Proc Natl Acad Sci U S A. May 18, 2010;107(20):9158-63. doi: 10.1073/pnas.1004290107. Epub May 3, 2010.

Lehr et al., Cell-Free Prototyping of AND-Logic Gates Based on Heterogeneous RNA Activators. ACS Synth Biol. Sep. 20, 2019;8(9):2163-2173. doi: 10.1021/acssynbio.9b00238. Epub Aug. 27, 2019.

Peterman et al., Sort-seq under the hood: implications of design choices on large-scale characterization of sequence-function relations. BMC Genomics. Mar. 9, 2016:17:206. doi: 10.1186/s12864-016-2533-5.

Singh et al. RNA secondary structure prediction using an ensemble of twodimensional deep neural networks and transfer learning. Nat Commun. Nov. 27, 2019;10(1):5407. doi: 10.1038/s41467-019-13395-9.

Valeri et al., Sequence-to-function deep learning frameworks for engineered riboregulators. Nat Commun. Oct. 7, 2020;11(1):5058. doi: 10.1038/s41467-020-18676-2.

* cited by examiner $$R_i = \sum_j \frac{a_i w_{ij}^+}{\sum_i a_i w_{ij}^+} R_j$$

Representative Individual Toehold Switch Saliency Maps

Learned Feature Diversity

Full Toehold Library
Averaged MFE Structures

Full Toehold Library
Averaged Saliency Map (Learned features)

RIBOREGULATORS AND METHODS OF USE THEREOF

RELATED APPLICATIONS

This application is a national stage filing under 35 U.S.C. § 371 of International Patent Application Serial No. PCT/US2020/064695, filed Dec. 11, 2020, which claims the benefit under 35 U.S.C. § 119(e) of U.S. Provisional Application Ser. No. 62/948,175, filed Dec. 13, 2019, entitled "RIBOREGULATORS AND METHODS OF USE THEREOF", the entire contents of each of which are incorporated by reference herein.

FEDERALLY SPONSORED RESEARCH

This invention was made with U.S. Government support under DE-FG02-02ER63445 awarded by the U.S. Department of Energy and HDTRA1-14-1-0006 awarded by the Department of Defense/Defense Advanced Research Projects Agency. The Government has certain rights in the invention.

REFERENCE TO A SEQUENCE LISTING SUBMITTED AS A TEXT FILE VIA EFS-WEB

The instant application contains a Sequence Listing which has been submitted in ASCII format via EFS-Web and is hereby incorporated by reference in its entirety. Said ASCII copy, created on Jun. 10, 2022, is named H049870709US01-SEQ-MAT, and is 69,080,020 bytes in size.

BACKGROUND OF INVENTION

Engineered ribonucleic acid (RNA) molecules with targeted biological functions play an important role in synthetic biology (1), particularly as programmable response elements for small molecules, proteins, and nucleic acids. Examples include riboswitches, riboregulators, and ribozymes, many of which hold great promise for a variety of in vitro and in vivo applications (1, 2).

Toehold riboregulators are a class of versatile prokaryotic riboregulators inducible by the presence of a fully programmable trans-RNA trigger sequence (2-6, 15, 16). These RNA synthetic biology modules have displayed impressive dynamic range and orthogonality when used both in vivo as genetic circuit components (2, 5, 6), and in vitro as nucleic acid diagnostic tools using cell-free protein synthesis (CFPS) systems (3, 4, 15, 16).

SUMMARY OF INVENTION

This disclosure provides novel toehold riboregulators and uses thereof. The toehold riboregulators are specific for a particular viral nucleic acid or a particular human transcription factor nucleic acid. The toehold riboregulators may be used to detect the presence of and/or measure the level of such nucleic acids. The presence and/or level of such nucleic acids may be associated with a viral infection or another condition such as a cancer.

Thus, in one aspect, this disclosure provides a toehold riboregulator comprising (a) a nucleic acid sequence comprising any one of SEQ ID NOs: 1-244,000, or (b) nucleotides 21-103 of any one of SEQ ID NOs: 1-244,000, or (c) nucleotides 21-100 of any one of SEQ ID NOs: 1-244,000, or (d) RNA versions of (a), (b) or (c).

In a related aspect, this disclosure provides a toehold riboregulator comprising (a) a nucleic acid sequence comprising any one of SEQ ID Nos: 164989, 43841, 9602, 40182, 62866, 111698, 236638, and 19367, or (b) nucleotides 21-103 of any one of SEQ ID NOs: 164989, 43841, 9602, 40182, 62866, 111698, 236638, and 19367, or (c) nucleotides 21-100 of any one of SEQ ID NOs: 164989, 43841, 9602, 40182, 62866, 111698, 236638, and 19367, or (d) RNA versions of (a), (b) or (c).

In another related aspect, this disclosure provides a toehold riboregulator comprising (a) a nucleic acid sequence comprising any one of SEQ ID Nos: 43841, 9602, 62866, and 19367, or (b) nucleotides 21-103 of any one of SEQ ID NOs: 43841, 9602, 62866, and 19367, or (c) nucleotides 21-100 of any one of SEQ ID NOs: 43841, 9602, 62866, and 19367, or (d) RNA versions of (a), (b) or (c).

In another related aspect, this disclosure provides a toehold riboregulator comprising (a) a nucleic acid sequence comprising any one of SEQ ID Nos: 43841 and 62866, or (b) nucleotides 21-103 of any one of SEQ ID NOs: 43841 and 62866, or (c) nucleotides 21-100 of any one of SEQ ID NOs: 43841 and 62866, or (d) RNA versions of (a), (b) or (c).

Any one of these toehold riboregulators may be covalently attached (or conjugated or operably linked), at its 3' end, to a nucleic acid encoding a reporter protein or reporter RNA.

In some embodiments, as defined herein, the riboregulator is specific for a virus selected from the group consisting of astrovirus, cardiovirus, chikungunya virus, cosavirus, coxsackie virus, dengue virus, ebola virus, hantavirus, human immunodeficiency virus, human parvo virus, human rhino virus, influenza virus: h1n1, influenza virus: h3n2, lassa virus, leishmanial virus, Marburg virus, papilloma virus, poliovirus, rabies virus, smallpox virus, west nile virus, yellow fever virus, an zika virus.

In some embodiments, as defined herein, the riboregulator is specific for a virus selected from the group consisting of dengue virus, human rhino virus, or smallpox virus.

In some embodiments, as defined herein, the riboregulator is specific for dengue virus.

In some embodiments, as defined herein, the riboregulator is specific for human rhino virus.

In some embodiments, as defined herein, the riboregulator is specific for smallpox virus.

In some embodiments, as defined herein, the riboregulator is SEQ ID NO: 43841 and it is it used to detect smallpox virus.

In some embodiments, as defined herein, the riboregulator is SEQ ID NO: 9602 and it is it used to detect dengue virus.

In some embodiments, as defined herein, the riboregulator is SEQ ID NO: 62866 and it is it used to detect smallpox virus.

In some embodiments, as defined herein, the riboregulator is SEQ ID NO: 19367 and it is it used to detect human rhino virus.

The nucleotide sequence of SEQ ID NO: 43841 is
TAATACGACT CACTATAGGG CTTCCTTTTC GTTGATCTCT

CATAGATTTA AACAGAGGAG ATAAATCATG GAGAGATCAA

ACCTGGCGGC AGCGCAAAAG ATG.

The nucleotide sequence of SEQ ID NO: 9602 is
TAATACGACT CACTATAGGG GGGTCTCAGC CACTTCCTTC

TCTAACTTGA AACAGAGGAG ATCAAGTATG AGAAGGAAGA

ACCTGGCGGC AGCGCAAAAG ATG.

The nucleotide sequence of SEQ ID NO: 62866 is
TAATACGACT CACTATAGGG GTCAATACCT AACTCCAATT

TTCAGTGATT AACAGAGGAG AAATCACATG AAATTGGAGA

ACCTGGCGGC AGCGCAAAAG ATG.

The nucleotide sequence of SEQ ID NO: 19367 is
TAATACGACT CACTATAGGG TTCTTCTCCT ATCTTCTTCC

TTTATATGAC AACAGAGGAG AGTCATAATG AGGAAGAAGA

ACCTGGCGGC AGCGCAAAAG ATG.

In some embodiments, as defined herein, the riboregulator is specific for a human transcription factor selected from the group consisting of AC097634.4, ACTB, ACTL6A, ACTN4, AEBP1, AEBP2, AGO1, AGO2, AHR, AIRE, AKNA, AL121581.1, ALX1, ALX4, ANHX, AR, ARHGAP35, ARID3A, ARID3B, ARID3C, ARID4A, ARID4B, ARID5A, ARID5B, ARNT, ARNT2, ARNTL, ARNTL2, ARRB1, ARX, ASCL1, ASCL2, ASCL3, ASCL4, ASCL5, ASH2L, ATF1, ATF2, ATF3, ATF4, ATF5, ATF6, ATF6B, ATMIN, ATOH1, ATOH8, ATXN3, BACH1, BACH2, BARHL1, BARHL2, BARX1, BARX2, BASP1, BATF, BATF2, BATF3, BAZ2A, BCL11A, BCL11B, BCL6, BCL6B, BCOR, BHLHA15, BHLHE40, BHLHE41, BORCS8-MEF2B, BRCA1, BRD7, BRF2, CALCOCO1, CARF, CARM1, CBX4, CC2D1A, CC2D1B, CCAR1, CCNT1, CDC5L, CDK12, CDK13, CDK5RAP2, CDK9, CDX1, CDX2, CDX4, CEBPA, CEBPB, CEBPD, CEBPE, CEBPG, CEBPZ, CGGBP1, CHD2, CHD4, CHD7, CIART, CIITA, CITED1, CLOCK, CNBP, CREB1, CREB3, CREB3L1, CREB3L2, CREB3L3, CREB3L4, CREBBP, CREBRF, CREM, CRX, CRY1, CRY2, CT476828.9, CTCF, CTCFL, CUX1, CUX2, CXXC1, DACH1, DBP, DDIT3, DDN, DEAF1, DHX36, DHX9, DLX1, DLX2, DLX4, DLX5, DMBX1, DMRT1, DMRT2, DNMT3A, DPF2, DR1, DRAP1, DUX4, E2F1, E2F2, E2F3, E2F4, E2F6, E2F7, E2F8, E4F1, EAF2, EBF2, EBF3, EBF4, EED, EGR1, EGR2, EGR3, EGR4, EHF, EHMT2, ELF1, ELF3, ELF4, ELF5, ELK1, ELK3, ELK4, ELL3, ELMSAN1, EN1, ENO1, EOMES, EP300, ERBB4, ERG, ESR1, ESR2, ESRRA, ESRRB, ESRRG, ESX1, ETS1, ETS2, ETV1, ETV2, ETV3, ETV4, ETV5, ETV6, ETV7, EZH2, FERD3L, FEZF1, FEZF2, FIGLA, FLI1, FOS, FOSB, FOSL1, FOSL2, FOXA1, FOXA2, FOXA3, FOXC1, FOXC2, FOXD1, FOXD3, FOXF1, FOXF2, FOXH1, FOXI1, FOXJ1, FOXJ2, FOXK1, FOXK2, FOXL2, FOXM1, FOXN4, FOXO3, FOXP2, FOXP3, FOXQ1, FOXS1, FUBP3, GABPA, GABPB1, GABPB2, GADD45A, GATA1, GATA2, GATA3, GATA4, GATA5, GATA6, GATAD2B, GBX2, GCFC2, GCM1, GFI1, GLI1, GLI2, GLI3, GLIS1, GLIS2, GLMP, GMEB1, GMEB2, GRHL1, GRHL2, GSC, GSX1, GTF2B, GTF3C1, GZF1, H2AFY, H2AFY2, H2AFZ, H3F3A, H3F3B, HAND1, HAND2, HDAC1, HDAC2, HDAC4, HDAC5, HDAC6, HELT, HES1, HES2, HES3, HES4, HES5, HES6, HES7, HESX1, HEY1, HEY2, HEYL, HHEX, HIC2, HIF1A, HINFP, HIVEP1, HLF, HLTF, HMGA1, HMGA2, HMGB1, HMGB2, HMX1, HMX3, HNF1A, HNF1B, HNF4A, HNF4G, HNRNPC, HNRNPK, HNRNPL, HNRNPU, HOXA10, HOXA2, HOXA3, HOXA4, HOXA5, HOXA6, HOXA7, HOXA9, HOXB1, HOXB2, HOXB3, HOXB4, HOXB5, HOXB6, HOXB7, HOXB9, HOXC10, HOXC11, HOXC4, HOXC5, HOXC6, HOXD10, HOXD13, HOXD3, HOXD4, HOXD8, HOXD9, HR, HSF1, HSF2, HSF4, HSF5, HSFX1, HSFX2, HSFX3, HSFX4, HSFY1, HSFY2, IER2, IFI16, IKZF1, IKZF2, IKZF3, IKZF4, IKZF5, INSM1, IRF1, IRF2, IRF2BP1, IRF2BP2, IRF2BPL, IRF3, IRF4, IRF5, IRF6, IRF7, IRF8, IRF9, ISL1, JARID2, JDP2, JMJD1C, JUN, JUNB, JUND, KAT2B, KAT7, KCNIP3, KDM1A, KDM2B, KDM3A, KDM3B, KDM5A, KDM6A, KDM6B, KLF1, KLF10, KLF11, KLF12, KLF13, KLF15, KLF16, KLF17, KLF3, KLF4, KLF5, KLF6, KLF7, KLF8, KMT2A, KMT2D, LDB1, LEF1, LHX2, LHX3, LITAF, LMO2, LMO4, LMX1A, LMX1B, LONP1, LRRFIP1, LYL1, MACC1, MAF, MAF1, MAFA, MAFB, MAFF, MAFG, MAFK, MAX, MAZ, MBD2, MBD3, MED1, MED12, MED8, MEF2A, MEF2B, MEF2C, MEF2D, MEIS1, MEIS2, MEN1, MEOX1, MEOX2, MESP1, MESP2, MITF, MIXL1, MLX, MLXIP, MLXIPL, MMP12, MNT, MRTFA, MSC, MSGN1, MSX1, MSX2, MTA1, MTA2, MTERF3, MTF1, MTF2, MTOR, MUC1, MXD1, MXD3, MXI1, MYB, MYBBP1A, MYBL1, MYBL2, MYC, MYCN, MYEF2, MYF5, MYF6, MYOCD, MYOD1, MYOG, MYPOP, MYT1, MYT1L, MZF1, NACC2, NANOG, NCOA2, NCOR1, NCOR2, NDN, NEUROD1, NEUROD2, NEUROD6, NEUROG1, NEU-ROG2, NEUROG3, NFAT5, NFATC1, NFATC2, NFATC3, NFATC4, NFE2, NFE2L1, NFE2L2, NFE2L3, NFIA, NFIB, NFIC, NFIL3, NFKB1, NFKB2, NFX1, NFXL1, NFYA, NFYB, NFYC, NHLH1, NHLH2, NKRF, NKX2-1, NKX2-2, NKX2-5, NKX2-6, NKX2-8, NKX3-1, NKX3-2, NKX6-1, NKX6-2, NLRC5, NME1, NONO, NOTCH1, NPAS2, NPAS4, NPM1, NR1D1, NR1D2, NR1H2, NR1H3, NR1H4, NR1I2, NR1I3, NR2C1, NR2C2, NR2E3, NR2F1, NR2F6, NR3C1, NR4A1, NR4A2, NR4A3, NR5A1, NR5A2, NR6A1, NRF1, NRIP1, NRL, NSD1, ONECUT2, ONECUT3, OSR1, OSR2, OTX1, OTX2, OVOL1, PARP1, PATZ1, PAX1, PAX2, PAX4, PAX5, PAX6, PAX8, PAX9, PAXBP1, PBX1, PBX2, PBX3, PCGF3, PCGF5, PCGF6, PDX1, PER1, PER2, PER3, PGR, PHB, PHOX2A, PHOX2B, PIH1D1, PITX1, PITX2, PITX3, PKNOX2, PLAG1, PLAGL1, POLRMT, POU1F1, POU2AF1, POU2F1, POU2F2, POU2F3, POU3F2, POU3F4, POU4F1, POU4F2, POU4F3, POU5F1, POU6F1, PPARA, PPARD, PPARG, PRDM1, PRDM11, PRDM12, PRDM13, PRDM14, PRDM15, PRDM2, PRDM4, PRDM5, PRDM6, PRDM7, PRDM9, PRDX5, PRKN, PRMT5, PROP1, PROX1, PRRX1, PSPC1, PTF1A, PURA, PURB, PURG, RAI1, RARA, RARB, RARG, RAX, RAX2, RB1, RBBP4, RBBP5, RBL1, RBL2, RBMX, RBPJ, RBPJL, RCOR1, RCOR2, RCOR3, REL, RELA, RELB, REST, RFX1, RFX2, RFX3, RFX4, RFX5, RFX6, RFX7, RFX8, RNF10, RORA, RORB, RORC, RPS3, RPTOR, RREB1, RRN3, RUNX1, RUNX2, RUNX3, RUVBL2, RXRA, RXRB, SAFB, SALL1, SALL2, SARS, SATB1, SATB2, SCRT1, SCRT2, SCX, SETX, SFPQ, SIN3A, SIRT1, SIX1, SIX2, SIX3, SIX4, SIX5, SIX6, SKIL, SMAD1, SMAD2, SMAD3, SMAD4, SMAD5, SMAD6, SMAD7, SMARCA2, SMARCA4, SMARCB1, SMARCC1, SMARCC2, SMARCD2, SMARCE1, SMYD3, SNAI1, SNAI2, SNAI3, SNCA, SOX1, SOX10, SOX11, SOX12, SOX13, SOX17, SOX18, SOX2, SOX21, SOX3, SOX4, SOX6, SOX7, SOX8, SOX9, SP1, SP2, SP3, SP5, SP7, SPI1, SPIB, SPIC, SREBF1, SREBF2, SRF, SSBP2, SSBP3, SSBP4, ST18, STAT1, STAT3, STAT5B, STAT6, STOX1, SUV39H1, SUV39H2, SUZ12, TAF1, TAF1B, TAF1C, TAF2, TAF5, TAF7, TAF7L, TAF9, TAF9B, TAL1, TAL2, TBL1X, TBL1XR1, TBP, TBPL1, TBPL2, TBR1, TBX15, TBX18, TBX19, TBX2, TBX20, TBX21, TBX22, TBX3, TBX5, TBX6, TBXT, TCF12, TCF15, TCF20, TCF21, TCF3, TCF4, TCF7, TCF7L1, TCF7L2, TCFL5, TEAD1, TEAD2, TEAD3, TEAD4, TEF, TFAM, TFAP2A, TFAP2B, TFAP2C, TFAP2D, TFAP2E, TFAP4, TFCP2, TFCP2L1, TFDP1, TFDP2, TFE3, TFEB, TFEC, TGIF1, THAP1, THAP11, THRA, THRAP3, THRB, TIPARP, TLX1, TNF, TOP1, TOX2, TOX3, TP53, TP63, TP73, TRERF1, TRIM24, TRPS1, TWIST1, TXK, UBTF, UHRF1, USP3, UTY, VAX1, VAX2, VDR, VEZF1, WBP2, WNT1, WNT11, WNT5A, WT1, XBP1, XRCC5, XRCC6, XRN2, YAP1, YBX1, YBX3, YY1, YY2, ZBED1, ZBTB14, ZBTB16, ZBTB17, ZBTB2, ZBTB20, ZBTB24, ZBTB4, ZBTB48, ZBTB5, ZBTB7A, ZBTB7B, ZC3H4, ZC3H6, ZC3H8, ZEB1, ZFHX2, ZFHX3, ZFHX4, ZFP42, ZFPM1, ZGPAT, ZHX3, ZIC1, ZIC2, ZIC3, ZIC4, ZIC5, ZKSCAN3, ZNF131, ZNF143, ZNF148, ZNF174, ZNF175, ZNF202, ZNF205, ZNF217, ZNF219, ZNF239, ZNF277, ZNF281, ZNF322, ZNF335, ZNF350, ZNF395, ZNF431, ZNF497, ZNF501, ZNF513, ZNF516, ZNF536, ZNF541, ZNF564, ZNF568, ZNF589, ZNF605, ZNF613, ZNF639, ZNF649, ZNF658, ZNF668, ZNF691, ZNF692, ZNF704, ZNF709, ZNF711, ZNF740, ZNF746, ZNF750, ZNF821, ZNF835, ZNF93, and ZSCAN21.

In some embodiments, as defined herein, the riboregulator is specific for a human transcription factor selected from the group consisting of NCOR1, E2F3 and ZNF175.

In some embodiments, as defined herein, the riboregulator is SEQ ID NO: 164989 and it is used to detect human transcription factor NCOR1.

In some embodiments, as defined herein, the riboregulator is SEQ ID NO: 111698 and it is used to detect human transcription factor E2F3.

In some embodiments, as defined herein, the riboregulator is SEQ ID NO: 236638 and it is used to detect human transcription factor ZNF175.

```
The nucleotide sequence of SEQ ID NO: 164989 is
TAATACGACT CACTATAGGG CCCTTTGTTT TCTTGCATGA

TTTCTTCTTT AACAGAGGAG AAAAGAAATG ATCATGCAAA

ACCTGGCGGC AGCGCAAAAG ATG.

The nucleotide sequence of SEQ ID NO: 111698 is
TAATACGACT CACTATAGGG TATCTTGATA TGTAACATAA

GCTAACCTTT AACAGAGGAG AAAAGGTATG CTTATGTTAA

ACCTGGCGGC AGCGCAAAAG ATG.

The nucleotide sequence of SEQ ID NO: 236638 is
TAATACGACT CACTATAGGG TGGAACACCA TGAACCATCT

CTTGTGAACT AACAGAGGAG AAGTTCAATG GAGATGGTTA

ACCTGGCGGC AGCGCAAAAG ATG.
```

In some embodiments, the riboregulator is specific for the human transcription factor STAT3.

In another aspect, this disclosure provides a method comprising contacting a sample with any of the foregoing toehold riboregulator conjugated to a reporter domain under conditions sufficient to allow the toehold riboregulator to hybridize to its respective trigger nucleic acid, and detecting and optionally measuring expression of the reporter domain product (e.g., reporter protein or reporter RNA). Detection of the trigger nucleic acid may indicate that the subject from whom the sample was derived has an infection of one of the foregoing viruses or has been exposed to such virus(es) or has a cancer associated with upregulated expression of one of the foregoing transcription factors.

In some embodiments, the sample is obtained from a human subject.

In some embodiments, the subject is suspected of having cancer.

In some embodiments, the subject is suspected of having an infection of one of the foregoing viruses.

In some embodiments, the subject is suspected of having a smallpox virus infection, a dengue virus infection, or a human rhino virus infection.

In some embodiments, the subject is suspected of having a smallpox virus infection.

In some embodiments, the subject is suspected of having a dengue virus infection.

In some embodiments, the subject is suspected of having a human rhino virus infection.

In some embodiments, the subject is suspected of having been exposed to smallpox virus, dengue virus, or human rhino virus.

In some embodiments, the subject is suspected of having been exposed to smallpox virus.

In some embodiments, the subject is suspected of having been exposed to dengue virus.

In some embodiments, the subject is suspected of having been exposed to human rhino virus.

In another aspect, this disclosure provides a method of treating a subject, comprising administering an effective amount of an anti-viral agent to a subject having a viral infection, wherein the subject is identified as having a viral infection by detecting viral mRNA in a sample from the subject using any of the foregoing viral-specific toehold riboregulators.

In another aspect, this disclosure provides a method of treating a subject, comprising administering an effective amount of an anti-cancer agent to a subject having a cancer, wherein the subject is identified as having a cancer by detecting increased mRNA expression of a human transcription factor in a sample from the subject using any of the foregoing transcription-factor specific toehold riboregulators.

A related aspect of this disclosure provides a toehold riboregulator having
    (a) a nucleic acid sequence comprising any one of SEQ ID NOs: 43841, 9602, 62866, 19367, 164989, 111698, and 236638, or
    (b) nucleotides 21-103 of any one of SEQ ID NOs: 43841, 9602, 62866, 19367, 164989, 111698, and 236638, or
    (c) nucleotides 21-100 of any one of SEQ ID NOs: 43841, 9602, 62866, 19367, 164989, 111698, and 236638, or
    (d) RNA versions of (a), (b) or (c).

In some embodiments, the toehold riboregulator is covalently attached, at its 3' end, to a nucleic acid encoding a reporter protein or reporter RNA.

In some embodiments, the toehold riboregulator is specific for dengue virus, human rhino virus, or smallpox virus.

In some embodiments, the toehold riboregulator is specific for a human mRNA encoding a transcription factor selected from E2F3, NCOR1, or ZNF175.

In some embodiments, the toehold riboregulator comprises a nucleotide sequence of any one of SEQ ID NOs: 43841, 9602, 62866, and 19367. In some embodiments, the toehold riboregulator comprises a nucleotide sequence of SEQ ID NO: 43841. In some embodiments, the toehold riboregulator comprises a nucleotide sequence of SEQ ID NO: 9602. In some embodiments, the toehold riboregulator comprises a nucleotide sequence of SEQ ID NO: 62866. In some embodiments, the toehold riboregulator comprises a nucleotide sequence of SEQ ID NO: 19367. In some embodiments, the toehold riboregulator is a plurality of toehold riboregulators comprising a toehold riboregulator comprising a nucleotide sequence of SEQ ID NO: 43841 and a toehold riboregulator comprising a nucleotide sequence of SEQ ID NO: 62866.

Another related aspect of this disclosure provides a method comprising contacting a sample with any one or more of the foregoing toehold riboregulators, covalently attached, at its 3' end, to a nucleic acid encoding a reporter protein or reporter RNA, under conditions sufficient to allow the toehold riboregulator to hybridize to its respective trigger nucleic acid, and detecting and optionally measuring expression of the reporter protein or reporter RNA.

In some embodiments, the sample is obtained from a human subject. In some embodiments, the subject is suspected of having cancer. In some embodiments, the subject is suspected of having a viral infection. In some embodiments, the subject is suspected of having come into contact with a virus, such as smallpox virus, dengue virus, or human rhino virus.

In some embodiments, the toehold riboregulator comprises a nucleotide sequence of any one of SEQ ID NOs: 43841, 9602, 62866, and 19367.

In some embodiments, the toehold riboregulator comprises a nucleotide sequence of SEQ ID NO: 43841. In some embodiments, the toehold riboregulator comprises a nucleotide sequence of SEQ ID NO: 9602. In some embodiments, the toehold riboregulator comprises a nucleotide sequence of SEQ ID NO: 62866. In some embodiments, the toehold riboregulator comprises a nucleotide sequence of SEQ ID NO: 19367. In some embodiments, the toehold riboregulator comprises a toehold riboregulator comprising a nucleotide sequence of SEQ ID NO: 43841 and a toehold riboregulator comprising a nucleotide sequence of SEQ ID NO: 62866.

In some embodiments, the subject is suspected of having a smallpox virus infection or having been exposed to smallpox virus. In some embodiments, the subject is suspected of having dengue virus infection or having been exposed to dengue virus. In some embodiments, the subject is suspect of having human rhino virus infection or having been exposed to human rhino virus.

In some embodiments, the sample has been treated to amplify RNA prior to contact with the riboregulator. In some embodiments, the sample has been treated to amplify RNA isothermally prior to contact with the riboregulator.

Another related aspect of this disclosure provides a method of treating a subject, comprising administering an effective amount of an anti-viral agent to a subject having a viral infection, wherein the subject is identified as having a viral infection or as having been exposed to a virus by detecting viral mRNA in a sample from the subject using one or more of the foregoing toehold riboregulators, including for example a toehold riboregulator comprising a nucleotide sequence of any one of SEQ ID NOs: 43841, 9602, 62866, and 19367.

Another related aspect of this disclosure provides a method of treating a subject, comprising administering an effective amount of an anti-cancer agent to a subject having a cancer, wherein the subject is identified as having a cancer by detecting increased mRNA expression of a human transcription factor in a sample from the subject using a toehold riboregulator, including for example a toehold riboregulator comprising a nucleotide sequence of any one of SEQ ID NOs: 164989, 111698, and 236638.

Another related aspect of this disclosure provides a system for assisted design of RNA-based synthetic biology components comprising at least one pre-processing stage dedicated to transform input nucleic acid sequences into a multi-dimensional representation, at least one machine learning architecture trained and optimized for classification and/or regression of said pre-processed sequences to predict at least one experimentally measured performance metric, and at least one output representing the attention and/or saliency mechanisms exhibited by at least one of the said machine learning architectures to inform further design of RNA-based synthetic biology components.

Another related aspect of this disclosure provides a method for assisted design of RNA-based synthetic biology components comprising generating pre-processed sequences comprising transforming input nucleic acid sequences into a multi-dimensional representation, training and optimizing at least one machine learning architecture for classification and/or regression of said pre-processed sequences to predict at least one experimentally measured performance metric, and generating at least one output representing the attention and/or saliency mechanisms exhibited by at least one of the said machine learning architectures to inform further design of RNA-based synthetic biology components.

These and other aspects and embodiments will be described in greater detail herein.

Figure 1:
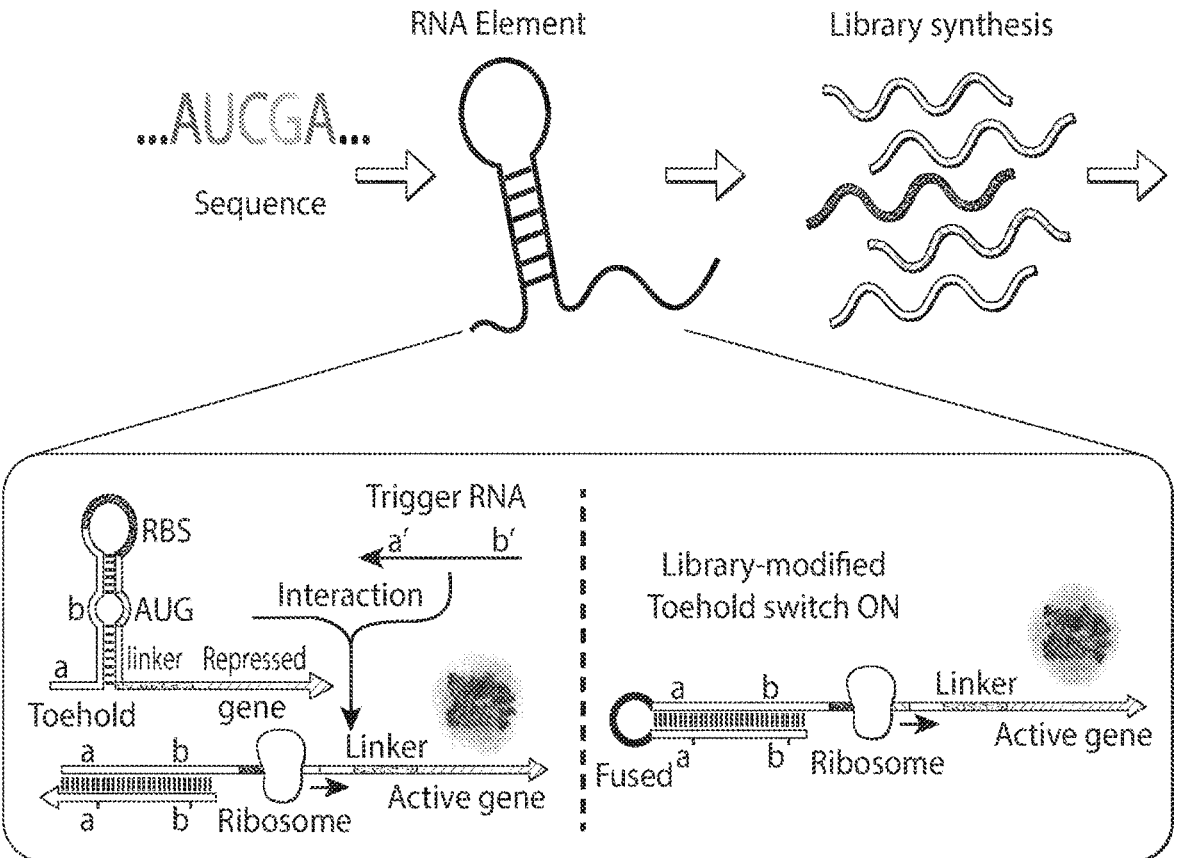
FIG. 1. Deep learning for RNA synthetic biology pipeline. RNA tool selection is followed by library synthesis and characterization with analysis using deep neural networks (DNN) to provide functionality predictions and design insight. We used a high-throughput toehold switch library as a canonical model for the general investigation of RNA synthetic biology tools. The original toehold switch architecture from Green et al. (2) was used, containing a 12-nucleotide (nt) toehold (a/a') and an 18-nt stem (b/b') fully unwound by the trigger (left-bottom). We selected to fuse the RNA trigger to the 5' end of the switch by an unstructured linker to facilitate library synthesis. Then, a flow-sequence (seq) pipeline was used to characterize the fluorescence signal of individual toehold switches in a pooled sequential assay, including pooled induction, FACS sorting, next-generation sequencing (NGS) and count frequency analysis. Finally, various DNN architectures were used to predict data outputs, while features contributing to DNN predictions were intuitively visualized to elucidate biological insights.
Figure 1:
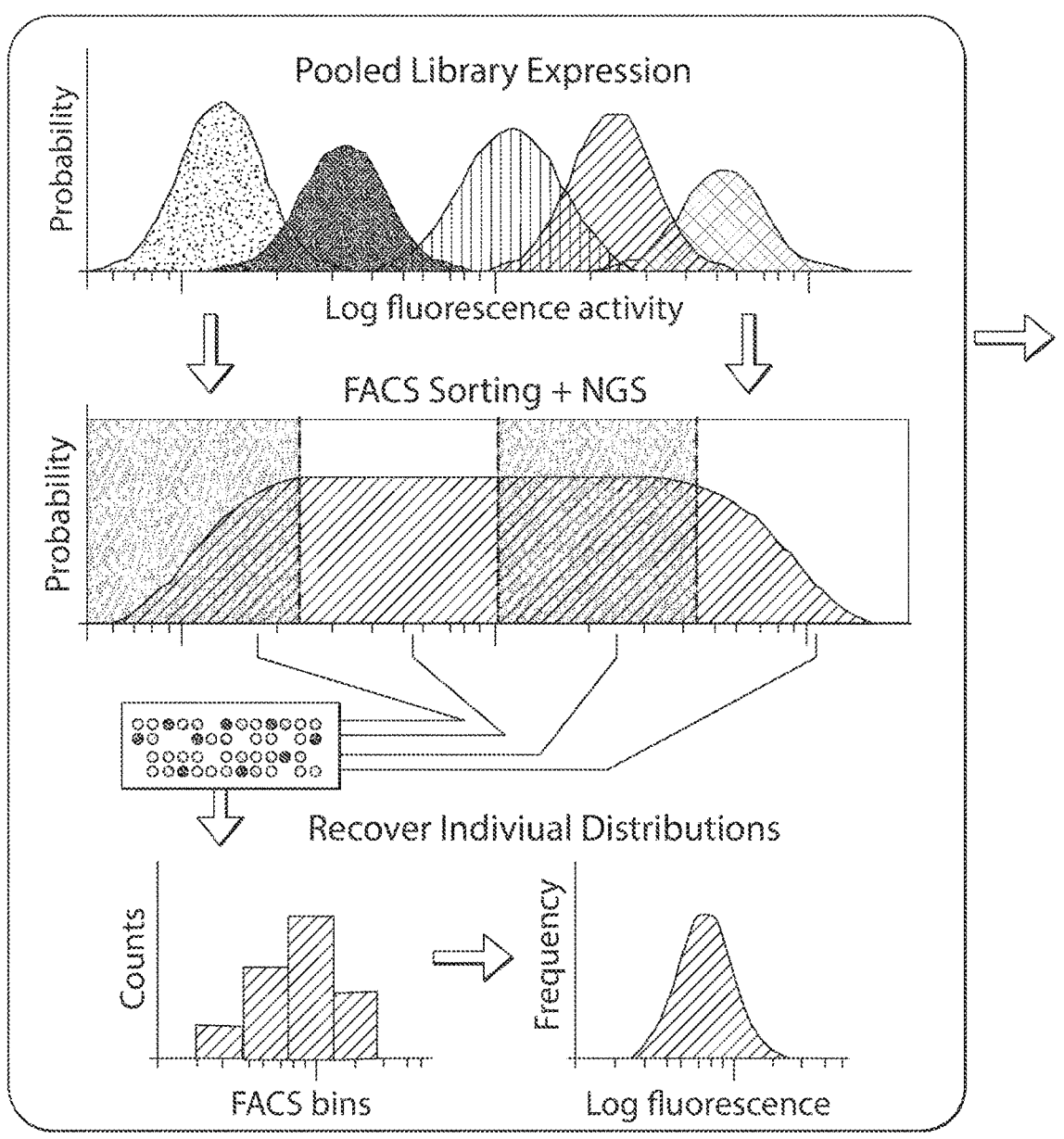
Figure 1:
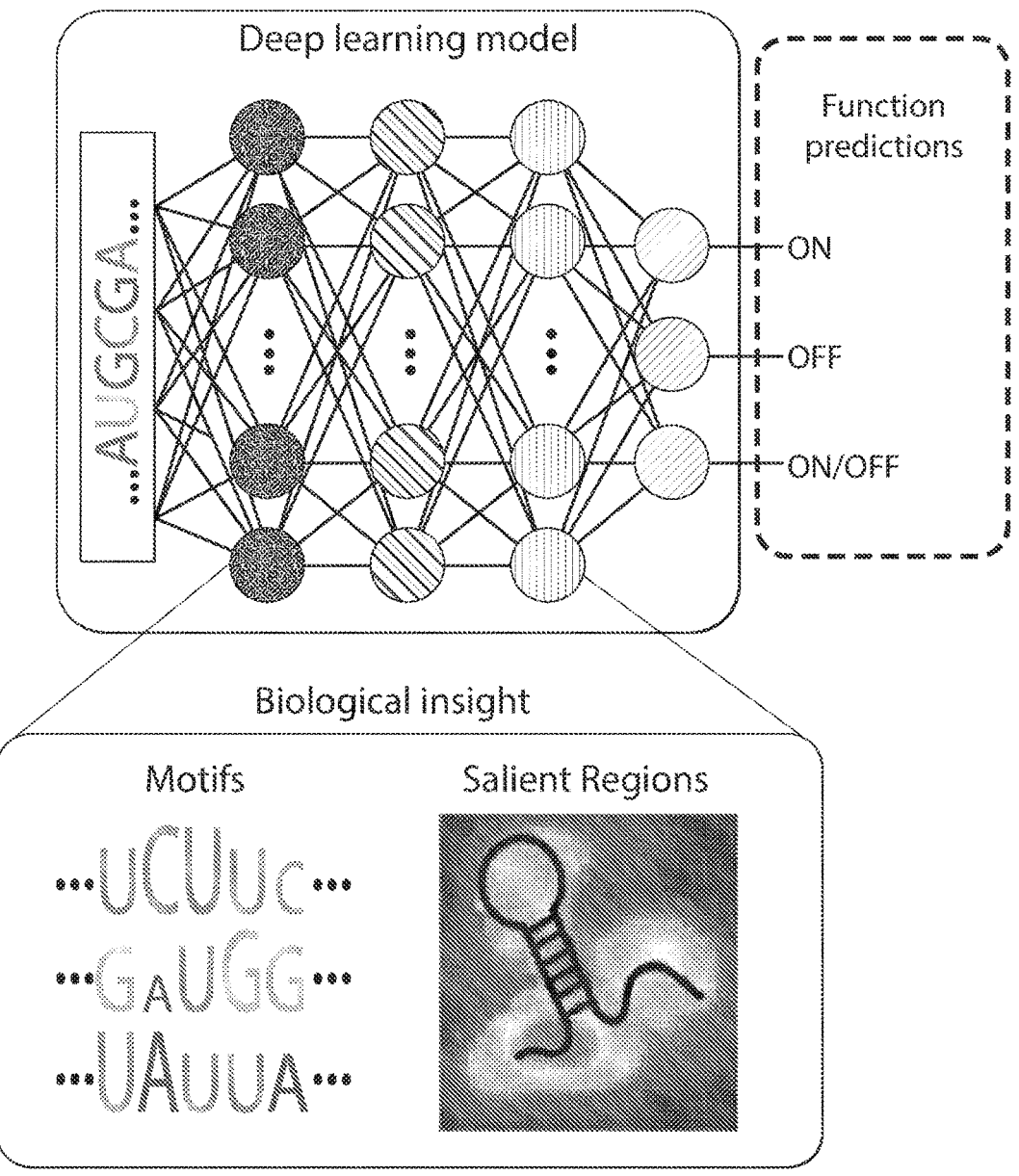

(E) Tested switch/trigger variants from each origin category, including randomly generated sequences, 906 human transcription factor transcripts, and 23 pathogenic viral genomes. (F) Experimental ON/OFF ratios for all triggers tiled across the transcripts of two clinically relevant human transcription factors (stat3 and kmt2a) upregulated in cancerous phenotypes (42, 43), as well as all triggers tiled across the genomes of two pathogenic viruses: West Nile Virus (WNV) and Human Immunodeficiency Virus (HIV). GFP=Green Fluorescent Protein; Seq=Sequence; HPV=Human Papillomavirus.

FIGS. 3A-G. Analysis of toehold switch performance using sequence k-mers, rational thermodynamic features, and sequence-based multilayer perceptron (MLP) models. (A) Sequence logos for k-mer motifs discovered to be disproportionately represented in weakly induced switches (low ON) and leaky switches (high OFF), functional proportions, and E-values. (B) The Pearson correlation (left, |max|=0.4) and $R^2$ metric (right, |max|=0.16) for thirty state-of-the-art thermodynamic features and obtained RBS Calculator v2.1 outputs. (C) Base architecture of investigated MLP models, featuring three fully connected layers. For training in regression-mode, three different outputs were predicted (ON, OFF, ON/OFF), whereas for classification training only a single binary output based on ON/OFF (threshold at 0.7) was predicted. (D) Box and whisker plots for $R^2$ between experimental and regression-based predictions for best performing rational features, logistic regression models and MLPs. (E) Minimum absolute error (MAE) between experimental and predicted values for these same models. (F) Box and whisker plots for area under the curve (AUC) of the receiver-operator curve (ROC) and the precision-recall curve (P-R) in classification-mode predictions compared to experimental values. In both regression and classification, the one-hot encoded sequence MLP delivered top-in-class performance without using pre-computed thermodynamic or kinetic metrics. (G) ROC curves of pre-trained MLP classification models validated with an unseen 168-sequence external dataset from Green et al. (2).

FIGS. 4A-D. Evaluation of neural network architectures with increased capacity. Performance metrics for convolutional neural networks (CNN) and long short-term memory (LSTM) networks trained on one-hot encoded toehold sequences, as well as a CNN trained on a two-dimensional, one-hot encoded sequence complementarity map. All models are compared to the previously reported MLPs trained on the 30 pre-calculated thermodynamic features and one-hot toehold sequences. For regression-based predictions (A) shows box and whisker plots for $R^2$ metric, while (B) shows MAE for all models. In the case of classification-based predictions (C) shows box and whisker plots of the area under the curve (AUC) of the receiver-operator curve (ROC) and the precision-recall curve (P-R) for all tested models. In both regression and classification, the one-hot encoded sequence MLP delivered top-in-class performance as compared to higher capacity deep learning models. (D) ROC curves of pre-trained higher-capacity classification models validated with an unseen 168-sequence external dataset from Green et al. (2). In A-C, for each group of 5 boxes, the first box represents MLP—All Rational Feat., the second box represents MLP—OneHot Seq., the third box represents CNN—OneHot Seq., the fourth box represents LSTM—OneHot Seq., and the fifth box represents CNN—2D Comp. Map.

FIGS. 5A-F. VIS4Map: Visualizing secondary structure features using saliency maps of a sequence-based complementarity matrix input. (A) A simplified schematic of the CNN-based architecture used to generate toehold functional predictions with network attention visualizations. The system receives a one-hot encoded, two-dimensional (2D) sequence complementarity map as input, followed by three 2D convolutional/max-pooling layers, a flattening step, and finally a set of dense layers. After output generation (e.g., OFF), a gradient-weighted activation mapping is performed to visualize activation maximization regions responsible for delivered predictions (VIS4Map). (B) Histograms of the percentage overlap between VIS4Maps generated from a CNN pre-trained to predict minimum free energy (MFE) using 120-nt RNA sequences and MFE maps generated by NUPACK. When analyzed using 500 random test set sequences, the distributions of correctly matched and randomly assigned maps are distinct with increased percentage overlap from matched samples as compared to unmatched. (C) Examples of saliency VIS4Maps compared with their corresponding MFE structures as predicted by NUPACK for three randomly selected 60-nt RNA sequences. See FIG. 16A for additional examples with 120-nt RNA sequences. (D) Four representative VIS4Map examples of randomly selected 118-nt RNA toehold switch sequences from an OFF-predictive CNN model. (E) Averaged VIS4Maps of 10,125 randomly selected toehold switch RNA sequences from our library test-set processed with our OFF-predicting CNN model (left) and compared their corresponding averaged MFE maps obtained using NUPACK (right). (F) Averaged VIS4Maps of the 10% most accurately predicted switches sorted by quartile from lowest OFF (tight) to highest OFF (leaky), inset at the hairpin stem, and toehold region of the switch. After contrast enhancement of averaged VIS4Maps to visualize sparsely distributed secondary structures, a noticeable increase in structures outside of the prominent equilibrium-designed switch hairpin structure appears, corresponding to increased toehold leakiness. A toehold switch schematic (right) is shown to denote how incorrectly folded and potentially weaker kinetically stable intermediate structures might compete with the correctly folded structure that is designed to be reached at equilibrium.

Figure 6A:
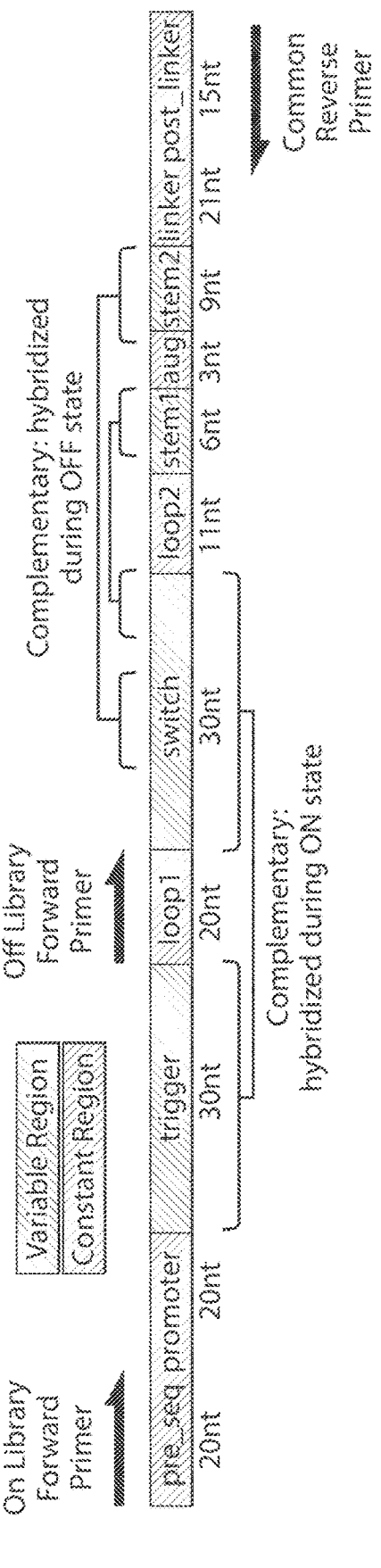
Figure 6B:
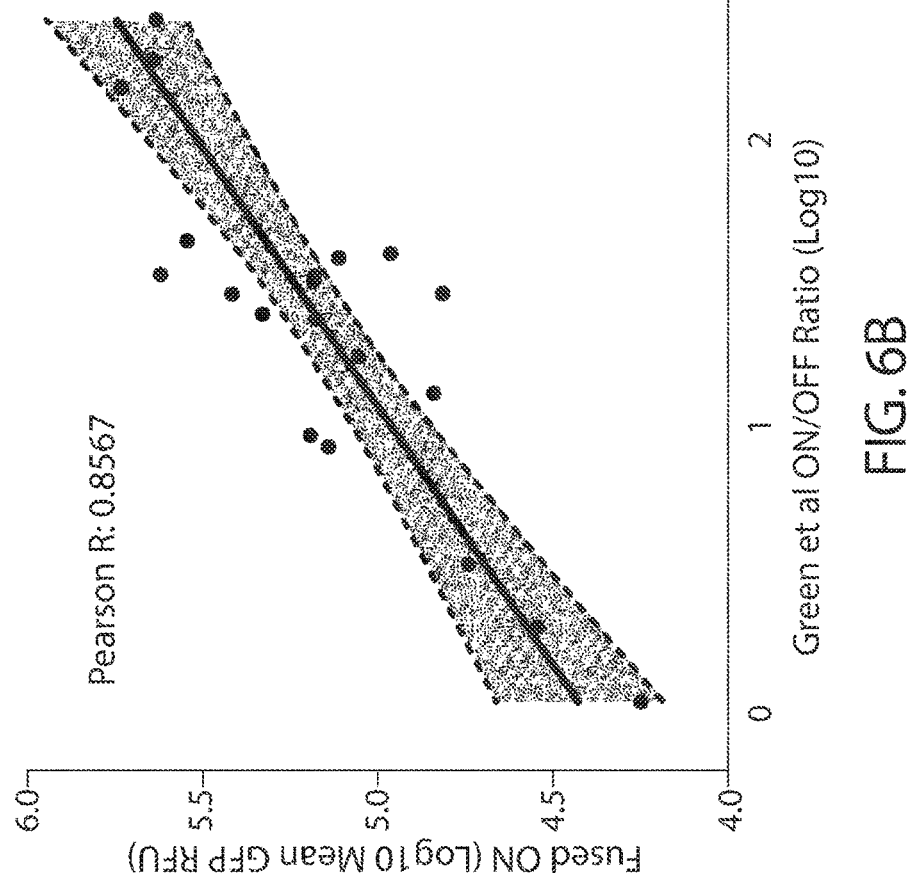

FIGS. 6A-B. Design and validation of oligomer library. Individual toehold switch constructs within the library were synthesized from a pool of oligomers, and a representative panel of constructs was verified against a previously published dataset. (A) Schematic of the pooled library oligo used for the synthesis of our high-throughput toehold switch library. Distinct toehold construct regions include: pre_seq (plasmid backbone sequence) (e.g., SEQ ID NO: 244020), promoter (T7 promoter including GGG) (e.g., SEQ ID NO: 244021), trigger (toehold-unique), switch (complete toehold and ascending stem), loop1 (region linking trigger to switch) (e.g., SEQ ID NO: 244022), loop2 (main toehold switch hairpin loop containing the RBS) (e.g., SEQ ID NO: 244023), stem1 (top half of descending stem), atg (start codon), stem2 (bottom half of descending stem), linker (21 nt sequence of unstructured amino acids) (e.g., SEQ ID NO: 244024) and post_linker (first 15 nt of GFP) (e.g., SEQ ID NO: 244025). Further detail can be found in Table 4. Amplification primers for both ON and OFF libraries (including the common reverse primer) are shown with black arrows. Sequences of common reverse primer, on forward primer and off forward primer are provided as SEQ ID NOs: 244026-244028. (B) Comparison of ON state GFP expression from a panel of 20 individually assayed switches from our high-throughput toehold switch pipeline against the ON/OFF ratio for equivalent switches reported by Green et al. (1). The agreement between the 5' fused triggers used in this work and the separately transcribed triggers used by Green et al. (1) was assessed based on the Pearson correlation coefficient (0.8567). GFP=Green fluorescent protein, nt=nucleotide, RBS=Ribosome binding site.

Figure 7:
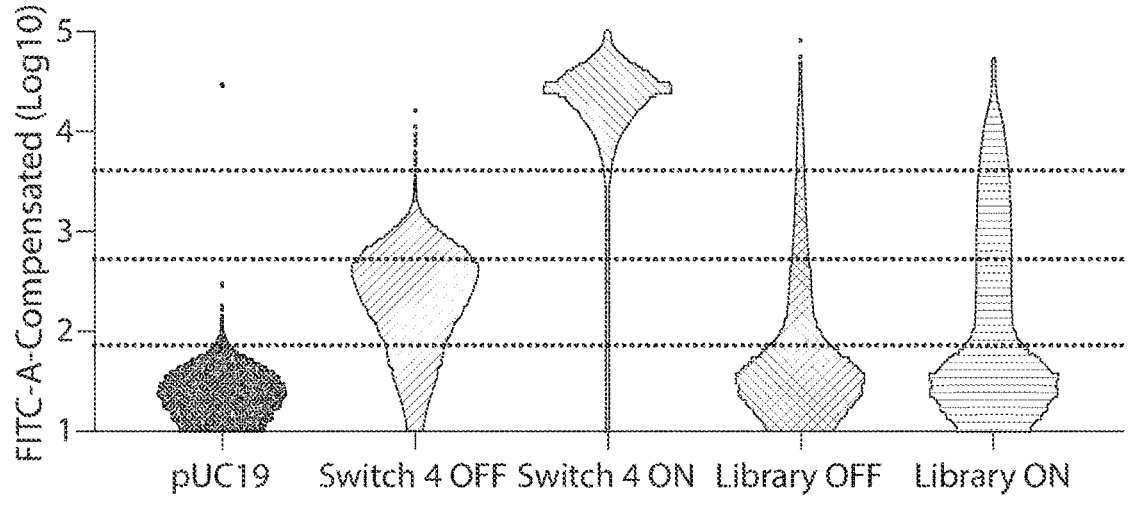

FIG. 7. Library FACS distributions and empirically-derived sorting gates. To determine the boundaries of the sorting gates for our high-throughput toehold switch pipeline, we used Switch #4 from Green et al. (1) in ON and OFF conformations as positive controls, and a pUC19 plasmid lacking a GFP gene as a negative control. Fluorescence distribution plots of IPTG-induced *E. coli* BL21-star cells from the three control conditions are shown alongside complete ON and OFF libraries for comparison. Boundaries for the four sorting bins are shown as dotted lines.

Figure 8A:
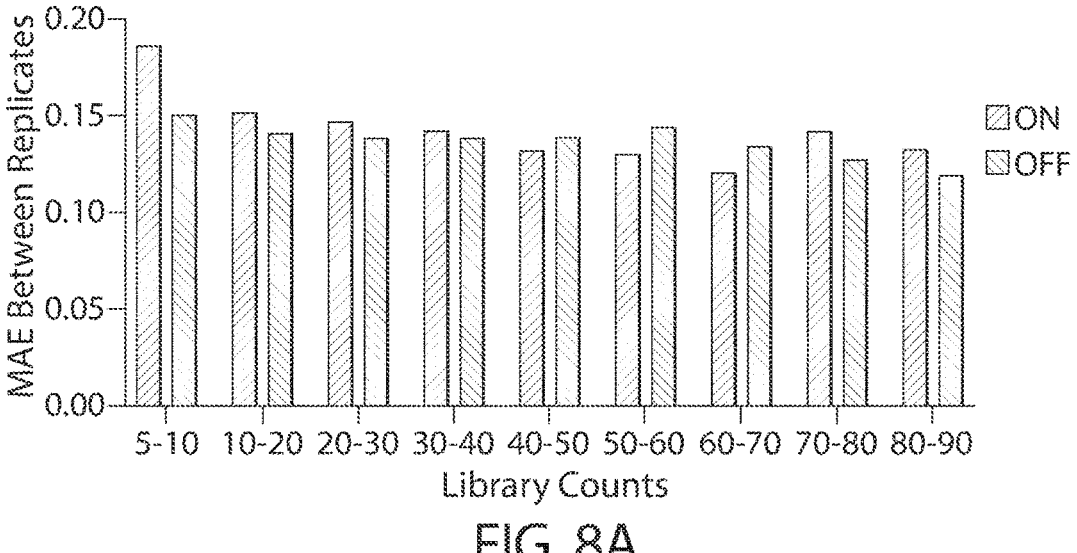
Figure 8B:
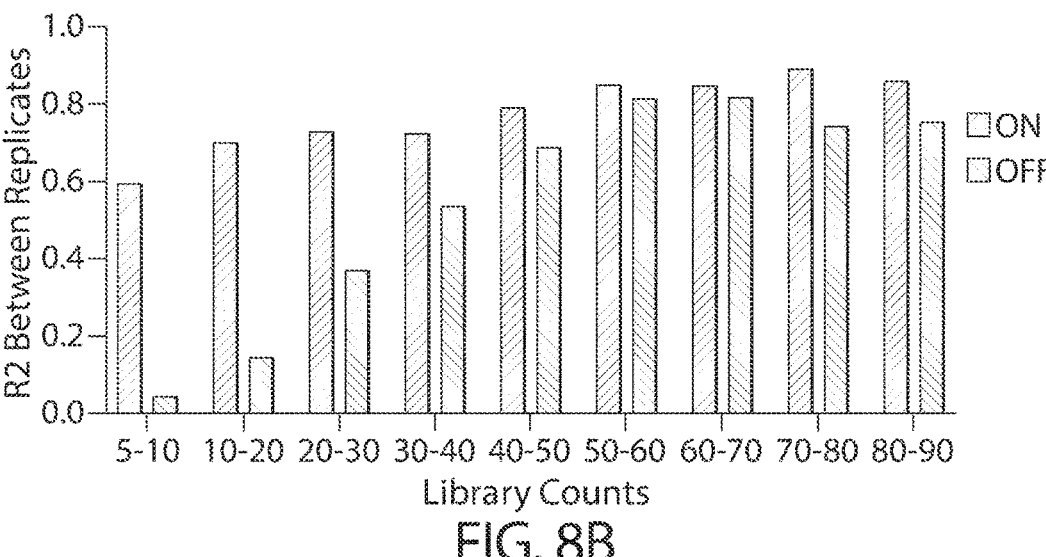

FIGS. 8A-B. Inter-replicate variability of toehold switch libraries. For the same initial toehold library, we performed two replicates of the BL21 transformation process followed by independent induction, sorting, and sequencing. Two metrics were used to compare the inter-replicate variability: (A) the mean absolute error (MAE), and (B) the $R^2$ correlation coefficient. Shown are the MAE and $R^2$ values for ON (first bar in each pair) and OFF (second bar in each pair) measurements at different ranges of library count thresholds.

Figure 9:
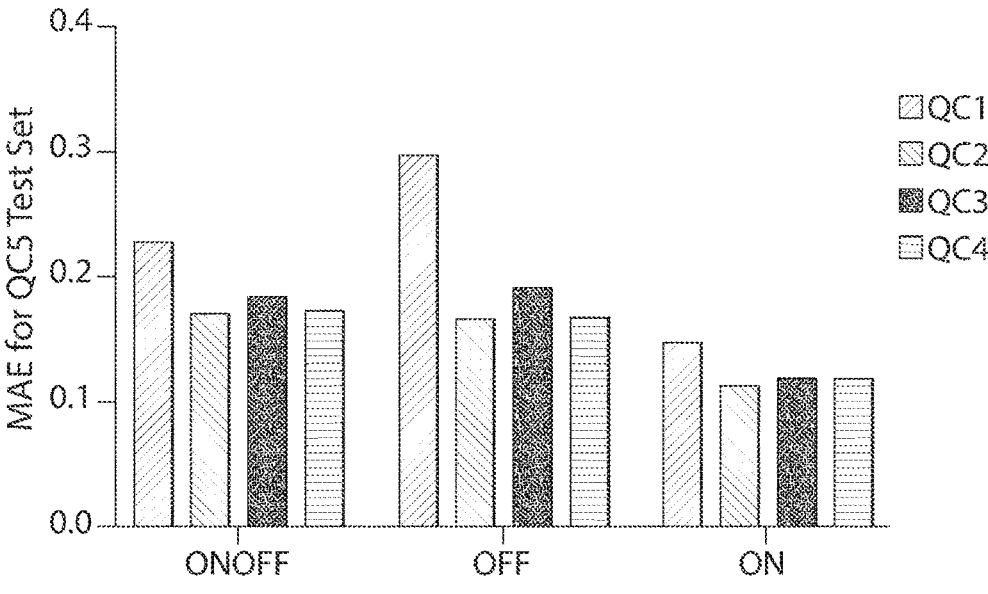
Figure 9:
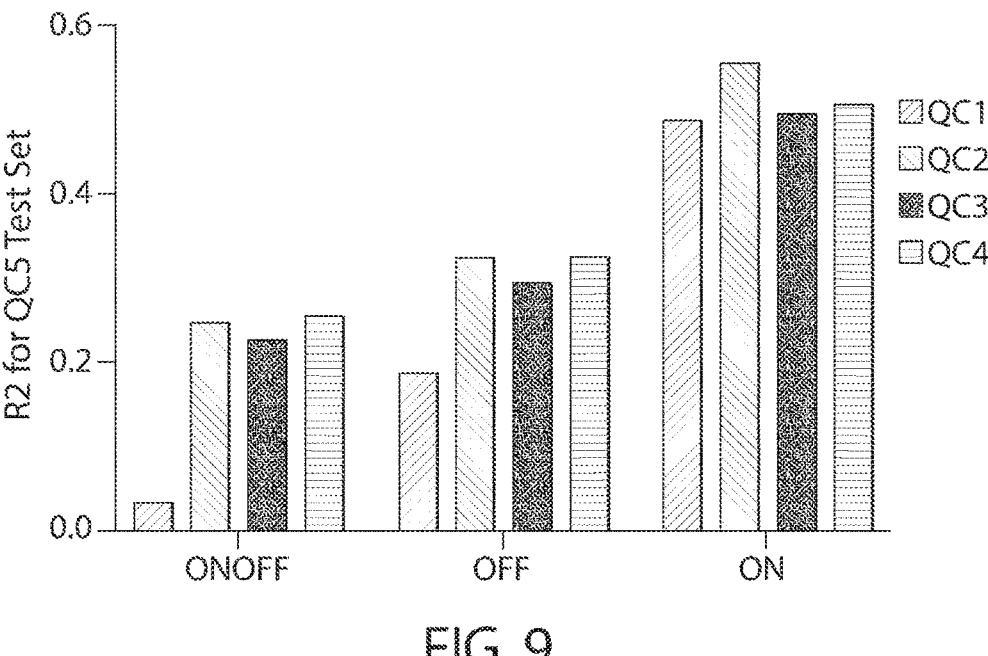

FIG. 9. Effect of QC level on MLP performance. The predictive power of our multilayer perceptron model was evaluated after training with datasets obtained from increasingly stringent quality control (QC) thresholds. The most stringent quality control group (QC5) was withheld as a test set, and an MLP trained on a one-hot representation of the toehold sequence was given either QC1 (first bar in each 4 bar group), QC2 (second bar in each 4 bar group), QC3 (third bar in each 4 bar group), or QC4 (fourth bar in each 4 bar group) as training data. From the resulting test-prediction of QC5 values, we show the MAE (upper panel), and the analogous $R^2$ correlation metric (lower panel) between the predicted and experimental values. See Table S1 for conditions for each QC level.

Figure 10:
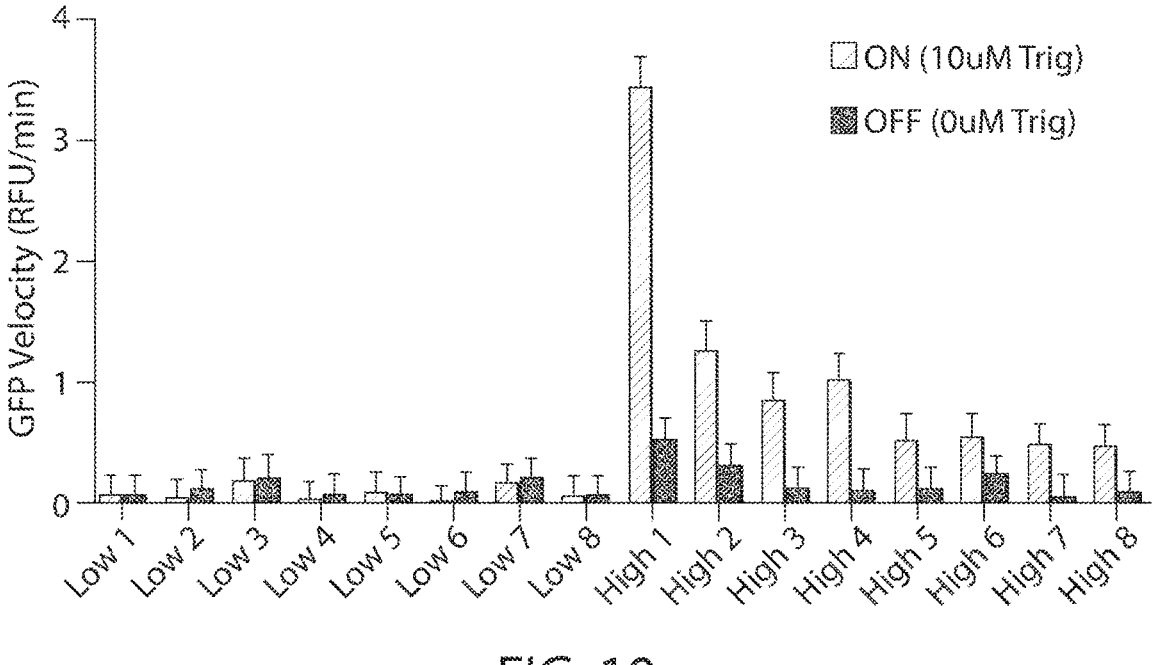

FIG. 10. Cell-free toehold switch validation. A panel of toeholds that showed either a low or high ON/OFF ratio as measured by our high-throughput flow-seq assay were individually cloned and assayed in a cell-free protein synthesis (CFPS) system. The time course velocities of GFP signal evolution are shown for the PURExpress CFPS reactions containing the sixteen switches with or without their separately transcribed RNA triggers. The sequences and flow-seq assay results for these sixteen switches can be found in Table 2. ON measurement is the first bar of each pair and corresponds to 10 μM trigger. OFF measurement is the second bar of each pair and corresponds to 0 μM trigger.

Figure 11A:
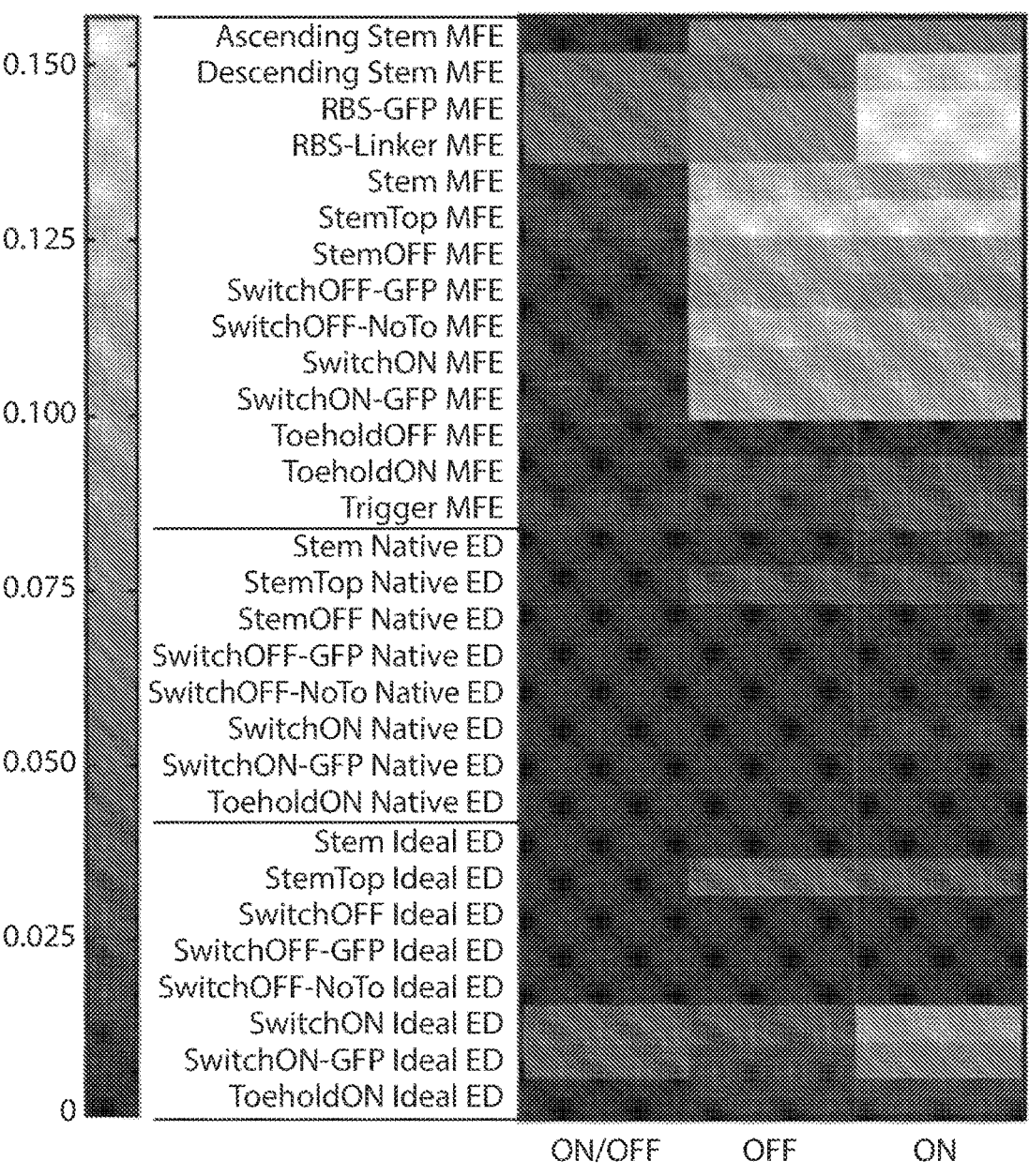
Figure 11B:
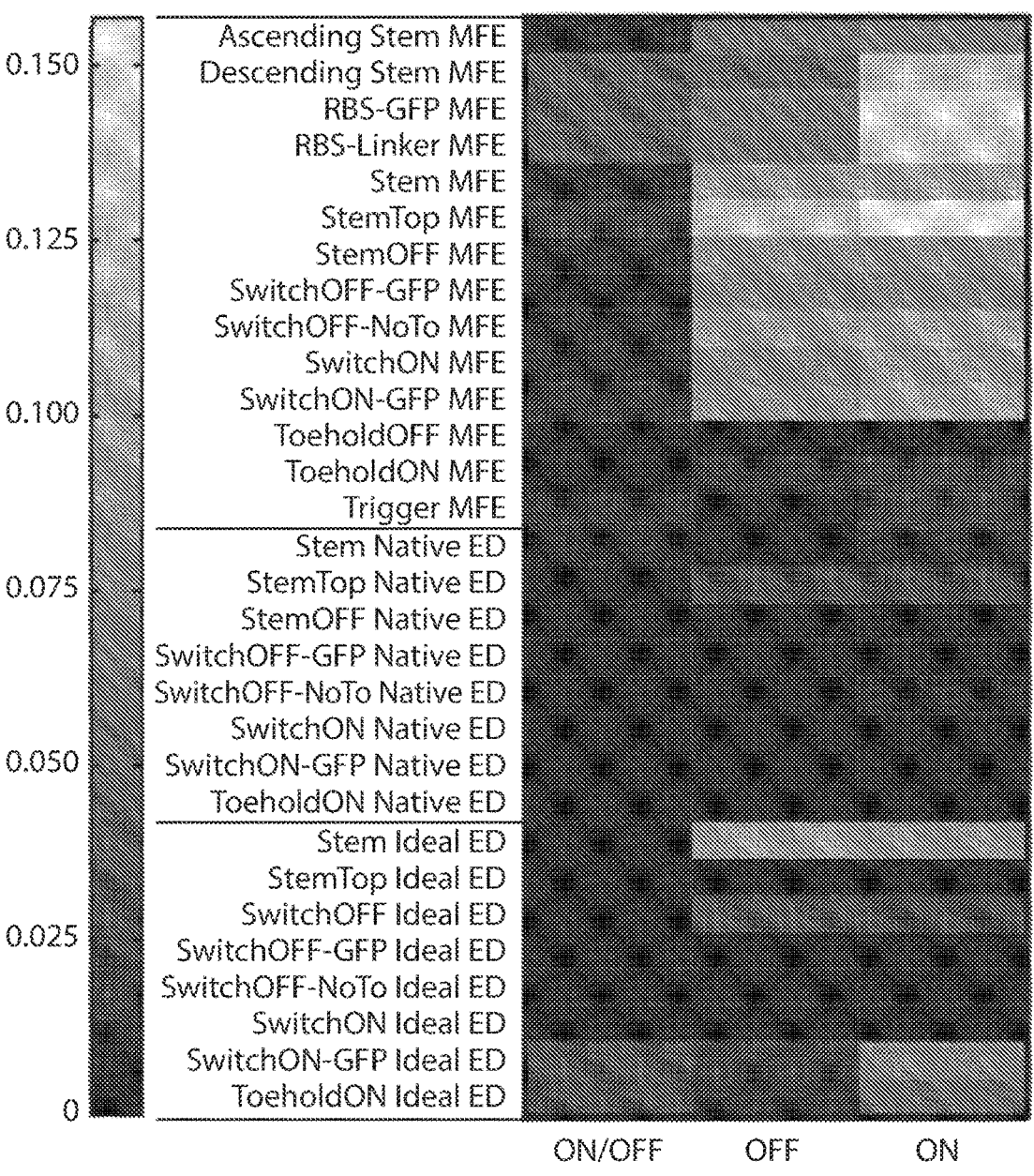

FIGS. 11A-B. Correlation between rational thermodynamic features and toehold switch dataset, subsetted for A-U content. We analyzed the $R^2$ coefficients between 30 commonly used thermodynamic features and the ON, OFF, or ON/OFF measurements of variants in our high-throughput dataset. (A) $R^2$ coefficients for the subset of switches that contained only an A-U or U-A base pair at the top of the toehold switch stem (positions 79 and 91 in Table 4). (B) $R^2$ coefficients for the entire set of switches, allowing for any base pair at the top of the toehold switch stem. Both $R^2$ value sets were compared to evaluate findings from Green et al. (1) where subsetting for switches with an A-U or U-A basepair at the top of the stem was sufficient to dramatically increase the predictive $R^2$ coefficient between thermodynamic features and measured ON/OFF. We found measurable differences between various thermodynamic features when subsetting for an A-U basepair at the top of the hairpin stem, particularly for those in the Ideal Ensemble Defect (ED)

block. However, differences between the $R^2$ values in said subset and those obtained for other possible base-pairs were not statistically significant suggesting no overall increase in predictive value (p>0.05 for ON, OFF, and ON/OFF, two-tailed t-test).

FIGS. 12A-F. Kinetic toehold switch folding analysis using Kinfold. Folding trajectories were run using the Kinfold package for the OFF-state switch sequence (positions 50-134 nt in Table 4). (A) For a single representative toehold switch, six example trajectories are shown. Trajectories in green reached the MFE structure within $10^3$ arbitrary time units (au), while those in blue did not. (B) For two representative toehold switches, 100 trajectories were run for a maximum time of $10^6$ au. Histograms of the time required for a trajectory to reach the MFE structure are shown. Most trajectories took longer than $10^3$ au, compared to the Kinfold analyses in Borujeni et al. (6), where average trajectory times fell in the range of $10^1$-$10^3$ au, and $10^4$ au was the longest allowed trajectory time. (C,D,E,F) For each switch in the QC4 dataset (total 19,983 variants), 100 trajectories were run and the following measurements plotted: (C) histograms of the mean and negative standard deviation of the trajectories' average energy during the first $10^3$ au, (D) the fraction of trajectories that completed folding of the MFE structure before $10^3$ au, (E) the ratio of average trajectory energy to the minimum possible MFE energy, and (F) the $R^2$ correlation between the metrics in C,D,E and the empirical measurements in our toehold switch dataset. For comparison with previous rational features the heatmap axis is set identically to FIG. 3B.

Figure 13A:
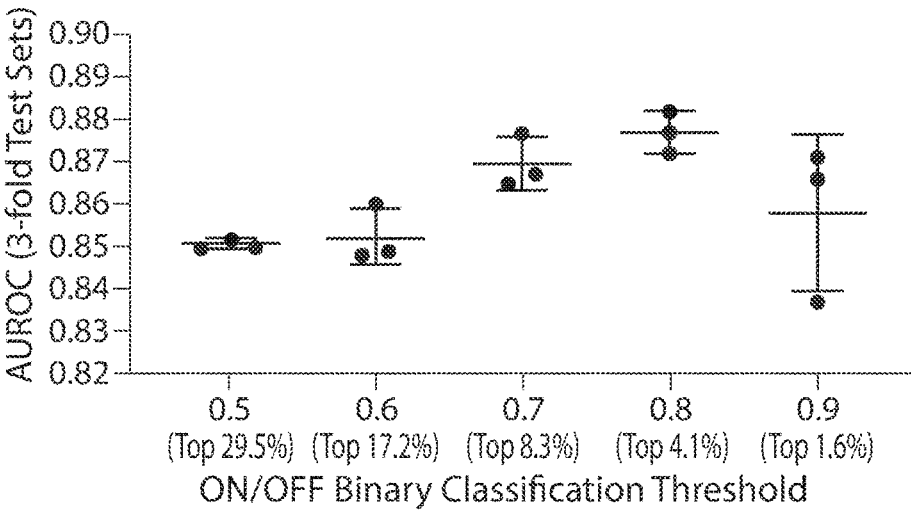
Figure 13B:
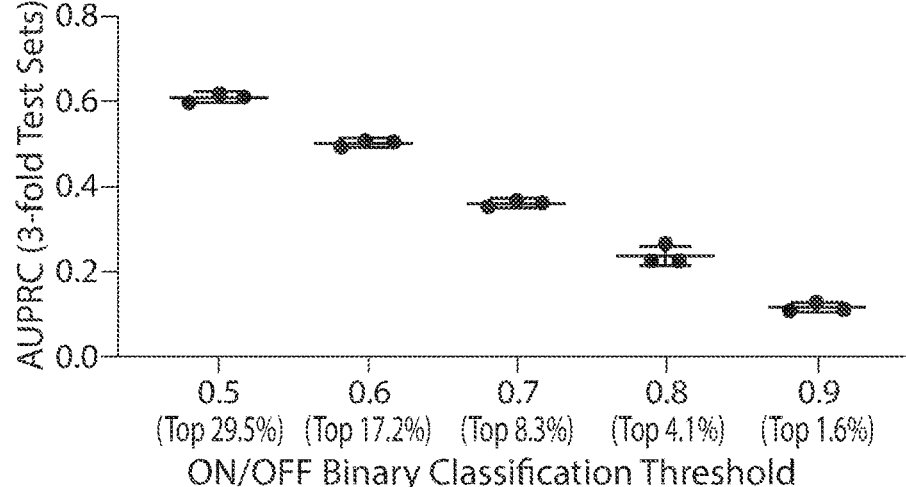
Figure 13C:
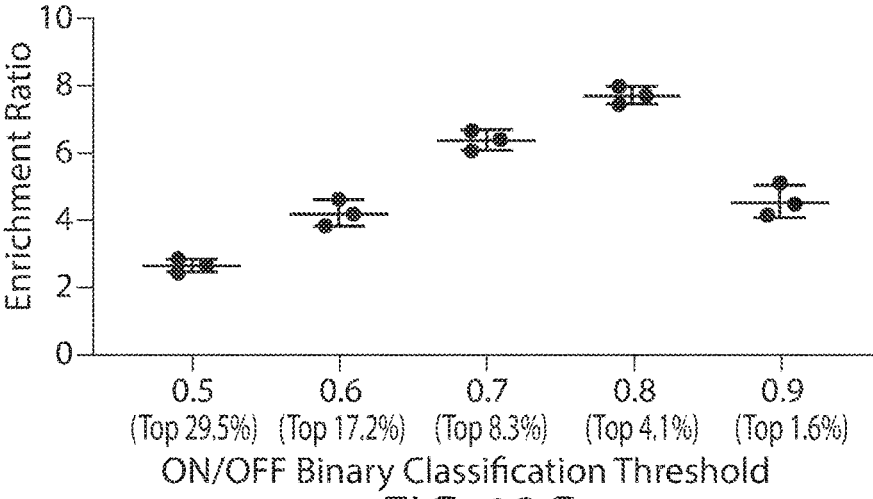

FIGS. 13A-C. Determination of the optimal ON/OFF binary classification cutoff threshold. AUC, P-R, and enrichment ratio analyses were used to determine the optimal cutoff threshold at which to binarize ON/OFF data for classification. We trained a standard MLP architecture on the one-hot sequence representation of the toehold switch at five different binarization thresholds, and compared the following performance metrics: (A) model AUROC results, (B) model AUPRC results, and (C) model enrichment ratio over random chance. The enrichment ratio is calculated as the fraction of true positive toehold switches returned by the model (i.e., the precision) divided by the fraction returned by random chance. The enrichment ratio was specifically calculated at the level of precision for which the recall returns one positive switch per 100, or approximately ten on average for a typical mRNA of length ~1000 nt. The final threshold selected for all classification models in this study was 0.7 (or the top 8.3% of switches), balancing a high enrichment ratio with a practical degree of overall precision.

Figure 14:
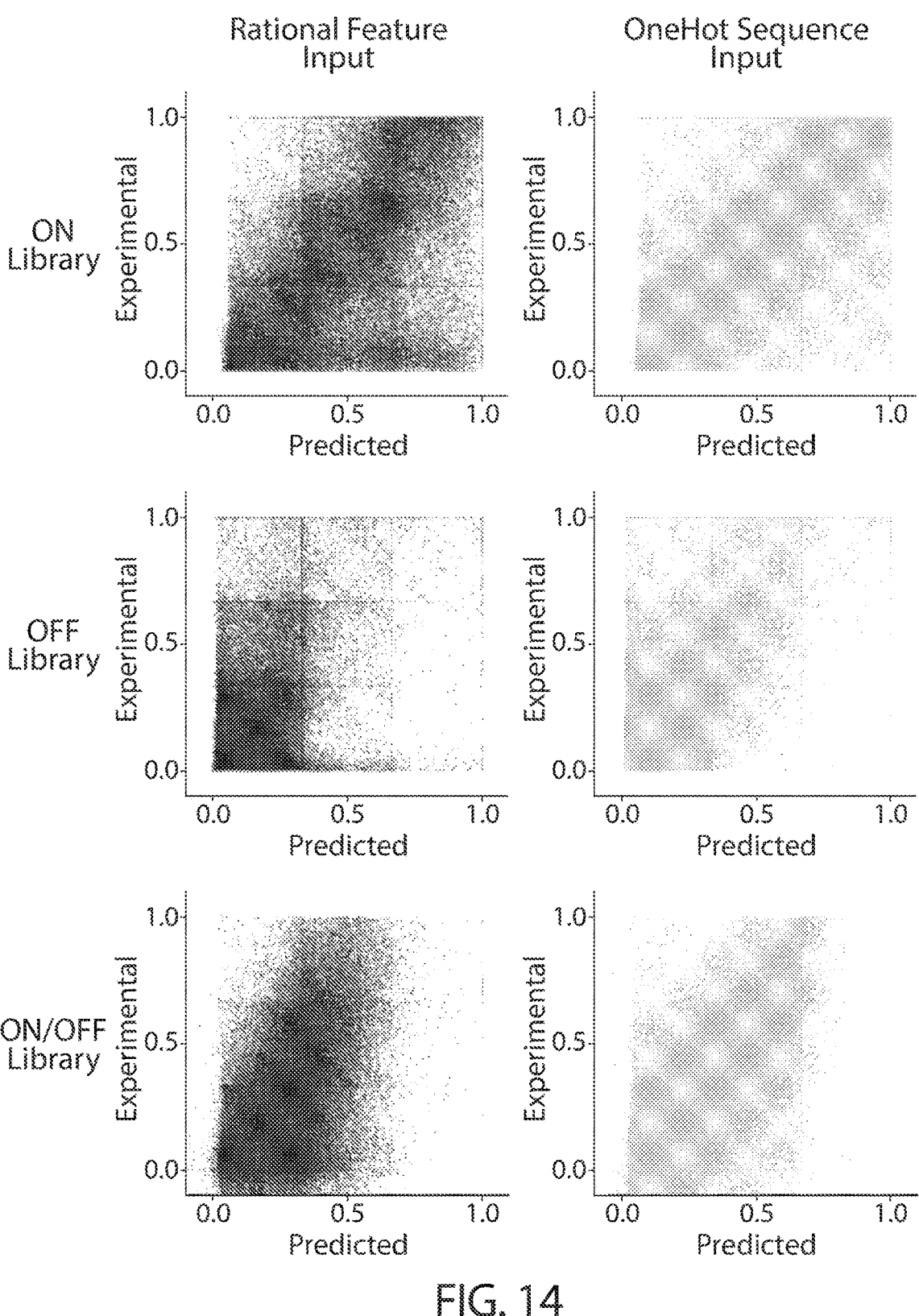
Figure 15A:
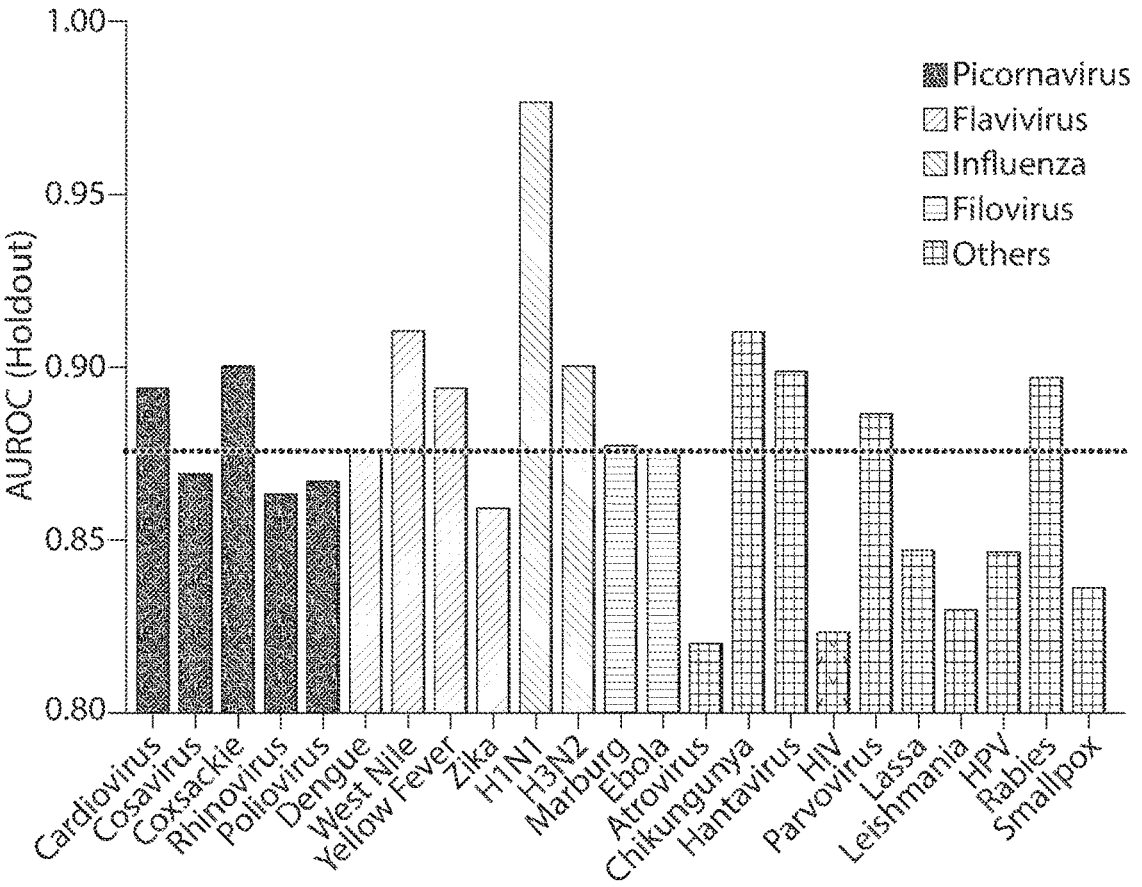
Figure 15B:
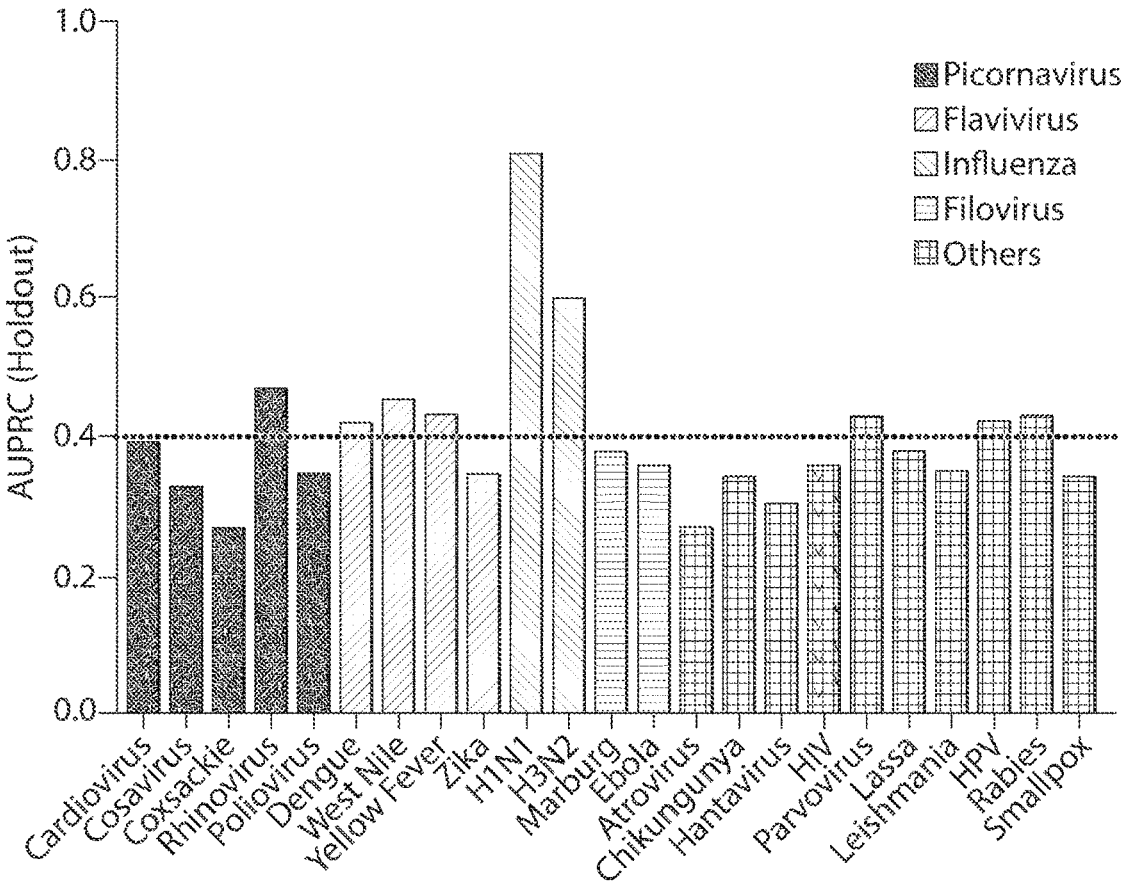
Figure 15C:
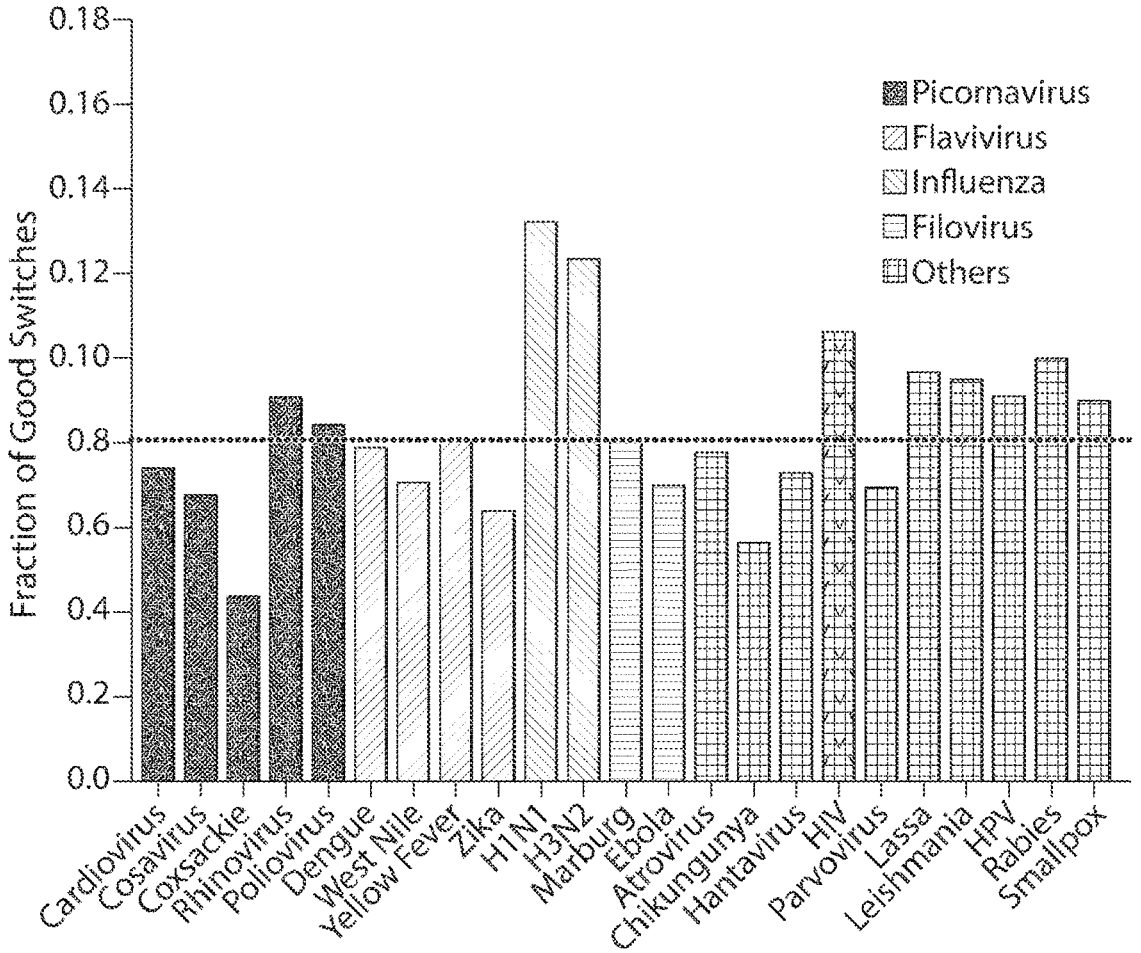
Figure 15D:
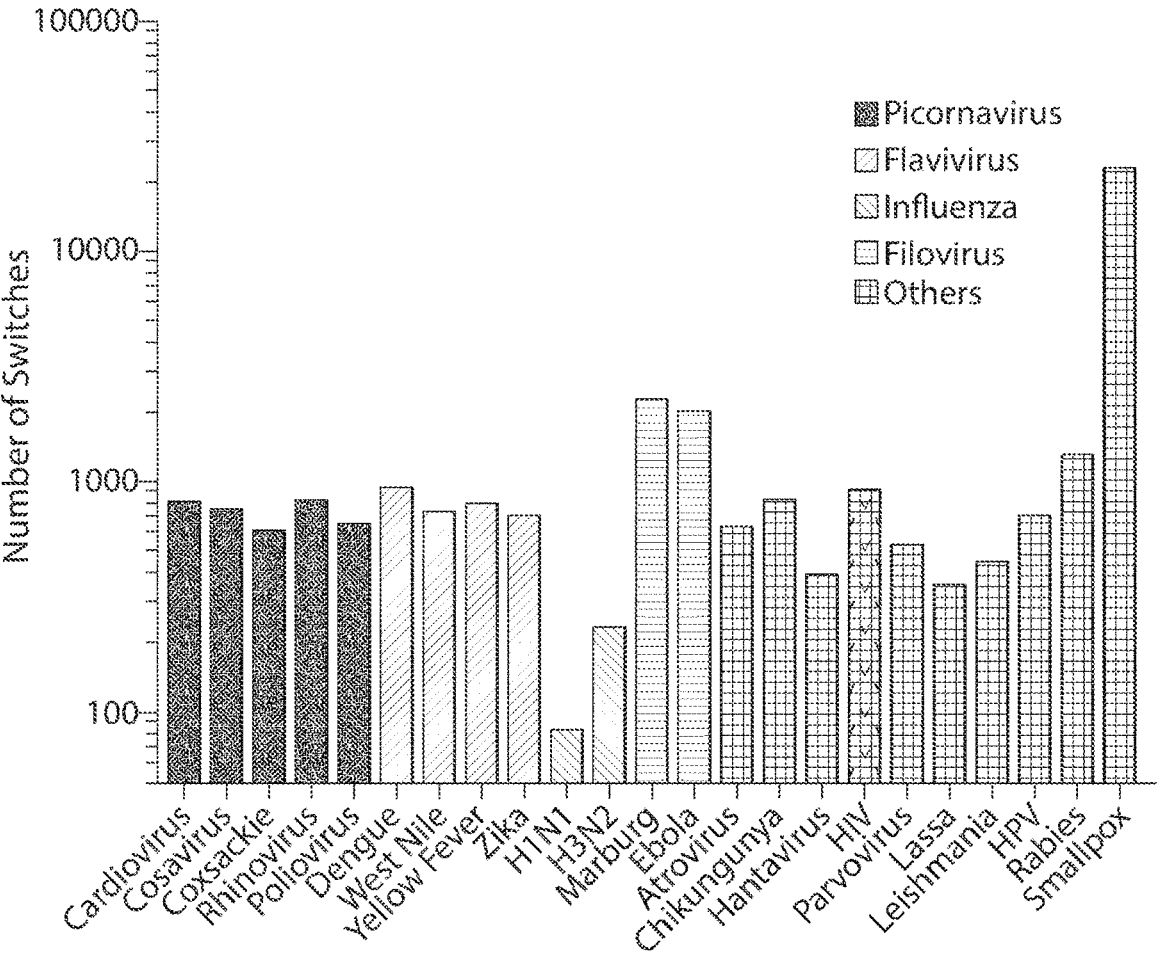

FIG. 14. MLP predictions vs. experimental results. Scatter plots of the predicted versus empirical values of our compiled test set are shown for ten-fold cross-validated MLP models trained with either the 30 pre-calculated rational thermodynamic features as inputs (left, dark green), or the toehold switch one-hot sequence representation as input (right, light green) for ON, OFF, and ON/OFF. Summary statistics are reported in FIG. 3D,E.

FIGS. 15A-D. Holdout validation of individual viral genomes. For each of the 23 pathogenic viruses tiled in our toehold switch dataset, every toehold switch targeting a given viral genome was withheld, and an MLP model was trained with the remaining sequences in the dataset using a one-hot sequence input representation classifying for ON/OFF ratio. The model performance was then evaluated on the switches of the withheld viral genoma as a test set. (A) Area under the receiver operating characteristic curves (AUROC) for holdout viral genomes. Dotted line denotes AUROC average across test samples. (B) Area under the precision-recall curves (AUPRC) for holdout viral genomes. Dotted line denotes AUPRC average across test samples. (C) Fraction of toehold switches in synthesized high-throughput library classified as high-performing for each virus type. Dotted line denotes average at 8%. (D) Total number of toehold switches synthesized for each virus type.

Figures 16A, 16B:
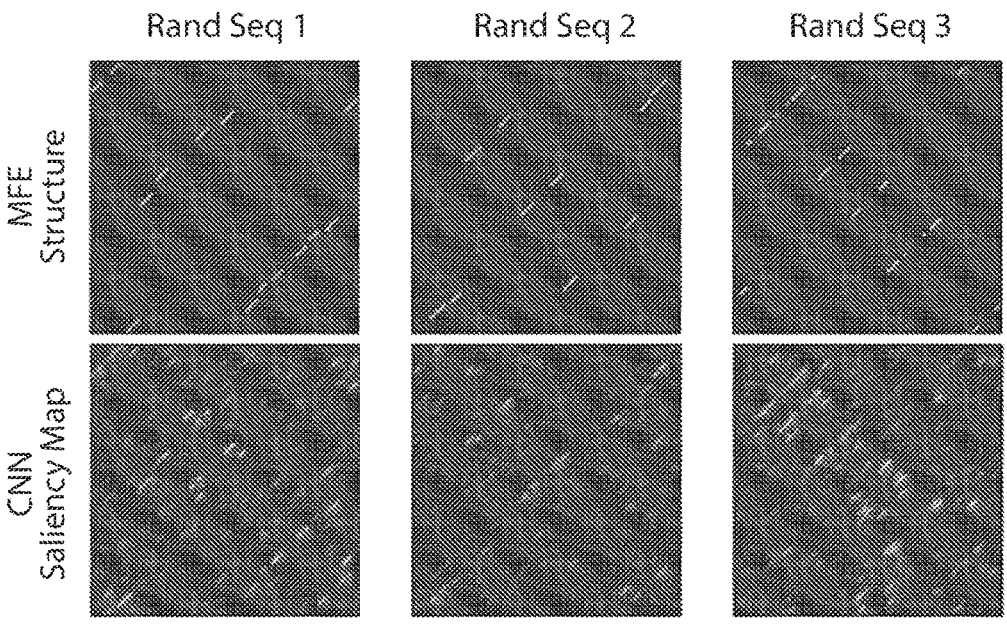

FIGS. 16A-B. VIS4Map analysis of random toehold sequences in MFE predictor 2D CNN model. A dataset of 50,000 random RNA sequences of length 120 nt and their corresponding MFE values were generated using NUPACK. A convolutional neural network (CNN) was then trained to predict the MFE of each sequence using either a one-hot representation or a complementarity map representation of the sequence as input. (A) For three randomly selected RNA sequences, representative saliency maps generated from the CNN model are shown alongside the MFE structure pre-computed independently using NUPACK. The CNN model was trained on complementarity map inputs. Overlap between salient diagonal features in the VIS4Map outputs and MFE structure maps is visible. (B) We then compared the $R^2$ coefficients between NUPACK-calculated MFE values and the predictions of a CNN model trained either on a one-hot representation or a complementarity matrix representation of the random RNA sequences. Error bars show standard deviation from five shuffled test sets.

Figure 17:
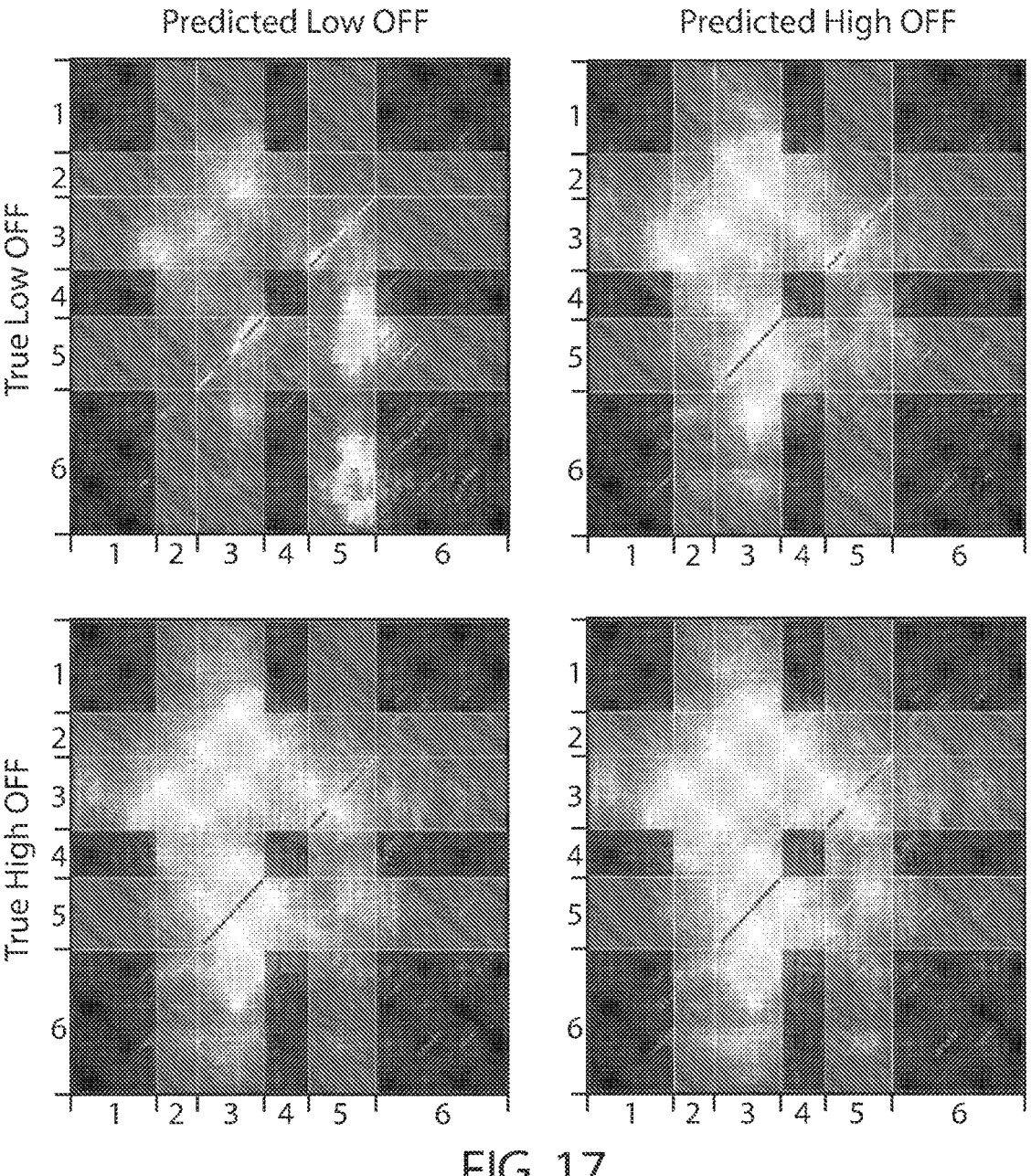

FIG. 17. VIS4Map confusion matrix analysis of switch OFF conformation. Saliency maps generated from a CNN model trained to predict the toehold switch OFF metric are shown for different ground-truth OFF metrics. The model was trained using a complementarity matrix representation of the toehold sequence as input. Regions labeled on the axes are as follows: 1) Constant Loop, 2) Toehold, 3) Ascending Stem, 4) Constant RBS Loop, 5) Descending Stem, and 6) Constant Linker. Regions of interaction between constant regions are shaded darker as they do not contain variability between different switch sequences. All saliency maps were generated from the test set only. Saliency maps were then sorted according to the 25% highest and 25% lowest experimentally-determined OFF signal. The 10% best-predicted and 10% worst-predicted saliency maps from the high OFF and low OFF groups were then averaged to produce the shown confusion matrix. Contrast was enhanced four-fold in the averaged maps in order to visualize more sparsely distributed features.

Figure 18:
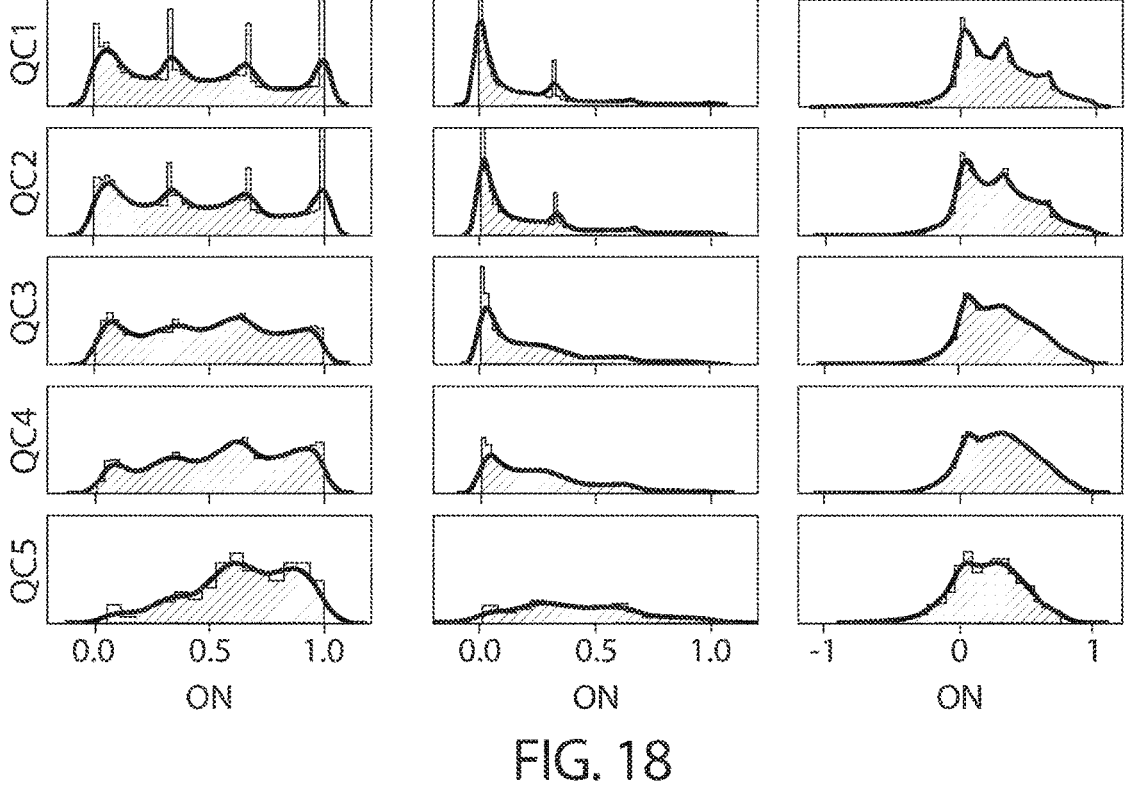

FIG. 18. Dataset distribution vs. QC level. Histograms of toehold switch library values for ON, OFF, and ON/OFF were grouped according to our five different QC threshold levels and are shown here for comparison. The y-axis limits are held constant for ON, OFF, and ON/OFF, respectively, across QC levels after normalizing for data subset size.

Color version of these Figures are accessible on the United States Patent and Trademark Office PAIR website, under the Supplemental Tab of the file history for U.S. Provisional Application Ser. No. 62/948,175, filed Dec. 13, 2019.

DETAILED DESCRIPTION OF INVENTION

This disclosure provides numerous toehold riboregulators, each specific for a particular human transcription factor or a particular virus. Some of these riboregulators may be used to detect the presence of a particular virus, and this may aid in the diagnosis of an infection by such virus. Some of these riboregulators may be used to detect the presence or expression level of a particular human transcription factor, and this may aid in the diagnosis or prognosis of a condition associated with the presence and/or increased expression of such transcription factor. One such condition is cancer. For example, the human transcription factor STAT3 is reportedly upregulated in certain cancers, and it may therefore act as a diagnostic and/or prognostic marker of such cancers.

As will be described in greater detail herein, the toehold riboregulators may be provided covalently conjugated, typically at their 3' ends, to a coding domain. The coding domain may be a reporter domain. The reporter domain may encode a reporter protein. Alternatively, the reporter domain may encode a reporter RNA (e.g., an RNA aptamer). Such toehold riboregulator-reporter domain constructs may be used to detect and/or measure a level (e.g., an expression level) of a nucleic acid of interest (i.e., a trigger nucleic acid that is present in the sample being tested).

Riboregulators are nucleic acid molecules that exist in two different conformations (i.e., closed and open conformations). In the closed conformation, the riboregulator adopts a secondary hairpin structure that sequesters a ribosome binding site (RBS) in a loop domain, rendering the RBS inaccessible to translation machinery. In the open conformation, the riboregulator adopts a linear structure and the RBS is no longer sequestered and rather it is accessible to the translation machinery. Riboregulators are designed to convert from their closed to their open conformations in the presence of a target nucleic acid (referred to herein as a trigger nucleic acid), which is typically the nucleic acid of interest in a sample. Thus, the conversion from closed to open conformations occurs upon specific binding of the riboregulator to a trigger nucleic acid. The binding of to the trigger causes the conversion which then enables expression of a downstream coding domain, such as a reporter protein domain. Presence of the reporter protein is therefore a surrogate for the presence of the trigger nucleic acid.

The riboregulators share a common structure, as shown in FIG. 1, which includes, in a 5' to 3' order, a single-stranded toehold domain, a hairpin domain comprising a stem domain and a loop domain, and a linker domain. The loop domain comprises the ribosome binding site (RBS, e.g., AGAG-GAGA) and the stem domain comprises the start codon, AUG, on the descending strand. The stem domain further comprises first and second stem domains, called stem domain 1 and stem domain 2. The start codon, AUG, separates stem domain 1 from stem domain 2, on the descending strand, as illustrated in FIG. 1. The single-stranded toehold domain and the adjacent ascending sequence of the stem domain together are referred to as the "switch" domain. This domain is represented by a+b (5' to 3') sequences in FIG. 1.

It is this switch domain which is complementary to the "trigger" nucleic acid being detected, which as described above is either a particular viral nucleic acid or a nucleic acid encoding a particular human transcription factor acid. The trigger is represented by a'+b' (3' to 5') sequences in FIG. 1. The trigger sequence a' hybridizes by complementary base pairing to the single-stranded toehold domain denoted a. As the stem domain naturally associates and dissociates (i.e., "breathes"), trigger sequence b' then has the opportunity to migrate into the hairpin and hybridize to the ascending sequence of the stem domain, denoted b. This hybridization unwinds the stem domain further and makes the RBS accessible to the ribosome, and this in turn enables translation of the downstream coding region, and production of the encoded protein (e.g., the reporter protein). In the absence of a trigger nucleic acid, the toehold domain remains single-stranded, the riboregulator typically remains closed, the RBS remains inaccessible to the ribosome machinery, and there is no or little translation of the downstream coding domain.

As will be understood, in their final form, riboregulators are RNA molecules that possess an RBS and are acted upon by ribosome machinery to produce an encoded protein. While they may be provided to a system, such as a cell-free system or an in vivo system, as RNAs, this is likely to be inefficient given the inherent instability of RNA. Instead, they are typically provided in a DNA form, conjugated to a promoter, such as but not limited to a T7 promoter, and are then produced in an RNA form through transcription from the T7 promoter. The sequences provided in the sequence listing submitted herewith and as part of this specification are DNA sequences that comprise the riboregulator sequence in a DNA form (i.e., there is a T in the sequence provided whereas the RNA counterpart would have a U in that position). Thus, these sequences are understood to comprise the DNA form of a riboregulator (with Ts) as well as the RNA form (with Us). As will be discussed below, these sequences also comprise elements in addition to the riboregulator elements discussed above.

The nucleic acids provided as SEQ ID NOs: 1-244,000 are DNAs that comprise the riboregulator elements described above. These sequences have a common structure/sequence as follows, in a 5' to 3' order:

```
Promoter sequence: T7 promoter, 20 nt,
                        (SEQ ID NO: 244001)
TAATACGACTCACTATAGGG;
```

Switch domain sequence: complete toehold (12 nt) and entire ascending stem (18 nt), 30 nt in total; variable sequence;

```
Loop domain sequence: includes RBS, 11 nt,
                        (SEQ ID NO: 244002)
AACAGAGGAGA;
```

Stem domain 1 sequence: top half of descending stem, 6 nt, variable sequence will be dictated by switch domain sequence, as illustrated in FIG. 6A;
ATG or AUG: start codon, 3 nt;
Stem domain 2 sequence: bottom half of descending stem, 9 nt, variable sequence will be dictated by switch domain sequence, as illustrated in FIG. 6A;
Linker domain sequence: sequence encoding unstructured amino acids, 21 nt,

```
                        (SEQ ID NO: 244003)
AACCTGGCGGCAGCGCAAAG;
```

Post-linker sequence: ATG start of reporter gene, 3 nt.

Accordingly, each of the sequences in the enclosed sequence listing is 103 nucleotides in length. These nucleic acid sequences are provided as DNA strands, which are then transcribed from the T7 promoter into RNA strands which are able to self-hybridize and thereby adopt the riboregulator structure described above. Further, before use, each of these sequences may be conjugated (i.e., operably linked) to a coding domain at their 3' ends. These sequences may be provided in a replication vector and/or an expression vector, and optionally in a host cell.

This disclosure contemplates use of the entire 103 nt sequence, for example by conjugating such sequence to a coding domain. Alternatively, this disclosure contemplates use of the sequence presented by nucleotides 21-100, which represent the toehold domain, the hairpin domain, and the linker domain, preferably in RNA form (i.e., with Ts replaced with Us and with an RNA backbone).

A cell or a cell-free system may be contacted with the riboregulator in its DNA form, and it may be transcribed from the T7 promoter in order to form its RNA form. A sample to be tested may be contacted with the DNA form, provided such sample is capable of transcribing the DNA form. Alternatively, the sample to be tested may be contacted with the RNA form, and thus the sample to be tested may be contacted with a riboregulator RNA sequence beginning at the switch domain and having a coding domain. In relation to SEQ ID NOs: 1-244,000, this means that samples may be contacted with RNA versions of these sequences that lack nucleotides 1-20 but that comprise a coding domain conjugated to their 3' ends.

Use of riboregulators in vitro as nucleic acid diagnostic tools using cell-free protein synthesis (CFPS) systems have been described previously (3, 4, 15, 16), and reference can be made to such prior teachings.

It is to be understood therefore that in its RNA form, the riboregulator typically lacks the promoter sequence and it is conjugated to a coding domain as shown in FIG. 1.

It is also to be understood that other promoters may be used in place of the T7 promoter that is provided in SEQ ID NOs: 1-244,000.

The consensus sequence therefore comprises certain constant or invariant sequences including the promoter sequence, the loop domain sequence, the linker sequence, and the post-linker sequence. The switch domain sequence, the stem domain 1 sequence, and the stem domain 2 sequence are all variable (i.e., they will vary between riboregulators), although they will have regions of complementarity to each other. This is illustrated in FIG. 6A which shows that stem domain 1 sequence is complementary to a 3' region of the switch domain, and stem domain 2 sequence is complementary to a 5' region of the switch domain. The complementarity of these regions results in the stem domain.

In general, the hairpin and stem domains described herein form at and are stable under physiological conditions, e.g., conditions present within a cell (e.g., conditions such as pH, temperature, and salt concentration that approximate physiological conditions). Such conditions include a pH between 6.8 and 7.6, more preferably approximately 7.4. Typical temperatures are approximately 37° C.

Various of the nucleic acids provided in this disclosure may be regarded as non-naturally occurring, artificial, engineered or synthetic. This means that the nucleic acid is not found naturally or in naturally occurring, unmanipulated, sources. A non-naturally occurring, artificial, engineered or synthetic nucleic acid may be similar in sequence to a naturally occurring nucleic acid but may contain at least one artificially created insertion, deletion, inversion, or substitution relative to the sequence found in its naturally occurring counterpart. A cell that contains an engineered nucleic acid may be regarded as an engineered cell.

In some instances, the riboregulators are operably linked to coding regions that encode reporter proteins. Such reporter proteins are typically used to visualize activation of the riboregulator and thus presence of the trigger nucleic acid in the sample being analyzed. Reporter proteins suitable for this purpose include but are not limited to fluorescent or chemiluminescent reporters (e.g., GFP variants, luciferase, e.g., luciferase derived from the firefly (*Photinus pyralis*) or the sea pansy (*Renilla reniformis*) and mutants thereof), enzymatic reporters (e.g., β-galactosidase, alkaline phosphatase, DHFR, CAT), etc. The eGFPs are a class of proteins that has various substitutions (e.g., Thr, Ala, Gly) of the serine at position 65 (Ser65). The blue fluorescent proteins (BFP) have a mutation at position 66 (Tyr to His mutation) which alters emission and excitation properties. This Y66H mutation in BFP causes the spectra to be blue-shifted compared to the wtGFP. Cyan fluorescent proteins (CFP) have a Y66W mutation with excitation and emission spectra wavelengths between those of BFP and eGFP. Sapphire is a mutant with the suppressed excitation peak at 495 nM but still retaining an excitation peak at 395 and the emission peak at 511 nM. Yellow FP (YFP) mutants have an aromatic amino acid (e.g. Phe, Tyr, etc.) at position 203 and have red-shifted emission and excitation spectra.

The riboregulators comprise an RBS. Exemplary RBS sequences include, but are not limited to, AGAGGAGA (or subsequences of this sequence, e.g., subsequences at least 6 nucleotides in length, such as AGGAGG). Shorter sequences are also acceptable, e.g., AGGA, AGGGAG, GAGGAG, etc. Numerous synthetic ribosome binding sites have been created, and their translation initiation activity has been tested. The activity of any candidate sequence to function as an RBS may be tested using any suitable method. For example, expression may be measured as described in Example 1 of published PCT application WO 2004/046321, or as described in reference 53 of that published PCT application, e.g., by measuring the activity of a reporter protein encoded by an mRNA that contains the candidate RBS appropriately positioned upstream of the AUG.

Particular Riboregulators

Some of the riboregulators of this disclosure are specific for (i.e., they specifically hybridize to, and thus can be used to detect) nucleic acids (DNA or RNA) from particular viruses. These viruses are astrovirus, cardiovirus, chikungunya virus, cosavirus, coxsackie virus, dengue virus, ebola virus, hantavirus, human immunodeficiency virus, human parvo virus, human rhino virus, influenza virus: h1n1, influenza virus: h3n2, lassa virus, leishmanial virus, Marburg virus, papilloma virus, poliovirus, rabies virus, smallpox virus, west nile virus, yellow fever virus, and zika virus. The switch domain of these virus-specific riboregulators will hybridize to a nucleic acid, such as a transcript, from one of these viruses. Table 5 provides details relating to the SEQ ID NO: viral specificity.

Of particular interest are riboregulators having a nucleotide sequence selected from the group consisting of SEQ ID NOs: 43841, 9602, 62866, and 19367. Of particular interest are riboregulators that are specific for smallpox virus, dengue virus, and human rhino virus.

Some of the riboregulators of this disclosure are specific for (i.e., they specifically hybridize to, and thus can be used to detect and optionally measure) nucleic acids (DNA or RNA) that encode particular human transcription factors. These human transcription factors are AC097634.4, ACTB, ACTL6A, ACTN4, AEBP1, AEBP2, AGO1, AGO2, AHR, AIRE, AKNA, AL121581.1, ALX1, ALX4, ANHX, AR, ARHGAP35, ARID3A, ARID3B, ARID3C, ARID4A, ARID4B, ARID5A, ARID5B, ARNT, ARNT2, ARNTL, ARNTL2, ARRB1, ARX, ASCL1, ASCL2, ASCL3, ASCL4, ASCL5, ASH2L, ATF1, ATF2, ATF3, ATF4, ATF5, ATF6, ATF6B, ATMIN, ATOH1, ATOH8, ATXN3, BACH1, BACH2, BARHL1, BARHL2, BARX1, BARX2, BASP1, BATF, BATF2, BATF3, BAZ2A, BCL11A, BCL11B, BCL6, BCL6B, BCOR, BHLHA15, BHLHE40, BHLHE41, BORCS8-MEF2B, BRCA1, BRD7, BRF2, CALCOCO1, CARF, CARM1, CBX4, CC2D1A, CC2D1B, CCAR1, CCNT1, CDC5L, CDK12, CDK13, CDK5RAP2, CDK9, CDX1, CDX2, CDX4, CEBPA, CEBPB, CEBPD, CEBPE, CEBPG, CEBPZ, CGGBP1, CHD2, CHD4, CHD7, CIART, CIITA, CITED1, CLOCK, CNBP, CREB1, CREB3, CREB3L1, CREB3L2, CREB3L3, CREB3L4, CREBBP, CREBRF, CREM, CRX, CRY1, CRY2, CT476828.9, CTCF, CTCFL, CUX1, CUX2, CXXC1, DACH1, DBP, DDIT3, DDN, DEAF1, DHX36, DHX9, DLX1, DLX2, DLX4, DLX5, DMBX1, DMRT1, DMRT2, DNMT3A, DPF2, DR1, DRAP1, DUX4, E2F1, E2F2, E2F3, E2F4, E2F6, E2F7, E2F8, E4F1, EAF2, EBF2, EBF3, EBF4, EED, EGR1, EGR2, EGR3, EGR4, EHF, EHMT2, ELF1, ELF3, ELF4, ELF5, ELK1, ELK3, ELK4, ELL3, ELMSAN1, EN1, ENO1, EOMES, EP300, ERBB4, ERG, ESR1, ESR2, ESRRA, ESRRB, ESRRG, ESX1, ETS1, ETS2, ETV1, ETV2, ETV3, ETV4, ETV5, ETV6, ETV7, EZH2, FERD3L, FEZF1, FEZF2, FIGLA, FLI1, FOS, FOSB, FOSL1, FOSL2, FOXA1, FOXA2, FOXA3, FOXC1, FOXC2, FOXD1, FOXD3, FOXF1, FOXF2, FOXH1, FOXI1, FOXJ1, FOXJ2, FOXK1, FOXK2, FOXL2, FOXM1, FOXN4, FOXO3, FOXP2, FOXP3, FOXQ1, FOXS1, FUBP3, GABPA, GABPB1, GABPB2, GADD45A, GATA1, GATA2, GATA3, GATA4, GATA5, GATA6, GATAD2B, GBX2, GCFC2, GCM1, GFI1, GLI1, GLI2, GLI3, GLIS1, GLIS2, GLMP, GMEB1, GMEB2, GRHL1, GRHL2, GSC, GSX1, GTF2B, GTF3C1, GZF1, H2AFY, H2AFY2, H2AFZ, H3F3A, H3F3B, HAND1, HAND2, HDAC1, HDAC2, HDAC4, HDAC5, HDAC6, HELT, HES1, HES2, HES3, HES4, HES5, HES6, HES7, HESX1, HEY1, HEY2, HEYL, HHEX, HIC2, HIF1A, HINFP, HIVEP1, HLF, HLTF, HMGA1, HMGA2, HMGB1, HMGB2, HMX1, HMX3, HNF1A, HNF1B, HNF4A, HNF4G, HNRNPC, HNRNPK, HNRNPL, HNRNPU, HOXA10, HOXA2, HOXA3, HOXA4, HOXA5, HOXA6, HOXA7, HOXA9, HOXB1, HOXB2, HOXB3, HOXB4, HOXB5, HOXB6, HOXB7, HOXB9, HOXC10, HOXC11, HOXC4, HOXC5, HOXC6, HOXD10, HOXD13, HOXD3, HOXD4, HOXD8, HOXD9, HR, HSF1, HSF2, HSF4, HSF5, HSFX1, HSFX2, HSFX3, HSFX4, HSFY1, HSFY2, IER2, IFI16, IKZF1, IKZF2, IKZF3, IKZF4, IKZF5, INSM1, IRF1, IRF2, IRF2BP1, IRF2BP2, IRF2BPL, IRF3, IRF4, IRF5, IRF6, IRF7, IRF8, IRF9, ISL1, JARID2, JDP2, JMJD1C, JUN, JUNB, JUND, KAT2B, KAT7, KCNIP3, KDM1A, KDM2B, KDM3A, KDM3B, KDM5A, KDM6A, KDM6B, KLF1, KLF10, KLF11, KLF12, KLF13, KLF15, KLF16, KLF17, KLF3, KLF4, KLF5, KLF6, KLF7, KLF8, KMT2A, KMT2D, LDB1, LEF1, LHX2, LHX3, LITAF, LMO2, LMO4, LMX1A, LMX1B, LONP1, LRRFIP1, LYL1, MACC1, MAF, MAF1, MAFA, MAFB, MAFF, MAFG, MAFK, MAX, MAZ, MBD2, MBD3, MED1, MED12, MED8, MEF2A, MEF2B, MEF2C, MEF2D, MEIS1, MEIS2, MEN1, MEOX1, MEOX2, MESP1, MESP2, MITF, MIXL1, MLX, MLXIP, MLXIPL, MMP12, MNT, MRTFA, MSC, MSGN1, MSX1, MSX2, MTA1, MTA2, MTERF3, MTF1, MTF2, MTOR, MUC1, MXD1, MXD3, MXI1, MYB, MYBBP1A, MYBL1, MYBL2, MYC, MYCN, MYEF2, MYF5, MYF6, MYOCD, MYOD1, MYOG, MYPOP, MYT1, MYT1L, MZF1, NACC2, NANOG, NCOA2, NCOR1, NCOR2, NDN, NEUROD1, NEUROD2, NEUROD6, NEUROG1, NEUROG2, NEUROG3, NFAT5, NFATC1, NFATC2, NFATC3, NFATC4, NFE2, NFE2L1, NFE2L2, NFE2L3, NFIA, NFIB, NFIC, NFIL3, NFKB1, NFKB2, NFX1, NFXL1, NFYA, NFYB, NFYC, NHLH1, NHLH2, NKRF, NKX2-1, NKX2-2, NKX2-5, NKX2-6, NKX2-8, NKX3-1, NKX3-2, NKX6-1, NKX6-2, NLRC5, NME1, NONO, NOTCH1, NPAS2, NPAS4, NPM1, NR1D1, NR1D2, NR1H2, NR1H3, NR1H4, NR1I2, NR1I3, NR2C1, NR2C2, NR2E3, NR2F1, NR2F6, NR3C1, NR4A1, NR4A2, NR4A3, NR5A1, NR5A2, NR6A1, NRF1, NRIP1, NRL, NSD1, ONECUT2, ONECUT3, OSR1, OSR2, OTX1, OTX2, OVOL1, PARP1, PATZ1, PAX1, PAX2, PAX4, PAX5, PAX6, PAX8, PAX9, PAXBP1, PBX1, PBX2, PBX3, PCGF3, PCGF5, PCGF6, PDX1, PER1, PER2, PER3, PGR, PHB, PHOX2A, PHOX2B, PIH1D1, PITX1, PITX2, PITX3, PKNOX2, PLAG1, PLAGL1, POLRMT, POU1F1, POU2AF1, POU2F1, POU2F2, POU2F3, POU3F2, POU3F4, POU4F1, POU4F2, POU4F3, POU5F1, POU6F1, PPARA, PPARD, PPARG, PRDM1, PRDM11, PRDM12, PRDM13, PRDM14, PRDM15, PRDM2, PRDM4, PRDM5, PRDM6, PRDM7, PRDM9, PRDX5, PRKN, PRMT5, PROP1, PROX1, PRRX1, PSPC1, PTF1A, PURA, PURB, PURG, RAI1, RARA, RARB, RARG, RAX, RAX2, RB1, RBBP4, RBBP5, RBL1, RBL2, RBMX, RBPJ, RBPJL, RCOR1, RCOR2, RCOR3, REL, RELA, RELB, REST, RFX1, RFX2, RFX3, RFX4, RFX5, RFX6, RFX7, RFX8, RNF10, RORA, RORB, RORC, RPS3, RPTOR, RREB1, RRN3, RUNX1, RUNX2, RUNX3, RUVBL2, RXRA, RXRB, SAFB, SALL1, SALL2, SARS, SATB1, SATB2, SCRT1, SCRT2, SCX, SETX, SFPQ, SIN3A, SIRT1, SIX1, SIX2, SIX3, SIX4, SIX5, SIX6, SKIL, SMAD1, SMAD2, SMAD3, SMAD4, SMAD5, SMAD6, SMAD7, SMARCA2, SMARCA4, SMARCB1, SMARCC1, SMARCC2, SMARCD2, SMARCE1, SMYD3, SNAI1, SNAI2, SNAI3, SNCA, SOX1, SOX10, SOX11, SOX12, SOX13, SOX17, SOX18, SOX2, SOX21, SOX3, SOX4, SOX6, SOX7, SOX8, SOX9, SP1, SP2, SP3, SP5, SP7, SPI1, SPIB, SPIC, SREBF1, SREBF2, SRF, SSBP2, SSBP3, SSBP4, ST18, STAT1, STAT3, STAT5B, STAT6, STOX1, SUV39H1, SUV39H2, SUZ12, TAF1, TAF1B, TAF1C, TAF2, TAF5, TAF7, TAF7L, TAF9, TAF9B, TAL1, TAL2, TBL1X, TBL1XR1, TBP, TBPL1, TBPL2, TBR1, TBX15, TBX18, TBX19, TBX2, TBX20, TBX21, TBX22, TBX3, TBX5, TBX6, TBXT, TCF12, TCF15, TCF20, TCF21, TCF3, TCF4, TCF7, TCF7L1, TCF7L2, TCFL5, TEAD1, TEAD2, TEAD3, TEAD4, TEF, TFAM, TFAP2A, TFAP2B, TFAP2C, TFAP2D, TFAP2E, TFAP4, TFCP2, TFCP2L1, TFDP1, TFDP2, TFE3, TFEB, TFEC, TGIF1, THAP1, THAP11, THRA, THRAP3, THRB, TIPARP, TLX1, TNF, TOP1, TOX2, TOX3, TP53, TP63, TP73, TRERF1, TRIM24, TRPS1, TWIST1, TXK, UBTF, UHRF1, USP3, UTY, VAX1, VAX2, VDR, VEZF1, WBP2, WNT1, WNT11, WNT5A, WT1, XBP1, XRCC5, XRCC6, XRN2, YAP1, YBX1, YBX3, YY1, YY2, ZBED1, ZBTB14, ZBTB16, ZBTB17, ZBTB2, ZBTB20, ZBTB24, ZBTB4, ZBTB48, ZBTB5, ZBTB7A, ZBTB7B, ZC3H4, ZC3H6, ZC3H8, ZEB1, ZFHX2, ZFHX3, ZFHX4, ZFP42, ZFPM1, ZGPAT, ZHX3, ZIC1, ZIC2, ZIC3, ZIC4, ZIC5, ZKSCAN3, ZNF131, ZNF143, ZNF148, ZNF174, ZNF175, ZNF202, ZNF205, ZNF217, ZNF219, ZNF239, ZNF277, ZNF281, ZNF322, ZNF335, ZNF350, ZNF395, ZNF431, ZNF497, ZNF501, ZNF513, ZNF516, ZNF536, ZNF541, ZNF564, ZNF568, ZNF589, ZNF605, ZNF613, ZNF639, ZNF649, ZNF658, ZNF668, ZNF691, ZNF692, ZNF704, ZNF709, ZNF711, ZNF740, ZNF746, ZNF750, ZNF821, ZNF835, ZNF93, and ZSCAN21. Table 5 provides details relating to the SEQ ID NO: transcription factor specificity.

In some embodiments, the riboregulator is specific for STAT3 transcription factor, and it is used to detect and optionally measure the expression level of this transcription factor. Riboregulators specific for STAT3 are provided as SEQ ID NOs: 210632-210860.

Of particular interest are riboregulators having a nucleotide sequence selected from the group consisting of SEQ ID NOs: 164989, 111698, and 236638. Of particular interest are riboregulators that are specific for transcription factors NCOR1, E2F3 and ZNF175.

This disclosure refers to riboregulators that are specific for a particular virus or a particular transcription factor. This intends that the switch domain in such riboregulators is complementary to a nucleic acid sequence in or produced from the particular virus or to a nucleic acid coding for the particular transcription factor. The nucleic acid sequence in or produced from the particular virus or the nucleic acid coding for the particular transcription factor are considered triggers in this disclosure.

This disclosure contemplates variants of the riboregulators provided herein. For example, the disclosure contemplates variants that differ from the disclosed sequences by 1, 2, 3, 4 or 5 nucleotides, wherein such variants retain the ability to specifically hybridize to the original trigger of interest (i.e., the trigger of their parent riboregulator). Such variants may have a cell-free ON/OFF value that less than that of their parent riboregulator provided that such ON/OFF value is still suitable for use. The ON/OFF value may be for example 2, 3, 4, 5, or more.

The riboregulators may be defined by their strength, and this in turn may be defined by the level of expression of the coding domain in the presence (ON state) versus in the absence (OFF state) of the trigger nucleic acid. The riboregulators may have a cell-free ON/OFF value of about 2 to about 10, and may be further subdivided into those having an ON/OFF value of about 2 to about 5 and about 5 to about 8 and about 8 to about 10. In some instances, riboregulators with higher ON/OFF may be preferred. The ON/OFF of an individual riboregulator in a cell-free system may be determined as described in the Examples.

Applications/Uses

The riboregulators may be used in a number of applications. For example, they may be used to detect presence of nucleic acid such as an RNA in a sample, and such a method may comprise combining any one or a combination (e.g., 2) of the toehold riboregulators provided herein with a sample, wherein the riboregulator comprises a switch domain including a single-stranded toehold domain that is complementary to a nucleic acid (e.g., an RNA) in the sample, such as a nucleic acid encoding a transcription factor a viral protein (e.g., a transcription factor RNA or a viral RNA). The riboregulator comprises a coding domain that encodes a reporter protein, under conditions that allow translation of the coding domain in the presence of the nucleic acid (e.g., RNA) of interest but not in the absence of such nucleic acid (e.g., RNA). The method further comprises detecting the reporter protein as an indicator (or surrogate) of the nucleic acid (e.g., RNA) of interest. As used herein, conditions that allow translation of the coding domain are conditions that include all the necessary machinery to produce a protein from an RNA such as but not limited to ribosomes, tRNAs, and the like.

Samples to be tested include samples obtained from a subject. The subject may be a human or a non-human.

In some instances, the subject is a subject having, suspected of having, or at risk of having a condition associated with the presence of a particular viral nucleic acid (e.g., a viral RNA) such as an infection by one of the viruses listed above. Thus, for example, the subject may be a subject having, suspected of having, or at risk of having an astrovirus infection, a cardiovirus infection, a chikungunya virus infection, a cosavirus infection, a coxsackie virus infection, a dengue virus infection, an ebola virus infection, a hanta-virus infection, a human immunodeficiency virus infection, a human parvo virus infection, a human rhino virus infection, an influenza h1n1 virus infection, an influenza h3n2 virus infection, a lassa virus infection, a leishmanial virus infection, a Marburg virus infection, a papilloma virus infection, a polio virus infection, a rabies virus infection, a smallpox virus infection, a west nile virus infection, a yellow fever virus infection, or a zika virus infection.

In some instances, the subject is a subject having, suspected of having, or at risk of having a condition associated with the presence and optionally increased expression of a particular human transcription factor from the list provided herein. A condition associated with the presence and optionally increased expression of a particular human transcription factor from the list provided herein is cancer.

In some embodiments, the transcription factor is STAT3 and the cancer is epithelial cancer such as squamous cell carcinoma of the head and neck, breast, ovary, prostate or lung cancer. In some embodiments, the cancer is intrahepatic cholangiocarcinoma. The presence and/or expression level of STAT3 may be used to diagnose or to prognose a particular cancer.

In some instances, the disclosure contemplates use of more than one virus-specific riboregulator. For example, some methods may involve contacting a sample with a plurality of virus-specific riboregulators in order to detect the presence of a plurality of viruses at the same time, or at least to test for the presence of a plurality of viruses at the same time. In this way, a single sample may be used and screened for the presence of a number of viruses. In order to distinguish which virus(es) are present in the sample, the riboregulators may be distinguished from each other based on the reporter protein to which they are operably linked. For example, GFP may be used as the reporter protein for HIV specific riboregulators.

The disclosure further contemplates that one or more riboregulators specific for the same virus may be used together. This may help with increasing the sensitivity of the detection assay. For example, riboregulators having SEQ ID Nos: 43841 and 62866 may be used together to detect smallpox virus. In some instances, the riboregulators are physically separate and drive translation of their respective reporter protein. In other instances, the riboregulators are physically attached, for example as an AND or an OR gate, and may contributed collectively to translation of a single reporter protein. Reference can be made to published PCT application WO 2014/074648 for a discussion of AND OR gates in the context of concatenated riboregulators.

In some embodiments, the riboregulator is operably linked to a coding domain that encodes a suicide gene (or suicide protein). In this way, the riboregulator can be used to selectively kill cells that are infected with a particular virus selected from the list provided herein. Alternatively, the riboregulator can be used to selectively kill cells that have increased expression of a particular transcription factor, such as STAT3, and which may therefore be cancer cells or pre-cancerous cells. An exemplary suicide gene is thymidylate synthase, and a subject is administered ganciclovir following production of the thymidylate synthase. In some embodiments, the suicide gene is herpes simplex virus type 1 thymidine kinase (HSV1-TK).

The riboregulators may be used to detect targets of interest such as viruses, and thus diagnose exposure to or infection by such viruses. The riboregulators may be used with an unmanipulated sample. Alternatively, the sample may be processed prior to contact with the riboregulator. For example, the sample may processed in order to extract RNA. Additionally or alternatively, the sample may be process to amplify RNA.

There are various techniques, including isothermal techniques, for amplifying nucleic acids such as RNA. One such method, referred to as nucleic acid sequence based amplification (NASBA)-mediated RNA amplification, is described by Pardee et al. Cell, 165:1255-1266, 2016. For example, RNA may be amplified using a method that comprises reverse transcription of a target RNA of interest using a sequence-specific reverse primer to form an RNA/DNA duplex. This duplex is then contacted with RNase H to degrade the RNA template. A forward primer having a T7 promoter is then introduced and allowed to bind and initiate elongation from the complementary strand, to form a double-stranded DNA product. T7-mediated transcription is then used to generate copies of the target RNA. NASBA is initiated at a higher temperature (e.g., about 65° C.) and then followed by isothermal amplification at about 41° C.

When used together, the isothermal RNA amplification and riboregulator-mediated detection steps provide a relatively low-cost and low-resource detection strategy.

The step of contacting the sample with the riboregulator can be performed in solution. Alternatively it can be performed in a paper-based form, as described by Pardee et al. Cell, 165:1255-1266, 2016.

EXAMPLES

In order that the invention described herein may be more fully understood, the following examples are set forth. It should be understood that these examples are for illustrative purposes only and are not to be construed as limiting this invention in any manner.

Engineered RNA modules are programmable elements capable of detecting small molecules, proteins, and nucleic acids. While useful, predicting the behavior of these tools remains a challenge, a situation that could be addressed through enhanced pattern recognition from deep learning. Thus, we investigate Deep Neural Networks (DNN) to predict toehold switch function as a canonical riboswitch model in synthetic biology. To facilitate DNN training, we synthesized and characterized in vivo a dataset of 91,534 toehold switches spanning 23 viral genomes and 906 human transcription factors. DNNs trained on nucleotide sequences ($R^2=0.43$) outperformed previous state-of-the-art thermodynamic and kinetic models ($R^2=0.0001-0.04$) and allowed for human-understandable attention-visualizations (VIS4Map) to identify failure modes. This deep learning pipeline constitutes a major step forward in engineering and understanding of RNA synthetic biology.

Materials and Methods

Toehold Switch Architecture Selection

The first-generation toehold switch architecture from Green et al. (SI-1) was selected in order to maximize the sequence variability in switch regions contributing to secondary structure. Where in later designs the trigger RNA only unwound a fraction of the stem (SI-1-3), in this earlier design the entire hairpin stem was variably complementary to the trigger, increasing the diversity of characterized RNA hairpins (FIG. 1A). An alternative fused ON state was also utilized. Normally, toehold switches detect the presence of a separate trigger RNA transcribed in trans to the OFF-state switch mRNA. However, for the testing of a large library of toehold-switch pairings, a two-plasmid system becomes intractable because each switch is designed around a specific cognate trigger. A two-plasmid system can also increase stochasticity caused by copy number variability. Green et al. (SI-1) found a strong positive correlation between conditions when the trigger is fused to the switch and conditions when un-fused, separate triggers are transcribed in excess. We confirmed this correlation ourselves on a subset of twenty toehold switches by comparing the signal from the alternative fused ON state used in our library to the measured ON/OFF from Green et al. (SI-1). Green et al have stated that due to a low switch plasmid copy number their OFF state rarely exceeded background autofluorescence, meaning that their reported ON/OFF ratios are essentially ON state measurements. The resulting comparison of signal from the alternative fused ON state we measured and the un-fused ON state measured by Green et al using a two-plasmid system resulted in a Pearson R=0.8567, as seen in FIG. 6B. Thus, the ON state of the switch can be reliably approximated by fusing the trigger RNA to the 5' end of the switch mRNA using a constant, unstructured linker sequence (FIG. 1A, 6A), allowing for the direct synthesis of trigger-switch cognates on a single plasmid.

Library Trigger Sequence Selection

Viral genomes were obtained on Nov. 6, 2018, from the NCBI/NIH website (genome/viruses). Each retrieved genome was tiled 30 bp at a time (the trigger length), with a stride of 5 bp, spanning the respective genome. Human transcription factors were obtained using ENSEMBL 94 BioMart (SI-4) utilizing the Gene Ontology term GO:0044212 (transcription regulatory region DNA binding). The coding region of each transcription factor was tiled 30 bp at a time with a stride of 10. A remaining portion of the designs (~10,000) was based on random 30 bp triggers.

Toehold Library Synthesis

We designed 244,000 toehold switch variants using 230 bp oligos, which were ordered and synthesized by Agilent. For each toehold switch variant, the oligo was designed containing the following sequence components in order from 5' to 3': 20 nt of common backbone, a T7 Promoter, the 30 nt Trigger sequence, a 20 nt unstructured Linker, the 12 nt Toehold, the 18 nt Ascending Stem, a 11 nt SD-containing Loop, the 18 nt Descending Stem including the start codon, a 21 nt AA-Linker, and the first 15 nt of the GFP gene. A schematic of the design can be found in FIG. 6A. In the previous validation of the fused trigger approach by Green et al. (SI-1), only part of the trigger was fused to avoid recombination of long repeated sequences, but the nature of our flow-seq pipeline allowed us to avoid this issue since the integrity of all variants was confirmed after measuring fluorescence through next-generation sequencing (NGS). The oligos were received at a stock amount of 10 pmol, which we diluted in 500 uL TE buffer for a working concentration of 20 nM. Of this working stock, 0.25 uL was used in 50 uL qPCR reactions using NEB Q5 polymerase 2×MM with 50 nM final concentration of appropriate primers. Two separate amplifications were done from the working stock of the oligo library for the ON and OFF states, respectively. One amplification, for the ON state, used a primer hybridizing to the 5' common backbone region. The resulting insert contained both the Switch RNA module and the Trigger attached to its 5' end. The second amplification, for the OFF state, used a primer hybridizing to the 20 nt unstructured Linker and included a T7 promoter and the 5' common backbone region in its tail. The OFF-state insert contained only the Switch RNA module without the Trigger module attached. See FIG. 6A for a full schematic of the amplification scheme. A third amplification linearized a ColE1 plasmid backbone for subsequent ligation. This backbone was the same ColE1 backbone as was used in Green et al. (SI-1) for transcribing trigger RNAs, but with a GFPmut3b-ASV gene inserted. All amplicons were cleaned from their reaction buffers by using carboxyl-coated magnetic beads (SI-5) (protocol 4.3): 1× concentration of beads to clean the longer linear backbone product, and 2× bead concentration to clean the smaller insert products. Both inserts were ligated separately into the ColE1 backbone in front of the GFPmut3b-ASV gene using golden gate cloning, as follows. The linearized plasmid backbone was diluted to 500 ng total mass. The ON or OFF insert was added according to a 1:1 molar ratio of insert to plasmid backbone. The inserts and backbone dilutions were prepared into 50 uL ligation reaction volumes, containing 5 uL NEB buffer 3.1, 5 uL T4 ligase buffer, 1 uL BsmBI, 0.5 uL Dpn1, 1 uL T4 ligase, and any remaining volume with nuclease-free water. The 50 uL reaction was placed into a thermocycler for 100 cycles of two steps: 16 C for 10 min and 37 C for 10 min. A final enzyme inactivation step at 65 C for 15 min was done. The ligation products were precipitated out of their reaction buffers using ethanol precipitation. The 50 uL ligation reactions were added to 1.5 mL Eppendorf tubes containing 150 uL of pure ethanol, 5 uL 0.3M sodium acetate (pH 5.2), and 1 uL glycoblue. Tubes were left on dry ice for 20 min and then immediately placed in a 4 C tabletop centrifuge and spun at max RPM for 30 min. Tubes were decanted, and 175 uL of 70% ethanol was added to the tube containing the pellet. Tubes were spun at max speed for 5 min. Tubes were then removed from the centrifuge, decanted, and allowed to dry for 15 min. Ligation products were then eluted in 4 uL TE buffer. For initial library transformation, 50 uL EclonI Supreme cells were given the full 4 uL ligation product elution and electro-transformed. Transformation efficiencies exceeding $10^7$ CFU/mL were achieved, and the expanded cells were harvested using a MaxiPrep kit (Qiagen). The resulting pool of plasmids was then electroporated into BL21 star *E. coli*, where transformation efficiencies exceeding $10^6$ were achieved.

Flow-Seq Pipeline

Induction was achieved by expanding BL21 cells overnight at 37 C in LB media with carbenicillin (carb) selection and then diluted 50× into fresh media. After the cells reached OD600 of 0.3 at 37 C (~2 hours of growth), 0.2 mM IPTG was added, and the cells were allowed to express for another 3 hours at 37 C. The cells were then moved to room temperature and sorted on a Sony SH800 FACS machine with four bins. A positive control consisting of Switch #4 from Green et al. (SI-1), one of the highest performing switches from that study's first-generation design, was cloned both in its OFF state and in the modified fused-trigger ON state. This positive control switch was then used to mark the highest and middle bins of GFP signal, while a negative control consisting of a pUC19 plasmid (containing no GFP) was used to mark the lowest bin of GFP signal (FIG. 7). Approximately 40 million events were sorted for each library. Cells in collected bins were diluted 10× into fresh LB media with carb selection and allowed to expand overnight at 30 C. The expanded cells were then harvested using a MaxiPrep kit (Qiagen).

Deep Sequencing, Read Data Processing and Read Count Analysis

Plasmid collected from sorted cells was amplified using NEB Q5 polymerase 2×MM and primers targeting the common backbone region upstream and downstream of the variable toehold region. The resulting 184 bp (OFF) or 224 bp (ON) PCR products were then analyzed by NGS using a MiSeq or NextSeq instrument (Illumina). Raw paired-end sequencing reads were quality filtered and merged with PEAR 0.9.1. Only sequences matching our intended designs were retained for further analysis. For the ON and OFF libraries, respectively, 10,390,207 reads and 20,788,966 reads were mapped to a correct switch sequence. The individual fluorescence distribution of the ON and OFF state for each switch was measured by calculating its frequency in each bin and assigning a normalized signal metric in the range of [0,1] (FIGS. 1C, D). An ON/OFF metric was calculated as the difference between the ON and OFF signal metrics independently (FIG. 1E). Frequencies of each variant were tabulated for each cell-sorted bin and normalized to the total reads per bin. Each variant's functional value was computed as the weighted mean of its normalized frequencies across all bins, scaled between 0 and 1. The ON/OFF ratios were then calculated as the subtracted difference between ON and OFF (since the fluorescence data had been collected on a logarithmic scale), resulting in a range scaled between −1 and 1.

Library Quality Control

A second biological replicate of our flow-seq pipeline was carried out that produced 60,800 ON measurements, 98,295 OFF measurements, and 30,101 ON/OFF ratio measurements where both ON and OFF were available for the same switch. The $R^2$ and MAE between our two datasets were calculated at different read count thresholds. Based on the results (FIGS. 8A-B), five different QC thresholds were established, some of which also included standard deviation cutoffs (Table 1, FIG. 18). QC1 and QC2 contained OFF data with significantly worse $R^2$ compared to QC3, QC4, and QC5, but only QC1 contained OFF data with worse MAE. We determined that the inter-replicate drop in $R^2$ for OFF values was mainly due to the skewness of the data—indeed, the OFF data consistently showed worse $R^2$ values than the ON data throughout the paper, despite having consistently better MAE values. Therefore, we chose to trust in the inter-replicate MAE values more than the inter-replicate $R^2$ metric for the OFF data.

To further evaluate the different QC levels, the most stringent data (QC5) were withheld as a test set, and an MLP fed a one-hot representation of the toehold sequence was trained on the four lower QC levels. The results for both predictive $R^2$ and MAE showed QC1 to be of significantly inferior quality, but QC2, QC3, and QC4 to be of roughly similar quality (FIG. 9). This result was consistent with the fact that inter-replicate MAE was notably worse at the QC1 count threshold but essentially unchanged across the read count thresholds contained by QC2, QC3, and QC4. The QC2 dataset gave the best predictive results by a small margin and was also significantly larger than QC3 or QC4 (Table 1). With these analyses in mind, QC2 was chosen as the final threshold for inclusion in our dataset. Within the measured ON/OFF ratios in the QC2 dataset, 40,824 had triggers of viral origin, 47,005 had triggers of human origin, and 3,705 had randomly generated trigger sequences.

Cell-Free Switch Validation

Eight of the best switches and eight of the worst switches were synthesized as PCR products, as previously described (SI-2). Briefly, they were ordered as single Ultramer oligos (IDT) without the Trigger fused, from the T7 promoter to the first 36 nt of the common linker and GFP sequences. These were added to a GFP gene by a single PCR amplification step. Triggers were in vitro transcribed from separate oligos that contained the antisense sequence and the antisense T7 promoter, to which the sense strand of the T7 promoter was annealed. Trigger RNA was purified using an RNA Clean &

Concentrator kit (Zymo), while Switch DNA was purified using a MinElute kit (Qiagen). To a 5 uL PURExpress reaction were added 2 U/uL Murine RNAse Inh, 5 nM of Toehold Switch PCR product, and either no Trigger RNA or 10 uM of Trigger RNA. Measurements of GFP velocity can be found in FIG. 10. The exact Switches tested and their library assay measurements can be found in Table 2.

Calculations Made with ViennaRNA, Kinfold, and the RBS Calculator

All thermodynamic MFE and ensemble defect calculations, as well as kinetic Kinfold calculations, were obtained using a custom-made python code including libraries from packages such as Biopython (Ref: github.com/biopython/biopython), ViennaRNA (Ref: github.com/ViennaRNA/ViennaRNA), RNAsketch (Ref: github.com/ViennaRNA/RNAsketch) and Pysster (Ref: github.com/budach/pysster). Calculations of thermodynamic rational parameters to include in our database were obtained from toehold RNA sequences by taking each basal 145-nucleotide toehold sequence and then isolating different sections (e.g., GGG, Trigger, Loop1, Switch, Loop2, Stem1, AUG, Stem2, Linker, Post-linker) into distinct sub-sequences with biological relevance for functional analysis (see FIG. 6A, Table 4). Minimum Free Energy (MFE) was calculated for all these sections using the previously reported python-based ViennaRNA Library. MFE calculation using ViennaRNA also specifies a secondary structure in dot-parens-plus notation (unpaired base=dot, base-pair=matching parentheses, and nick between strands=plus). Ideal structures are assumed to be connected and free of pseudoknots. These ideal secondary structures for such sections are:

SwitchOFF='... (((((((((... (((((... ))))))... )))))))))'
SwitchOFF_GFP=' ... (((((((((... (((((... ))))-)) ... ))))))))) ... (((... (((((... ))))) ... ))) ... '
SwitchOFF_NoTo='((((((((... (((((... )))))) ... ))))))-))) ... (((... (((((... ))))) ... ))) ... '
SwitchON=' ... ((((((((((((((((((((((((... ))))-))))))))))))))))))))))) ... '
SwitchON_GFP=' ... (((((((((((((((((((((... ... ))))))))))))))))))))))) ... (((... (((((... )))-)) ... ))) ... '
ToeholdON=' ... (((((((((((... ))))))))))))'
Stem='((((((((... (((((... )))))) ... )))))))))'
StemTop='(((((... ))))))'

Ensemble defect as a rational parameter was calculated via ViennaRNA/NUPACK for each of the toehold switches in the above subsets of sequence regions: SwitchOFF, SwitchOFF_GFP, Switch_OFF_NoTo, SwitchON, SwitchON_GFP, ToeholdON, Stem, StemTop. This calculation used both the native (calculated from MFE) and the ideal (predefined above) dot-Bracket representation for each sequence to assess the average number of nucleotides that are incorrectly paired at equilibrium. Thirty rational parameters were calculated for each toehold using these methods (fourteen MFE values, eight ideal ensemble defect values, and eight native ensemble defect values).

Figures 12A, 12B:
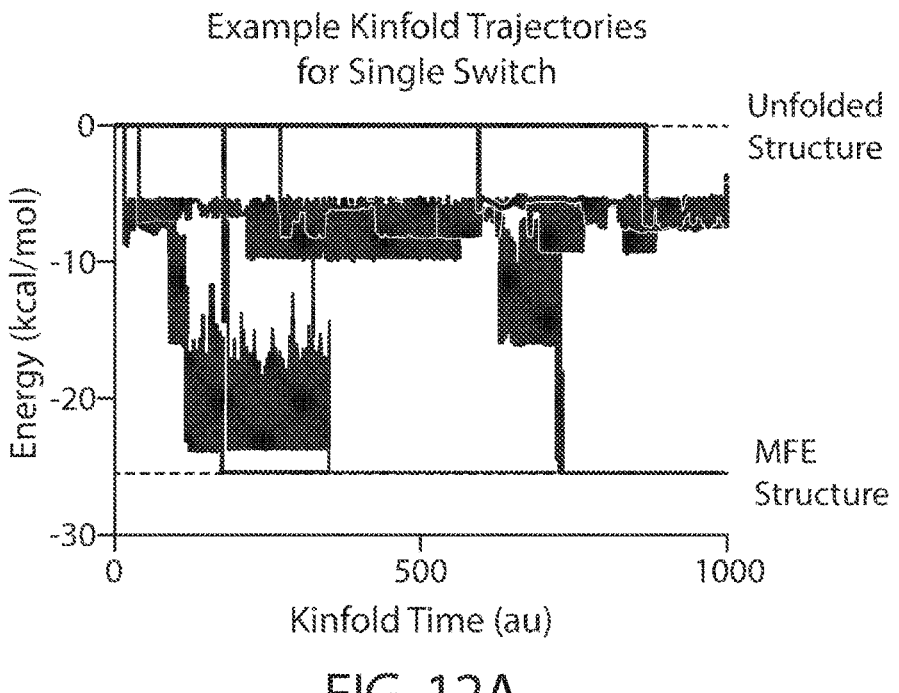
Figure 12C:
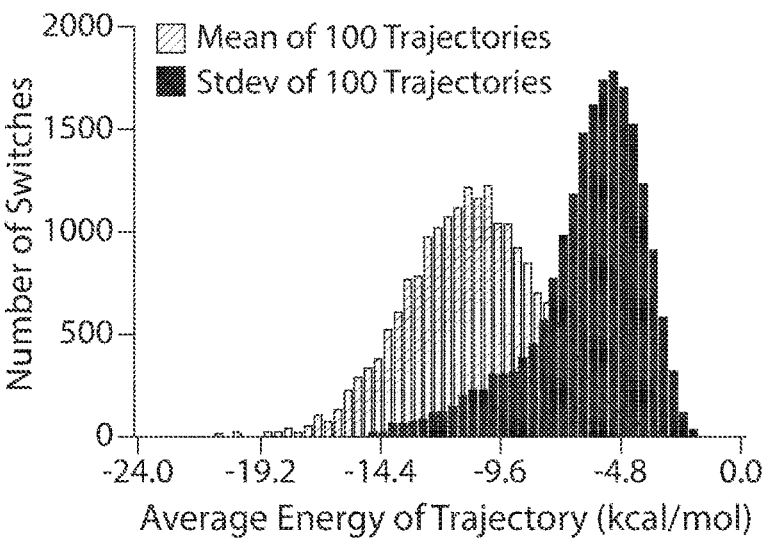
Figure 12D:
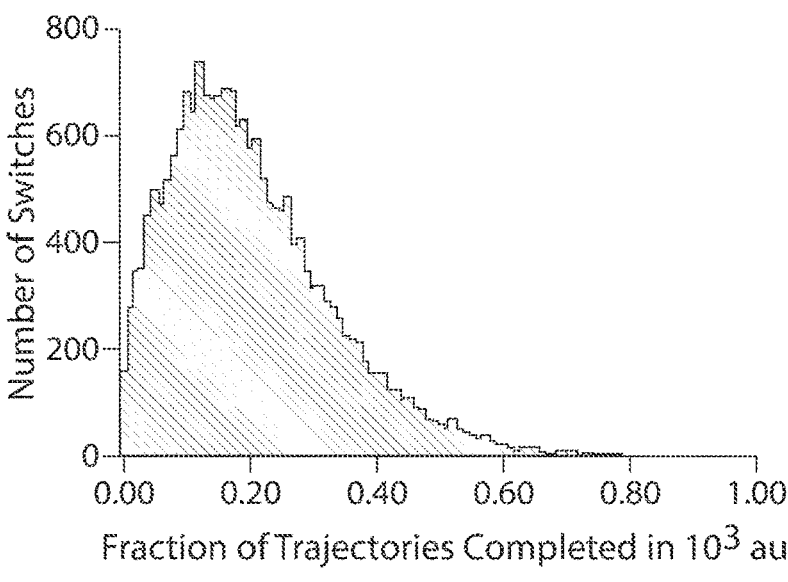

Kinetic analyses using Kinfold were run from the ViennaRNA package. The OFF-switch sequence was selected, spanning nucleotides 50 to 134 in Table 4 from the start of the toehold to the end of the linker. Due to the large size of the toehold switch RBS, Kinfold trajectories ran for 100-1000× longer than for RBS's previously analyzed relating to the RBS calculator in Borujeni et al. (SI-6) (FIG. 12B). Hence our analysis was scaled down to the QC4 dataset (containing 19,983 total switches), with 100 Kinfold trajectories run for each switch with a maximum stopping time of $10^3$ arbitrary Kinfold units (au). The energy and time at each step of each trajectory were recorded. If the MFE structure was reached within $10^3$ au, it was assumed that the RNA would remain in the MFE structure for the rest of the $10^3$ au timeframe. From each energy trajectory spanning $10^3$ au, the average energy (in kcal/mol) was calculated by integrating the energy-time curve and dividing by $10^3$. For each switch, the following features were extracted: the mean and standard deviation of the average energy of its 100 sampled trajectories (FIG. 12C), the ratio of the mean average energy to the MFE (FIG. 12E), and the fraction of trajectories that reached the MFE structure within the analyzed $10^3$ timeframe (FIG. 12D).

For predictions by the RBS Calculator, an API was used to access the most recent publicly available version (2.1). Due to limiting computational costs, the QC3 dataset was used instead of the QC2 dataset. For each switch, the translation initiation rate (TIR) of the on-target start codon was predicted for both the ON and OFF states ("SwitchON_GFP" and "SwitchOFF_GFP" respectively in Table 4).

K-Mer Motif Search

Figure 3A:
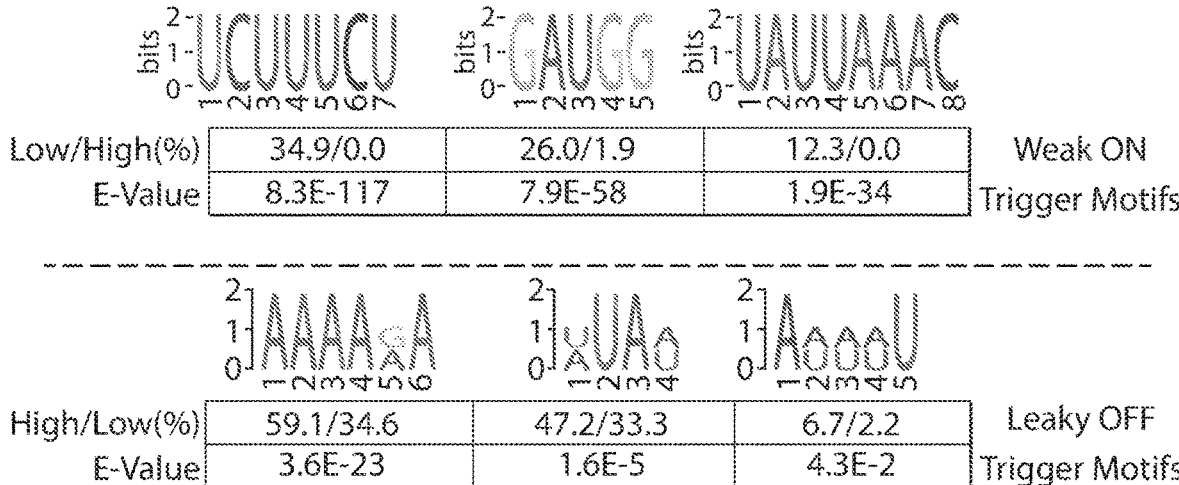

In order to compare sequence-level motifs between the best and worst variants measured in our dataset, we performed a k-mer search for over-represented sequence motifs at the tails of our observed functional values. We first filtered the variants for high quality, retaining those with a QC4 score or above. We then took the top and bottom 1,000 variants based on the ON and OFF functional values, respectively. We utilized DREME (SI-7) to test for enrichment or depletion of all possible subsequences of length 3-16 bases, using the indicated foreground and background frequencies. All results above the default E-value cutoff are shown (FIG. 3A, Table 3)

Deep Learning Model Architectures

MLP—Rational Features

The multilayer perceptron (MLP) model based on rational features included a 30-feature input followed by three dense fully connected layers of 25, 10, and 7 neurons, respectively, with rectified linear unit (ReLU) activation, batch normalization, and 20% dropout. This network was then fed to a final three-neuron layer (ON, OFF, ON/OFF) with linear activation for regression output, or to a final two-neuron layer (ON/OFF: binarized at +/−0.7) with softmax activation for classification output.

MLP—OneHot Seq

The MLP model based on the one-hot encoded full 145-nucleotide sequence input was achieved by using a flatten layer followed by three dense layers with ReLU activation, batch normalization, and 20% dropout. Dense layers used 128, 64, and 32 neurons, respectively. This network was then fed to a final three-neuron layer (ON, OFF, ON/OFF) with linear activation for regression output, or to a final two-neuron layer (ON/OFF: binarized at +/−0.7) with softmax activation for classification output.

MLP—Hybrid Rational Features/OneHot Seq

The ensemble MLP model was based on the rational features, as well as a one-hot encoded full 145-nucleotide sequence as input. To construct this model, two networks were assembled in parallel. The first network uses the same architecture for the MLP model with rational features, while the second network used the architecture of the MLP model for one-hot encoded 145-nucleotide sequences. Both networks were then concatenated and connected to a four-neuron dense fully connected layers with ReLU activation. This network was then fed to a final three-neuron layer (ON, OFF, ON/OFF) with linear activation for regression output, or to a final two-neuron layer (ON/OFF: binarized at +/−0.7) with softmax activation for classification output.

CNN—OneHot Seq

The Convolutional Neural Network (CNN) model based on the one-hot encoded full 145-nucleotide sequence as input was achieved by direct feeding of the input to three convolutional layers with ReLU activation, batch normalization, and 20% dropout. The convolutional layers used had 32, 64, and 128 filters of size 3, respectively. Same-padding was used with L1 and L2 kernel regularization. The output from the convolutional layers was flattened and fed to two fully connected sequential dense layers of 16 neurons each with ReLU activation, batch normalization, and 20% dropout. This network was then fed to a final three-neuron layer (ON, OFF, ON/OFF) with linear activation for regression output, or to a final two-neuron layer (ON/OFF: binarized at +/−0.7) with softmax activation for classification output.

CNN—2D Complementarity Map

The Convolutional Neural Network (CNN) model based on the one-hot encoded categorical 2D complementarity-directional matrix from the full 145-nucleotide sequence as input was achieved by direct feeding of the input to three convolutional layers with ReLU activation, batch normalization, and 30% dropout. The convolutional layers used had 32, 64, and 128 filters of size 5×5 respectively. Same-padding was used with L1 and L2 kernel regularization. The output from the convolutional layers was flattened and fed to two fully connected sequential dense layers of 16 neurons each with ReLU activation, batch normalization, and 20% dropout. This network was then fed to a final three-neuron layer (ON, OFF, ON/OFF) with linear activation for regression output, or to a final two-neuron layer (ON/OFF: binarized at +/−0.7) with softmax activation for classification output.

LSTM—OneHot Seq

The Long Short-Term Memory (LSTM) recurrent neural network model on the one-hot encoded full 145-nucleotide sequence as input was achieved by direct feeding of the input to a network with 128 recurrent units. The output of this was then connected to 100-neuron fully connected dense layer with ReLU activation, followed by batch normalization and 30% dropout. This network was then fed to a final three-neuron layer (ON, OFF, ON/OFF) with linear activation for regression output, or to a final two-neuron layer (ON/OFF: binarized at +/−0.7) with softmax activation for classification output.

All models were trained using a maximum of 300 epochs, considering a 20-epoch early stopping patience, which gets triggered upon lack of model improvement on the validation set. Batch size for all models was 64*(1+ngpus), where ngpus is defined as the number of used graphic processing units during model training. All trained regression models were verified for reported metrics using 10-fold cross-validation, while classification-trained models were evaluated on three shuffled test sets as indicated.

Complementarity Matrix and VIS4Map

Complementary maps were defined as a One-Hot Encoded Categorical 2D Complementarity-directional Matrix (total number of tensor dimensions=3) constructed by defining columns and rows of the matrix as the position of potential complementarity between any two given pairs of nucleotides in a single RNA sequence. The value in each position is defined as a one-hot encoded categorical variable according to the Watson-Crick pairing of the two nucleotides defining that position. Nucleotide pairings are assigned the following category: G-C (6)=[0 0 0 0 0 1], C-G (5)=[0 0 0 0 0 1 0], A-U (4)=[0 0 0 0 1 0 0], U-A (3)=[0 0 0 1 0 0 0], G-U (2)=[0 0 1 0 0 0 0], U-G (1)=[0 1 0 0 0 0 0], NonWCpairs (0)=[1 0 0 0 0 0 0]. VIS4Maps were generated using a modified algorithm, attention, activation maximization and saliency map visualization for Keras (Keras-Vis, Ref: github.com/raghakot/keras-vis) with tensorflow backend.

In this case, gradients were calculated from a regression model for all regions of the image to visualize what spatial features cause the predicted output to increase. To visualize the toehold regions that are mostly responsible for each prediction, small positive or negative gradients are highlighted using a normalization strategy. Given this information, such techniques allow us to generate heatmap-encoded saliency map images that spatially relate to the toehold regions in the complementarity map that lead to accurate predictions.

Results

Engineered ribonucleic acid (RNA) molecules with targeted biological functions play an important role in synthetic biology (1), particularly as programmable response elements for small molecules, proteins, and nucleic acids. Examples include riboswitches, riboregulators, and ribozymes, many of which hold great promise for a variety of in vitro and in vivo applications (1, 2). Despite their appeal, the design and validation of this emerging class of synthetic biology modules have proven challenging due to variability in function that remains difficult to predict (2-9). Current efforts aiming to unveil fundamental relationships between RNA sequence, structure, and behavior focus mostly on mechanistic thermodynamic modeling and low-throughput experimentation, which often fail to deliver sufficiently predictive and actionable information to aid in the design of complex RNA tools (2-9). Deep learning, by contrast, constitutes a set of computational techniques well suited for pattern recognition in complex and highly combinatorial biological problems (10-14), such as the sequence design space of RNA tools. However, the application of deep learning to predicting function in RNA synthetic biology has been limited by a notable scarcity of datasets large enough to effectively train deep neural networks. Toehold switches, in particular, represent a canonical RNA element in synthetic biology that could greatly benefit from deep learning approaches to better predict function and elucidate useful design rules.

Toehold switches are a class of versatile prokaryotic riboregulators inducible by the presence of a fully programmable trans-RNA trigger sequence (2-6, 15, 16). These RNA synthetic biology modules have displayed impressive dynamic range and orthogonality when used both in vivo as genetic circuit components (2, 5, 6), and in vitro as nucleic acid diagnostic tools using cell-free protein synthesis (CFPS) systems (3, 4, 15, 16). Similar to other RNA synthetic biology tools, a substantial fraction of toehold switches show poor to no measurable function when tested experimentally, and while efforts have been made to establish rational, mechanistic rules for improved performance based on low-throughput datasets (2-9, 15, 16), the practical utility of these approaches remains inconclusive. Thus, considering the wide applicability and general challenges of toehold switch design, our objective in this study was to develop a deep learning platform to predict toehold switch function as a canonical RNA switch model in synthetic biology.

To achieve this goal, we first aimed to expand the size of available toehold datasets using a high-throughput DNA synthesis and sequencing pipeline to characterize over $10^5$ new toehold switches. We then used this comprehensive new dataset to demonstrate that deep neural networks trained directly on switch RNA sequences can outperform rational thermodynamic and kinetic analyses to predict toehold switch function. Furthermore, we enhanced the transparency of our deep learning approach by utilizing a nucleotide (nt) complementarity matrix input representation to visualize learned secondary structure patterns in selected models. This attention-visualization technique, which we term VIS4Map (Visualizing Secondary Structure Saliency Maps), allowed us to identify RNA module failure modes by discovering secondary structures that our deep learning model used to accurately predict toehold switch function. The resulting dataset, models, and visualization analysis (FIG. 1) represent a substantial step forward for the validation and interpretability of high-throughput approaches to designing RNA synthetic biology tools, surpassing the limits of current mechanistic RNA secondary structure modeling.

Library Synthesis, Characterization, and Validation

As mentioned previously, a fundamental hurdle in applying deep learning techniques to RNA synthetic biology systems is the limited size of currently published datasets, which are notably smaller than typical dataset sizes required for training of deep network architectures in other fields (10, 17-21). For example, to date, less than 1000 total toehold switches have been designed and tested (2-6, 9, 15, 16), a situation that currently limits the synthetic biology community's ability to utilize deep learning techniques for analysis of this type of response molecules. Therefore, towards improving our understanding and ability to predict new functional RNA-based response elements, we first set out to synthesize and characterize an extensive in vivo library of toehold switches using a high-throughput flow-seq pipeline (22) for subsequent exploration using various machine learning and deep learning architectures.

Figures 2A, 2B:
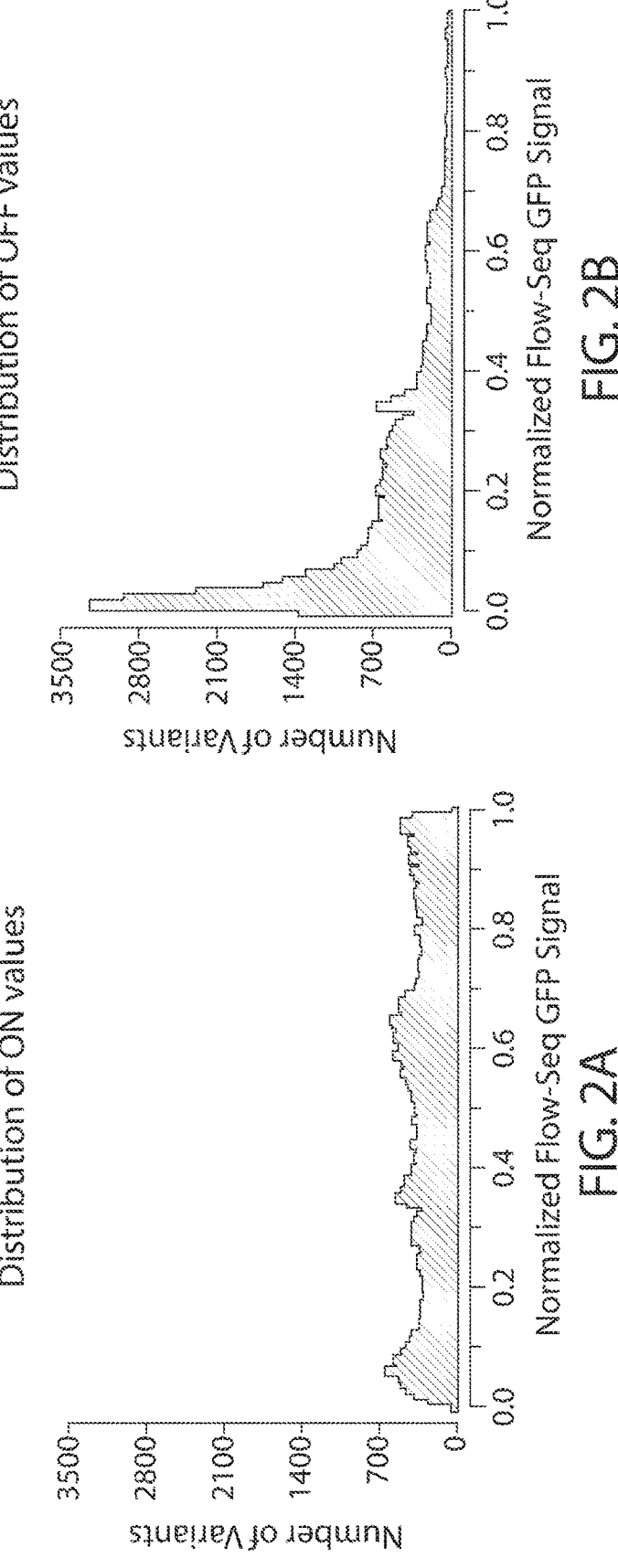
FIGS. 2A-F. Flow-seq toehold switch library characterization and trigger ontology. The distribution of recovered toeholds for (A) ON-state signals, (B) OFF-state signals, and (C) calculated ON/OFF ratios are shown (selected from quality control process #3, QC3 in FIG. 18 and Table 1). (D) Validation results for toehold switches expressed in a PUR-Express cell-free system with un-fused trigger RNA, including eight low-performing (poor, ON/OFF <0.05) and eight high-performing (good, ON/OFF >0.97) samples. Obtained flow-seq data show competency in performance-based switch classification within this distinct biological context.
Figures 2C, 2D:
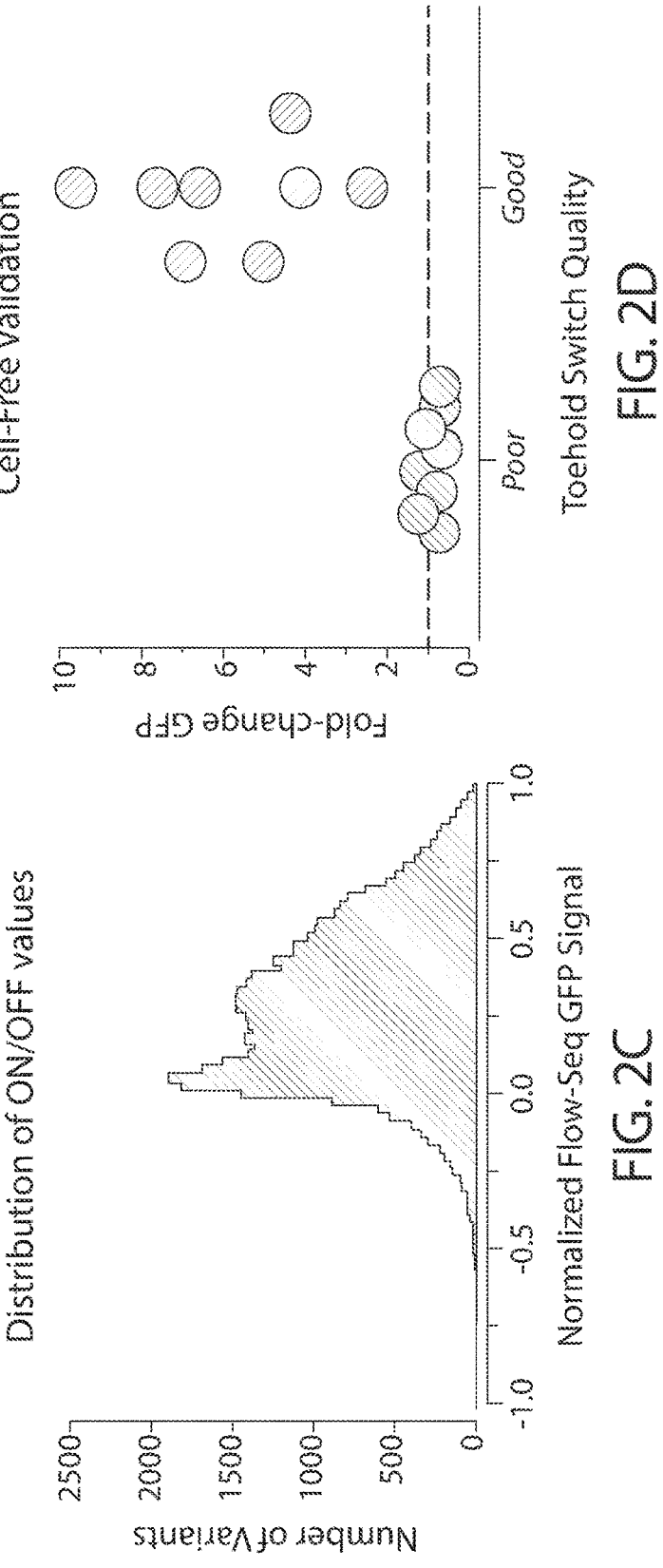
Figure 2E:
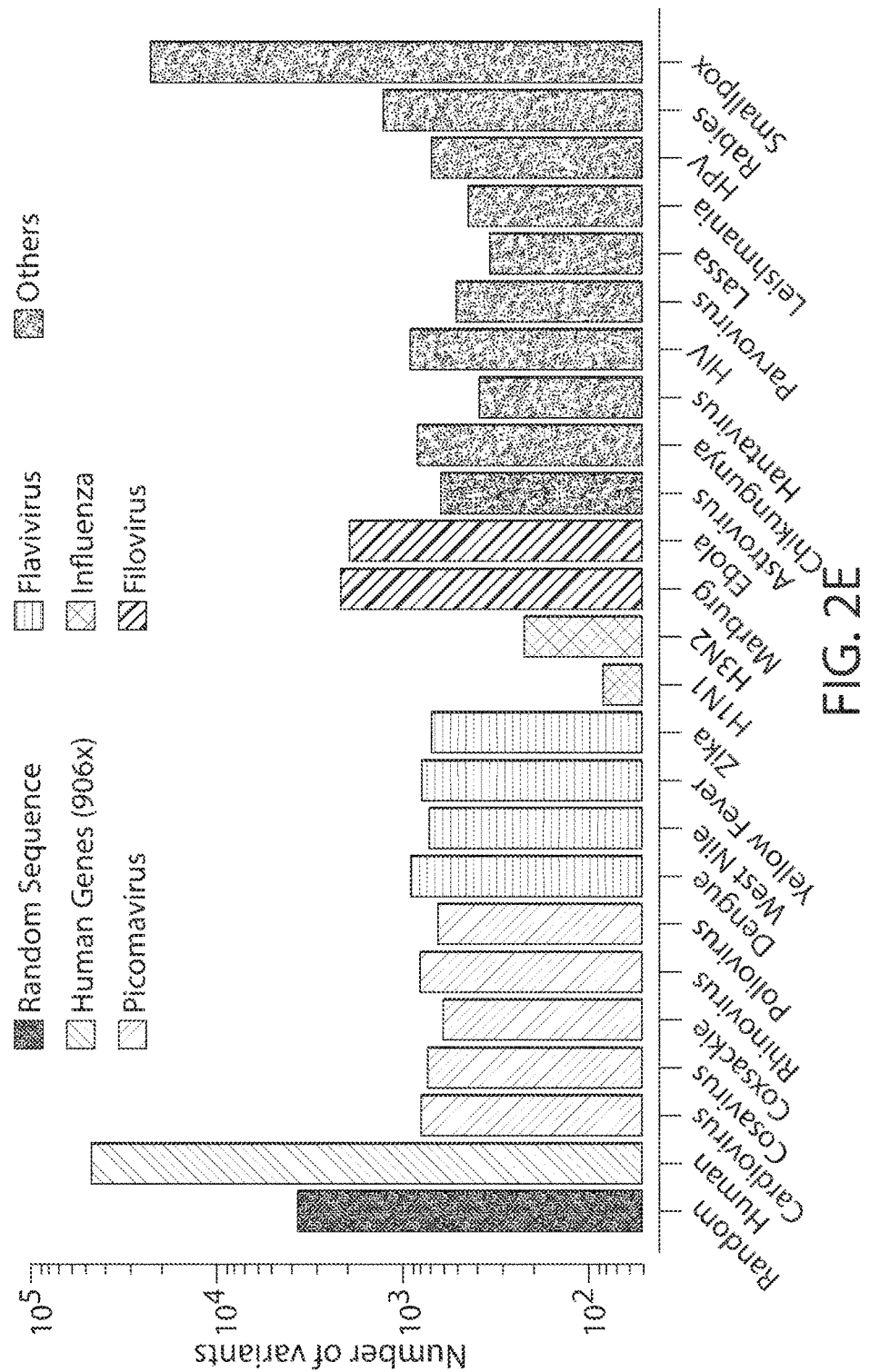
Figure 2F:
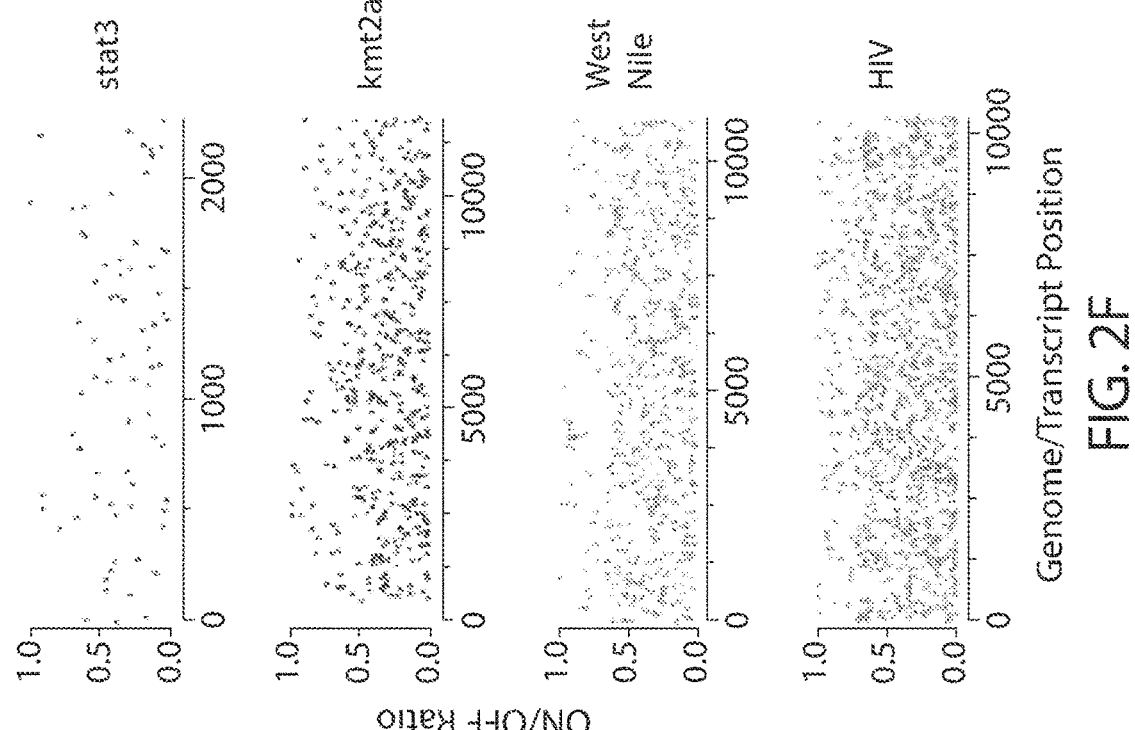

Our toehold switch library was designed and synthesized based on a large collection (244,000) of putative trigger sequences, spanning the complete genomes of 23 pathogenic viruses, the entire coding regions of 906 human transcription factors, and ~10,000 random sequences. From a synthesized oligo pool, we generated two construct libraries, for ON and OFF states, which were subsequently transformed into BL21 *Escherichia coli* (FIGS. 1, 6A-B). The first library contained OFF toehold switch constructs that lacked a trigger, while the second library of ON constructs contained the same toeholds with the complementary triggers fused to their corresponding switches. The two libraries were then sorted on a fluorescence-activated cell sorter (FACS) using four bins (FIGS. 1, 7), and the toehold switch variants contained in each bin were quantified using next-generation sequencing (NGS) to recover their individual fluorescence distributions from raw read counts (FIG. 1). After quality control (Table 1), the toehold switch library contained 109,067 ON state measurements (FIG. 2A), 163,967 OFF state measurements (FIG. 2B), and 91,534 ON/OFF paired difference ratios (FIG. 2C), where both ON and OFF states were characterized for each switch (FIGS. 2E,F). ON and OFF data were normalized from 0 to 1, resulting in an ON/OFF difference ratio normalized from −1 to 1.

Since RNA synthetic biology tools such as toehold switches are often used within in vitro cell-free systems (3, 4, 15, 16), we validated our in vivo ON/OFF measurements in an in vitro setting to ensure these were reasonable indicators of switch performance in a CFPS system. To achieve this, we selected eight high-performance switches and eight low-performance switches, and individually cloned and characterized them in a PURExpress CFPS (FIGS. 1D, 10 and Table 2). All low-performance switches showed no induction, while the high-performance switches showed a spread of cell-free ON/OFF ratios between 2 and 10 (p<0.0001 between high and low switches, two-tailed t-test). These results confirm that while the performance of toehold switches in vivo and in vitro may differ, in vivo measurements can still be used to classify categorically whether a switch will function in vitro.

Rational Analysis Using Thermodynamic RNA Secondary Structure Models

Figure 3B:
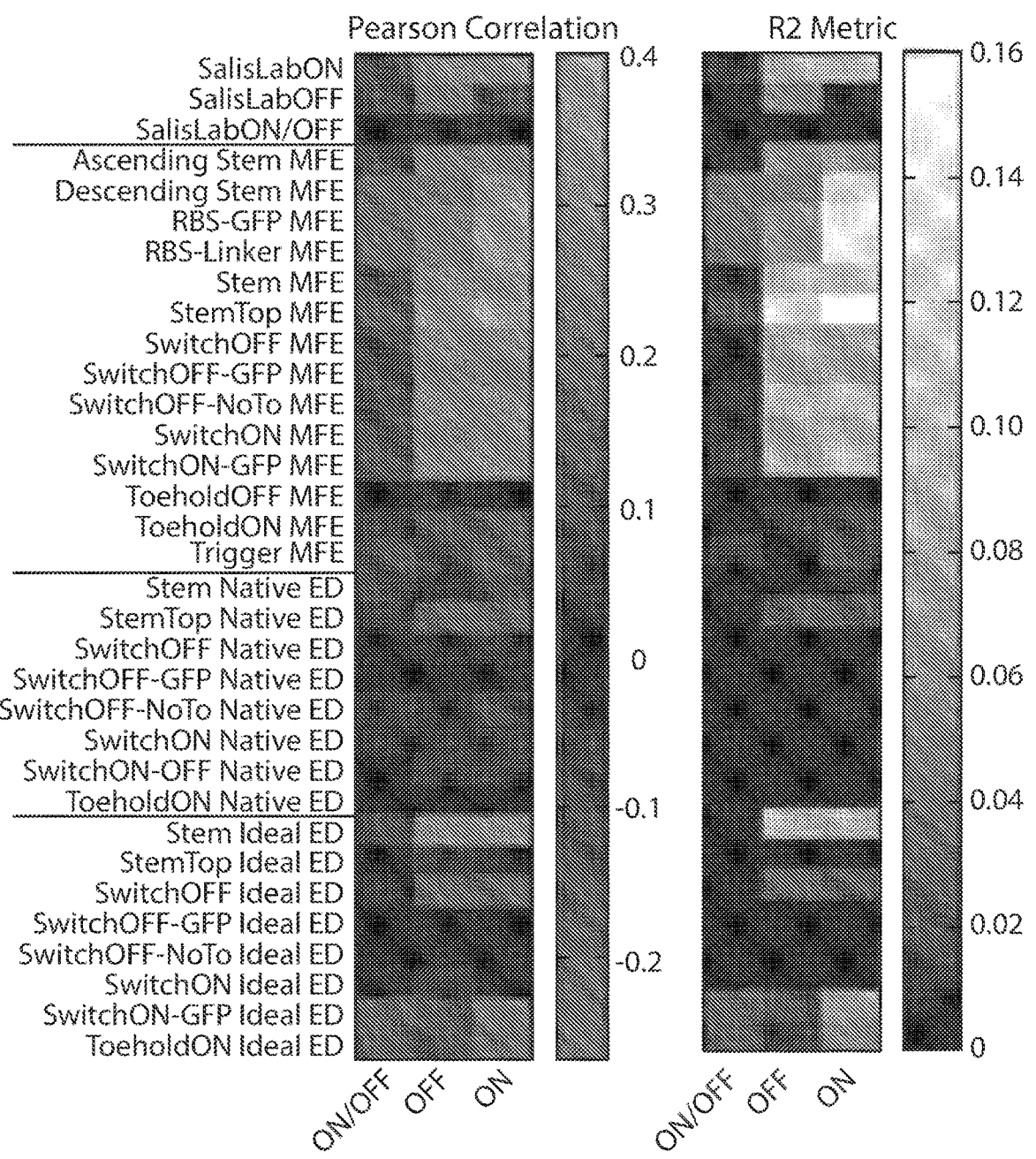

Before initiating the exploration of deep learning models to predict function in our large-scale toehold switch library, we sought to determine whether traditional tools for analyzing synthetic RNA modules could be used to accurately predict toehold switch behavior, including k-mer searches and mechanistic modeling using thermodynamic parameters. K-mer searches of biological sequence data are often used to discover motifs, and while certain overrepresented motifs were found in our dataset (FIG. 3A and Table 3), utilization of these did not significantly improve functional predictions of switch behavior. Other current state-of-the-art approaches for designing RNA synthetic biology tools primarily analyze secondary structure using thermodynamic principles (23-25). Following such prior works, we used NUPACK (23) and ViennaRNA (25) software packages to calculate a total of 30 rational features for our entire library, including the minimum free energy (MFE), ideal ensemble defect (IED), and native ensemble defect (NED) of the entire toehold switch library as well as various sub-segments in each sequence (Table 4). A number of these parameters had previously been reported to correlate with experimental toehold switch ON/OFF measurements for smaller datasets (2), and NUPACK's design algorithm, in particular, is set to optimize IED when proposing target RNA secondary structures (3, 4, 15, 23). However, when analyzing these rational features with our larger dataset, we found them to be poor predictors of toehold switch function (FIGS. 3B, 11A-B). In modest agreement with the findings of Green et al. (2), the MFE of the RBS-linker region showed the highest correlation of this feature set for ON/OFF ($R^2$: ON=0.14, OFF=0.06, ON/OFF=0.04), with NUPACK's IED also showing above-average correlation ($R^2$: ON=0.07, OFF=0.02, ON/OFF=0.03). While measurable, these correlation metrics were far too weak for practical use in computer-aided design of this specific RNA synthetic biology tool (3, 4, 15, 23).

Moving forward, we explored the use of more complex thermodynamic models that take into account well-established hypotheses for translation initiation and the ribosome docking mechanism in combination with multiple thermodynamic features to improve their predictions (26-31). One of the most developed of these models is the Ribosome Binding Site (RBS) calculator (v2.1; Salis Lab); a comprehensive model parameterized on thousands of curated RBS variants (26-29). We used the RBS calculator to predict the ON and OFF translation initiation rates for our toehold switches, but also found low predictive performance comparable to other rational features (FIG. 3B) when tested on our database ($R^2$: ON=0.09, OFF=0.05, ON/OFF=0.0001).

Figure 12E:
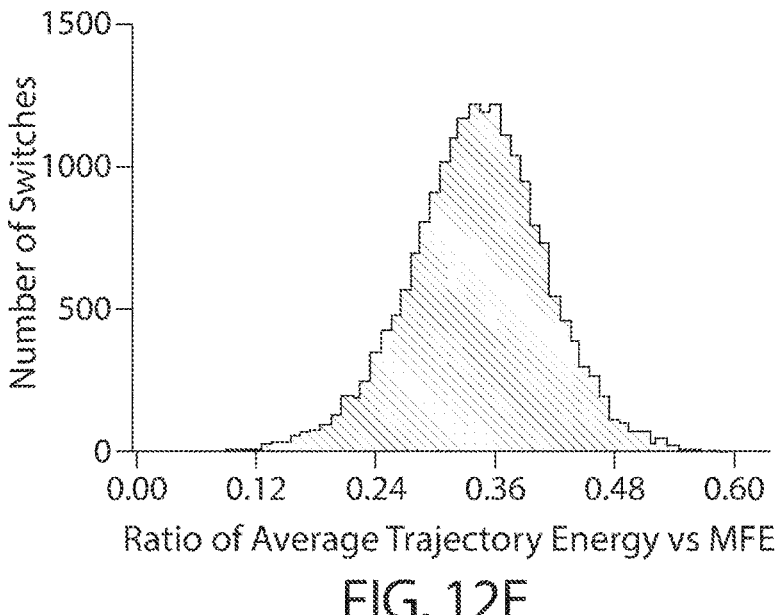
Figure 12F:
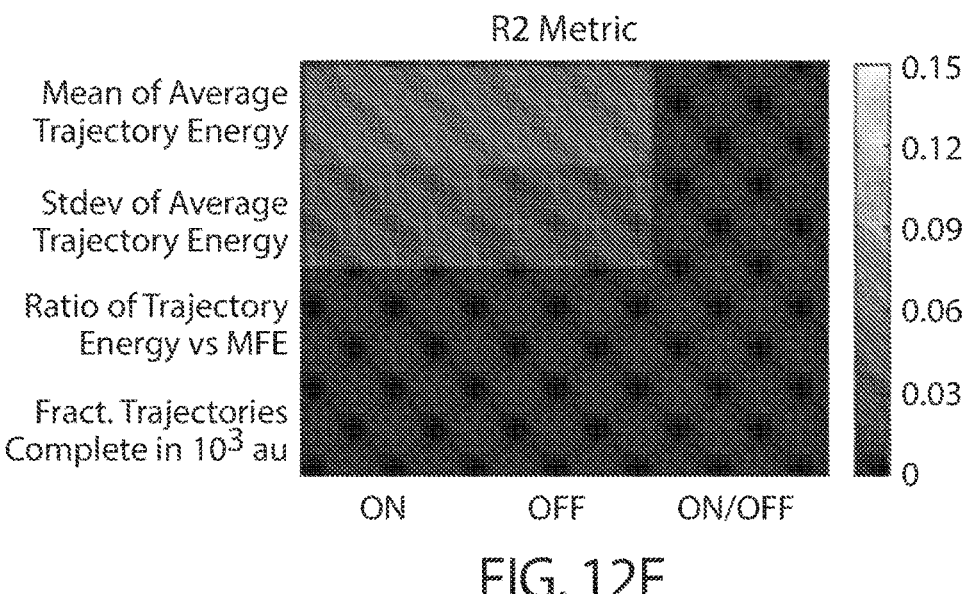

One potential explanation for the limited predictive power of current thermodynamic models for RNA folding tasks concerns the influence of kinetically stable secondary structure intermediates that may compete with thermodynamic equilibrium states (29, 32). To determine whether a kinetic analysis of toehold switch folding dynamics could help explain our experimental results, we calculated four additional features based on kinetic trajectories using the Kinfold package (33) (FIG. 12A-F). As with predictions obtained using other thermodynamic models, these kinetic features showed poor correlations ($R^2$: ON=0.04, OFF=0.04, ON/OFF=0.001 for the best feature) to our empirical dataset (FIG. 12E). Considering these results, the cause of limited function predictions from thermodynamic and kinetic models of RNA secondary structure remains unclear but may stem from the use of potentially incomplete energetic models, incorrect mechanistic hypotheses, and from interference within the in vivo context of the bacterial cells. Regardless of the source of error, we sought to explore deep learning as a machine learning paradigm to develop models with higher predictive abilities than previously reported, with the hope of allowing useful computer-aided systems for the design of RNA synthetic biology tools.

Improved Prediction Using Sequence-Based Multilayer Perceptron Models

Figure 3C:
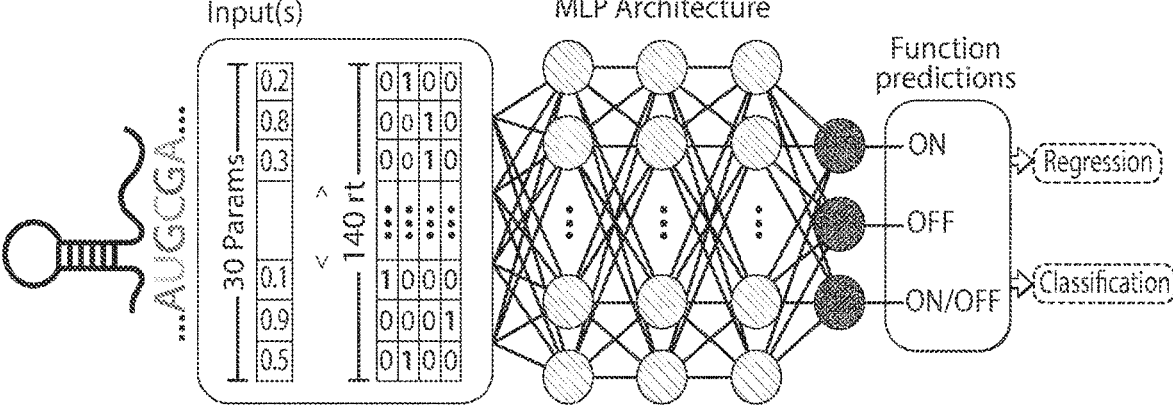
Figure 3D:
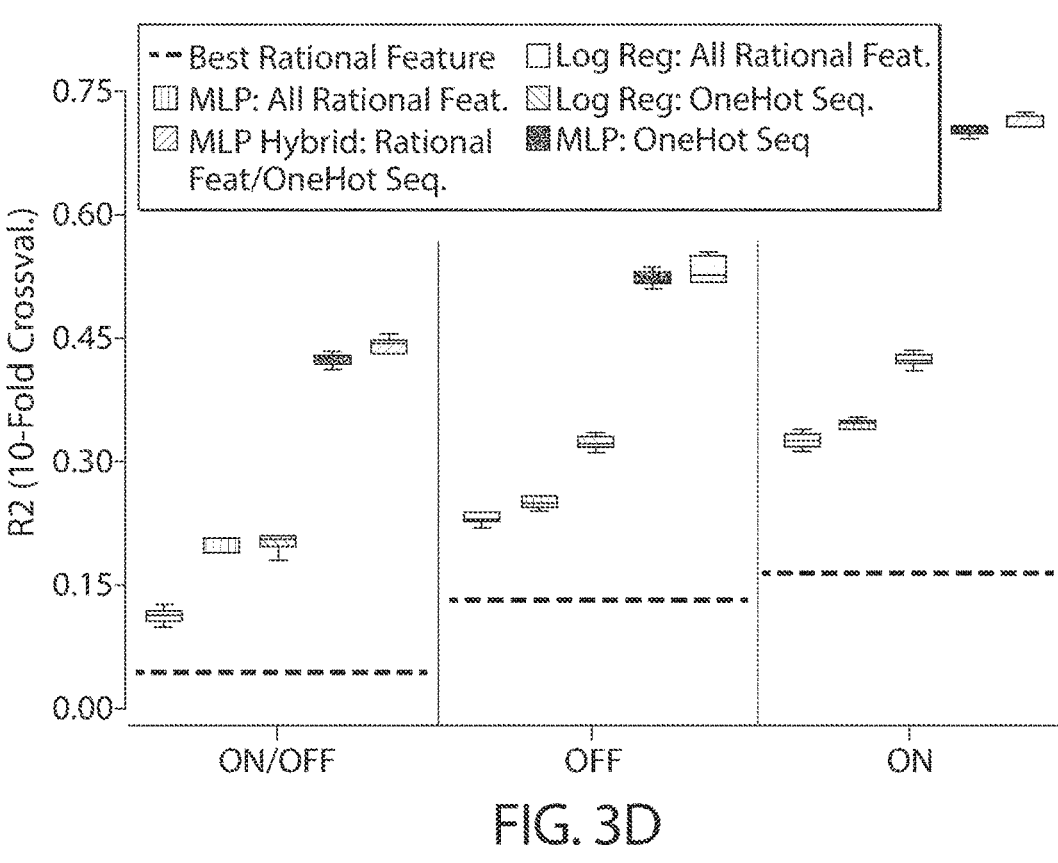
Figure 3E:
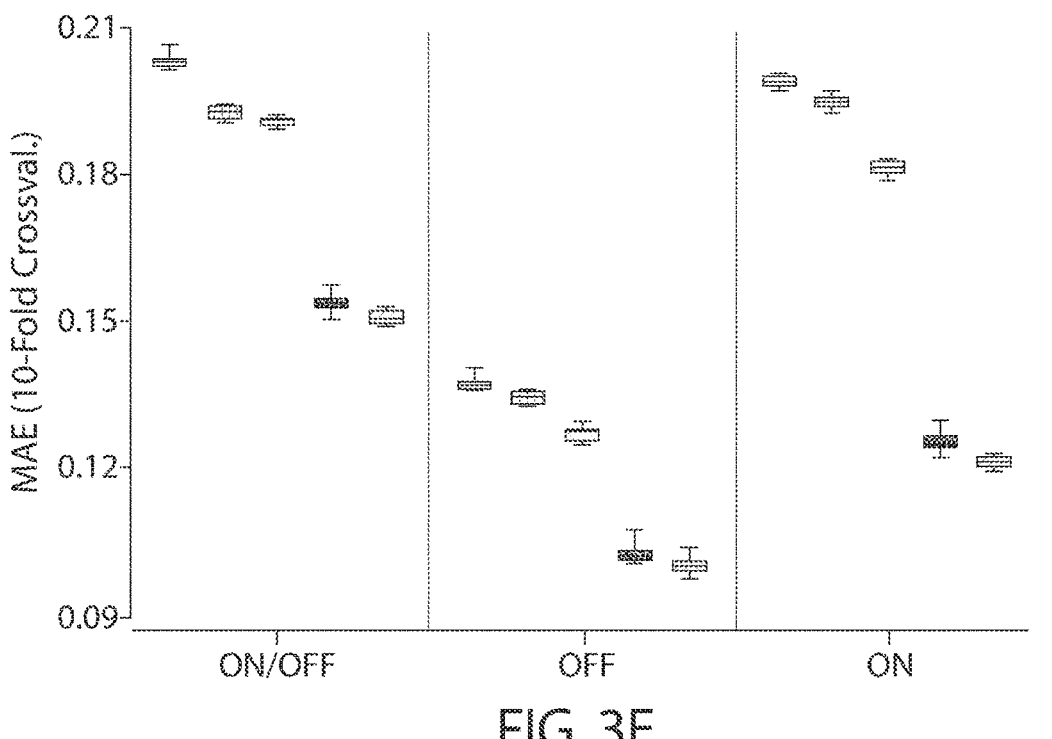
Figures 3F, 3G:
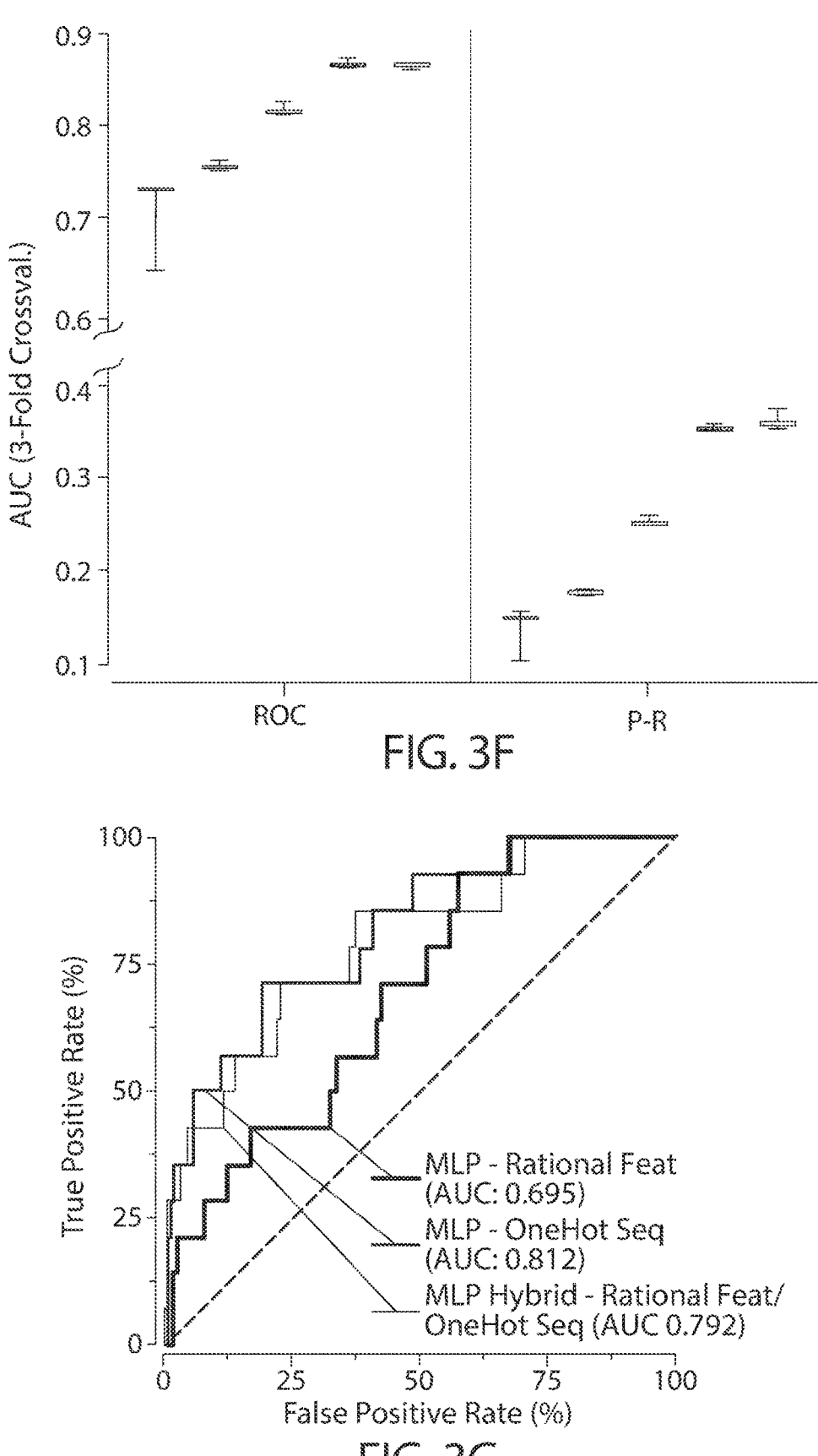

Given that simple regression models based on state-of-the-art RNA thermodynamic and kinetic calculations were ineffective at predicting toehold switch performance, we next tested the use of a type of feed-forward neural networks, also known as multilayer perceptron (MLP) models, as a baseline architecture for our investigation (FIG. 3C). We first trained a three-layer MLP model on our dataset with an input consisting of the 30 previously calculated thermodynamic rational features (see Methods section for further detail). When trained in regression-mode, this MLP model was able to deliver better predictions than any of the individual rational features or the RBS calculator based on $R^2$ and MAE ($R^2$: ON=0.35, OFF=0.25, ON/OFF=0.20) (FIGS. 3D, E). Similarly, when this model was trained for classification (ON/OFF: binarized at +/−0.7), as seen in FIG. 13, it achieved a 0.76 area under the receiver-operator curve (AUROC) and 0.18 area under the precision-recall curve (AUPRC), as seen in FIG. 3F. The MLP model modestly outperformed a logistic regressor trained on the same rational features (FIGS. 3D,E,F), suggesting that the MLP architecture was able to abstract higher-order patterns from these features as compared to simpler non-hierarchical models.

While these results already constitute an improvement compared to the current state-of-the-art analysis of RNA synthetic biology tools, we wondered whether the use of pre-computed rational features as network input led to information loss that could inherently limit the predictive power of these models. Considering that possibility, we trained an MLP model solely on one-hot encoded sequence representations of our toehold switches, eliminating potential bias introduced by a priori mechanistic modeling. We found that this sequence-based MLP delivered improved functional predictions based on $R^2$ and MAE ($R^2$: ON=0.70, OFF=0.53, ON/OFF=0.43) metrics (FIGS. 3D, E, 14). These values represent a doubling of $R^2$ performance as compared to the MLP trained on rational features and a ten-fold improvement in ON/OFF $R^2$ over the best rational feature used for previous linear models.

Similarly, when training for classification, our one-hot sequence MLP produced improved AUROCs and AUPRCs, reaching 0.87 and 0.36, respectively (FIG. 3F). This improvement in performance when training on sequence-only inputs compared to rational features suggests that significant information loss occurs when performing thermodynamic calculations on toehold switch sequences, a problem that may extend to other RNA synthetic biology tools in use today. Also, the sequence-only MLP model dramatically outperformed the logistic regressor model trained on the same one-hot sequence input (FIGS. 3D,E,F), further supporting the hypothesis that improved accuracy of our sequence-based MLP arises from learned hierarchical non-linear features extracted directly from RNA sequences.

A combined input concatenating both the rational features and the one-hot representation was also evaluated, giving a small, but significant improvement in regression mode ($\Delta R^2 \approx 0.025$ and $\Delta MAE \approx -0.0025$, $p < 0.05$ for all six comparisons, two-tailed t-test), but with no significant improvement for AUROC or AUPRC when in classification mode (FIGS. 3D,E,F). These results suggest that while the use of rational features may facilitate the abstraction of potentially relevant information of toehold switch function, the one-hot sequence-only MLP model can recover such information if given enough training data without a priori hypothesis-driven assumptions built into the model.

In order to validate the degree of biological generalization in our sequence-only MLP model, we withheld 23 viral genomes tiled in the toehold switch dataset during training and predicted their function resulting in a 0.82-0.98 AUROC range (average 0.87, FIG. 15). We then carried out an external validation on a previously published dataset of 168 characterized toehold switches (2) that our models had never seen before and that had been collected under different experimental conditions. Our MLP models achieved an AUROC of 0.70, 0.81, and 0.79, when trained on rational features, one-hot sequence, and hybrid inputs, respectively (FIG. 3G). The improved performance observed when training the models directly on nucleotide sequence rather than thermodynamic features, even for an external dataset, suggest a competent degree of biological generalization and supports the value of modeling RNA synthetic biology tools using deep learning and high-throughput datasets, removing current assumptions from mechanistic rational parameters.

Predictive Performance of Higher-Capacity Deep Learning Models

Having explored relatively simple deep learning architectures first, we next sought to determine whether training our dataset on higher-capacity convolutional neural networks (CNN) and long short-term memory (LSTM) recurrent neural networks could increase our predictive ability. CNN and LSTM models have been applied to a variety of biological datasets in recent years, and have been cited as being particularly adept at recognizing motifs and long-range interactions in nucleotide sequence data (10, 17-20, 34-38). We specifically evaluated a CNN trained on a one-hot sequence input, an LSTM trained on a one-hot sequence input, and a CNN applied to a two-dimensional (2D), one-hot complementarity map representation input (see Methods for complete descriptions of all models). Upon evaluating both the $R^2$ and MAE in regression mode and the AUROC and AUPRC in classification mode for these models (FIGS. 4A,B,C,D), we concluded that these neural network architectures did not lead to superior predictive models, as compared to the sequence-based, three-layer MLP described previously. We reasoned that, in these specific cases, increased model capacity led to under- or over-fitting, requiring additional training examples or improved fine-tuning to accelerate effective training.

Visualizing Learned RNA Secondary Structure Motifs with VIS4Map

One significant drawback of using deep learning approaches to predict biological function is the inherent difficulty in understanding learned patterns in a way that aids researchers in elucidating biological mechanisms underlying the model predictions. By contrast, mechanistic hypothesis-driven models can more directly inform which aspects of a biological theory best explain the observations. Various methods have been established to address this limitation, including alternative network architectures (39), and the use of saliency maps (40, 41), which reveal the regions of an input that deep learning models pay attention to when making predictions. While saliency maps have been previously used to visualize model attention in one-hot representations of sequence data (10, 17, 18, 20, 40), such implementations focus only on the primary sequence and have not been developed to identify secondary structure interactions, which are specially relevant in the operation of RNA synthetic biology elements. In the few cases where secondary structure has been investigated, input representations have been constrained to predetermined structures based on the predictions of thermodynamic models (37, 38), whose abstractions we have found cause significant information loss.

In order to better explain our deep learning model's predictions, we sought to visualize RNA secondary structures learned by our neural networks in a manner unconstrained by thermodynamic modeling. To achieve this, we chose to use a CNN trained on two-dimensional nucleotide complementarity map representations (FIG. 5A) to allow for attention pattern visualization in this secondary structure space. Each position in this complementarity map corresponds to the potential pair between two nucleotides, indicating its identity with a one-hot encoding (G-C, C-G, A-U, U-A, G-U, U-G, or an unproductive pair). We hypothesized that by training deep networks on such a representation of RNA sequences, it would be possible for generated saliency maps to reveal learned secondary structure features as visually intuitive diagonal features. Importantly, because the complementarity map is unconstrained by a priori hypotheses of RNA folding (similarly to our sequence-based MLP models), we anticipated this approach to be able to identify secondary structures that might be overlooked by commonly used thermodynamic and kinetic algorithms, such as NUPACK and Kinfold.

Figure 5A:
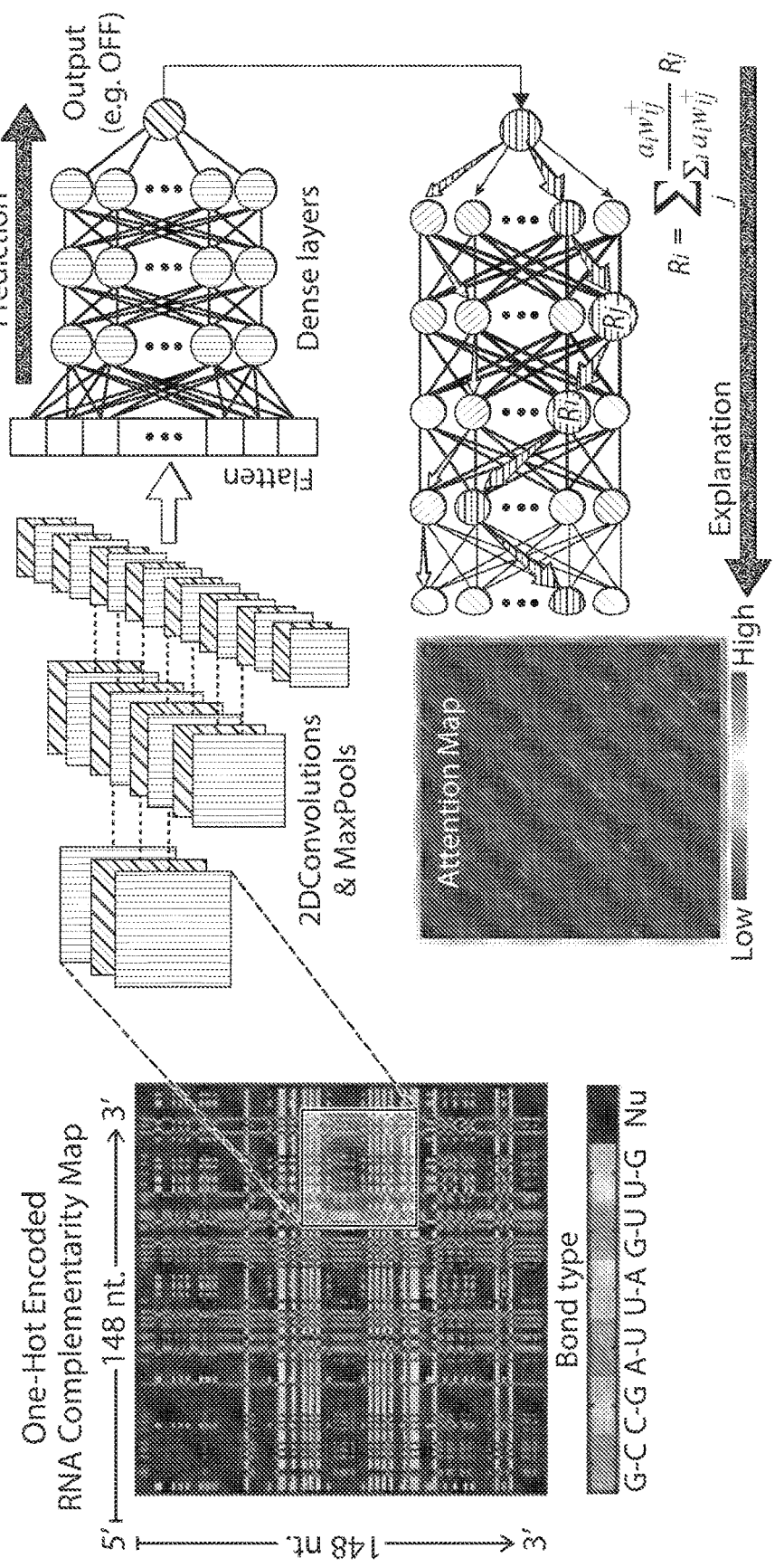
Figure 5B:
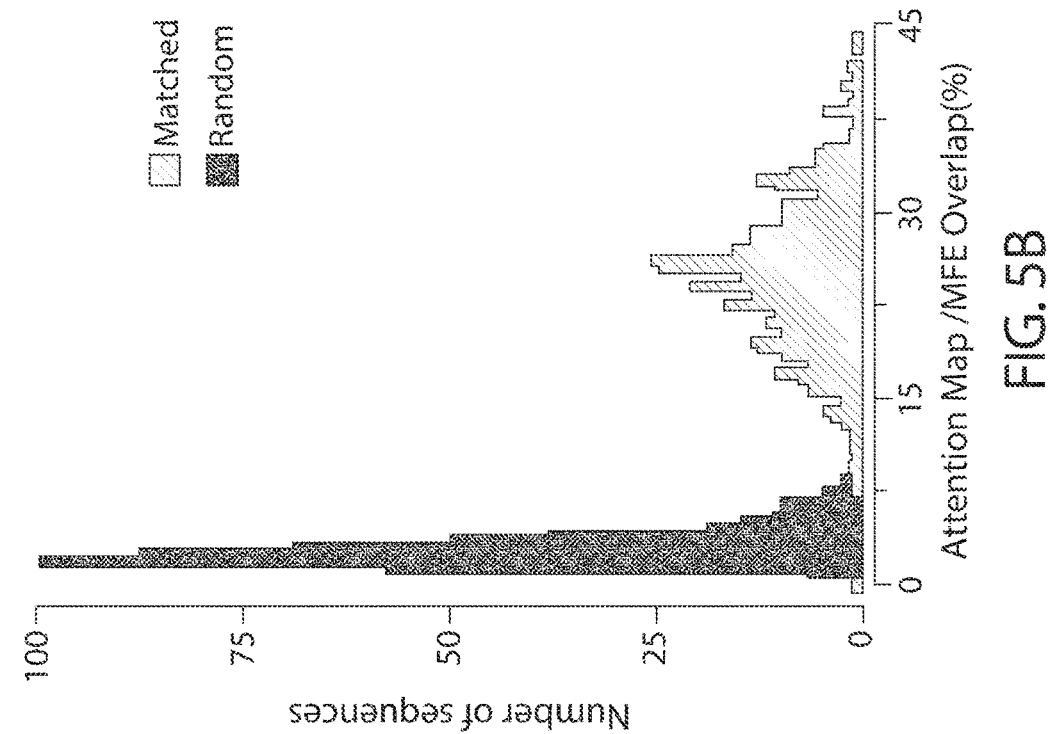
Figure 5C:
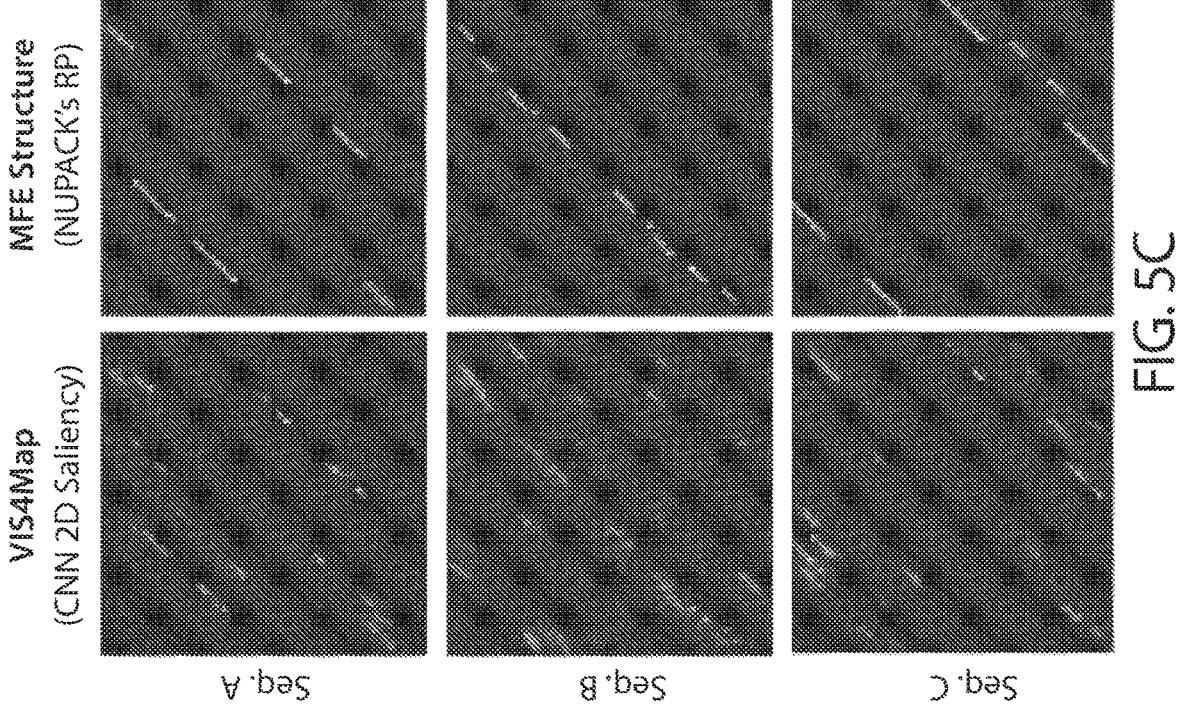

To validate the feasibility of our visualization approach, we first pre-trained a CNN to predict NUPACK MFE values from complementarity map representations of a randomly selected in silico RNA sequence dataset. Because MFE is directly determined by RNA secondary structure, we anticipated that a CNN undergoing this pre-training would likely pay attention to secondary structure features, a situation that was confirmed through visualization of individual attention maps (FIGS. 5B,C). Additionally, we found that the use of a complementarity map input improved the CNN's predictions of MFE from $R^2 = 0.6$ to $R^2 = 0.74$ compared with a one-hot sequence input (FIG. 16). Indeed, the saliency maps generated from a CNN trained on a complementarity map input contained primarily diagonal features that showed a statistically significant degree of agreement with the MFE structures from which NUPACK based its MFE calculations (FIGS. 5B, C, 16). Hence without prior knowledge of the algorithm or parameters NUPACK uses to calculate MFE, our CNN was able to learn similar abstractions as NUPACK, which we then used to intuitively visualize underlying relevant RNA secondary structures utilizing our complementarity map input representation. We named this approach for interpreting RNA deep learning models Visualizing Secondary Structure Saliency Maps or VIS4Map.

Figures 4A, 4B:
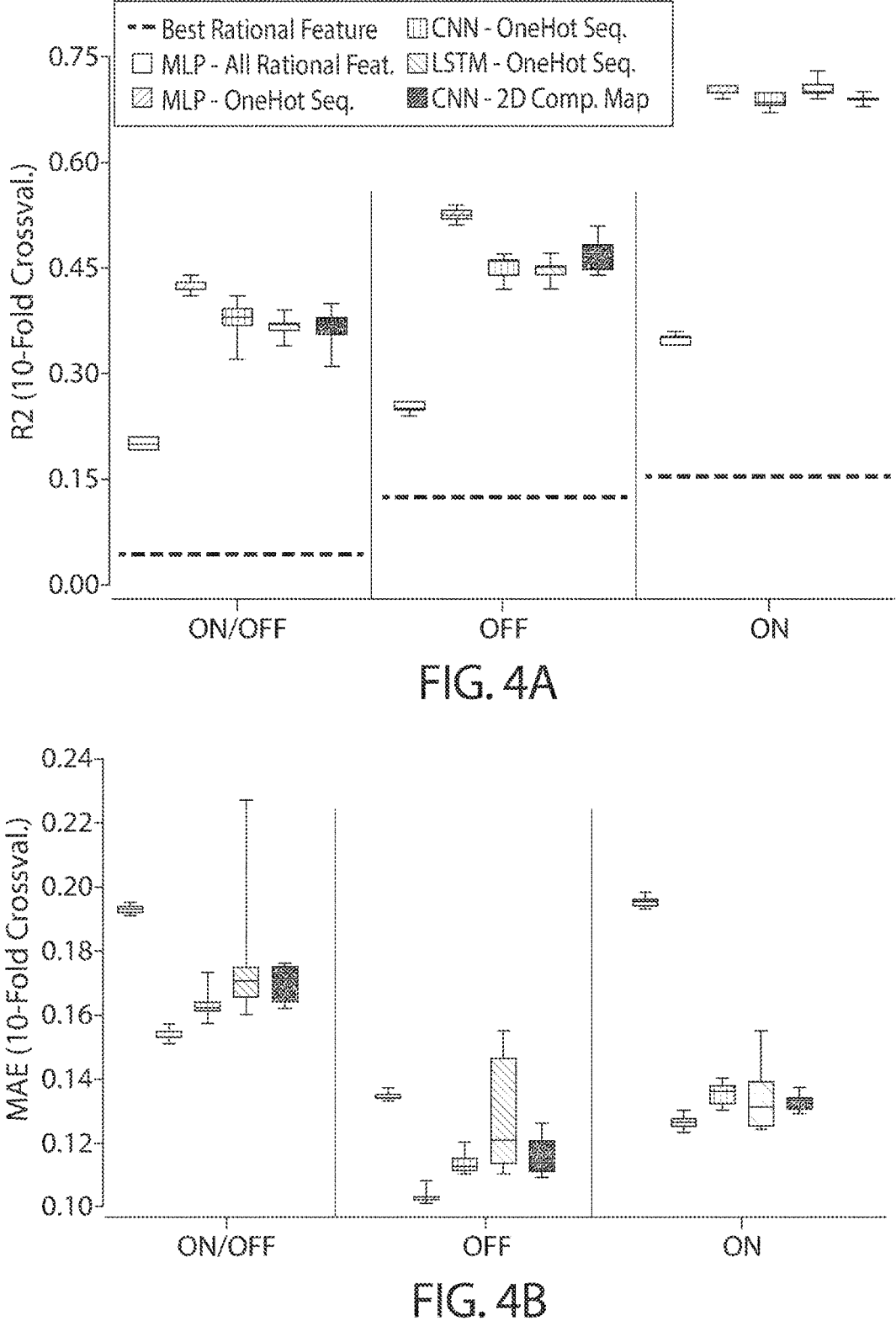
Figures 4C, 4D:
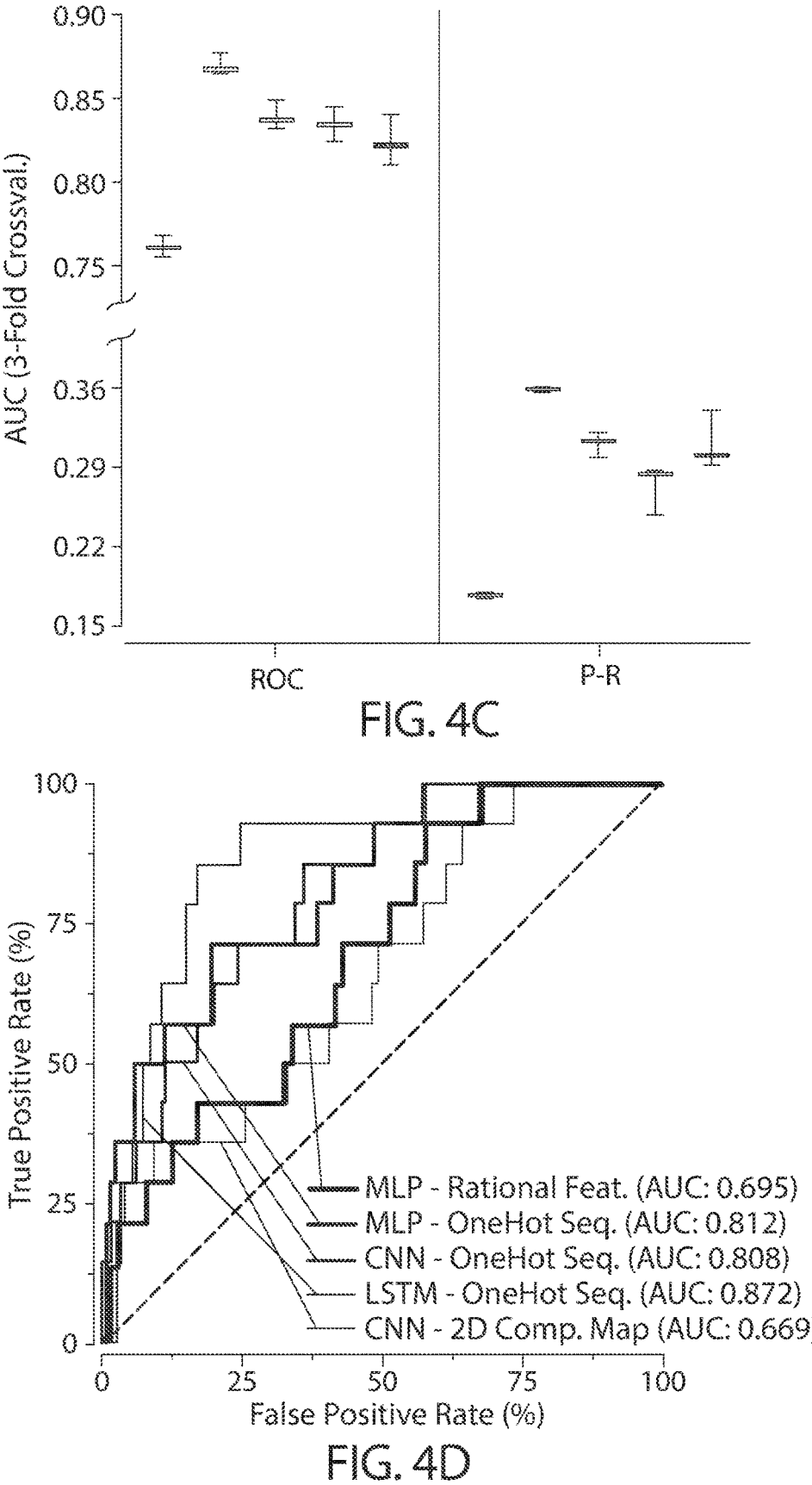
Figure 5D:
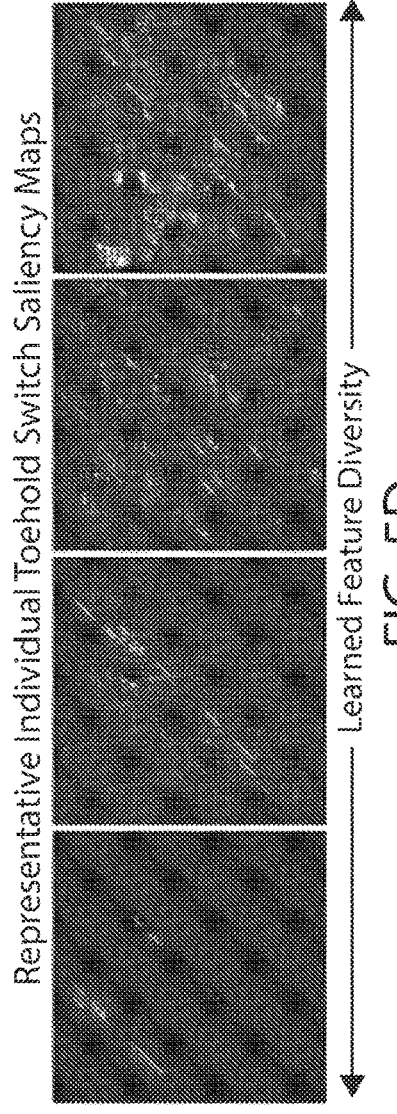
Figure 5E:
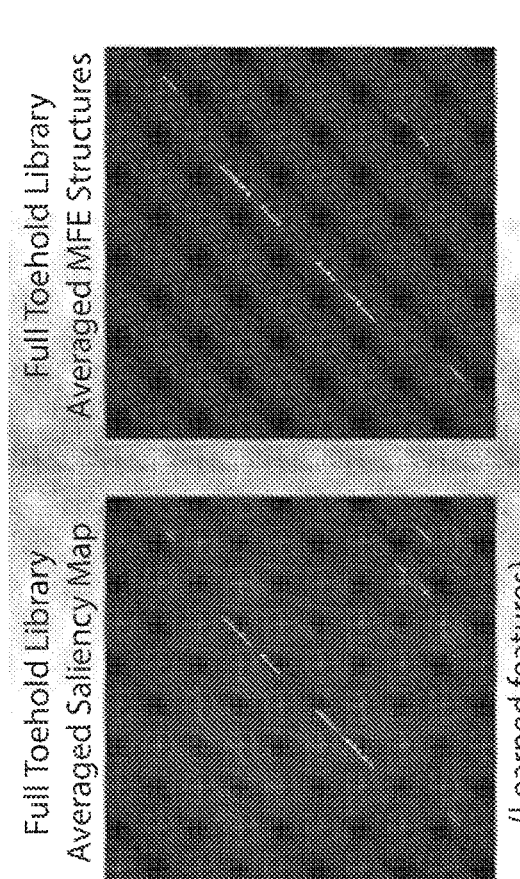
Figure 5F:
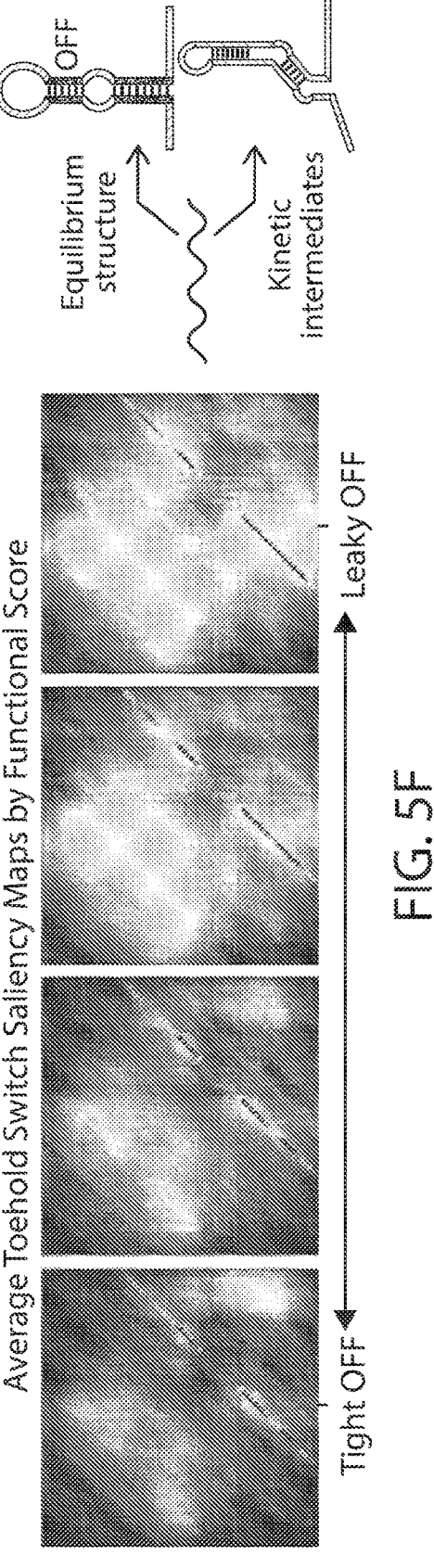

Encouraged by our CNN's ability to elucidate RNA secondary structure features directly from training data, we applied VIS4Map to our entire toehold switch dataset. When trained on a complementarity map representation of the switch OFF conformation (FIG. 5D) both in regression mode and classification mode, VIS4Map significantly outperformed an MLP trained on rational thermodynamic features; however, VIS4Map did not significantly outperform our MLP trained on one-hot inputs, similar to the case of our other higher capacity models (FIGS. 4A,B,C,D). Encouragingly, nonetheless, we found that saliency maps produced by this CNN model displayed clear diagonal secondary structure features (FIG. 5D). These structures appear to span from hybridization between the toehold and the ascending stem, to hybridization between the descending stem and the downstream linker. We confirmed the biological relevance of these features by averaging saliency maps and found that the shared structures corresponded to the designed on-target structure of the switch hairpin (FIG. 5E). We further analyzed learned features outside of the designed MFE structure by sorting saliency maps using the toehold switch OFF signal (FIGS. 5F and 17). We found that for leakier (high OFF) switches, the CNN identified a high degree of salient off-target secondary structures that could compete with the main hairpin stem and thereby exposed the RBS, whereas for tight (low OFF) switches the CNN identified fewer competing off-target secondary structures. In the context of general riboregulator behavior, these findings support the hypothesis that leaky expression from an RBS repressed by secondary structures can be caused by the misfolding of the repressive structure into less stable kinetic intermediate conformations (29, 32) (FIG. 5F, right).

The fact that VIS4Map was able to identify both equilibrium and kinetically stable RNA secondary structures indicates a remarkable ability to uncover biologically relevant information, which in this case supports currently postulated hypotheses on prokaryotic translation initiation. Importantly, the identified secondary structure features could not have been visualized using the one-hot sequence representation commonly associated with saliency maps (10, 17, 18, 20). These findings compound to the advantage of using sequence-only deep learning approaches for analyzing RNA synthetic biology tools. Outside of toehold switches and other synthetic RNA systems, we anticipate VIS4Map will be broadly useful for the discovery of previously unknown equilibrium or kinetically stable structures contributing to RNA biology, that are not predicted by current mechanistic RNA structure models.

Discussion

Here we presented a high-throughput DNA synthesis, sequencing, and deep learning pipeline for the design and analysis of a synthetic system in RNA biology. Having produced a toehold switch dataset ~100-fold larger than dynamic and kinetic features. Moreover, the validation of our deep learning models on an external previously characterized dataset, as well as the holdout prediction of every individual viral genome in our dataset, further demonstrated the robust biological generalization of our models.

As with most work in RNA synthetic biology, all previous attempts to improve toehold switch functionality have relied on the guidance of mechanistic thermodynamic modeling and low-throughput datasets (2-8, 15, 16). Too frequently, rational design rules fail to give meaningful predictions of function for RNA-based synthetic systems. The results presented here suggest that the biological processes underlying RNA biology may be more complex than current state-of-the-art analyses take into account and that high-throughput DNA synthesis, sequencing, and deep learning pipelines can be more effective for modeling said complexity. Combining improved predictions with enhanced understanding, our novel VIS4Map method further allowed us to visualize the equilibrium and kinetic secondary structure features that our deep learning models identified as important to the leakage of the switch OFF state. While secondary structures identified by NUPACK, Kinfold, and other rational mechanistic models are limited by predefined abstractions, which may cause significant information loss, our approach explored sequence space in an unrestricted manner and analyzed all possible RNA secondary structures. VIS4Map could prove useful for identifying complex secondary structure information that might otherwise be ignored by simplified physical energetic models of RNA folding.

The dataset reported here also represents an extensive repository of characterized toehold switches, which could be used to accelerate the development of future cell-free diagnostics (3, 4, 15, 16). These switches tile the entire genomes of 23 pathogenic viruses of high clinical importance, as well as tiling hundreds of human transcripts, including many that are differentially expressed in cancerous phenotypes (42, 43). The total cost of our flow-seq pipeline equates to ~$0.08 per measurement, suggesting that the benefits of high-throughput design and assaying of RNA synthetic biology tools could be made widely accessible. We hope that this work will encourage the use of high-throughput data collection for the training of deep learning systems, paired with more interpretable neural network architectures unrestricted by thermodynamic or kinetic secondary structure models for improved prediction and insight generation in RNA synthetic biology.

TABLE 1

| | Quality control thresholds. | | | | | | |
| | Quality Control Conditions | | | | Library Size | | |
| | OFF Count Threshold | ON Count Threshold | Upper Stdev. Cutoff | Lower Stdev. Cutoff | ON Variants | OFF Variants | ON/OFF Variants |
|---|---|---|---|---|---|---|---|
| QC1 | >=5 | >=5 | None | None | 126,620 | 180,552 | 110,931 |
| QC2 | >=10 | >=10 | None | None | 109,067 | 163,967 | 91,534 |
| QC3 | >=20 | >=40 | None | >0 | 77,040 | 90,264 | 43,044 |
| QC4 | >=60 | >=60 | 0.4> | >0.04 | 39,283 | 67,507 | 19,983 |
| QC5 | >=300 | >=300 | 0.4> | >0.04 | 6,187 | 12,551 | 1,137 | previously published as a model system for investigating synthetic RNA response elements (2-6, 15, 16), we demonstrated the benefits of using deep learning methods that directly analyze sequence rather than relying on calculations from mechanistic thermodynamic and kinetic models. This approach resulted in tenfold improvement in functional prediction $R^2$ over an ensemble of commonly used thermo- The conditions for inclusion in our five quality control groups (QC1-5) are shown above, including standard deviation cutoffs and library count thresholds. QC2 was ultimately chosen as the final condition for inclusion in our dataset, and all data used or shown in this manuscript is for QC2 unless otherwise stated. The size of each dataset is shown in the three rightmost columns.

TABLE 2

| Toehold switch sequences validated in cell-free format. |
| --- |

| | Corresponding Riboregulator SEQ ID NO # | Trigger Sequence | On | Off |
| --- | --- | --- | --- | --- |
| Low 1 | 52454 | CCGACACCTGTTTCATGGAACAATAAAAGA (SEQ ID NO: 244004) | 0.0153 | 0.0085 |
| Low 2 | 65651 | TGCTGTCTGTGAAACAGATAAATGGAAATA (SEQ ID NO: 244005) | 0.0176 | 0.0100 |
| Low 3 | 67027 | TCCCTTTCCCAGAAATAAACTTTTTTACCC (SEQ ID NO: 244006) | 0.0181 | 0.0136 |
| Low 4 | 235901 | TCACTGAGTCATTGCCATCTGCAGAATCAG (SEQ ID NO: 244007) | 0.0048 | 0.0134 |
| Low 5 | 81973 | TCCAAGACCCAAAGTTCTGGGAACTGGTGG (SEQ ID NO: 244008) | 0.0192 | 0.0156 |
| Low 6 | 45174 | TGGCAATTGTAGATATAACTTCTGGTAAAT (SEQ ID NO: 244009) | 0.0153 | 0.0183 |
| Low 7 | 74706 | ATCCAAATATAATGATGACCTATATGCCCT (SEQ ID NO: 244010) | 0.0158 | 0.0102 |
| Low 8 | 66097 | CCAATATGAGATCTGTAATGCTAACAGTTT (SEQ ID NO: 244011) | 0.0076 | 0.0146 |
| High 1 | 19367 | GTCATATAAAGGAAGAAGATAGGAGAAGAA (SEQ ID NO: 244012) | 0.9860 | 0.0031 |
| High 2 | 236638 | AGTTCACAAGAGATGGTTCATGGTGTTCCA (SEQ ID NO: 244013) | 0.9937 | 0.0132 |
| High 3 | 111698 | AAAGGTTAGCTTATGTTACATATCAAGATA (SEQ ID NO: 244014) | 0.9740 | 0.0016 |
| High 4 | 62866 | AATCACTGAAAATTGGAGTTAGGTATTGAC (SEQ ID NO: 244015) | 0.9747 | 0.0007 |
| High 5 | 40182 | GGTATGTTAAGTATGAGGCCTTATCCGTAC (SEQ ID NO: 244016) | 0.9895 | 0.0115 |
| High 6 | 9602 | TCAAGTTAGAGAAGGAAGTGGCTGAGACCC (SEQ ID NO: 244017) | 0.9856 | 0.0122 |
| High 7 | 43841 | TAAATCTATGAGAGATCAACGAAAAGGAAG (SEQ ID NO: 244018) | 0.9942 | 0.0150 |
| High 8 | 164989 | AAAGAAGAAATCATGCAAGAAAACAAAGGG (SEQ ID NO: 244019) | 0.9744 | 0.0007 |

Sequences of the individually cloned toehold switches for cell-free validation using PURExpress were selected from the QC3 threshold. Their trigger sequences and flow-seq assay performances are shown (see FIGS. 1F,9 for cell-free assay performance). All highly-functional switches have ON/OFF of 0.97 or greater, while all poorly-functional switches have ON/OFF of 0.04 or less.

TABLE 3

| K-mer search results. | | | | |
| --- | --- | --- | --- | --- |
| Motif | Counts in Foreground | Counts in Background | P-value | E-value |
| ON Triggers Low versus High Signal | | | | |
| UCUYU CU* | 349 | 0 | 7.10E-122 | 8.30E-117 |

TABLE 3-continued

| K-mer search results. | | | | |
| --- | --- | --- | --- | --- |
| Motif | Counts in Foreground | Counts in Background | P-value | E-value |
| GAUGG | 260 | 19 | 6.80E-63 | 7.90E-58 |
| AAAAA | 391 | 128 | 1.90E-42 | 2.10E-37 |
| CUCYU C* | 142 | 4 | 1.30E-39 | 1.40E-34 |
| UAUUA AC | 123 | 0 | 1.70E-39 | 1.90E-34 |
| UCUCA C* | 26 | 2 | 4.10E-37 | 4.50E-32 |
| GAGUC GU | 100 | 0 | 5.80E-32 | 6.30E-27 |

TABLE 3-continued

K-mer search results.

| Motif | Counts in Foreground | Counts in Background | P-value | E-value |
|---|---|---|---|---|
| GUUUU AUC | 100 | 2 | 8.50E-29 | 9.10E-24 |
| | | High versus Low Signal | | |
| ANSA | 785 | 427 | 6.00E-62 | 1.00E-56 |
| AWUB | 644 | 359 | 9.50E-38 | 7.80E-33 |
| UAYR | 355 | 163 | 3.90E-23 | 1.70E-18 |
| GVRA | 270 | 128 | 8.20E-16 | 2.50E-11 |
| ACK | 344 | 224 | 1.60E-09 | 3.80E-05 |
| AUAA | 104 | 47 | 8.30E-07 | 1.40E-02 |
| | OFF Triggers Low versus High Signal | | | |
| CNG | 762 | 503 | 8.40E-34 | 1.50E-28 |
| GRS | 510 | 342 | 1.90E-14 | 1.80E-09 |
| CCUH | 218 | 132 | 2.60E-07 | 1.60E-02 |
| | | High versus Low Signal | | |
| AWWWU | 591 | 346 | 2.10E-28 | 3.60E-23 |
| WUAW | 472 | 333 | 1.40E-10 | 1.60E-05 |
| AAAAR A | 67 | 22 | 5.60E-07 | 4.30E-02 |

K-mer motifs searched with DREME using the trigger RNA sequences of the highest and lowest performing 1000 switches sorted by either ON or OFF signal. For this search, QC3 dataset was selected. * Denotes potential anti-SD pyrimidine-rich sequences.

TABLE 4

Rational feature sub-sequences.

| Rational Feature Sub-sequence Name | Sequence Region | Brief Description |
|---|---|---|
| SwitchOFF | 30-108 | Toehold switch off conformation |
| SwitchOFF-GFP | 30-144 | Off conformation with added GFP sequence |
| SwitchOFF-NoTo | 62-144 | Off conformation with toehold removed |
| SwitchON | 0-108 | Toehold switch on conformation |
| SwitchON-GFP | 0-144 | On conformation with added GFP sequence |
| Trigger | 0-29 | Trigger sequence alone |
| ToeholdOFF | 30-62 | Toehold region of switch including link1 |
| ToeholdON | 0-62 | Toehold region only hybridized to trigger |
| Stem | 62-108 | Stem only of toehold switch |
| AscendingStem | 62-100 | Ascending arm of the switch stem |
| DescendingStem | 80-108 | Descending arm of the switch stem |
| StemTop | 74-97 | Top half of the stem from start codon up |
| RBS-Linker | 80-134 | Region from RBS loop2 to linker |
| RBS-GFP | 80-144 | RBS-Linker with added GFP sequence |

| [-3, -1] | [0, 29] | [30, 49] | [50, 79] | [80, 90] | [91, 96] | [97, 99] | [100, 108] | [109, 134] | [135, 144] |
|---|---|---|---|---|---|---|---|---|---|
| GGG | trigger | loop1 | switch | loop2 | stem1 | AUG | stem2 | linker | post-linker |

The sub-sequences from which the thirty rational features used as MLP input were calculated using ViennaRNA are shown here in the upper panel. In the lower panel, we show the full un-truncated toehold switch sequence framework from which the sub-sequences in the top table were selected.

TABLE 5

List of SEQ ID NOs: 1-244,000 denoting viral or transcription factor specificity

| Virus/Source Gene | SEQ ID NOs: 1-159175 |
|---|---|
| astrovirus | SEQ ID NO: 1-1298 |
| cardiovirus | SEQ ID NO: 1299-2885 |
| chikungunya | SEQ ID NO: 2886-5245 |
| cosavirus | SEQ ID NO: 5246-6682 |
| coxsackie | SEQ ID NO: 6683-8156 |
| dengue | SEQ ID NO: 8157-10298 |
| ebola | SEQ ID NO: 10299-14080 |
| hantavirus | SEQ ID NO: 14081-14798 |
| human immunodeficiency | SEQ ID NO: 14799-16864 |
| human parvo | SEQ ID NO: 16865-17978 |
| human rhino | SEQ ID NO: 17979-19403 |
| influenza: h1n1 | SEQ ID NO: 19404-19603 |
| influenza: h3n2 | SEQ ID NO: 19604-20044 |
| lassa | SEQ ID NO: 20045-20719 |
| leishmania | SEQ ID NO: 20720-21752 |
| marburg | SEQ ID NO: 21753-25569 |
| papilloma | SEQ ID NO: 25570-27118 |
| poliovirus | SEQ ID NO: 27119-28601 |
| rabies | SEQ ID NO: 28602-30976 |
| random_sequences | SEQ ID NO: 30977-41790 |
| smallpox | SEQ ID NO: 41791-78900 |
| west nile | SEQ ID NO: 78901-81100 |
| yellow fever | SEQ ID NO: 81101-83267 |
| zika | SEQ ID NO: 83268-85423 |
| human_AC009336.2 | SEQ ID NO: 85424-85465 |
| human_AC012531.2 | SEQ ID NO: 85466-85501 |
| human_AC097634.4 | SEQ ID NO: 85502-85702 |
| human_ACTB | SEQ ID NO: 85703-85812 |
| human_ACTL6A | SEQ ID NO: 85813-85926 |
| human_ACTN4 | SEQ ID NO: 85927-86197 |
| human_AEBP1 | SEQ ID NO: 86198-86542 |
| human_AEBP2 | SEQ ID NO: 86543-86695 |
| human_AGO1 | SEQ ID NO: 86696-86950 |
| human_AGO2 | SEQ ID NO: 86951-87206 |
| human_AHR | SEQ ID NO: 87207-87458 |
| human_AIRE | SEQ ID NO: 87459-87619 |

TABLE 5-continued

List of SEQ ID NOs: 1-244,000 denoting viral
or transcription factor specificity

| Virus/Source Gene | |
|---|---|
| human_AKNA | SEQ ID NO: 87620-87887 |
| human_AL121581.1 | SEQ ID NO: 87888-88134 |
| human_ALX1 | SEQ ID NO: 88135-88230 |
| human_ALX4 | SEQ ID NO: 88231-88351 |
| human_ANHX | SEQ ID NO: 88352-88463 |
| human_AR | SEQ ID NO: 88464-88737 |
| human_ARHGAP35 | SEQ ID NO: 88738-89185 |
| human_ARID3A | SEQ ID NO: 89186-89361 |
| human_ARID3B | SEQ ID NO: 89362-89527 |
| human_ARID3C | SEQ ID NO: 89528-89648 |
| human_ARID4A | SEQ ID NO: 89649-90002 |
| human_ARID4B | SEQ ID NO: 90003-90393 |
| human_ARID5A | SEQ ID NO: 90394-90569 |
| human_ARID5B | SEQ ID NO: 90570-90923 |
| human_ARNT | SEQ ID NO: 90924-91157 |
| human_ARNT2 | SEQ ID NO: 91158-91370 |
| human_ARNTL | SEQ ID NO: 91371-91556 |
| human_ARNTL2 | SEQ ID NO: 91557-91730 |
| human_ARRB1 | SEQ ID NO: 91731-91851 |
| human_ARX | SEQ ID NO: 91852-92017 |
| human_ASCL1 | SEQ ID NO: 92018-92086 |
| human_ASCL2 | SEQ ID NO: 92087-92142 |
| human_ASCL3 | SEQ ID NO: 92143-92194 |
| human_ASCL4 | SEQ ID NO: 92195-92244 |
| human_ASCL5 | SEQ ID NO: 92245-92304 |
| human_ASH2L | SEQ ID NO: 92305-92490 |
| human_ATF1 | SEQ ID NO: 92491-92569 |
| human_ATF2 | SEQ ID NO: 92570-92718 |
| human_ATF3 | SEQ ID NO: 92719-92770 |
| human_ATF4 | SEQ ID NO: 92771-92873 |
| human_ATF5 | SEQ ID NO: 92874-92955 |
| human_ATF6 | SEQ ID NO: 92956-93154 |
| human_ATF6B | SEQ ID NO: 93155-93363 |
| human_ATMIN | SEQ ID NO: 93364-93608 |
| human_ATOH1 | SEQ ID NO: 93609-93712 |
| human_ATOH8 | SEQ ID NO: 93713-93806 |
| human_ATXN3 | SEQ ID NO: 93807-93912 |
| human_BACH1 | SEQ ID NO: 93913-94131 |
| human_BACH2 | SEQ ID NO: 94132-94381 |
| human_BARHL1 | SEQ ID NO: 94382-94477 |
| human_BARHL2 | SEQ ID NO: 94478-94591 |
| human_BARX1 | SEQ ID NO: 94592-94665 |
| human_BARX2 | SEQ ID NO: 94666-94747 |
| human_BASP1 | SEQ ID NO: 94748-94813 |
| human_BATF | SEQ ID NO: 94814-94848 |
| human_BATF2 | SEQ ID NO: 94849-94928 |
| human_BATF3 | SEQ ID NO: 94929-94964 |
| human_BAZ2A | SEQ ID NO: 94965-95533 |
| human_BCL11A | SEQ ID NO: 95534-95771 |
| human_BCL11B | SEQ ID NO: 95772-96037 |
| human_BCL6 | SEQ ID NO: 96038-96247 |
| human_BCL6B | SEQ ID NO: 96248-96389 |
| human_BCOR | SEQ ID NO: 96390-96903 |
| human_BHLHA15 | SEQ ID NO: 96904-96958 |
| human_BHLHE40 | SEQ ID NO: 96959-97079 |
| human_BHLHE41 | SEQ ID NO: 97080-97221 |
| human_BORCS8-MEF2B | SEQ ID NO: 97222-97328 |
| human_BRCA1 | SEQ ID NO: 97329-97542 |
| human_BRD7 | SEQ ID NO: 97543-97735 |
| human_BRF2 | SEQ ID NO: 97736-97859 |
| human_CALCOCO1 | SEQ ID NO: 97860-98064 |
| human_CARF | SEQ ID NO: 98065-98279 |
| human_CARM1 | SEQ ID NO: 98280-98459 |
| human_CBX4 | SEQ ID NO: 98460-98625 |
| human_CC2D1A | SEQ ID NO: 98626-98908 |
| human_CC2D1B | SEQ ID NO: 98909-99163 |
| human_CCAR1 | SEQ ID NO: 99164-99506 |
| human_CCNT1 | SEQ ID NO: 99507-99722 |
| human_CDC5L | SEQ ID NO: 99723-99960 |
| human_CDK12 | SEQ ID NO: 99961-100405 |
| human_CDK13 | SEQ ID NO: 100406-100856 |
| human_CDK5RAP2 | SEQ ID NO: 100857-101422 |
| human_CDK9 | SEQ ID NO: 101423-101531 |
| human_CDX1 | SEQ ID NO: 101532-101608 |
| human_CDX2 | SEQ ID NO: 101609-101700 |

TABLE 5-continued

List of SEQ ID NOs: 1-244,000 denoting viral
or transcription factor specificity

| Virus/Source Gene | |
|---|---|
| human_CDX4 | SEQ ID NO: 101701-101783 |
| human_CEBPA | SEQ ID NO: 101784-101888 |
| human_CEBPB | SEQ ID NO: 101889-101989 |
| human_CEBPD | SEQ ID NO: 101990-102068 |
| human_CEBPE | SEQ ID NO: 102069-102150 |
| human_CEBPG | SEQ ID NO: 102151-102193 |
| human_CEBPZ | SEQ ID NO: 102194-102507 |
| human_CGGBP1 | SEQ ID NO: 102508-102555 |
| human_CHD2 | SEQ ID NO: 102556-102703 |
| human_CHD4 | SEQ ID NO: 102704-103283 |
| human_CHD7 | SEQ ID NO: 103284-104180 |
| human_CIART | SEQ ID NO: 104181-104293 |
| human_CIITA | SEQ ID NO: 104294-104455 |
| human_CITED1 | SEQ ID NO: 104456-104511 |
| human_CLOCK | SEQ ID NO: 104512-104763 |
| human_CNBP | SEQ ID NO: 104764-104814 |
| human_CREB1 | SEQ ID NO: 104815-104910 |
| human_CREB3 | SEQ ID NO: 104911-105019 |
| human_CREB3L1 | SEQ ID NO: 105020-105173 |
| human_CREB3L2 | SEQ ID NO: 105174-105327 |
| human_CREB3L3 | SEQ ID NO: 105328-105463 |
| human_CREB3L4 | SEQ ID NO: 105464-105579 |
| human_CREBBP | SEQ ID NO: 105580-106309 |
| human_CREBRF | SEQ ID NO: 106310-106499 |
| human_CREM | SEQ ID NO: 106500-106587 |
| human_CRX | SEQ ID NO: 106588-106675 |
| human_CRY1 | SEQ ID NO: 106676-106849 |
| human_CRY2 | SEQ ID NO: 106850-107006 |
| human_CT476828.9 | SEQ ID NO: 107007-107131 |
| human_CTCF | SEQ ID NO: 107132-107347 |
| human_CTCFL | SEQ ID NO: 107348-107544 |
| human_CUX1 | SEQ ID NO: 107545-107993 |
| human_CUX2 | SEQ ID NO: 107994-108437 |
| human_CXXC1 | SEQ ID NO: 108438-108633 |
| human_DACH1 | SEQ ID NO: 108634-108843 |
| human_DBP | SEQ ID NO: 108844-108938 |
| human_DDIT3 | SEQ ID NO: 108939-108987 |
| human_DDN | SEQ ID NO: 108988-109198 |
| human_DEAF1 | SEQ ID NO: 109199-109365 |
| human_DHX36 | SEQ ID NO: 109366-109657 |
| human_DHX9 | SEQ ID NO: 109658-110036 |
| human_DLX1 | SEQ ID NO: 110037-110110 |
| human_DLX2 | SEQ ID NO: 110111-110206 |
| human_DLX4 | SEQ ID NO: 110207-110276 |
| human_DLX5 | SEQ ID NO: 110277-110361 |
| human_DMBX1 | SEQ ID NO: 110362-110472 |
| human_DMRT1 | SEQ ID NO: 110473-110582 |
| human_DMRT2 | SEQ ID NO: 110583-110748 |
| human_DNMT3A | SEQ ID NO: 110749-111019 |
| human_DPF2 | SEQ ID NO: 111020-111079 |
| human_DR1 | SEQ ID NO: 111080-111130 |
| human_DRAP1 | SEQ ID NO: 111131-111189 |
| human_DUX4 | SEQ ID NO: 111190-111314 |
| human_E2F1 | SEQ ID NO: 111315-111443 |
| human_E2F2 | SEQ ID NO: 111444-111572 |
| human_E2F3 | SEQ ID NO: 111573-111709 |
| human_E2F4 | SEQ ID NO: 111710-111831 |
| human_E2F6 | SEQ ID NO: 111832-111904 |
| human_E2F7 | SEQ ID NO: 111905-112175 |
| human_E2F8 | SEQ ID NO: 112176-112433 |
| human_E4F1 | SEQ ID NO: 112434-112666 |
| human_EAF2 | SEQ ID NO: 112667-112742 |
| human_EBF2 | SEQ ID NO: 112743-112912 |
| human_EBF3 | SEQ ID NO: 112913-113075 |
| human_EBF4 | SEQ ID NO: 113076-113252 |
| human_EED | SEQ ID NO: 113253-113390 |
| human_EGR1 | SEQ ID NO: 113391-113551 |
| human_EGR2 | SEQ ID NO: 113552-113692 |
| human_EGR3 | SEQ ID NO: 113693-113806 |
| human_EGR4 | SEQ ID NO: 113807-113981 |
| human_EHF | SEQ ID NO: 113982-114069 |
| human_EHMT2 | SEQ ID NO: 114070-114437 |
| human_ELF1 | SEQ ID NO: 114438-114621 |
| human_ELF3 | SEQ ID NO: 114622-114730 |
| human_ELF4 | SEQ ID NO: 114731-114927 |

TABLE 5-continued

List of SEQ ID NOs: 1-244,000 denoting viral
or transcription factor specificity

| Virus/Source Gene | |
| --- | --- |
| human_ELF5 | SEQ ID NO: 114928-115004 |
| human_ELK1 | SEQ ID NO: 115005-115130 |
| human_ELK3 | SEQ ID NO: 115131-115250 |
| human_ELK4 | SEQ ID NO: 115251-115369 |
| human_ELL3 | SEQ ID NO: 115370-115486 |
| human_ELMSAN1 | SEQ ID NO: 115487-115797 |
| human_EN1 | SEQ ID NO: 115798-115912 |
| human_ENO1 | SEQ ID NO: 115913-116040 |
| human_EOMES | SEQ ID NO: 116041-116249 |
| human_EP300 | SEQ ID NO: 116250-116971 |
| human_ERBB4 | SEQ ID NO: 116972-117361 |
| human_ERG | SEQ ID NO: 117362-117503 |
| human_ESR1 | SEQ ID NO: 117504-117679 |
| human_ESR2 | SEQ ID NO: 117680-117809 |
| human_ESRRA | SEQ ID NO: 117810-117934 |
| human_ESRRB | SEQ ID NO: 117935-118084 |
| human_ESRRG | SEQ ID NO: 118085-118223 |
| human_ESX1 | SEQ ID NO: 118224-118343 |
| human_ETS1 | SEQ ID NO: 118344-118473 |
| human_ETS2 | SEQ ID NO: 118474-118612 |
| human_ETV1 | SEQ ID NO: 118613-118748 |
| human_ETV2 | SEQ ID NO: 118749-118848 |
| human_ETV3 | SEQ ID NO: 118849-118999 |
| human_ETV4 | SEQ ID NO: 119000-119142 |
| human_ETV5 | SEQ ID NO: 119143-119293 |
| human_ETV6 | SEQ ID NO: 119294-119426 |
| human_ETV7 | SEQ ID NO: 119427-119526 |
| human_EZH2 | SEQ ID NO: 119527-119749 |
| human_FERD3L | SEQ ID NO: 119750-119797 |
| human_FEZF1 | SEQ ID NO: 119798-119937 |
| human_FEZF2 | SEQ ID NO: 119938-120073 |
| human_FIGLA | SEQ ID NO: 120074-120137 |
| human_FLI1 | SEQ ID NO: 120138-120270 |
| human_FOS | SEQ ID NO: 120271-120382 |
| human_FOSB | SEQ ID NO: 120383-120481 |
| human_FOSL1 | SEQ ID NO: 120482-120560 |
| human_FOSL2 | SEQ ID NO: 120561-120656 |
| human_FOXA1 | SEQ ID NO: 120657-120795 |
| human_FOXA2 | SEQ ID NO: 120796-120930 |
| human_FOXA3 | SEQ ID NO: 120931-121033 |
| human_FOXC1 | SEQ ID NO: 121034-121197 |
| human_FOXC2 | SEQ ID NO: 121198-121345 |
| human_FOXD1 | SEQ ID NO: 121346-121482 |
| human_FOXD3 | SEQ ID NO: 121483-121623 |
| human_FOXF1 | SEQ ID NO: 121624-121735 |
| human_FOXF2 | SEQ ID NO: 121736-121866 |
| human_FOXH1 | SEQ ID NO: 121867-121973 |
| human_FOXI1 | SEQ ID NO: 121974-122084 |
| human_FOXJ1 | SEQ ID NO: 122085-122208 |
| human_FOXJ2 | SEQ ID NO: 122209-122378 |
| human_FOXK1 | SEQ ID NO: 122379-122596 |
| human_FOXK2 | SEQ ID NO: 122597-122792 |
| human_FOXL2 | SEQ ID NO: 122793-122903 |
| human_FOXM1 | SEQ ID NO: 122904-123141 |
| human_FOXN4 | SEQ ID NO: 123142-123294 |
| human_FOXO3 | SEQ ID NO: 123295-123494 |
| human_FOXP2 | SEQ ID NO: 123495-123714 |
| human_FOXP3 | SEQ ID NO: 123715-123841 |
| human_FOXQ1 | SEQ ID NO: 123842-123960 |
| human_FOXS1 | SEQ ID NO: 123961-124057 |
| human_FUBP3 | SEQ ID NO: 124058-124226 |
| human_GABPA | SEQ ID NO: 124227-124360 |
| human_GABPB1 | SEQ ID NO: 124361-124476 |
| human_GABPB2 | SEQ ID NO: 124477-124608 |
| human_GADD45A | SEQ ID NO: 124609-124655 |
| human_GATA1 | SEQ ID NO: 124656-124777 |
| human_GATA2 | SEQ ID NO: 124778-124919 |
| human_GATA3 | SEQ ID NO: 124920-125050 |
| human_GATA4 | SEQ ID NO: 125051-125180 |
| human_GATA5 | SEQ ID NO: 125181-125297 |
| human_GATA6 | SEQ ID NO: 125298-125473 |
| human_GATAD2B | SEQ ID NO: 125474-125649 |
| human_GBX2 | SEQ ID NO: 125650-125751 |
| human_GCFC2 | SEQ ID NO: 125752-125983 |
| human_GCM1 | SEQ ID NO: 125984-126112 |

TABLE 5-continued

List of SEQ ID NOs: 1-244,000 denoting viral
or transcription factor specificity

| Virus/Source Gene | |
| --- | --- |
| human_GFI1 | SEQ ID NO: 126113-126236 |
| human_GLI1 | SEQ ID NO: 126237-126566 |
| human_GLI2 | SEQ ID NO: 126567-127040 |
| human_GLI3 | SEQ ID NO: 127041-127512 |
| human_GLIS1 | SEQ ID NO: 127513-127696 |
| human_GLIS2 | SEQ ID NO: 127697-127851 |
| human_GLMP | SEQ ID NO: 127852-127971 |
| human_GMEB1 | SEQ ID NO: 127972-128141 |
| human_GMEB2 | SEQ ID NO: 128142-128298 |
| human_GRHL1 | SEQ ID NO: 128299-128481 |
| human_GRHL2 | SEQ ID NO: 128482-128666 |
| human_GSC | SEQ ID NO: 128667-128741 |
| human_GSX1 | SEQ ID NO: 128742-128818 |
| human_GTF2B | SEQ ID NO: 128819-128911 |
| human_GTF3C1 | SEQ ID NO: 128912-129542 |
| human_GZF1 | SEQ ID NO: 129543-129753 |
| human_H2AFY | SEQ ID NO: 129754-129862 |
| human_H2AFY2 | SEQ ID NO: 129863-129971 |
| human_H2AFZ | SEQ ID NO: 129972-130007 |
| human_H3F3A | SEQ ID NO: 130008-130046 |
| human_H3F3B | SEQ ID NO: 130047-130085 |
| human_HAND1 | SEQ ID NO: 130086-130147 |
| human_HAND2 | SEQ ID NO: 130148-130210 |
| human_HDAC1 | SEQ ID NO: 130211-130352 |
| human_HDAC2 | SEQ ID NO: 130353-130487 |
| human_HDAC4 | SEQ ID NO: 130488-130810 |
| human_HDAC5 | SEQ ID NO: 130811-131145 |
| human_HDAC6 | SEQ ID NO: 131146-131507 |
| human_HELT | SEQ ID NO: 131508-131577 |
| human_HES1 | SEQ ID NO: 131578-131659 |
| human_HES2 | SEQ ID NO: 131660-131709 |
| human_HES3 | SEQ ID NO: 131710-131763 |
| human_HES4 | SEQ ID NO: 131764-131827 |
| human_HES5 | SEQ ID NO: 131828-131875 |
| human_HES6 | SEQ ID NO: 131876-131940 |
| human_HES7 | SEQ ID NO: 131941-132005 |
| human_HESX1 | SEQ ID NO: 132006-132058 |
| human_HEY1 | SEQ ID NO: 132059-132148 |
| human_HEY2 | SEQ ID NO: 132149-132247 |
| human_HEYL | SEQ ID NO: 132248-132343 |
| human_HHEX | SEQ ID NO: 132344-132422 |
| human_HIC2 | SEQ ID NO: 132423-132604 |
| human_HIF1A | SEQ ID NO: 132605-132857 |
| human_HINFP | SEQ ID NO: 132858-133010 |
| human_HIVEP1 | SEQ ID NO: 133011-133823 |
| human_HLF | SEQ ID NO: 133824-133909 |
| human_HLTF | SEQ ID NO: 133910-134210 |
| human_HMGA1 | SEQ ID NO: 134211-134237 |
| human_HMGA2 | SEQ ID NO: 134238-134267 |
| human_HMGB1 | SEQ ID NO: 134268-134329 |
| human_HMGB2 | SEQ ID NO: 134330-134390 |
| human_HMX1 | SEQ ID NO: 134391-134492 |
| human_HMX3 | SEQ ID NO: 134493-134597 |
| human_HNF1A | SEQ ID NO: 134598-134678 |
| human_HNF1B | SEQ ID NO: 134679-134843 |
| human_HNF4A | SEQ ID NO: 134844-134976 |
| human_HNF4G | SEQ ID NO: 134977-135096 |
| human_HNRNPC | SEQ ID NO: 135097-135186 |
| human_HNRNPK | SEQ ID NO: 135187-135323 |
| human_HNRNPL | SEQ ID NO: 135324-135498 |
| human_HNRNPU | SEQ ID NO: 135499-135743 |
| human_HOXA10 | SEQ ID NO: 135744-135864 |
| human_HOXA2 | SEQ ID NO: 135865-135975 |
| human_HOXA3 | SEQ ID NO: 135976-136106 |
| human_HOXA4 | SEQ ID NO: 136107-136200 |
| human_HOXA5 | SEQ ID NO: 136201-136279 |
| human_HOXA6 | SEQ ID NO: 136280-136347 |
| human_HOXA7 | SEQ ID NO: 136348-136414 |
| human_HOXA9 | SEQ ID NO: 136415-136493 |
| human_HOXB1 | SEQ ID NO: 136494-136581 |
| human_HOXB2 | SEQ ID NO: 136582-136686 |
| human_HOXB3 | SEQ ID NO: 136687-136813 |
| human_HOXB4 | SEQ ID NO: 136814-136886 |
| human_HOXB5 | SEQ ID NO: 136887-136965 |
| human_HOXB6 | SEQ ID NO: 136966-137030 |

TABLE 5-continued

List of SEQ ID NOs: 1-244,000 denoting viral
or transcription factor specificity Virus/Source Gene

| | |
|---|---|
| human_HOXB7 | SEQ ID NO: 137031-137093 |
| human_HOXB9 | SEQ ID NO: 137094-137166 |
| human_HOXC10 | SEQ ID NO: 137167-137266 |
| human_HOXC11 | SEQ ID NO: 137267-137355 |
| human_HOXC4 | SEQ ID NO: 137356-137432 |
| human_HOXC5 | SEQ ID NO: 137433-137496 |
| human_HOXC6 | SEQ ID NO: 137497-137564 |
| human_HOXD10 | SEQ ID NO: 137565-137664 |
| human_HOXD13 | SEQ ID NO: 137665-137765 |
| human_HOXD3 | SEQ ID NO: 137766-137892 |
| human_HOXD4 | SEQ ID NO: 137893-137966 |
| human_HOXD8 | SEQ ID NO: 137967-138051 |
| human_HOXD9 | SEQ ID NO: 138052-138154 |
| human_HR | SEQ ID NO: 138155-138492 |
| human_HSF1 | SEQ ID NO: 138493-138649 |
| human_HSF2 | SEQ ID NO: 138650-138808 |
| human_HSF4 | SEQ ID NO: 138809-138944 |
| human_HSF5 | SEQ ID NO: 138945-139121 |
| human_HSFX1 | SEQ ID NO: 139122-139246 |
| human_HSFX2 | SEQ ID NO: 139247-139371 |
| human_HSFX3 | SEQ ID NO: 139372-139469 |
| human_HSFX4 | SEQ ID NO: 139470-139567 |
| human_HSFY1 | SEQ ID NO: 139568-139626 |
| human_HSFY2 | SEQ ID NO: 139627-139744 |
| human_IER2 | SEQ ID NO: 139745-139809 |
| human_IFI16 | SEQ ID NO: 139810-140042 |
| human_IKZF1 | SEQ ID NO: 140043-140196 |
| human_IKZF2 | SEQ ID NO: 140197-140209 |
| human_IKZF3 | SEQ ID NO: 140210-140286 |
| human_IKZF4 | SEQ ID NO: 140287-140459 |
| human_IKZF5 | SEQ ID NO: 140460-140583 |
| human_INSM1 | SEQ ID NO: 140584-140734 |
| human_IRF1 | SEQ ID NO: 140735-140829 |
| human_IRF2 | SEQ ID NO: 140830-140932 |
| human_IRF2BP1 | SEQ ID NO: 140933-141105 |
| human_IRF2BP2 | SEQ ID NO: 141106-141279 |
| human_IRF2BPL | SEQ ID NO: 141280-141516 |
| human_IRF3 | SEQ ID NO: 141517-141642 |
| human_IRF4 | SEQ ID NO: 141643-141775 |
| human_IRF5 | SEQ ID NO: 141776-141922 |
| human_IRF6 | SEQ ID NO: 141923-142060 |
| human_IRF7 | SEQ ID NO: 142061-142213 |
| human_IRF8 | SEQ ID NO: 142214-142339 |
| human_IRF9 | SEQ ID NO: 142340-142400 |
| human_ISL1 | SEQ ID NO: 142401-142503 |
| human_JARID2 | SEQ ID NO: 142504-142875 |
| human_JDP2 | SEQ ID NO: 142876-142925 |
| human_JMJD1C | SEQ ID NO: 142926-143685 |
| human_JUN | SEQ ID NO: 143686-143782 |
| human_JUNB | SEQ ID NO: 143783-143884 |
| human_JUND | SEQ ID NO: 143885-143986 |
| human_KAT2B | SEQ ID NO: 143987-144233 |
| human_KAT7 | SEQ ID NO: 144234-144414 |
| human_KCNIP3 | SEQ ID NO: 144415-144489 |
| human_KDM1A | SEQ ID NO: 144490-144750 |
| human_KDM2B | SEQ ID NO: 144751-145149 |
| human_KDM3A | SEQ ID NO: 145150-145543 |
| human_KDM3B | SEQ ID NO: 145544-146069 |
| human_KDM5A | SEQ ID NO: 146070-146574 |
| human_KDM6A | SEQ ID NO: 146575-146992 |
| human_KDM6B | SEQ ID NO: 146993-147494 |
| human_KLF1 | SEQ ID NO: 147495-147600 |
| human_KLF10 | SEQ ID NO: 147601-147742 |
| human_KLF11 | SEQ ID NO: 147743-147893 |
| human_KLF12 | SEQ ID NO: 147894-148011 |
| human_KLF13 | SEQ ID NO: 148012-148095 |
| human_KLF15 | SEQ ID NO: 148096-148218 |
| human_KLF16 | SEQ ID NO: 148219-148291 |
| human_KLF17 | SEQ ID NO: 148292-148406 |
| human_KLF3 | SEQ ID NO: 148407-148507 |
| human_KLF4 | SEQ ID NO: 148508-148649 |
| human_KLF5 | SEQ ID NO: 148650-148784 |
| human_KLF6 | SEQ ID NO: 148785-148866 |
| human_KLF7 | SEQ ID NO: 148867-148954 |
| human_KLF8 | SEQ ID NO: 148955-149029 |

TABLE 5-continued

List of SEQ ID NOs: 1-244,000 denoting viral
or transcription factor specificity Virus/Source Gene

| | |
|---|---|
| human_KMT2A | SEQ ID NO: 149030-150218 |
| human_KMT2D | SEQ ID NO: 150219-151877 |
| human_LDB1 | SEQ ID NO: 151878-151998 |
| human_LEF1 | SEQ ID NO: 151999-152116 |
| human_LHX2 | SEQ ID NO: 152117-152236 |
| human_LHX3 | SEQ ID NO: 152237-152354 |
| human_LITAF | SEQ ID NO: 152355-152400 |
| human_LMO2 | SEQ ID NO: 152401-152466 |
| human_LMO4 | SEQ ID NO: 152467-152513 |
| human_LMX1A | SEQ ID NO: 152514-152625 |
| human_LMX1B | SEQ ID NO: 152626-152745 |
| human_LONP1 | SEQ ID NO: 152746-153031 |
| human_LRRFIP1 | SEQ ID NO: 153032-153264 |
| human_LYL1 | SEQ ID NO: 153265-153346 |
| human_MACC1 | SEQ ID NO: 153347-153599 |
| human_MAF | SEQ ID NO: 153600-153718 |
| human_MAF1 | SEQ ID NO: 153719-153793 |
| human_MAFA | SEQ ID NO: 153794-153897 |
| human_MAFB | SEQ ID NO: 153898-153992 |
| human_MAFF | SEQ ID NO: 153993-154039 |
| human_MAFG | SEQ ID NO: 154040-154085 |
| human_MAFK | SEQ ID NO: 154086-154130 |
| human_MAX | SEQ ID NO: 154131-154157 |
| human_MAZ | SEQ ID NO: 154158-154303 |
| human_MBD2 | SEQ ID NO: 154304-154424 |
| human_MBD3 | SEQ ID NO: 154425-154500 |
| human_MED1 | SEQ ID NO: 154501-154972 |
| human_MED2 | SEQ ID NO: 154973-155623 |
| human_MED8 | SEQ ID NO: 155624-155711 |
| human_MEF2A | SEQ ID NO: 155712-155858 |
| human_MEF2B | SEQ ID NO: 155859-155968 |
| human_MEF2C | SEQ ID NO: 155969-156111 |
| human_MEF2D | SEQ ID NO: 156112-156265 |
| human_MEIS1 | SEQ ID NO: 156266-156380 |
| human_MEIS2 | SEQ ID NO: 156381-156468 |
| human_MEN1 | SEQ ID NO: 156469-156650 |
| human_MEOX1 | SEQ ID NO: 156651-156724 |
| human_MEOX2 | SEQ ID NO: 156725-156813 |
| human_MESP1 | SEQ ID NO: 156814-156891 |
| human_MESP2 | SEQ ID NO: 156892-157008 |
| human_MITF | SEQ ID NO: 157009-157162 |
| human_MIXL1 | SEQ ID NO: 157163-157229 |
| human_MLX | SEQ ID NO: 157230-157316 |
| human_MLXIP | SEQ ID NO: 157317-157590 |
| human_MLXIPL | SEQ ID NO: 157591-157760 |
| human_MMP12 | SEQ ID NO: 157761-157899 |
| human_MNT | SEQ ID NO: 157900-158071 |
| human_MRTFA | SEQ ID NO: 158072-158359 |
| human_MSC | SEQ ID NO: 158360-158419 |
| human_MSGN1 | SEQ ID NO: 158420-158475 |
| human_MSX1 | SEQ ID NO: 158476-158564 |
| human_MSX2 | SEQ ID NO: 158565-158642 |
| human_MTA1 | SEQ ID NO: 158643-158854 |
| human_MTA2 | SEQ ID NO: 158855-159052 |
| human_MTERF3 | SEQ ID NO: 159053-159175 |
| | SEQ ID NOs: 159176-244000 |
| | |
| human_MTF1 | SEQ ID NO: 159176-159399 |
| human_MTF2 | SEQ ID NO: 159400-159575 |
| human_MTOR | SEQ ID NO: 159576-160338 |
| human_MUC1 | SEQ ID NO: 160339-160418 |
| human_MXD1 | SEQ ID NO: 160419-160482 |
| human_MXD3 | SEQ ID NO: 160483-160542 |
| human_MXI1 | SEQ ID NO: 160543-160608 |
| human_MYB | SEQ ID NO: 160609-160834 |
| human_MYBBP1A | SEQ ID NO: 160835-161231 |
| human_MYBL1 | SEQ ID NO: 161232-161454 |
| human_MYBL2 | SEQ ID NO: 161455-161662 |
| human_MYC | SEQ ID NO: 161663-161792 |
| human_MYCN | SEQ ID NO: 161793-161929 |
| human_MYEF2 | SEQ ID NO: 161930-161965 |
| human_MYF5 | SEQ ID NO: 161966-162039 |
| human_MYF6 | SEQ ID NO: 162040-162109 |
| human_MYOCD | SEQ ID NO: 162110-162388 |
| human_MYOD1 | SEQ ID NO: 162389-162482 |

TABLE 5-continued

List of SEQ ID NOs: 1-244,000 denoting viral
or transcription factor specificity Virus/Source Gene

| | |
|---|---|
| human_MYOG | SEQ ID NO: 162483-162547 |
| human_MYPOP | SEQ ID NO: 162548-162665 |
| human_MYT1 | SEQ ID NO: 162666-162999 |
| human_MYT1L | SEQ ID NO: 163000-163352 |
| human_MZF1 | SEQ ID NO: 163353-163570 |
| human_NACC2 | SEQ ID NO: 163571-163744 |
| human_NANOG | SEQ ID NO: 163745-163833 |
| human_NCOA2 | SEQ ID NO: 163834-164270 |
| human_NCOR1 | SEQ ID NO: 164271-165000 |
| human_NCOR2 | SEQ ID NO: 165001-165752 |
| human_NDN | SEQ ID NO: 165753-165846 |
| human_NEUROD1 | SEQ ID NO: 165847-165951 |
| human_NEUROD2 | SEQ ID NO: 165952-166063 |
| human_NEUROD6 | SEQ ID NO: 166064-166162 |
| human_NEUROG1 | SEQ ID NO: 166163-166231 |
| human_NEUROG2 | SEQ ID NO: 166232-166310 |
| human_NEUROG3 | SEQ ID NO: 166311-166372 |
| human_NFAT5 | SEQ ID NO: 166373-166829 |
| human_NFATC1 | SEQ ID NO: 166830-167074 |
| human_NFATC2 | SEQ ID NO: 167075-167348 |
| human_NFATC3 | SEQ ID NO: 167349-167668 |
| human_NFATC4 | SEQ ID NO: 167669-167936 |
| human_NFE2 | SEQ ID NO: 167937-168046 |
| human_NFE2L1 | SEQ ID NO: 168047-168266 |
| human_NFE2L2 | SEQ ID NO: 168267-168445 |
| human_NFE2L3 | SEQ ID NO: 168446-168651 |
| human_NFIA | SEQ ID NO: 168652-168799 |
| human_NFIB | SEQ ID NO: 168800-168923 |
| human_NFIC | SEQ ID NO: 168924-169049 |
| human_NFIL3 | SEQ ID NO: 169050-169185 |
| human_NFKB1 | SEQ ID NO: 169186-169474 |
| human_NFKB2 | SEQ ID NO: 169475-169742 |
| human_NFX1 | SEQ ID NO: 169743-169990 |
| human_NFXL1 | SEQ ID NO: 169991-170261 |
| human_NFYA | SEQ ID NO: 170262-170354 |
| human_NFYB | SEQ ID NO: 170355-170414 |
| human_NFYC | SEQ ID NO: 170415-170549 |
| human_NHLH1 | SEQ ID NO: 170550-170587 |
| human_NHLH2 | SEQ ID NO: 170588-170625 |
| human_NKRF | SEQ ID NO: 170626-170830 |
| human_NKX2-1 | SEQ ID NO: 170831-170948 |
| human_NKX2-2 | SEQ ID NO: 170949-171028 |
| human_NKX2-5 | SEQ ID NO: 171029-171123 |
| human_NKX2-6 | SEQ ID NO: 171124-171211 |
| human_NKX2-8 | SEQ ID NO: 171212-171281 |
| human_NKX3-1 | SEQ ID NO: 171282-171349 |
| human_NKX3-2 | SEQ ID NO: 171350-171447 |
| human_NKX6-1 | SEQ ID NO: 171448-171555 |
| human_NKX6-2 | SEQ ID NO: 171556-171636 |
| human_NLRC5 | SEQ ID NO: 171637-172194 |
| human_NME1 | SEQ ID NO: 172195-172245 |
| human_NONO | SEQ ID NO: 172246-172384 |
| human_NOTCH1 | SEQ ID NO: 172385-173148 |
| human_NPAS2 | SEQ ID NO: 173149-173393 |
| human_NPAS4 | SEQ ID NO: 173394-173631 |
| human_NPM1 | SEQ ID NO: 173632-173717 |
| human_NR1D1 | SEQ ID NO: 173718-173899 |
| human_NR1D2 | SEQ ID NO: 173900-174071 |
| human_NR1H2 | SEQ ID NO: 174072-174207 |
| human_NR1H3 | SEQ ID NO: 174208-174321 |
| human_NR1H4 | SEQ ID NO: 174322-174463 |
| human_NR1I2 | SEQ ID NO: 174464-174603 |
| human_NR1I3 | SEQ ID NO: 174604-174706 |
| human_NR2C1 | SEQ ID NO: 174707-174885 |
| human_NR2C2 | SEQ ID NO: 174886-175067 |
| human_NR2E3 | SEQ ID NO: 175068-175188 |
| human_NR2F1 | SEQ ID NO: 175189-175313 |
| human_NR2F6 | SEQ ID NO: 175314-175432 |
| human_NR3C1 | SEQ ID NO: 175433-175663 |
| human_NR4A1 | SEQ ID NO: 175664-175840 |
| human_NR4A2 | SEQ ID NO: 175841-176017 |
| human_NR4A3 | SEQ ID NO: 176018-176206 |
| human_NR5A1 | SEQ ID NO: 176207-176342 |
| human_NR5A2 | SEQ ID NO: 176343-176488 |
| human_NR6A1 | SEQ ID NO: 176489-176630 |

TABLE 5-continued

List of SEQ ID NOs: 1-244,000 denoting viral
or transcription factor specificity Virus/Source Gene

| | |
|---|---|
| human_NRF1 | SEQ ID NO: 176631-176779 |
| human_NRIP1 | SEQ ID NO: 176780-177124 |
| human_NRL | SEQ ID NO: 177125-177193 |
| human_NSD1 | SEQ ID NO: 177194-177919 |
| human_ONECUT2 | SEQ ID NO: 177920-178068 |
| human_ONECUT3 | SEQ ID NO: 178069-178214 |
| human_OSR1 | SEQ ID NO: 178215-178292 |
| human_OSR2 | SEQ ID NO: 178293-178383 |
| human_OTX1 | SEQ ID NO: 178384-178487 |
| human_OTX2 | SEQ ID NO: 178488-178574 |
| human_OVOL1 | SEQ ID NO: 178575-178652 |
| human_PARP1 | SEQ ID NO: 178653-178954 |
| human_PATZ1 | SEQ ID NO: 178955-179158 |
| human_PAX1 | SEQ ID NO: 179159-179316 |
| human_PAX2 | SEQ ID NO: 179317-179432 |
| human_PAX4 | SEQ ID NO: 179433-179533 |
| human_PAX5 | SEQ ID NO: 179534-179648 |
| human_PAX6 | SEQ ID NO: 179649-179772 |
| human_PAX8 | SEQ ID NO: 179773-179866 |
| human_PAX9 | SEQ ID NO: 179867-179966 |
| human_PAXBP1 | SEQ ID NO: 179967-180208 |
| human_PBX1 | SEQ ID NO: 180209-180335 |
| human_PBX2 | SEQ ID NO: 180336-180462 |
| human_PBX3 | SEQ ID NO: 180463-180590 |
| human_PCGF3 | SEQ ID NO: 180591-180660 |
| human_PCGF5 | SEQ ID NO: 180661-180735 |
| human_PCGF6 | SEQ ID NO: 180736-180815 |
| human_PDX1 | SEQ ID NO: 180816-180898 |
| human_PER1 | SEQ ID NO: 180899-181283 |
| human_PER2 | SEQ ID NO: 181284-181657 |
| human_PER3 | SEQ ID NO: 181658-182018 |
| human_PGR | SEQ ID NO: 182019-182265 |
| human_PHB | SEQ ID NO: 182266-182344 |
| human_PHOX2A | SEQ ID NO: 182345-182427 |
| human_PHOX2B | SEQ ID NO: 182428-182519 |
| human_PIH1D1 | SEQ ID NO: 182520-182604 |
| human_PITX1 | SEQ ID NO: 182605-182696 |
| human_PITX2 | SEQ ID NO: 182697-182791 |
| human_PITX3 | SEQ ID NO: 182792-182879 |
| human_PKNOX2 | SEQ ID NO: 182880-183018 |
| human_PLAG1 | SEQ ID NO: 183019-183166 |
| human_PLAGL1 | SEQ ID NO: 183167-183303 |
| human_POLRMT | SEQ ID NO: 183304-183670 |
| human_POU1F1 | SEQ ID NO: 183671-183763 |
| human_POU2AF1 | SEQ ID NO: 183764-183838 |
| human_POU2F1 | SEQ ID NO: 183839-184062 |
| human_POU2F2 | SEQ ID NO: 184063-184204 |
| human_POU2F3 | SEQ ID NO: 184205-184333 |
| human_POU3F2 | SEQ ID NO: 184334-184464 |
| human_POU3F4 | SEQ ID NO: 184465-184570 |
| human_POU4F1 | SEQ ID NO: 184571-184694 |
| human_POU4F2 | SEQ ID NO: 184695-184815 |
| human_POU4F3 | SEQ ID NO: 184816-184914 |
| human_POU5F1 | SEQ ID NO: 184915-185020 |
| human_POU6F1 | SEQ ID NO: 185021-185201 |
| human_PPARA | SEQ ID NO: 185202-185339 |
| human_PPARD | SEQ ID NO: 185340-185445 |
| human_PPARG | SEQ ID NO: 185446-185594 |
| human_PRDM1 | SEQ ID NO: 185595-185829 |
| human_PRDM11 | SEQ ID NO: 185830-185970 |
| human_PRDM12 | SEQ ID NO: 185971-186078 |
| human_PRDM13 | SEQ ID NO: 186079-186288 |
| human_PRDM14 | SEQ ID NO: 186289-186457 |
| human_PRDM15 | SEQ ID NO: 186458-186907 |
| human_PRDM2 | SEQ ID NO: 186908-187420 |
| human_PRDM4 | SEQ ID NO: 187421-187658 |
| human_PRDM5 | SEQ ID NO: 187659-187845 |
| human_PRDM6 | SEQ ID NO: 187846-188021 |
| human_PRDM7 | SEQ ID NO: 188022-188166 |
| human_PRDM9 | SEQ ID NO: 188167-188432 |
| human_PRDX5 | SEQ ID NO: 188433-188494 |
| human_PRKN | SEQ ID NO: 188495-188574 |
| human_PRMT5 | SEQ ID NO: 188575-188745 |
| human_PROP1 | SEQ ID NO: 188746-188811 |
| human_PROX1 | SEQ ID NO: 188812-189030 |

TABLE 5-continued

List of SEQ ID NOs: 1-244,000 denoting viral
or transcription factor specificity Virus/Source Gene

| | |
|---|---|
| human_PRRX1 | SEQ ID NO: 189031-189101 |
| human_PSPC1 | SEQ ID NO: 189102-189256 |
| human_PTF1A | SEQ ID NO: 189257-189352 |
| human_PURA | SEQ ID NO: 189353-189446 |
| human_PURB | SEQ ID NO: 189447-189537 |
| human_PURG | SEQ ID NO: 189538-189631 |
| human_RAI1 | SEQ ID NO: 189632-190201 |
| human_RARA | SEQ ID NO: 190202-190337 |
| human_RARB | SEQ ID NO: 190338-190469 |
| human_RARG | SEQ ID NO: 190470-190600 |
| human_RAX | SEQ ID NO: 190601-190629 |
| human_RAX2 | SEQ ID NO: 190630-190682 |
| human_RB1 | SEQ ID NO: 190683-190958 |
| human_RBBP4 | SEQ ID NO: 190959-191083 |
| human_RBBP5 | SEQ ID NO: 191084-191242 |
| human_RBL1 | SEQ ID NO: 191243-191544 |
| human_RBL2 | SEQ ID NO: 191545-191884 |
| human_RBMX | SEQ ID NO: 191885-191999 |
| human_RBPJ | SEQ ID NO: 192000-192147 |
| human_RBPJL | SEQ ID NO: 192148-192300 |
| human_RCOR1 | SEQ ID NO: 192301-192443 |
| human_RCOR2 | SEQ ID NO: 192444-192598 |
| human_RCOR3 | SEQ ID NO: 192599-192744 |
| human_REL | SEQ ID NO: 192745-192928 |
| human_RELA | SEQ ID NO: 192929-193090 |
| human_RELB | SEQ ID NO: 193091-193262 |
| human_REST | SEQ ID NO: 193263-193589 |
| human_RFX1 | SEQ ID NO: 193590-193881 |
| human_RFX2 | SEQ ID NO: 193882-194096 |
| human_RFX3 | SEQ ID NO: 194097-194218 |
| human_RFX4 | SEQ ID NO: 194219-194408 |
| human_RFX5 | SEQ ID NO: 194409-194591 |
| human_RFX6 | SEQ ID NO: 194592-194867 |
| human_RFX7 | SEQ ID NO: 194868-195274 |
| human_RFX8 | SEQ ID NO: 195275-195414 |
| human_RNF10 | SEQ ID NO: 195415-195655 |
| human_RORA | SEQ ID NO: 195656-195820 |
| human_RORB | SEQ ID NO: 195821-195956 |
| human_RORC | SEQ ID NO: 195957-196109 |
| human_RPS3 | SEQ ID NO: 196110-196185 |
| human_RPTOR | SEQ ID NO: 196186-196583 |
| human_RREB1 | SEQ ID NO: 196584-197024 |
| human_RRN3 | SEQ ID NO: 197025-197217 |
| human_RUNX1 | SEQ ID NO: 197218-197359 |
| human_RUNX2 | SEQ ID NO: 197360-197513 |
| human_RUNX3 | SEQ ID NO: 197514-197640 |
| human_RUVBL2 | SEQ ID NO: 197641-197777 |
| human_RXRA | SEQ ID NO: 197778-197913 |
| human_RXRB | SEQ ID NO: 197914-198071 |
| human_SAFB | SEQ ID NO: 198072-198343 |
| human_SALL1 | SEQ ID NO: 198344-198738 |
| human_SALL2 | SEQ ID NO: 198739-199038 |
| human_SARS | SEQ ID NO: 199039-199190 |
| human_SATB1 | SEQ ID NO: 199191-199417 |
| human_SATB2 | SEQ ID NO: 199418-199635 |
| human_SCRT1 | SEQ ID NO: 199636-199737 |
| human_SCRT2 | SEQ ID NO: 199738-199827 |
| human_SCX | SEQ ID NO: 199828-199885 |
| human_SETX | SEQ ID NO: 199886-200686 |
| human_SFPQ | SEQ ID NO: 200687-200896 |
| human_SIN3A | SEQ ID NO: 200897-201276 |
| human_SIRT1 | SEQ ID NO: 201277-201498 |
| human_SIX1 | SEQ ID NO: 201499-201581 |
| human_SIX2 | SEQ ID NO: 201582-201666 |
| human_SIX3 | SEQ ID NO: 201667-201763 |
| human_SIX4 | SEQ ID NO: 201764-201995 |
| human_SIX5 | SEQ ID NO: 201996-202215 |
| human_SIX6 | SEQ ID NO: 202216-202287 |
| human_SKIL | SEQ ID NO: 202288-202490 |
| human_SMAD1 | SEQ ID NO: 202491-202627 |
| human_SMAD2 | SEQ ID NO: 202628-202765 |
| human_SMAD3 | SEQ ID NO: 202766-202890 |
| human_SMAD4 | SEQ ID NO: 202891-203053 |
| human_SMAD5 | SEQ ID NO: 203054-203190 |
| human_SMAD6 | SEQ ID NO: 203191-203337 |

TABLE 5-continued

List of SEQ ID NOs: 1-244,000 denoting viral
or transcription factor specificity Virus/Source Gene

| | |
|---|---|
| human_SMAD7 | SEQ ID NO: 203338-203463 |
| human_SMARCA2 | SEQ ID NO: 203464-203938 |
| human_SMARCA4 | SEQ ID NO: 203939-204430 |
| human_SMARCB1 | SEQ ID NO: 204431-204541 |
| human_SMARCC1 | SEQ ID NO: 204542-204870 |
| human_SMARCC2 | SEQ ID NO: 204871-205232 |
| human_SMARCD2 | SEQ ID NO: 205233-205375 |
| human_SMARCE1 | SEQ ID NO: 205376-205482 |
| human_SMYD3 | SEQ ID NO: 205483-205608 |
| human_SNAI1 | SEQ ID NO: 205609-205685 |
| human_SNAI2 | SEQ ID NO: 205686-205763 |
| human_SNAI3 | SEQ ID NO: 205764-205848 |
| human_SNCA | SEQ ID NO: 205849-205879 |
| human_SOX1 | SEQ ID NO: 205880-205994 |
| human_SOX10 | SEQ ID NO: 205995-206132 |
| human_SOX11 | SEQ ID NO: 206133-206262 |
| human_SOX12 | SEQ ID NO: 206263-206354 |
| human_SOX13 | SEQ ID NO: 206355-206538 |
| human_SOX17 | SEQ ID NO: 206539-206660 |
| human_SOX18 | SEQ ID NO: 206661-206773 |
| human_SOX2 | SEQ ID NO: 206774-206866 |
| human_SOX21 | SEQ ID NO: 206867-206947 |
| human_SOX3 | SEQ ID NO: 206948-207079 |
| human_SOX4 | SEQ ID NO: 207080-207219 |
| human_SOX6 | SEQ ID NO: 207220-207459 |
| human_SOX7 | SEQ ID NO: 207460-207573 |
| human_SOX8 | SEQ ID NO: 207574-207705 |
| human_SOX9 | SEQ ID NO: 207706-207856 |
| human_SP1 | SEQ ID NO: 207857-208089 |
| human_SP2 | SEQ ID NO: 208090-208271 |
| human_SP3 | SEQ ID NO: 208272-208503 |
| human_SP5 | SEQ ID NO: 208504-208620 |
| human_SP7 | SEQ ID NO: 208621-208747 |
| human_SPI1 | SEQ ID NO: 208748-208826 |
| human_SPIB | SEQ ID NO: 208827-208877 |
| human_SPIC | SEQ ID NO: 208878-208949 |
| human_SREBF1 | SEQ ID NO: 208950-209291 |
| human_SREBF2 | SEQ ID NO: 209292-209631 |
| human_SRF | SEQ ID NO: 209632-209781 |
| human_SSBP2 | SEQ ID NO: 209782-209887 |
| human_SSBP3 | SEQ ID NO: 209888-209995 |
| human_SSBP4 | SEQ ID NO: 209996-210108 |
| human_ST18 | SEQ ID NO: 210109-210420 |
| human_STAT1 | SEQ ID NO: 210421-210631 |
| human_STAT3 | SEQ ID NO: 210632-210860 |
| human_STAT5B | SEQ ID NO: 210861-211094 |
| human_STAT6 | SEQ ID NO: 211095-211346 |
| human_STOX1 | SEQ ID NO: 211347-211641 |
| human_SUV39H1 | SEQ ID NO: 211642-211766 |
| human_SUV39H2 | SEQ ID NO: 211767-211887 |
| human_SUZ12 | SEQ ID NO: 211888-212107 |
| human_TAF1 | SEQ ID NO: 212108-212673 |
| human_TAF1B | SEQ ID NO: 212674-212847 |
| human_TAF1C | SEQ ID NO: 212848-213077 |
| human_TAF2 | SEQ ID NO: 213078-213435 |
| human_TAF5 | SEQ ID NO: 213436-213673 |
| human_TAF7 | SEQ ID NO: 213674-213776 |
| human_TAF7L | SEQ ID NO: 213777-213864 |
| human_TAF9 | SEQ ID NO: 213865-213941 |
| human_TAF9B | SEQ ID NO: 213942-214014 |
| human_TAL1 | SEQ ID NO: 214015-214111 |
| human_TAL2 | SEQ ID NO: 214112-214141 |
| human_TBL1X | SEQ ID NO: 214142-214312 |
| human_TBL1XR1 | SEQ ID NO: 214313-214464 |
| human_TBP | SEQ ID NO: 214465-214564 |
| human_TBPL1 | SEQ ID NO: 214565-214618 |
| human_TBPL2 | SEQ ID NO: 214619-214728 |
| human_TBR1 | SEQ ID NO: 214729-214930 |
| human_TBX15 | SEQ ID NO: 214931-215108 |
| human_TBX18 | SEQ ID NO: 215109-215288 |
| human_TBX19 | SEQ ID NO: 215289-215420 |
| human_TBX2 | SEQ ID NO: 215421-215631 |
| human_TBX20 | SEQ ID NO: 215632-215763 |
| human_TBX21 | SEQ ID NO: 215764-215921 |
| human_TBX22 | SEQ ID NO: 215922-216075 |

TABLE 5-continued

List of SEQ ID NOs: 1-244,000 denoting viral
or transcription factor specificity

| Virus/Source Gene | |
|---|---|
| human_TBX3 | SEQ ID NO: 216076-216296 |
| human_TBX5 | SEQ ID NO: 216297-216449 |
| human_TBX6 | SEQ ID NO: 216450-216578 |
| human_TBXT | SEQ ID NO: 216579-216706 |
| human_TCF12 | SEQ ID NO: 216707-216908 |
| human_TCF15 | SEQ ID NO: 216909-216966 |
| human_TCF20 | SEQ ID NO: 216967-217545 |
| human_TCF21 | SEQ ID NO: 217546-217597 |
| human_TCF3 | SEQ ID NO: 217598-217791 |
| human_TCF4 | SEQ ID NO: 217792-217990 |
| human_TCF7 | SEQ ID NO: 217991-218103 |
| human_TCF7L1 | SEQ ID NO: 218104-218277 |
| human_TCF7L2 | SEQ ID NO: 218278-218413 |
| human_TCFL5 | SEQ ID NO: 218414-218561 |
| human_TEAD1 | SEQ ID NO: 218562-218666 |
| human_TEAD2 | SEQ ID NO: 218667-218798 |
| human_TEAD3 | SEQ ID NO: 218799-218926 |
| human_TEAD4 | SEQ ID NO: 218927-219015 |
| human_TEF | SEQ ID NO: 219016-219104 |
| human_TFAM | SEQ ID NO: 219105-219166 |
| human_TFAP2A | SEQ ID NO: 219167-219294 |
| human_TFAP2B | SEQ ID NO: 219295-219430 |
| human_TFAP2C | SEQ ID NO: 219431-219563 |
| human_TFAP2D | SEQ ID NO: 219564-219696 |
| human_TFAP2E | SEQ ID NO: 219697-219826 |
| human_TFAP4 | SEQ ID NO: 219827-219925 |
| human_TFCP2 | SEQ ID NO: 219926-220073 |
| human_TFCP2L1 | SEQ ID NO: 220074-220215 |
| human_TFDP1 | SEQ ID NO: 220216-220336 |
| human_TFDP2 | SEQ ID NO: 220337-220449 |
| human_TFE3 | SEQ ID NO: 220450-220619 |
| human_TFEB | SEQ ID NO: 220620-220760 |
| human_TFEC | SEQ ID NO: 220761-220862 |
| human_TGIF1 | SEQ ID NO: 220863-220980 |
| human_THAP1 | SEQ ID NO: 220981-221042 |
| human_THAP11 | SEQ ID NO: 221043-221134 |
| human_THRA | SEQ ID NO: 221135-221279 |
| human_THRAP3 | SEQ ID NO: 221280-221563 |
| human_THRB | SEQ ID NO: 221564-221704 |
| human_TIPARP | SEQ ID NO: 221705-221899 |
| human_TLX1 | SEQ ID NO: 221900-221996 |
| human_TNF | SEQ ID NO: 221997-222064 |
| human_TOP1 | SEQ ID NO: 222065-222291 |
| human_TOX2 | SEQ ID NO: 222292-222441 |
| human_TOX3 | SEQ ID NO: 222442-222612 |
| human_TP53 | SEQ ID NO: 222613-222728 |
| human_TP63 | SEQ ID NO: 222729-222930 |
| human_TP73 | SEQ ID NO: 222931-223078 |
| human_TRERF1 | SEQ ID NO: 223079-223415 |
| human_TRIM24 | SEQ ID NO: 223416-223728 |
| human_TRPS1 | SEQ ID NO: 223729-224110 |
| human_TWIST1 | SEQ ID NO: 224111-224168 |
| human_TXK | SEQ ID NO: 224169-224324 |
| human_UBTF | SEQ ID NO: 224325-224551 |
| human_UHRF1 | SEQ ID NO: 224552-224787 |
| human_USP3 | SEQ ID NO: 224788-224941 |
| human_UTY | SEQ ID NO: 224942-225263 |
| human_VAX1 | SEQ ID NO: 225264-225361 |
| human_VAX2 | SEQ ID NO: 225362-225446 |
| human_VDR | SEQ ID NO: 225447-225572 |
| human_VEZF1 | SEQ ID NO: 225573-225726 |
| human_WBP2 | SEQ ID NO: 225727-225802 |
| human_WNT1 | SEQ ID NO: 225803-225911 |
| human_WNT11 | SEQ ID NO: 225912-226015 |
| human_WNT5A | SEQ ID NO: 226016-226127 |
| human_WT1 | SEQ ID NO: 226128-226215 |
| human_XBP1 | SEQ ID NO: 226216-226291 |
| human_XRCC5 | SEQ ID NO: 226292-226508 |
| human_XRCC6 | SEQ ID NO: 226509-226689 |
| human_XRN2 | SEQ ID NO: 226690-226972 |
| human_YAP1 | SEQ ID NO: 226973-227121 |
| human_YBX1 | SEQ ID NO: 227122-227216 |
| human_YBX3 | SEQ ID NO: 227217-227325 |
| human_YY1 | SEQ ID NO: 227326-227447 |
| human_YY2 | SEQ ID NO: 227448-227556 |

TABLE 5-continued

List of SEQ ID NOs: 1-244,000 denoting viral
or transcription factor specificity

| Virus/Source Gene | |
|---|---|
| human_ZBED1 | SEQ ID NO: 227557-227762 |
| human_ZBTB14 | SEQ ID NO: 227763-227895 |
| human_ZBTB16 | SEQ ID NO: 227896-228095 |
| human_ZBTB17 | SEQ ID NO: 228096-228336 |
| human_ZBTB2 | SEQ ID NO: 228337-228488 |
| human_ZBTB20 | SEQ ID NO: 228489-228686 |
| human_ZBTB24 | SEQ ID NO: 228687-228893 |
| human_ZBTB4 | SEQ ID NO: 228894-229195 |
| human_ZBTB48 | SEQ ID NO: 229196-229399 |
| human_ZBTB5 | SEQ ID NO: 229400-229600 |
| human_ZBTB7A | SEQ ID NO: 229601-229773 |
| human_ZBTB7B | SEQ ID NO: 229774-229933 |
| human_ZC3H4 | SEQ ID NO: 229934-230322 |
| human_ZC3H6 | SEQ ID NO: 230323-230677 |
| human_ZC3H8 | SEQ ID NO: 230678-230762 |
| human_ZEB1 | SEQ ID NO: 230763-231097 |
| human_ZFHX2 | SEQ ID NO: 231098-231866 |
| human_ZFHX3 | SEQ ID NO: 231867-232975 |
| human_ZFHX4 | SEQ ID NO: 232976-234058 |
| human_ZFP42 | SEQ ID NO: 234059-234149 |
| human_ZFPM1 | SEQ ID NO: 234150-234449 |
| human_ZGPAT | SEQ ID NO: 234450-234606 |
| human_ZHX3 | SEQ ID NO: 234607-234891 |
| human_ZIC1 | SEQ ID NO: 234892-235023 |
| human_ZIC2 | SEQ ID NO: 235024-235180 |
| human_ZIC3 | SEQ ID NO: 235181-235318 |
| human_ZIC4 | SEQ ID NO: 235319-235427 |
| human_ZIC5 | SEQ ID NO: 235428-235624 |
| human_ZKSCAN3 | SEQ ID NO: 235625-235783 |
| human_ZNF131 | SEQ ID NO: 235784-235958 |
| human_ZNF143 | SEQ ID NO: 235959-236138 |
| human_ZNF148 | SEQ ID NO: 236139-236374 |
| human_ZNF174 | SEQ ID NO: 236375-236494 |
| human_ZNF175 | SEQ ID NO: 236495-236705 |
| human_ZNF202 | SEQ ID NO: 236706-236897 |
| human_ZNF205 | SEQ ID NO: 236898-237061 |
| human_ZNF217 | SEQ ID NO: 237062-237373 |
| human_ZNF219 | SEQ ID NO: 237374-237587 |
| human_ZNF239 | SEQ ID NO: 237588-237722 |
| human_ZNF277 | SEQ ID NO: 237723-237855 |
| human_ZNF281 | SEQ ID NO: 237856-238121 |
| human_ZNF322 | SEQ ID NO: 238122-238239 |
| human_ZNF335 | SEQ ID NO: 238240-238639 |
| human_ZNF350 | SEQ ID NO: 238640-238796 |
| human_ZNF395 | SEQ ID NO: 238797-238948 |
| human_ZNF431 | SEQ ID NO: 238949-239119 |
| human_ZNF497 | SEQ ID NO: 239120-239266 |
| human_ZNF501 | SEQ ID NO: 239267-239345 |
| human_ZNF513 | SEQ ID NO: 239346-239505 |
| human_ZNF516 | SEQ ID NO: 239506-239852 |
| human_ZNF536 | SEQ ID NO: 239853-240240 |
| human_ZNF541 | SEQ ID NO: 240241-240642 |
| human_ZNF564 | SEQ ID NO: 240643-240806 |
| human_ZNF568 | SEQ ID NO: 240807-240997 |
| human_ZNF589 | SEQ ID NO: 240998-241104 |
| human_ZNF605 | SEQ ID NO: 241105-241303 |
| human_ZNF613 | SEQ ID NO: 241304-241486 |
| human_ZNF639 | SEQ ID NO: 241487-241629 |
| human_ZNF649 | SEQ ID NO: 241630-241778 |
| human_ZNF658 | SEQ ID NO: 241779-241961 |
| human_ZNF668 | SEQ ID NO: 241962-242151 |
| human_ZNF691 | SEQ ID NO: 242152-242243 |
| human_ZNF692 | SEQ ID NO: 242244-242397 |
| human_ZNF704 | SEQ ID NO: 242398-242518 |
| human_ZNF709 | SEQ ID NO: 242519-242708 |
| human_ZNF711 | SEQ ID NO: 242709-242934 |
| human_ZNF740 | SEQ ID NO: 242935-242990 |
| human_ZNF746 | SEQ ID NO: 242991-243181 |
| human_ZNF750 | SEQ ID NO: 243182-243396 |
| human_ZNF821 | SEQ ID NO: 243397-243517 |
| human_ZNF835 | SEQ ID NO: 243518-243676 |
| human_ZNF93 | SEQ ID NO: 243677-243860 |
| human_ZSCAN21 | SEQ ID NO: 243861-244000 |

REFERENCES

1. F. J. Isaacs, D. J. Dwyer, J. J. Collins, RNA synthetic biology. *Nature biotechnology* 24, 545 (2006).
2. A. A. Green, P. A. Silver, J. J. Collins, P. Yin, Toehold switches: de-novo-designed regulators of gene expression. *Cell* 159, 925-939 (2014).
3. K. Pardee et al., Rapid, low-cost detection of Zika virus using programmable biomolecular components. *Cell* 165, 1255-1266 (2016).
4. M. K. Takahashi et al., A low-cost paper-based synthetic biology platform for analyzing gut microbiota and host biomarkers. *Nature communications* 9, 3347 (2018).
5. A. A. Green et al., Complex cellular logic computation using ribocomputing devices. *Nature* 548, 117 (2017).
6. S.-J. Kim, M. Leong, M. B. Amrofell, Y. J. Lee, T. S. Moon, Modulating responses of toehold switches by an inhibitory hairpin. *ACS synthetic biology* 8, 601-605 (2019).
7. M. Krishnamurthy et al., Tunable riboregulator switches for post-transcriptional control of gene expression. *ACS synthetic biology* 4, 1326-1334 (2015).
8. J. Kim et al., De-Novo-Designed Translational Repressors for Multi-Input Cellular Logic. *bioRxiv,* 501783 (2018).
9. A. C.-Y. To et al., A comprehensive web tool for toehold switch design. *Bioinformatics* 34, 2862-2864 (2018).
10. H. K. Kim et al., Deep learning improves prediction of CRISPR-Cpf1 guide RNA activity. *Nature biotechnology* 36, 239 (2018).
11. S. Webb, Deep learning for biology. *Nature* 554, (2018).
12. C. Angermueller, T. Pärnamaa, L. Parts, O. Stegle, Deep learning for computational biology. *Molecular systems biology* 12, (2016).
13. M. Wainberg, D. Merico, A. Delong, B. J. Frey, Deep learning in biomedicine. *Nature biotechnology* 36, 829 (2018).
14. D. M. Camacho, K. M. Collins, R. K. Powers, J. C. Costello, J. J. Collins, Next-generation machine learning for biological networks. *Cell* 173, 1581-1592 (2018).
15. K. Pardee et al., Paper-based synthetic gene networks. *Cell* 159, 940-954 (2014).
16. D. Ma, L. Shen, K. Wu, C. W. Diehnelt, A. A. Green, Low-cost detection of norovirus using paper-based cell-free systems and synbody-based viral enrichment. *Synthetic Biology* 3, ysy018 (2018).
17. G. Chuai et al., DeepCRISPR: optimized CRISPR guide RNA design by deep learning. *Genome biology* 19, 80 (2018).
18. J. Luo, W. Chen, L. Xue, B. Tang, Prediction of activity and specificity of CRISPR-Cpf1 using convolutional deep learning neural networks. *BMC bioinformatics* 20, 332 (2019).
19. S. Zhang, H. Hu, T. Jiang, L. Zhang, J. Zeng, TITER: predicting translation initiation sites by deep learning. *Bioinformatics* 33, i234-i242 (2017).
20. J. Zuallaert, M. Kim, Y. Saeys, W. De Neve, in 2017 *IEEE International Conference on Bioinformatics and Biomedicine (BIBM).* (IEEE, 2017), pp. 1233-1237.
21. E. C. Alley, G. Khimulya, S. Biswas, M. AlQuraishi, G. M. Church, Unified rational protein engineering with sequence-only deep representation learning. *bioRxiv,* 589333 (2019).
22. D. B. Goodman, G. M. Church, S. Kosuri, Causes and effects of N-terminal codon bias in bacterial genes. *Science* 342, 475-479 (2013).
23. J. N. Zadeh, B. R. Wolfe, N. A. Pierce, Nucleic acid sequence design via efficient ensemble defect optimization. *Journal of computational chemistry* 32, 439-452 (2011).
24. R. M. Dirks, M. Lin, E. Winfree, N. A. Pierce, Paradigms for computational nucleic acid design. *Nucleic acids research* 32, 1392-1403 (2004).
25. R. Lorenz et al., ViennaRNA Package 2.0. *Algorithms for molecular biology* 6, 26 (2011).
26. H. M. Salis, E. A. Mirsky, C. A. Voigt, Automated design of synthetic ribosome binding sites to control protein expression. *Nature biotechnology* 27, 946 (2009).
27. A. Espah Borujeni et al., Precise quantification of translation inhibition by mRNA structures that overlap with the ribosomal footprint in N-terminal coding sequences. *Nucleic acids research* 45, 5437-5448 (2017).
28. A. Espah Borujeni, A. S. Channarasappa, H. M. Salis, Translation rate is controlled by coupled trade-offs between site accessibility, selective RNA unfolding and sliding at upstream standby sites. *Nucleic acids research* 42, 2646-2659 (2013).
29. A. Espah Borujeni, H. M. Salis, Translation initiation is controlled by RNA folding kinetics via a ribosome drafting mechanism. *Journal of the American Chemical Society* 138, 7016-7023 (2016).
30. B. Reeve, T. Hargest, C. Gilbert, T. Ellis, Predicting translation initiation rates for designing synthetic biology. *Frontiers in bioengineering and biotechnology* 2, 1 (2014).
31. M. M. Meyer, The role of mRNA structure in bacterial translational regulation. *Wiley Interdisciplinary Reviews: RNA* 8, e1370 (2017).
32. S. Badelt, S. Hammer, C. Flamm, I. L. Hofacker, in *Methods in enzymology.* (Elsevier, 2015), vol. 553, pp. 193-213.
33. B. Sauerwine, M. Widom, Kinetic Monte Carlo method applied to nucleic acid hairpin folding. *Physical Review E* 84, 061912 (2011).
34. V. I. Jurtz et al., An introduction to deep learning on biological sequence data: examples and solutions. *Bioinformatics* 33, 3685-3690 (2017).
35. X.-Q. Liu, B.-X. Li, G.-R. Zeng, Q.-Y. Liu, D.-M. Ai, Prediction of Long Non-Coding RNAs Based on Deep Learning. *Genes* 10, 273 (2019).
36. J. Baek, B. Lee, S. Kwon, S. Yoon, Lncrnanet: long non-coding ma identification using deep learning. *Bioinformatics* 34, 3889-3897 (2018).
37. G. Aoki, Y. Sakakibara, Convolutional neural networks for classification of alignments of non-coding RNA sequences. *Bioinformatics* 34, i237-i244 (2018).
38. A. Fiannaca, M. La Rosa, L. La Paglia, R. Rizzo, A. Urso, nRC: non-coding RNA Classifier based on structural features. *BioData mining* 10, 27 (2017).
39. N. Frosst, G. Hinton, Distilling a neural network into a soft decision tree. *arXiv preprint arXiv:*1711.09784, (2017).
40. P. K. Koo, S. R. Eddy, Representation Learning of Genomic Sequence Motifs with Convolutional Neural Networks. *BioRxiv,* 362756 (2018).
41. K. Simonyan, A. Vedaldi, A. Zisserman, Deep inside convolutional networks: Visualising image classification models and saliency maps. *arXiv preprint arXiv:* 1312.6034, (2013).
42. A. Dhawan, J. G. Scott, A. L. Harris, F. M. Buffa, Pan-cancer characterisation of microRNA across cancer hallmarks reveals microRNA-mediated downregulation of tumour suppressors. *Nature communications* 9, 5228 (2018).

43. Y. Xin-wei et al., STAT3 overexpression promotes metastasis in intrahepatic cholangiocarcinoma and correlates negatively with surgical outcome. *Oncotarget* 8, 7710 (2017).

SI-1. A. A. Green, P. A. Silver, J. J. Collins, P. Yin, Toehold switches: de-novo-designed regulators of gene expression. *Cell* 159, 925-939 (2014).

SI-2. K. Pardee et al., Rapid, low-cost detection of Zika virus using programmable biomolecular components. *Cell* 165, 1255-1266 (2016).

SI-3. K. Pardee et al., Paper-based synthetic gene networks. *Cell* 159, 940-954 (2014).

SI-4. S. E. Hunt et al., Ensembl variation resources. *Database* 2018, (2018).

SI-5. P. Oberacker et al., Bio-On-Magnetic-Beads (BOMB): Open platform for high-throughput nucleic acid extraction and manipulation. *PLoS biology* 17, e3000107 (2019).

SI-6. A. Espah Borujeni, H. M. Salis, Translation initiation is controlled by RNA folding kinetics via a ribosome drafting mechanism. *Journal of the American Chemical Society* 138, 7016-7023 (2016).

SI-7. T. L. Bailey, DREME: motif discovery in transcription factor ChIP-seq data. *Bioinformatics* 27, 1653-1659 (2011).

ASPECTS AND EMBODIMENTS OF THIS DISCLOSURE

Clause 1. A toehold riboregulator having (a) a nucleic acid sequence comprising any one of SEQ ID NOs: 1-244,000, or (b) nucleotides 21-103 of any one of SEQ ID NOs: 1-244,000, or (c) nucleotides 21-100 of any one of SEQ ID NOs: 1-244,000, or (d) RNA versions of (a), (b) or (c).

Clause 2. The toehold riboregulator of clause 1 covalently attached, at its 3' end, to a nucleic acid encoding a reporter protein or reporter RNA.

Clause 3. The toehold riboregulator of clause 1 or 2, wherein the riboregulator is specific for astrovirus, cardiovirus, chikungunya virus, cosavirus, coxsackie virus, dengue virus, ebola virus, hantavirus, human immunodeficiency virus, human parvo virus, human rhino virus, influenza virus: h1n1, influenza virus: h3n2, lassa virus, leishmanial virus, Marburg virus, papilloma virus, poliovirus, rabies virus, smallpox virus, west nile virus, yellow fever virus, or zika virus.

Clause 4. The toehold riboregulator of clause 1 or 2, wherein the riboregulator is specific for a human mRNA selected from AC097634.4, ACTB, ACTL6A, ACTN4, AEBP1, AEBP2, AGO1, AGO2, AHR, AIRE, AKNA, AL121581.1, ALX1, ALX4, ANHX, AR, ARHGAP35, ARID3A, ARID3B, ARID3C, ARID4A, ARID4B, ARID5A, ARID5B, ARNT, ARNT2, ARNTL, ARNTL2, ARRB1, ARX, ASCL1, ASCL2, ASCL3, ASCL4, ASCL5, ASH2L, ATF1, ATF2, ATF3, ATF4, ATF5, ATF6, ATF6B, ATMIN, ATOH1, ATOH8, ATXN3, BACH1, BACH2, BARHL1, BARHL2, BARX1, BARX2, BASP1, BATF, BATF2, BATF3, BAZ2A, BCL11A, BCL11B, BCL6, BCL6B, BCOR, BHLHA15, BHLHE40, BHLHE41, BORCS8-MEF2B, BRCA1, BRD7, BRF2, CALCOCO1, CARF, CARM1, CBX4, CC2D1A, CC2D1B, CCAR1, CCNT1, CDC5L, CDK12, CDK13, CDK5RAP2, CDK9, CDX1, CDX2, CDX4, CEBPA, CEBPB, CEBPD, CEBPE, CEBPG, CEBPZ, CGGBP1, CHD2, CHD4, CHD7, CIART, CIITA, CITED1, CLOCK, CNBP, CREB1, CREB3, CREB3L1, CREB3L2, CREB3L3, CREB3L4, CREBBP, CREBRF, CREM, CRX, CRY1, CRY2, CT476828.9, CTCF, CTCFL, CUX1, CUX2, CXXC1, DACH1, DBP, DDIT3, DDN, DEAF1, DHX36, DHX9, DLX1, DLX2, DLX4, DLX5, DMBX1, DMRT1, DMRT2, DNMT3A, DPF2, DR1, DRAP1, DUX4, E2F1, E2F2, E2F3, E2F4, E2F6, E2F7, E2F8, E4F1, EAF2, EBF2, EBF3, EBF4, EED, EGR1, EGR2, EGR3, EGR4, EHF, EHMT2, ELF1, ELF3, ELF4, ELF5, ELK1, ELK3, ELK4, ELL3, ELMSAN1, EN1, ENO1, EOMES, EP300, ERBB4, ERG, ESR1, ESR2, ESRRA, ESRRB, ESRRG, ESX1, ETS1, ETS2, ETV1, ETV2, ETV3, ETV4, ETV5, ETV6, ETV7, EZH2, FERD3L, FEZF1, FEZF2, FIGLA, FLI1, FOS, FOSB, FOSL1, FOSL2, FOXA1, FOXA2, FOXA3, FOXC1, FOXC2, FOXD1, FOXD3, FOXF1, FOXF2, FOXH1, FOXI1, FOXJ1, FOXJ2, FOXK1, FOXK2, FOXL2, FOXM1, FOXN4, FOXO3, FOXP2, FOXP3, FOXQ1, FOXS1, FUBP3, GABPA, GABPB1, GABPB2, GADD45A, GATA1, GATA2, GATA3, GATA4, GATA5, GATA6, GATAD2B, GBX2, GCFC2, GCM1, GFI1, GLI1, GLI2, GLI3, GLIS1, GLIS2, GLMP, GMEB1, GMEB2, GRHL1, GRHL2, GSC, GSX1, GTF2B, GTF3C1, GZF1, H2AFY, H2AFY2, H2AFZ, H3F3A, H3F3B, HAND1, HAND2, HDAC1, HDAC2, HDAC4, HDAC5, HDAC6, HELT, HES1, HES2, HES3, HES4, HES5, HES6, HES7, HESX1, HEY1, HEY2, HEYL, HHEX, HIC2, HIF1A, HINFP, HIVEP1, HLF, HLTF, HMGA1, HMGA2, HMGB1, HMGB2, HMX1, HMX3, HNF1A, HNF1B, HNF4A, HNF4G, HNRNPC, HNRNPK, HNRNPL, HNRNPU, HOXA10, HOXA2, HOXA3, HOXA4, HOXA5, HOXA6, HOXA7, HOXA9, HOXB1, HOXB2, HOXB3, HOXB4, HOXB5, HOXB6, HOXB7, HOXB9, HOXC10, HOXC11, HOXC4, HOXC5, HOXC6, HOXD10, HOXD13, HOXD3, HOXD4, HOXD8, HOXD9, HR, HSF1, HSF2, HSF4, HSF5, HSFX1, HSFX2, HSFX3, HSFX4, HSFY1, HSFY2, IER2, IFI16, IKZF1, IKZF2, IKZF3, IKZF4, IKZF5, INSM1, IRF1, IRF2, IRF2BP1, IRF2BP2, IRF2BPL, IRF3, IRF4, IRF5, IRF6, IRF7, IRF8, IRF9, ISL1, JARID2, JDP2, JMJD1C, JUN, JUNB, JUND, KAT2B, KAT7, KCNIP3, KDM1A, KDM2B, KDM3A, KDM3B, KDM5A, KDM6A, KDM6B, KLF1, KLF10, KLF11, KLF12, KLF13, KLF15, KLF16, KLF17, KLF3, KLF4, KLF5, KLF6, KLF7, KLF8, KMT2A, KMT2D, LDB1, LEF1, LHX2, LHX3, LITAF, LMO2, LMO4, LMX1A, LMX1B, LONP1, LRRFIP1, LYL1, MACC1, MAF, MAF1, MAFA, MAFB, MAFF, MAFG, MAFK, MAX, MAZ, MBD2, MBD3, MED1, MED12, MED8, MEF2A, MEF2B, MEF2C, MEF2D, MEIS1, MEIS2, MEN1, MEOX1, MEOX2, MESP1, MESP2, MITF, MIXL1, MLX, MLXIP, MLXIPL, MMP12, MNT, MRTFA, MSC, MSGN1, MSX1, MSX2, MTA1, MTA2, MTERF3, MTF1, MTF2, MTOR, MUC1, MXD1, MXD3, MXI1, MYB, MYBBP1A, MYBL1, MYBL2, MYC, MYCN, MYEF2, MYF5, MYF6, MYOCD, MYOD1, MYOG, MYPOP, MYT1, MYT1L, MZF1, NACC2, NANOG, NCOA2, NCOR1, NCOR2, NDN, NEUROD1, NEUROD2, NEUROD6, NEUROG1, NEUROG2, NEUROG3, NFAT5, NFATC1, NFATC2, NFATC3, NFATC4, NFE2, NFE2L1, NFE2L2, NFE2L3, NFIA, NFIB, NFIC, NFIL3, NFKB1, NFKB2, NFX1, NFXL1, NFYA, NFYB, NFYC, NHLH1, NHLH2, NKRF, NKX2-1, NKX2-2, NKX2-5, NKX2-6, NKX2-8, NKX3-1, NKX3-2, NKX6-1, NKX6-2, NLRC5, NME1, NONO, NOTCH1, NPAS2, NPAS4, NPM1, NR1D1, NR1D2, NR1H2, NR1H3, NR1H4, NR1I2, NR1I3, NR2C1, NR2C2, NR2E3, NR2F1, NR2F6, NR3C1, NR4A1, NR4A2, NR4A3, NR5A1, NR5A2, NR6A1, NRF1, NRIP1, NRL, NSD1, ONECUT2, ONECUT3, OSR1, OSR2, OTX1, OTX2, OVOL1, PARP1, PATZ1, PAX1, PAX2, PAX4, PAX5, PAX6, PAX8, PAX9, PAXBP1, PBX1, PBX2, PBX3, PCGF3, PCGF5, PCGF6, PDX1, PER1, PER2, PER3, PGR, PHB, PHOX2A, PHOX2B, PIH1D1, PITX1, PITX2, PITX3, PKNOX2, PLAG1, PLAGL1, POLRMT, POU1F1, POU2AF1, POU2F1, POU2F2, POU2F3, POU3F2, POU3F4, POU4F1, POU4F2, POU4F3, POU5F1, POU6F1, PPARA, PPARD, PPARG, PRDM1, PRDM11, PRDM12, PRDM13, PRDM14, PRDM15, PRDM2, PRDM4, PRDM5, PRDM6, PRDM7, PRDM9, PRDX5, PRKN, PRMT5, PROP1, PROX1, PRRX1, PSPC1, PTF1A, PURA, PURB, PURG, RAI1, RARA, RARB, RARG, RAX, RAX2, RB1, RBBP4, RBBP5, RBL1, RBL2, RBMX, RBPJ, RBPJL, RCOR1, RCOR2, RCOR3, REL, RELA, RELB, REST, RFX1, RFX2, RFX3, RFX4, RFX5, RFX6, RFX7, RFX8, RNF10, RORA, RORB, RORC, RPS3, RPTOR, RREB1, RRN3, RUNX1, RUNX2, RUNX3, RUVBL2, RXRA, RXRB, SAFB, SALL1, SALL2, SARS, SATB1, SATB2, SCRT1, SCRT2, SCX, SETX, SFPQ, SIN3A, SIRT1, SIX1, SIX2, SIX3, SIX4, SIX5, SIX6, SKIL, SMAD1, SMAD2, SMAD3, SMAD4, SMAD5, SMAD6, SMAD7, SMARCA2, SMARCA4, SMARCB1, SMARCC1, SMARCC2, SMARCD2, SMARCE1, SMYD3, SNAI1, SNAI2, SNAI3, SNCA, SOX1, SOX10, SOX11, SOX12, SOX13, SOX17, SOX18, SOX2, SOX21, SOX3, SOX4, SOX6, SOX7, SOX8, SOX9, SP1, SP2, SP3, SP5, SP7, SPI1, SPIB, SPIC, SREBF1, SREBF2, SRF, SSBP2, SSBP3, SSBP4, ST18, STAT1, STAT3, STAT5B, STAT6, STOX1, SUV39H1, SUV39H2, SUZ12, TAF1, TAF1B, TAF1C, TAF2, TAF5, TAF7, TAF7L, TAF9, TAF9B, TAL1, TAL2, TBL1X, TBL1XR1, TBP, TBPL1, TBPL2, TBR1, TBX15, TBX18, TBX19, TBX2, TBX20, TBX21, TBX22, TBX3, TBX5, TBX6, TBXT, TCF12, TCF15, TCF20, TCF21, TCF3, TCF4, TCF7, TCF7L1, TCF7L2, TCFL5, TEAD1, TEAD2, TEAD3, TEAD4, TEF, TFAM, TFAP2A, TFAP2B, TFAP2C, TFAP2D, TFAP2E, TFAP4, TFCP2, TFCP2L1, TFDP1, TFDP2, TFE3, TFEB, TFEC, TGIF1, THAP1, THAP11, THRA, THRAP3, THRB, TIPARP, TLX1, TNF, TOP1, TOX2, TOX3, TP53, TP63, TP73, TRERF1, TRIM24, TRPS1, TWIST1, TXK, UBTF, UHRF1, USP3, UTY, VAX1, VAX2, VDR, VEZF1, WBP2, WNT1, WNT11, WNT5A, WT1, XBP1, XRCC5, XRCC6, XRN2, YAP1, YBX1, YBX3, YY1, YY2, ZBED1, ZBTB14, ZBTB16, ZBTB17, ZBTB2, ZBTB20, ZBTB24, ZBTB4, ZBTB48, ZBTB5, ZBTB7A, ZBTB7B, ZC3H4, ZC3H6, ZC3H8, ZEB1, ZFHX2, ZFHX3, ZFHX4, ZFP42, ZFPM1, ZGPAT, ZHX3, ZIC1, ZIC2, ZIC3, ZIC4, ZIC5, ZKSCAN3, ZNF131, ZNF143, ZNF148, ZNF174, ZNF175, ZNF202, ZNF205, ZNF217, ZNF219, ZNF239, ZNF277, ZNF281, ZNF322, ZNF335, ZNF350, ZNF395, ZNF431, ZNF497, ZNF501, ZNF513, ZNF516, ZNF536, ZNF541, ZNF564, ZNF568, ZNF589, ZNF605, ZNF613, ZNF639, ZNF649, ZNF658, ZNF668, ZNF691, ZNF692, ZNF704, ZNF709, ZNF711, ZNF740, ZNF746, ZNF750, ZNF821, ZNF835, ZNF93, and ZSCAN21.

Clause 5. The toehold riboregulator of clause 1 or 2, wherein the riboregulator is specific for a human mRNA encoding STAT3.

Clause 6. A method comprising
contacting a sample with a toehold riboregulator of any one of clauses 2-5 under conditions sufficient to allow the toehold riboregulator to hybridize to its respective trigger nucleic acid, and detecting and optionally measuring expression of the reporter protein or reporter RNA.

Clause 7. The method of clause 6, wherein the sample is obtained from a human subject.

Clause 8. The method of clause 7, wherein the subject is suspected of having cancer.

Clause 9. The method of clause 7, wherein the subject is suspected of having an infection of a virus of clause 3.

Clause 10. A method of treating a subject, comprising administering an effective amount of an anti-viral agent to a subject having a viral infection, wherein the subject is identified as having a viral infection by detecting viral mRNA in a sample from the subject using a toehold riboregulator of clause 3.

Clause 11. A method of treating a subject, comprising administering an effective amount of an anti-cancer agent to a subject having a cancer, wherein the subject is identified as having a cancer by detecting increased mRNA expression of a human transcription factor in a sample from the subject using a toehold riboregulator of clause 4 or 5.

More generally, those skilled in the art will readily appreciate that all parameters, dimensions, materials, and configurations described herein are meant to be exemplary and that the actual parameters, dimensions, materials, and/or configurations will depend upon the specific application or applications for which the teachings of the present invention is/are used. Those skilled in the art will recognize, or be able to ascertain using no more than routine experimentation, many equivalents to the specific embodiments of the invention described herein. It is, therefore, to be understood that the foregoing embodiments are presented by way of example only and that, within the scope of the appended claims and equivalents thereto, the invention may be practiced otherwise than as specifically described and claimed. The present invention is directed to each individual feature, system, article, material, kit, and/or method described herein. In addition, any combination of two or more such features, systems, articles, materials, kits, and/or methods, if such features, systems, articles, materials, kits, and/or methods are not mutually inconsistent, is included within the scope of the present invention.

The indefinite articles "a" and "an," as used herein in the specification and in the claims, unless clearly indicated to the contrary, should be understood to mean "at least one."

The phrase "and/or," as used herein in the specification and in the claims, should be understood to mean "either or both" of the elements so conjoined, i.e., elements that are conjunctively present in some cases and disjunctively present in other cases. Other elements may optionally be present other than the elements specifically identified by the "and/or" clause, whether related or unrelated to those elements specifically identified unless clearly indicated to the contrary. Thus, as a non-limiting example, a reference to "A and/or B," when used in conjunction with open-ended language such as "comprising" can refer, in one embodiment, to A without B (optionally including elements other than B); in another embodiment, to B without A (optionally including elements other than A); in yet another embodiment, to both A and B (optionally including other elements); etc.

As used herein in the specification and in the claims, "or" should be understood to have the same meaning as "and/or" as defined above. For example, when separating items in a list, "or" or "and/or" shall be interpreted as being inclusive, i.e., the inclusion of at least one, but also including more than one, of a number or list of elements, and, optionally, additional unlisted items. Only terms clearly indicated to the contrary, such as "only one of" or "exactly one of," or, when used in the claims, "consisting of," will refer to the inclusion of exactly one element of a number or list of elements. In general, the term "or" as used herein shall only be interpreted as indicating exclusive alternatives (i.e. "one or the other but not both") when preceded by terms of exclusivity, such as "either," "one of," "only one of," or "exactly one of." "Consisting essentially of," when used in the claims, shall have its ordinary meaning as used in the field of patent law.

As used herein in the specification and in the claims, the phrase "at least one," in reference to a list of one or more elements, should be understood to mean at least one element selected from any one or more of the elements in the list of elements, but not necessarily including at least one of each and every element specifically listed within the list of elements and not excluding any combinations of elements in the list of elements. This definition also allows that elements may optionally be present other than the elements specifically identified within the list of elements to which the phrase "at least one" refers, whether related or unrelated to those elements specifically identified. Thus, as a non-limiting example, "at least one of A and B" (or, equivalently, "at least one of A or B," or, equivalently "at least one of A and/or B") can refer, in one embodiment, to at least one, optionally including more than one, A, with no B present (and optionally including elements other than B); in another embodiment, to at least one, optionally including more than one, B, with no A present (and optionally including elements other than A); in yet another embodiment, to at least one, optionally including more than one, A, and at least one, optionally including more than one, B (and optionally including other elements); etc.

In the claims, as well as in the specification above, all transitional phrases such as "comprising," "including," "carrying," "having," "containing," "involving," "holding," and the like are to be understood to be open-ended, i.e., to mean including but not limited to. Only the transitional phrases "consisting of" and "consisting essentially of" shall be closed or semi-closed transitional phrases, respectively, as set forth in the United States Patent Office Manual of Patent Examining Procedures, Section 2111.03.

SEQUENCE LISTING (244028 sequences)

SEQ ID NO: 1 - DNA, 103 bp, Artificial Sequence
  Synthetic Polynucleotide
taatacgactcactatagggcagatgccaaaaggcaccaaccctcatttgaacagaggagacaaatgatggttggtgccaacctggcggcagcgcaaaagatg

SEQ ID NO: 2 - DNA, 103 bp, Artificial Sequence
  Synthetic Polynucleotide
taatacgactcactatagggacttgagaccctttgggcttgtatgagcacaacagaggagagtgctcatgcaagcccaaaacctggcggcagcgcaaaagatg

SEQ ID NO: 3 - DNA, 103 bp, Artificial Sequence
  Synthetic Polynucleotide
taatacgactcactatagggttgagggtcctagtggtgggtcttgctctcaacagaggagagagagcatgacccaccacaacctggcggcagcgcaaaagatg

SEQ ID NO: 4 - DNA, 103 bp, Artificial Sequence
  Synthetic Polynucleotide
taatacgactcactatagggtcaattgatgcattggtttcttcaaccacaaacagaggagatgtggtatgagaaaccaaaacctggcggcagcgcaaaagatg

SEQ ID NO: 5 - DNA, 103 bp, Artificial Sequence
  Synthetic Polynucleotide
taatacgactcactatagggcaacctcaattgatgcattggtttcttcaaaacagaggagattgaagatgccaatgcataacctggcggcagcgcaaaagatg

SEQ ID NO: 6 - DNA, 103 bp, Artificial Sequence
  Synthetic Polynucleotide
taatacgactcactatagggggcaccaacctcaattgatgcattggtttcaacagaggagagaaaccatggcatcaattaacctggcggcagcgcaaaagatg

SEQ ID NO: 7 - DNA, 103 bp, Artificial Sequence
  Synthetic Polynucleotide
taatacgactcactatagggccatcggcaccaacctcaattgatgcattgaacagaggagacaatgcatgaattgaggtaacctggcggcagcgcaaaagatg

SEQ ID NO: 8 - DNA, 103 bp, Artificial Sequence
  Synthetic Polynucleotide
taatacgactcactatagggtgacaccatcggcaccaacctcaattgatgaacagaggagacatcaaatgaggttggtgaacctggcggcagcgcaaaagatg

SEQ ID NO: 9 - DNA, 103 bp, Artificial Sequence
  Synthetic Polynucleotide
taatacgactcactatagggcttcatgacaccatcggcaccaacctcaataacagaggagaattgagatgggtgccgataacctggcggcagcgcaaaagatg

SEQ ID NO: 10 - DNA, 103 bp, Artificial Sequence
  Synthetic Polynucleotide
taatacgactcactataggggtcatcttcatgacaccatcggcaccaaccaacagaggagaggttggatgcgatggtgtaacctggcggcagcgcaaaagatg

SEQ ID NO: 11 - DNA, 103 bp, Artificial Sequence
  Synthetic Polynucleotide
taatacgactcactataggggaattgtcatcttcatgacaccatcggcacaacagaggagagtgccgatggtgtcatgaaacctggcggcagcgcaaaagatg

SEQ ID NO: 12 - DNA, 103 bp, Artificial Sequence
  Synthetic Polynucleotide
taatacgactcactatagggtgaaggaattgtcatcttcatgacaccatcaacagaggagagatggtatgatgaagatgaacctggcggcagcgcaaaagatg

SEQ ID NO: 13 - DNA, 103 bp, Artificial Sequence
  Synthetic Polynucleotide
taatacgactcactatagggctagttgaaggaattgtcatcttcatgacaaacagaggagatgtcatatggatgacaataacctggcggcagcgcaaaagatg

SEQ ID NO: 14 - DNA, 103 bp, Artificial Sequence
  Synthetic Polynucleotide
taatacgactcactatagggttggtttgagggtcctagtggtgggtcttgaacagaggagacaagacatgccactaggaaacctggcggcagcgcaaaagatg

SEQ ID NO: 15 - DNA, 103 bp, Artificial Sequence
  Synthetic Polynucleotide
taatacgactcactataggggacggctagttgaaggaattgtcatcttcaaacagaggagatgaagaatgcaattccttaacctggcggcagcgcaaaagatg

SEQ ID NO: 16 - DNA, 103 bp, Artificial Sequence
  Synthetic Polynucleotide
taatacgactcactatagggagcaagacggctagttgaaggaattgtcataacagaggagaatgacaatgccttcaactaacctggcggcagcgcaaaagatg

SEQ ID NO: 17 - DNA, 103 bp, Artificial Sequence
  Synthetic Polynucleotide
taatacgactcactatagggtgcctagcaagacggctagttgaaggaattaacagaggagaaattccatgaactagccgaacctggcggcagcgcaaaagatg

SEQ ID NO: 18 - DNA, 103 bp, Artificial Sequence
  Synthetic Polynucleotide
taatacgactcactatagggacatgtgcctagcaagacggctagttgaagaacagaggagacttcaaatggccgtcttgaacctggcggcagcgcaaaagatg

SEQ ID NO: 19 - DNA, 103 bp, Artificial Sequence
  Synthetic Polynucleotide
taatacgactcactatagggctcagacatgtgcctagcaagacggctagtaacagaggagaactagcatgcttgctaggaacctggcggcagcgcaaaagatg

SEQ ID NO: 20 - DNA, 103 bp, Artificial Sequence
  Synthetic Polynucleotide
taatacgactcactatagggcattgctcagacatgtgcctagcaagacggaacagaggagaccgtctatgtaggcacataacctggcggcagcgcaaaagatg

SEQ ID NO: 21 - DNA, 103 bp, Artificial Sequence
  Synthetic Polynucleotide
taatacgactcactatagggtttcgcattgctcagacatgtgcctagcaaaacagaggagattgctaatgacatgtctgaacctggcggcagcgcaaaagatg

SEQ ID NO: 22 - DNA, 103 bp, Artificial Sequence
  Synthetic Polynucleotide
taatacgactcactatagggtgttctttcgcattgctcagacatgtgcctaacagaggagaaggcacatgtctgagcaaaacctggcggcagcgcaaaagatg

SEQ ID NO: 23 - DNA, 103 bp, Artificial Sequence
  Synthetic Polynucleotide
taatacgactcactatagggcttgatgttctttcgcattgctcagacatgaacagaggagacatgtcatggcaatgcgaaacctggcggcagcgcaaaagatg

SEQ ID NO: 24 - DNA, 103 bp, Artificial Sequence
  Synthetic Polynucleotide
taatacgactcactatagggcagcacttgatgttctttcgcattgctcagaacagaggagactgagcatggcgaaagaaaacctggcggcagcgcaaaagatg

SEQ ID NO: 25 - DNA, 103 bp, Artificial Sequence
  Synthetic Polynucleotide
taatacgactcactatagggactgattggtttgagggtcctagtggtgggaacagaggagacccaccatgaggaccctcaacctggcggcagcgcaaaagatg

SEQ ID NO: 26 - DNA, 103 bp, Artificial Sequence
  Synthetic Polynucleotide
taatacgactcactataggggctagcagcacttgatgttctttcgcattgaacagaggagacaatgcatgagaacatcaaacctggcggcagcgcaaaagatg

SEQ ID NO: 27 - DNA, 103 bp, Artificial Sequence
  Synthetic Polynucleotide
taatacgactcactatagggatctggctagcagcacttgatgttctttcgaacagaggagacgaaagatgatcaagtgcaacctggcggcagcgcaaaagatg

SEQ ID NO: 28 - DNA, 103 bp, Artificial Sequence
  Synthetic Polynucleotide
taatacgactcactatagggcgccaatctggctagcagcacttgatgttcaacagaggagagaacatatggtgctgctaaacctggcggcagcgcaaaagatg

SEQ ID NO: 29 - DNA, 103 bp, Artificial Sequence
  Synthetic Polynucleotide
taatacgactcactatagggggtttcgccaatctggctagcagcacttgaaacagaggagatcaagtatggctagccagaacctggcggcagcgcaaaagatg

SEQ ID NO: 30 - DNA, 103 bp, Artificial Sequence
  Synthetic Polynucleotide
taatacgactcactatagggcagatggtttcgccaatctggctagcagcaaacagaggagatgctgcatgccagattggaacctggcggcagcgcaaaagatg

SEQ ID NO: 31 - DNA, 103 bp, Artificial Sequence
  Synthetic Polynucleotide
taatacgactcactatagggcctgccagatggtttcgccaatctggctagaacagaggagactagccatgttggcgaaaaacctggcggcagcgcaaaagatg

SEQ ID NO: 32 - DNA, 103 bp, Artificial Sequence
  Synthetic Polynucleotide
taatacgactcactatagggaactacctgccagatggtttcgccaatctgaacagaggagacagattatggaaaccatcaacctggcggcagcgcaaaagatg

SEQ ID NO: 33 - DNA, 103 bp, Artificial Sequence
  Synthetic Polynucleotide
taatacgactcactatagggtggtcaactacctgccagatggtttcgccaaacagaggagatggcgaatgcatctggcaaacctggcggcagcgcaaaagatg

SEQ ID NO: 34 - DNA, 103 bp, Artificial Sequence
  Synthetic Polynucleotide
taatacgactcactatagggcaccttggtcaactacctgccagatggtttaacagaggagaaaaccaatgggcaggtagaacctggcggcagcgcaaaagatg

SEQ ID NO: 35 - DNA, 103 bp, Artificial Sequence
  Synthetic Polynucleotide
taatacgactcactatagggcccagcaccttggtcaactacctgccagataacagaggagaatctggatggtagttgacaacctggcggcagcgcaaaagatg

SEQ ID NO: 36 - DNA, 103 bp, Artificial Sequence
  Synthetic Polynucleotide
taatacgactcactataggggtaacactgattggtttgagggtcctagtgaacagaggagacactagatgcctcaaaccaacctggcggcagcgcaaaagatg

SEQ ID NO: 37 - DNA, 103 bp, Artificial Sequence
  Synthetic Polynucleotide
taatacgactcactatagggaccaacccagcaccttggtcaactacctgcaacagaggagagcaggtatgtgaccaaggaacctggcggcagcgcaaaagatg

SEQ ID NO: 38 - DNA, 103 bp, Artificial Sequence
  Synthetic Polynucleotide
taatacgactcactatagggttgcaaccaacccagcaccttggtcaactaaacagaggagatagttgatgaaggtgctgaacctggcggcagcgcaaaagatg

SEQ ID NO: 39 - DNA, 103 bp, Artificial Sequence
  Synthetic Polynucleotide
taatacgactcactatagggaacacttgcaaccaacccagcaccttggtcaacagaggagagaccaaatggctgggttgaacctggcggcagcgcaaaagatg

SEQ ID NO: 40 - DNA, 103 bp, Artificial Sequence
  Synthetic Polynucleotide
taatacgactcactatagggggggcaacacttgcaaccaacccagcacctaacagaggagaaggtgcatggttggttgcaacctggcggcagcgcaaaagatg

SEQ ID NO: 41 - DNA, 103 bp, Artificial Sequence
  Synthetic Polynucleotide
taatacgactcactataggggttcaggggcaacacttgcaaccaacccagaacagaggagactgggtatgttgcaagtgaacctggcggcagcgcaaaagatg

SEQ ID NO: 42 - DNA, 103 bp, Artificial Sequence
  Synthetic Polynucleotide
taatacgactcactatagggaaaaggttcaggggcaacacttgcaaccaaaacagaggagattggttatgagtgttgccaacctggcggcagcgcaaaagatg

SEQ ID NO: 43 - DNA, 103 bp, Artificial Sequence
  Synthetic Polynucleotide
taatacgactcactatagggcagccaaaaggttcaggggcaacacttgcaaacagaggagatgcaagatgtgcccctgaaacctggcggcagcgcaaaagatg

SEQ ID NO: 44 - DNA, 103 bp, Artificial Sequence
  Synthetic Polynucleotide
taatacgactcactatagggtgagccagccaaaaggttcaggggcaacacaacagaggagagtgttgatgctgaaccttaacctggcggcagcgcaaaagatg

SEQ ID NO: 45 - DNA, 103 bp, Artificial Sequence
  Synthetic Polynucleotide
taatacgactcactatagggtttaatgagccagccaaaaggttcaggggcaacagaggagagcccctatgccttttggcaacctggcggcagcgcaaaagatg

SEQ ID NO: 46 - DNA, 103 bp, Artificial Sequence
  Synthetic Polynucleotide
taatacgactcactatagggccacctttaatgagccagccaaaaggttcaaacagaggagatgaaccatgtggctggctaacctggcggcagcgcaaaagatg

SEQ ID NO: 47 - DNA, 103 bp, Artificial Sequence
  Synthetic Polynucleotide
taatacgactcactatagggttcgagtaacactgattggtttgagggtccaacagaggagaggacccatgaaccaatcaaacctggcggcagcgcaaaagatg

SEQ ID NO: 48 - DNA, 103 bp, Artificial Sequence
  Synthetic Polynucleotide
taatacgactcactatagggaccacccacctttaatgagccagccaaaagaacagaggagacttttgatgggctcattaaacctggcggcagcgcaaaagatg

SEQ ID NO: 49 - DNA, 103 bp, Artificial Sequence
  Synthetic Polynucleotide
taatacgactcactatagggaaaccaccacccacctttaatgagccagccaacagaggagaggctggatgattaaaggtaacctggcggcagcgcaaaagatg

SEQ ID NO: 50 - DNA, 103 bp, Artificial Sequence
  Synthetic Polynucleotide
taatacgactcactatagggttgacaaaccaccacccacctttaatgagcaacagaggagagctcatatgaggtgggtgaacctggcggcagcgcaaaagatg

SEQ ID NO: 51 - DNA, 103 bp, Artificial Sequence
  Synthetic Polynucleotide
taatacgactcactatagggttttcttgacaaaccaccacccacctttaaaacagaggagattaaagatgggtggtggtaacctggcggcagcgcaaaagatg

SEQ ID NO: 52 - DNA, 103 bp, Artificial Sequence
  Synthetic Polynucleotide
taatacgactcactatagggaagaattttcttgacaaaccaccacccaccaacagaggagaggtgggatgtggtttgtcaacctggcggcagcgcaaaagatg

SEQ ID NO: 53 - DNA, 103 bp, Artificial Sequence
  Synthetic Polynucleotide
taatacgactcactatagggctgccaagaattttcttgacaaaccaccacaacagaggagagtggtgatgtgtcaagaaaacctggcggcagcgcaaaagatg

SEQ ID NO: 54 - DNA, 103 bp, Artificial Sequence
  Synthetic Polynucleotide
taatacgactcactatagggttgctctgccaagaattttcttgacaaaccaacagaggagaggtttgatgagaaaattcaacctggcggcagcgcaaaagatg

SEQ ID NO: 55 - DNA, 103 bp, Artificial Sequence
  Synthetic Polynucleotide
taatacgactcactatagggagtgtttgctctgccaagaattttcttgacaacagaggagagtcaagatgattcttggcaacctggcggcagcgcaaaagatg

SEQ ID NO: 56 - DNA, 103 bp, Artificial Sequence
  Synthetic Polynucleotide
taatacgactcactatagggtcaccagtgtttgctctgccaagaattttcaacagaggagagaaaatatgtggcagagcaacctggcggcagcgcaaaagatg

SEQ ID NO: 57 - DNA, 103 bp, Artificial Sequence
  Synthetic Polynucleotide
taatacgactcactatagggcctcatcaccagtgtttgctctgccaagaaaacagaggagattcttgatggagcaaacaaacctggcggcagcgcaaaagatg

SEQ ID NO: 58 - DNA, 103 bp, Artificial Sequence
  Synthetic Polynucleotide
taatacgactcactatagggaacaattcgagtaacactgattggtttgagaacagaggagactcaaaatgatcagtgttaacctggcggcagcgcaaaagatg

SEQ ID NO: 59 - DNA, 103 bp, Artificial Sequence
  Synthetic Polynucleotide
taatacgactcactatagggatacacctcatcaccagtgtttgctctgccaacagaggagaggcagaatgaacactggtaacctggcggcagcgcaaaagatg

SEQ ID NO: 60 - DNA, 103 bp, Artificial Sequence
  Synthetic Polynucleotide
taatacgactcactatagggacataatacacctcatcaccagtgtttgctaacagaggagaagcaaaatgtggtgatgaaacctggcggcagcgcaaaagatg

SEQ ID NO: 61 - DNA, 103 bp, Artificial Sequence
  Synthetic Polynucleotide
taatacgactcactatagggcgtaaacataatacacctcatcaccagtgtaacagaggagaacactgatgatgaggtgtaacctggcggcagcgcaaaagatg

SEQ ID NO: 62 - DNA, 103 bp, Artificial Sequence
  Synthetic Polynucleotide
taatacgactcactatagggagaggcgtaaacataatacacctcatcaccaacagaggagaggtgatatggtgtattataacctggcggcagcgcaaaagatg

SEQ ID NO: 63 - DNA, 103 bp, Artificial Sequence
  Synthetic Polynucleotide
taatacgactcactataggggcaagagaggcgtaaacataatacacctcaaacagaggagatgaggtatgttatgtttaaacctggcggcagcgcaaaagatg

SEQ ID NO: 64 - DNA, 103 bp, Artificial Sequence
  Synthetic Polynucleotide
taatacgactcactatagggcatctgcaagagaggcgtaaacataatacaaacagaggagatgtattatgtttacgcctaacctggcggcagcgcaaaagatg

SEQ ID NO: 65 - DNA, 103 bp, Artificial Sequence
  Synthetic Polynucleotide
taatacgactcactatagggttgtgcatctgcaagagaggcgtaaacataaacagaggagatatgttatggcctctcttaacctggcggcagcgcaaaagatg

SEQ ID NO: 66 - DNA, 103 bp, Artificial Sequence
  Synthetic Polynucleotide
taatacgactcactatagggttattttgtgcatctgcaagagaggcgtaaaacagaggagattacgcatgtcttgcagaaacctggcggcagcgcaaaagatg

SEQ ID NO: 67 - DNA, 103 bp, Artificial Sequence
  Synthetic Polynucleotide
taatacgactcactataggggcttattattttgtgcatctgcaagagaggaacagaggagacctctcatgcagatgcacaacctggcggcagcgcaaaagatg

SEQ ID NO: 68 - DNA, 103 bp, Artificial Sequence
  Synthetic Polynucleotide
taatacgactcactatagggaactggcttattattttgtgcatctgcaagaacagaggagacttgcaatggcacaaaataacctggcggcagcgcaaaagatg

SEQ ID NO: 69 - DNA, 103 bp, Artificial Sequence
  Synthetic Polynucleotide
taatacgactcactatagggaacataacaattcgagtaacactgattggtaacagaggagaaccaatatgtgttactcgaacctggcggcagcgcaaaagatg

SEQ ID NO: 70 - DNA, 103 bp, Artificial Sequence
  Synthetic Polynucleotide
taatacgactcactataggggcttcaactggcttattattttgtgcatctaacagaggagaagatgcatgaaataataaaacctggcggcagcgcaaaagatg

SEQ ID NO: 71 - DNA, 103 bp, Artificial Sequence
  Synthetic Polynucleotide
taatacgactcactataggggatttgcttcaactggcttattattttgtgaacagaggagacacaaaatgataagccagaacctggcggcagcgcaaaagatg

SEQ ID NO: 72 - DNA, 103 bp, Artificial Sequence
  Synthetic Polynucleotide
taatacgactcactatagggaaattgatttgcttcaactggcttattattaacagaggagaaataatatgccagttgaaaacctggcggcagcgcaaaagatg

SEQ ID NO: 73 - DNA, 103 bp, Artificial Sequence
  Synthetic Polynucleotide
taatacgactcactatagggttattaaattgatttgcttcaactggcttaaacagaggagataagccatgtgaagcaaaaacctggcggcagcgcaaaagatg

SEQ ID NO: 74 - DNA, 103 bp, Artificial Sequence
  Synthetic Polynucleotide
taatacgactcactatagggactgcttattaaattgatttgcttcaactgaacagaggagacagttgatgcaaatcaataacctggcggcagcgcaaaagatg

SEQ ID NO: 75 - DNA, 103 bp, Artificial Sequence
  Synthetic Polynucleotide
taatacgactcactatagggatgagactgcttattaaattgatttgcttcaacagaggagagaagcaatgcaatttaataacctggcggcagcgcaaaagatg

SEQ ID NO: 76 - DNA, 103 bp, Artificial Sequence
  Synthetic Polynucleotide
taatacgactcactataggggtattatgagactgcttattaaattgatttaacagaggagaaaatcaatgtaataagcaaacctggcggcagcgcaaaagatg

SEQ ID NO: 77 - DNA, 103 bp, Artificial Sequence
  Synthetic Polynucleotide
taatacgactcactatagggatgttgtattatgagactgcttattaaattaacagaggagaaatttaatgagcagtctcaacctggcggcagcgcaaaagatg

SEQ ID NO: 78 - DNA, 103 bp, Artificial Sequence
  Synthetic Polynucleotide
taatacgactcactatagggagccaatgttgtattatgagactgcttattaacagaggagaaataagatgtctcataataacctggcggcagcgcaaaagatg

SEQ ID NO: 79 - DNA, 103 bp, Artificial Sequence
  Synthetic Polynucleotide
taatacgactcactataggggtcacagccaatgttgtattatgagactgcaacagaggagagcagtcatgtaatacaacaacctggcggcagcgcaaaagatg

SEQ ID NO: 80 - DNA, 103 bp, Artificial Sequence
  Synthetic Polynucleotide
taatacgactcactataggggcccgaacataacaattcgagtaacactgaaacagaggagatcagtgatgctcgaattgaacctggcggcagcgcaaaagatg

SEQ ID NO: 81 - DNA, 103 bp, Artificial Sequence
  Synthetic Polynucleotide
taatacgactcactatagggtttgggtcacagccaatgttgtattatgagaacagaggagactcataatgcaacattggaacctggcggcagcgcaaaagatg

SEQ ID NO: 82 - DNA, 103 bp, Artificial Sequence
  Synthetic Polynucleotide
taatacgactcactatagggattaatttgggtcacagccaatgttgtattaacagaggagaaatacaatgttggctgtgaacctggcggcagcgcaaaagatg

SEQ ID NO: 83 - DNA, 103 bp, Artificial Sequence
  Synthetic Polynucleotide
taatacgactcactatagggggagcattaatttgggtcacagccaatgttaacagaggagaaacattatgtgtgacccaaacctggcggcagcgcaaaagatg

SEQ ID NO: 84 - DNA, 103 bp, Artificial Sequence
  Synthetic Polynucleotide
taatacgactcactatagggtatttggagcattaatttgggtcacagccaaacagaggagatggctgatgcccaaattaaacctggcggcagcgcaaaagatg

SEQ ID NO: 85 - DNA, 103 bp, Artificial Sequence
  Synthetic Polynucleotide
taatacgactcactatagggcccagtatttggagcattaatttgggtcacaacagaggagagtgaccatgattaatgctaacctggcggcagcgcaaaagatg

SEQ ID NO: 86 - DNA, 103 bp, Artificial Sequence
  Synthetic Polynucleotide
taatacgactcactatagggtttggcccagtatttggagcattaatttggaacagaggagaccaaatatgtgctccaaaaacctggcggcagcgcaaaagatg

SEQ ID NO: 87 - DNA, 103 bp, Artificial Sequence
  Synthetic Polynucleotide
taatacgactcactatagggcattgtttggcccagtatttggagcattaaaacagaggagattaatgatgcaaatactgaacctggcggcagcgcaaaagatg

SEQ ID NO: 88 - DNA, 103 bp, Artificial Sequence
  Synthetic Polynucleotide
taatacgactcactatagggtggcgcattgtttggcccagtatttggagcaacagaggagagctccaatgactgggccaaacctggcggcagcgcaaaagatg

SEQ ID NO: 89 - DNA, 103 bp, Artificial Sequence
  Synthetic Polynucleotide
taatacgactcactatagggactgctggcgcattgtttggcccagtatttaacagaggagaaaatacatggccaaacaaaacctggcggcagcgcaaaagatg

SEQ ID NO: 90 - DNA, 103 bp, Artificial Sequence
  Synthetic Polynucleotide
taatacgactcactatagggtaactactgctggcgcattgtttggcccagaacagaggagactgggcatgacaatgcgcaacctggcggcagcgcaaaagatg

SEQ ID NO: 91 - DNA, 103 bp, Artificial Sequence
  Synthetic Polynucleotide
taatacgactcactatagggcagcagcccgaacataacaattcgagtaacaacagaggagagttactatgattgttatgaacctggcggcagcgcaaaagatg

SEQ ID NO: 92 - DNA, 103 bp, Artificial Sequence
  Synthetic Polynucleotide
taatacgactcactatagggggatgtaactactgctggcgcattgtttggaacagaggagaccaaacatggcgccagcaaacctggcggcagcgcaaaagatg

SEQ ID NO: 93 - DNA, 103 bp, Artificial Sequence
  Synthetic Polynucleotide
taatacgactcactatagggagcctggatgtaactactgctggcgcattgaacagaggagacaatgcatgagcagtagtaacctggcggcagcgcaaaagatg

SEQ ID NO: 94 - DNA, 103 bp, Artificial Sequence
  Synthetic Polynucleotide
taatacgactcactataggggaaacagcctggatgtaactactgctggcgaacagaggagacgccagatgtagttacataacctggcggcagcgcaaaagatg

SEQ ID NO: 95 - DNA, 103 bp, Artificial Sequence
  Synthetic Polynucleotide
taatacgactcactatagggtatgggaaacagcctggatgtaactactgcaacagaggagagcagtaatgacatccaggaacctggcggcagcgcaaaagatg

SEQ ID NO: 96 - DNA, 103 bp, Artificial Sequence
  Synthetic Polynucleotide
taatacgactcactatagggtgtggtatgggaaacagcctggatgtaactaacagaggagaagttacatgcaggctgttaacctggcggcagcgcaaaagatg

SEQ ID NO: 97 - DNA, 103 bp, Artificial Sequence
  Synthetic Polynucleotide
taatacgactcactatagggcagcttgtggtatgggaaacagcctggatgaacagaggagacatccaatgtgtttcccaaacctggcggcagcgcaaaagatg

SEQ ID NO: 98 - DNA, 103 bp, Artificial Sequence
  Synthetic Polynucleotide
taatacgactcactatagggtatcccagcttgtggtatgggaaacagcctaacagaggagaaggctgatgcccataccaaacctggcggcagcgcaaaagatg

SEQ ID NO: 99 - DNA, 103 bp, Artificial Sequence
  Synthetic Polynucleotide
taatacgactcactatagggtctggtatcccagcttgtggtatgggaaacaacagaggagagtttccatgaccacaagcaacctggcggcagcgcaaaagatg

SEQ ID NO: 100 - DNA, 103 bp, Artificial Sequence
  Synthetic Polynucleotide
taatacgactcactatagggagccatctggtatcccagcttgtggtatggaacagaggagaccatacatgaagctgggaaacctggcggcagcgcaaaagatg

SEQ ID NO: 101 - DNA, 103 bp, Artificial Sequence
  Synthetic Polynucleotide
taatacgactcactatagggaaaccagccatctggtatcccagcttgtggaacagaggagaccacaaatggggataccaaacctggcggcagcgcaaaagatg

SEQ ID NO: 102 - DNA, 103 bp, Artificial Sequence
  Synthetic Polynucleotide
taatacgactcactatagggccaatcagcagcccgaacataacaattcgaaacagaggagatcgaatatgtatgttcggaacctggcggcagcgcaaaagatg

SEQ ID NO: 103 - DNA, 103 bp, Artificial Sequence
  Synthetic Polynucleotide
taatacgactcactatagggatccaaaaccagccatctggtatcccagctaacagaggagaagctggatgaccagatggaacctggcggcagcgcaaaagatg

SEQ ID NO: 104 - DNA, 103 bp, Artificial Sequence
  Synthetic Polynucleotide
taatacgactcactatagggcactaatccaaaaccagccatctggtatccaacagaggagaggatacatgatggctggtaacctggcggcagcgcaaaagatg

SEQ ID NO: 105 - DNA, 103 bp, Artificial Sequence
  Synthetic Polynucleotide
taatacgactcactataggggtgtccactaatccaaaaccagccatctggaacagaggagaccagatatgtggttttggaacctggcggcagcgcaaaagatg

SEQ ID NO: 106 - DNA, 103 bp, Artificial Sequence
  Synthetic Polynucleotide
taatacgactcactatagggtcaaagtgtccactaatccaaaaccagccaaacagaggagatggctgatgttggattagaacctggcggcagcgcaaaagatg

SEQ ID NO: 107 - DNA, 103 bp, Artificial Sequence
  Synthetic Polynucleotide
taatacgactcactataggggtgattcaaagtgtccactaatccaaaaccaacagaggagaggttttatgttagtggacaacctggcggcagcgcaaaagatg

SEQ ID NO: 108 - DNA, 103 bp, Artificial Sequence
  Synthetic Polynucleotide
taatacgactcactataggggtgtagtgattcaaagtgtccactaatccaaacagaggagatggattatgggacactttaacctggcggcagcgcaaaagatg

SEQ ID NO: 109 - DNA, 103 bp, Artificial Sequence
  Synthetic Polynucleotide
taatacgactcactatagggaccatgtgtagtgattcaaagtgtccactaaacagaggagatagtggatgctttgaatcaacctggcggcagcgcaaaagatg

SEQ ID NO: 110 - DNA, 103 bp, Artificial Sequence
  Synthetic Polynucleotide
taatacgactcactatagggagccaaccatgtgtagtgattcaaagtgtcaacagaggagagacactatgaatcactacaacctggcggcagcgcaaaagatg

SEQ ID NO: 111 - DNA, 103 bp, Artificial Sequence
  Synthetic Polynucleotide
taatacgactcactatagggatttaagccaaccatgtgtagtgattcaaaaacagaggagatttgaaatgctacacatgaacctggcggcagcgcaaaagatg

SEQ ID NO: 112 - DNA, 103 bp, Artificial Sequence
  Synthetic Polynucleotide
taatacgactcactataggggtaccatttaagccaaccatgtgtagtgataacagaggagaatcactatgcatggttggaacctggcggcagcgcaaaagatg

SEQ ID NO: 113 - DNA, 103 bp, Artificial Sequence
  Synthetic Polynucleotide
taatacgactcactatagggcataaacttgagaccctttgggcttgtatgaacagaggagacatacaatgccaaagggtaacctggcggcagcgcaaaagatg

SEQ ID NO: 114 - DNA, 103 bp, Artificial Sequence
  Synthetic Polynucleotide
taatacgactcactatagggataatccaatcagcagcccgaacataacaaaacagaggagattgttaatgtcgggctgcaacctggcggcagcgcaaaagatg

SEQ ID NO: 115 - DNA, 103 bp, Artificial Sequence
  Synthetic Polynucleotide
taatacgactcactatagggcatttgtaccatttaagccaaccatgtgtaaacagaggagatacacaatgttggcttaaaacctggcggcagcgcaaaagatg

SEQ ID NO: 116 - DNA, 103 bp, Artificial Sequence
  Synthetic Polynucleotide
taatacgactcactatagggtgatccatttgtaccatttaagccaaccataacagaggagaatggttatgttaaatggtaacctggcggcagcgcaaaagatg

SEQ ID NO: 117 - DNA, 103 bp, Artificial Sequence
  Synthetic Polynucleotide
taatacgactcactatagggaatgttgatccatttgtaccatttaagccaaacagaggagatggcttatgtggtacaaaaacctggcggcagcgcaaaagatg

SEQ ID NO: 118 - DNA, 103 bp, Artificial Sequence
  Synthetic Polynucleotide
taatacgactcactatagggagggtaatgttgatccatttgtaccatttaaacagaggagataaatgatgcaaatggataacctggcggcagcgcaaaagatg

SEQ ID NO: 119 - DNA, 103 bp, Artificial Sequence
  Synthetic Polynucleotide
taatacgactcactataggggccacagggtaatgttgatccatttgtaccaacagaggagaggtacaatgggatcaacaaacctggcggcagcgcaaaagatg

SEQ ID NO: 120 - DNA, 103 bp, Artificial Sequence
  Synthetic Polynucleotide
taatacgactcactatagggatgatgccacagggtaatgttgatccatttaacagaggagaaaatggatgaacattaccaacctggcggcagcgcaaaagatg

SEQ ID NO: 121 - DNA, 103 bp, Artificial Sequence
  Synthetic Polynucleotide
taatacgactcactatagggtagttatgatgccacagggtaatgttgatcaacagaggagagatcaaatgtaccctgtgaacctggcggcagcgcaaaagatg

SEQ ID NO: 122 - DNA, 103 bp, Artificial Sequence
  Synthetic Polynucleotide
taatacgactcactataggggaaagtagttatgatgccacagggtaatgtaacagaggagaacattaatgtgtggcatcaacctggcggcagcgcaaaagatg

SEQ ID NO: 123 - DNA, 103 bp, Artificial Sequence
  Synthetic Polynucleotide
taatacgactcactatagggtgggggaaagtagttatgatgccacagggtaacagaggagaaccctgatgcatcataacaacctggcggcagcgcaaaagatg

SEQ ID NO: 124 - DNA, 103 bp, Artificial Sequence
  Synthetic Polynucleotide
taatacgactcactatagggcccactgggggaaagtagttatgatgccacaacagaggagagtggcaatgtaactacttaacctggcggcagcgcaaaagatg

SEQ ID NO: 125 - DNA, 103 bp, Artificial Sequence
  Synthetic Polynucleotide
taatacgactcactatagggcaacaataatccaatcagcagcccgaacataacagaggagaatgttcatgctgctgattaacctggcggcagcgcaaaagatg

SEQ ID NO: 126 - DNA, 103 bp, Artificial Sequence
  Synthetic Polynucleotide
taatacgactcactatagggaaattcccactgggggaaagtagttatgataacagaggagaatcataatgactttccccaacctggcggcagcgcaaaagatg

SEQ ID NO: 127 - DNA, 103 bp, Artificial Sequence
  Synthetic Polynucleotide
taatacgactcactatagggaatttaaattcccactgggggaaagtagttaacagaggagaaactacatgcccccagtgaacctggcggcagcgcaaaagatg

SEQ ID NO: 128 - DNA, 103 bp, Artificial Sequence
  Synthetic Polynucleotide
taatacgactcactatagggttttcaatttaaattcccactgggggaaagaacagaggagactttccatgagtgggaataacctggcggcagcgcaaaagatg

SEQ ID NO: 129 - DNA, 103 bp, Artificial Sequence
  Synthetic Polynucleotide
taatacgactcactatagggtccctttttcaatttaaattcccactggggaacagaggagaccccagatggaatttaaaaacctggcggcagcgcaaaagatg

SEQ ID NO: 130 - DNA, 103 bp, Artificial Sequence
  Synthetic Polynucleotide
taatacgactcactataggggtagctccctttttcaatttaaattcccacaacagaggagagtgggaatgtaaattgaaaacctggcggcagcgcaaaagatg

SEQ ID NO: 131 - DNA, 103 bp, Artificial Sequence
  Synthetic Polynucleotide
taatacgactcactatagggattcggtagctccctttttcaatttaaattaacagaggagaaatttaatgtgaaaaaggaacctggcggcagcgcaaaagatg

SEQ ID NO: 132 - DNA, 103 bp, Artificial Sequence
  Synthetic Polynucleotide
taatacgactcactataggggccccattcggtagctccctttttcaatttaacagaggagaaaattgatgaagggagctaacctggcggcagcgcaaaagatg

SEQ ID NO: 133 - DNA, 103 bp, Artificial Sequence
  Synthetic Polynucleotide
taatacgactcactataggggcacagccccattcggtagctccctttttcaacagaggagagaaaaaatgagctaccgaaacctggcggcagcgcaaaagatg

SEQ ID NO: 134 - DNA, 103 bp, Artificial Sequence
  Synthetic Polynucleotide
taatacgactcactataggggcattgcacagccccattcggtagctccctaacagaggagaagggagatgccgaatgggaacctggcggcagcgcaaaagatg

SEQ ID NO: 135 - DNA, 103 bp, Artificial Sequence
  Synthetic Polynucleotide
taatacgactcactatagggaccctgcattgcacagccccattcggtagcaacagaggagagctaccatgtggggctgtaacctggcggcagcgcaaaagatg

SEQ ID NO: 136 - DNA, 103 bp, Artificial Sequence
  Synthetic Polynucleotide
taatacgactcactatagggtgtgccaacaataatccaatcagcagcccgaacagaggagacgggctatggattggattaacctggcggcagcgcaaaagatg

SEQ ID NO: 137 - DNA, 103 bp, Artificial Sequence
  Synthetic Polynucleotide
taatacgactcactataggggccacaccctgcattgcacagccccattcgaacagaggagacgaatgatgctgtgcaataacctggcggcagcgcaaaagatg

SEQ ID NO: 138 - DNA, 103 bp, Artificial Sequence
  Synthetic Polynucleotide
taatacgactcactatagggttgatgccacaccctgcattgcacagccccaacagaggagaggggctatgcaatgcaggaacctggcggcagcgcaaaagatg

SEQ ID NO: 139 - DNA, 103 bp, Artificial Sequence
  Synthetic Polynucleotide
taatacgactcactatagggtgggcttgatgccacaccctgcattgcacaaacagaggagatgtgcaatgcagggtgtgaacctggcggcagcgcaaaagatg

SEQ ID NO: 140 - DNA, 103 bp, Artificial Sequence
  Synthetic Polynucleotide
taatacgactcactatagggttatctgggcttgatgccacaccctgcattaacagaggagaaatgcaatgtgtggcatcaacctggcggcagcgcaaaagatg

SEQ ID NO: 141 - DNA, 103 bp, Artificial Sequence
  Synthetic Polynucleotide
taatacgactcactatagggttacattatctgggcttgatgccacaccctaacagaggagaagggtgatgcatcaagccaacctggcggcagcgcaaaagatg

SEQ ID NO: 142 - DNA, 103 bp, Artificial Sequence
  Synthetic Polynucleotide
taatacgactcactataggggcatgttacattatctgggcttgatgccacaacagaggagagtggcaatgagcccagataacctggcggcagcgcaaaagatg

SEQ ID NO: 143 - DNA, 103 bp, Artificial Sequence
  Synthetic Polynucleotide
taatacgactcactataggggaccagcatgttacattatctgggcttgataacagaggagaatcaagatgagataatgtaacctggcggcagcgcaaaagatg

SEQ ID NO: 144 - DNA, 103 bp, Artificial Sequence
  Synthetic Polynucleotide
taatacgactcactatagggcaacggaccagcatgttacattatctgggcaacagaggagagcccagatgatgtaacataacctggcggcagcgcaaaagatg

SEQ ID NO: 145 - DNA, 103 bp, Artificial Sequence
  Synthetic Polynucleotide
taatacgactcactatagggcgagtcaacggaccagcatgttacattatcaacagaggagagataatatgacatgctggaacctggcggcagcgcaaaagatg

SEQ ID NO: 146 - DNA, 103 bp, Artificial Sequence
  Synthetic Polynucleotide
taatacgactcactatagggtagtccgagtcaacggaccagcatgttacaaacagaggagatgtaacatgctggtccgtaacctggcggcagcgcaaaagatg

SEQ ID NO: 147 - DNA, 103 bp, Artificial Sequence
  Synthetic Polynucleotide
taatacgactcactatagggttgcatgtgccaacaataatccaatcagcaaacagaggagatgctgaatggattattgtaacctggcggcagcgcaaaagatg

SEQ ID NO: 148 - DNA, 103 bp, Artificial Sequence
  Synthetic Polynucleotide
taatacgactcactatagggactgatagtccgagtcaacggaccagcatgaacagaggagacatgctatgccgttgactaacctggcggcagcgcaaaagatg

SEQ ID NO: 149 - DNA, 103 bp, Artificial Sequence
  Synthetic Polynucleotide
taatacgactcactatagggtttcaactgatagtccgagtcaacggaccaaacagaggagatggtccatggactcggacaacctggcggcagcgcaaaagatg

SEQ ID NO: 150 - DNA, 103 bp, Artificial Sequence
  Synthetic Polynucleotide
taatacgactcactatagggcaccctttcaactgatagtccgagtcaacgaacagaggagacgttgaatgggactatcaaacctggcggcagcgcaaaagatg

SEQ ID NO: 151 - DNA, 103 bp, Artificial Sequence
  Synthetic Polynucleotide
taatacgactcactatagggcgtaccaccctttcaactgatagtccgagtaacagaggagaactcggatgatcagttgaaacctggcggcagcgcaaaagatg

SEQ ID NO: 152 - DNA, 103 bp, Artificial Sequence
  Synthetic Polynucleotide
taatacgactcactatagggaacgtcgtaccaccctttcaactgatagtcaacagaggagagactatatgttgaaagggaacctggcggcagcgcaaaagatg

SEQ ID NO: 153 - DNA, 103 bp, Artificial Sequence
  Synthetic Polynucleotide
taatacgactcactatagggccagcaacgtcgtaccaccctttcaactgaaacagaggagatcagttatgagggtggtaaacctggcggcagcgcaaaagatg

SEQ ID NO: 154 - DNA, 103 bp, Artificial Sequence
  Synthetic Polynucleotide
taatacgactcactataggggtataccagcaacgtcgtaccaccctttcaaacagaggagatgaaagatgggtacgacgaacctggcggcagcgcaaaagatg

SEQ ID NO: 155 - DNA, 103 bp, Artificial Sequence
  Synthetic Polynucleotide
taatacgactcactatagggtgatggtataccagcaacgtcgtaccacccaacagaggagagggtggatggacgttgctaacctggcggcagcgcaaaagatg

SEQ ID NO: 156 - DNA, 103 bp, Artificial Sequence
  Synthetic Polynucleotide
taatacgactcactatagggccggttgatggtataccagcaacgtcgtacaacagaggagagtacgaatgtgctggtataacctggcggcagcgcaaaagatg

SEQ ID NO: 157 - DNA, 103 bp, Artificial Sequence
  Synthetic Polynucleotide
taatacgactcactatagggctatgccggttgatggtataccagcaacgtaacagaggagaacgttgatggtataccataacctggcggcagcgcaaaagatg

SEQ ID NO: 158 - DNA, 103 bp, Artificial Sequence
  Synthetic Polynucleotide
taatacgactcactataggggctagttgcatgtgccaacaataatccaataacagaggagaattggaatgttgttggcaaacctggcggcagcgcaaaagatg

SEQ ID NO: 159 - DNA, 103 bp, Artificial Sequence
  Synthetic Polynucleotide
taatacgactcactatagggaacgactatgccggttgatggtataccagcaacagaggagagctggtatgccatcaaccaacctggcggcagcgcaaaagatg

SEQ ID NO: 160 - DNA, 103 bp, Artificial Sequence
  Synthetic Polynucleotide
taatacgactcactatagggcaatcaacgactatgccggttgatggtataaacagaggagatataccatgaaccggcataacctggcggcagcgcaaaagatg

SEQ ID NO: 161 - DNA, 103 bp, Artificial Sequence
  Synthetic Polynucleotide
taatacgactcactatagggtgacccaatcaacgactatgccggttgatgaacagaggagacatcaaatggcatagtcgaacctggcggcagcgcaaaagatg

SEQ ID NO: 162 - DNA, 103 bp, Artificial Sequence
  Synthetic Polynucleotide
taatacgactcactatagggaccagtgacccaatcaacgactatgccggtaacagaggagaaccggcatggtcgttgataacctggcggcagcgcaaaagatg

SEQ ID NO: 163 - DNA, 103 bp, Artificial Sequence
  Synthetic Polynucleotide
taatacgactcactatagggttggaaccagtgacccaatcaacgactatgaacagaggagacatagtatgtgattgggtaacctggcggcagcgcaaaagatg

SEQ ID NO: 164 - DNA, 103 bp, Artificial Sequence
  Synthetic Polynucleotide
taatacgactcactatagggtttgattggaaccagtgacccaatcaacgaaacagaggagatcgttgatggggtcactgaacctggcggcagcgcaaaagatg

SEQ ID NO: 165 - DNA, 103 bp, Artificial Sequence
  Synthetic Polynucleotide
taatacgactcactataggggacagtttgattggaaccagtgacccaatcaacagaggagagattggatgactggttccaacctggcggcagcgcaaaagatg

SEQ ID NO: 166 - DNA, 103 bp, Artificial Sequence
  Synthetic Polynucleotide
taatacgactcactatagggaggtggacagtttgattggaaccagtgaccaacagaggagaggtcacatgttccaatcaaacctggcggcagcgcaaaagatg

SEQ ID NO: 167 - DNA, 103 bp, Artificial Sequence
  Synthetic Polynucleotide
taatacgactcactatagggagtctaggtggacagtttgattggaaccagaacagaggagactggttatgatcaaactgaacctggcggcagcgcaaaagatg

SEQ ID NO: 168 - DNA, 103 bp, Artificial Sequence
  Synthetic Polynucleotide
taatacgactcactatagggagcccagtctaggtggacagtttgattggaaacagaggagatccaatatgactgtccacaacctggcggcagcgcaaaagatg

SEQ ID NO: 169 - DNA, 103 bp, Artificial Sequence
  Synthetic Polynucleotide
taatacgactcactatagggaagccgctagttgcatgtgccaacaataataacagaggagaattattatgggcacatgcaacctggcggcagcgcaaaagatg

SEQ ID NO: 170 - DNA, 103 bp, Artificial Sequence
  Synthetic Polynucleotide
taatacgactcactatagggacatcagcccagtctaggtggacagtttgaaacagaggagatcaaacatgccacctagaaacctggcggcagcgcaaaagatg

SEQ ID NO: 171 - DNA, 103 bp, Artificial Sequence
  Synthetic Polynucleotide
taatacgactcactatagggccaagacatcagcccagtctaggtggacagaacagaggagactgtccatgtagactgggaacctggcggcagcgcaaaagatg

SEQ ID NO: 172 - DNA, 103 bp, Artificial Sequence
  Synthetic Polynucleotide
taatacgactcactatagggccaagccaagacatcagcccagtctaggtgaacagaggagacacctaatgtgggctgataacctggcggcagcgcaaaagatg

SEQ ID NO: 173 - DNA, 103 bp, Artificial Sequence
  Synthetic Polynucleotide
taatacgactcactataggggatctccaagccaagacatcagcccagtctaacagaggagaagactgatgtgatgtcttaacctggcggcagcgcaaaagatg

SEQ ID NO: 174 - DNA, 103 bp, Artificial Sequence
  Synthetic Polynucleotide
taatacgactcactatagggcatcggatctccaagccaagacatcagcccaacagaggagagggctgatgtcttggcttaacctggcggcagcgcaaaagatg

SEQ ID NO: 175 - DNA, 103 bp, Artificial Sequence
  Synthetic Polynucleotide
taatacgactcactatagggccactcatcggatctccaagccaagacatcaacagaggagagatgtcatggcttggagaaacctggcggcagcgcaaaagatg

SEQ ID NO: 176 - DNA, 103 bp, Artificial Sequence
  Synthetic Polynucleotide
taatacgactcactataggggttccccactcatcggatctccaagccaagaacagaggagacttggcatggagatccgaaacctggcggcagcgcaaaagatg

SEQ ID NO: 177 - DNA, 103 bp, Artificial Sequence
  Synthetic Polynucleotide
taatacgactcactataggggaagcgttccccactcatcggatctccaagaacagaggagacttggaatgccgatgagtaacctggcggcagcgcaaaagatg

SEQ ID NO: 178 - DNA, 103 bp, Artificial Sequence
  Synthetic Polynucleotide
taatacgactcactatagggtagacgaagcgttccccactcatcggatctaacagaggagaagatccatggagtggggaaacctggcggcagcgcaaaagatg

SEQ ID NO: 179 - DNA, 103 bp, Artificial Sequence
  Synthetic Polynucleotide
taatacgactcactatagggtatgttagacgaagcgttccccactcatcgaacagaggagacgatgaatggggaacgctaacctggcggcagcgcaaaagatg

SEQ ID NO: 180 - DNA, 103 bp, Artificial Sequence
  Synthetic Polynucleotide
taatacgactcactatagggttctgaagccgctagttgcatgtgccaacaaacagaggagatgttggatgatgcaactaaacctggcggcagcgcaaaagatg

SEQ ID NO: 181 - DNA, 103 bp, Artificial Sequence
  Synthetic Polynucleotide
taatacgactcactatagggaccagtatgttagacgaagcgttccccactaacagaggagaagtgggatgcgcttcgtcaacctggcggcagcgcaaaagatg

SEQ ID NO: 182 - DNA, 103 bp, Artificial Sequence
  Synthetic Polynucleotide
taatacgactcactatagggacacaaccagtatgttagacgaagcgttccaacagaggagaggaacgatgcgtctaacaaacctggcggcagcgcaaaagatg

SEQ ID NO: 183 - DNA, 103 bp, Artificial Sequence
  Synthetic Polynucleotide
taatacgactcactataggggtcctacacaaccagtatgttagacgaagcaacagaggagagcttcgatgaacatactgaacctggcggcagcgcaaaagatg

SEQ ID NO: 184 - DNA, 103 bp, Artificial Sequence
  Synthetic Polynucleotide
taatacgactcactataggggcctagtcctacacaaccagtatgttagacaacagaggagagtctaaatgactggttgtaacctggcggcagcgcaaaagatg

SEQ ID NO: 185 - DNA, 103 bp, Artificial Sequence
  Synthetic Polynucleotide
taatacgactcactatagggctcacgcctagtcctacacaaccagtatgtaacagaggagaacatacatgttgtgtaggaacctggcggcagcgcaaaagatg

SEQ ID NO: 186 - DNA, 103 bp, Artificial Sequence
  Synthetic Polynucleotide
taatacgactcactataggggtgacctcacgcctagtcctacacaaccagaacagaggagactggttatgtaggactagaacctggcggcagcgcaaaagatg

SEQ ID NO: 187 - DNA, 103 bp, Artificial Sequence
  Synthetic Polynucleotide
taatacgactcactatagggaagcagtgacctcacgcctagtcctacacaaacagaggagatgtgtaatgctaggcgtgaacctggcggcagcgcaaaagatg

SEQ ID NO: 188 - DNA, 103 bp, Artificial Sequence
  Synthetic Polynucleotide
taatacgactcactatagggatccgaagcagtgacctcacgcctagtcctaacagaggagaaggactatgcgtgaggtcaacctggcggcagcgcaaaagatg

SEQ ID NO: 189 - DNA, 103 bp, Artificial Sequence
  Synthetic Polynucleotide
taatacgactcactatagggtcaaaatccgaagcagtgacctcacgcctaaacagaggagataggcgatgggtcactgcaacctggcggcagcgcaaaagatg

SEQ ID NO: 190 - DNA, 103 bp, Artificial Sequence
  Synthetic Polynucleotide
taatacgactcactatagggttgtatcaaaatccgaagcagtgacctcacaacagaggagagtgaggatgctgcttcggaacctggcggcagcgcaaaagatg

SEQ ID NO: 191 - DNA, 103 bp, Artificial Sequence
  Synthetic Polynucleotide
taatacgactcactatagggaccagttctgaagccgctagttgcatgtgcaacagaggagagcacatatgactagcggcaacctggcggcagcgcaaaagatg

SEQ ID NO: 192 - DNA, 103 bp, Artificial Sequence
  Synthetic Polynucleotide
taatacgactcactatagggctgagttgtatcaaaatccgaagcagtgacaacagaggagagtcactatgtcggattttaacctggcggcagcgcaaaagatg

SEQ ID NO: 193 - DNA, 103 bp, Artificial Sequence
  Synthetic Polynucleotide
taatacgactcactatagggttcttctgagttgtatcaaaatccgaagcaaacagaggagatgcttcatgttttgatacaacctggcggcagcgcaaaagatg

SEQ ID NO: 194 - DNA, 103 bp, Artificial Sequence
  Synthetic Polynucleotide
taatacgactcactatagggtaggattcttctgagttgtatcaaaatccgaacagaggagacggattatgatacaactcaacctggcggcagcgcaaaagatg

SEQ ID NO: 195 - DNA, 103 bp, Artificial Sequence
  Synthetic Polynucleotide
taatacgactcactatagggtgggctaggattcttctgagttgtatcaaaaacagaggagatttgatatgactcagaagaacctggcggcagcgcaaaagatg

SEQ ID NO: 196 - DNA, 103 bp, Artificial Sequence
  Synthetic Polynucleotide
taatacgactcactatagggatgtatgggctaggattcttctgagttgtaaacagaggagatacaacatggaagaatccaacctggcggcagcgcaaaagatg

SEQ ID NO: 197 - DNA, 103 bp, Artificial Sequence
  Synthetic Polynucleotide
taatacgactcactatagggttgtaatgtatgggctaggattcttctgagaacagaggagactcagaatgatcctagccaacctggcggcagcgcaaaagatg

SEQ ID NO: 198 - DNA, 103 bp, Artificial Sequence
  Synthetic Polynucleotide
taatacgactcactatagggtgcatttgtaatgtatgggctaggattcttaacagaggagaaagaatatgagcccatacaacctggcggcagcgcaaaagatg

SEQ ID NO: 199 - DNA, 103 bp, Artificial Sequence
  Synthetic Polynucleotide
taatacgactcactataggggcctctgcatttgtaatgtatgggctaggaaacagaggagatcctagatgatacattacaacctggcggcagcgcaaaagatg

SEQ ID NO: 200 - DNA, 103 bp, Artificial Sequence
  Synthetic Polynucleotide
taatacgactcactatagggtttgggcctctgcatttgtaatgtatgggcaacagaggagagcccatatgttacaaatgaacctggcggcagcgcaaaagatg

SEQ ID NO: 201 - DNA, 103 bp, Artificial Sequence
  Synthetic Polynucleotide
taatacgactcactataggggtatttttgggcctctgcatttgtaatgtaaacagaggagatacattatgaatgcagagaacctggcggcagcgcaaaagatg

SEQ ID NO: 202 - DNA, 103 bp, Artificial Sequence
  Synthetic Polynucleotide
taatacgactcactatagggcattgaccagttctgaagccgctagttgcaaacagaggagatgcaacatgcggcttcagaacctggcggcagcgcaaaagatg

SEQ ID NO: 203 - DNA, 103 bp, Artificial Sequence
  Synthetic Polynucleotide
taatacgactcactataggggctttgtatttttgggcctctgcatttgtaaacagaggagatacaaaatgagaggcccaaacctggcggcagcgcaaaagatg

SEQ ID NO: 204 - DNA, 103 bp, Artificial Sequence
  Synthetic Polynucleotide
taatacgactcactatagggcatcagctttgtatttttgggcctctgcataacagaggagaatgcagatgcccaaaaataacctggcggcagcgcaaaagatg

SEQ ID NO: 205 - DNA, 103 bp, Artificial Sequence
  Synthetic Polynucleotide
taatacgactcactatagggccgcacatcagctttgtatttttgggcctcaacagaggagagaggccatgaaatacaaaaacctggcggcagcgcaaaagatg

SEQ ID NO: 206 - DNA, 103 bp, Artificial Sequence
  Synthetic Polynucleotide
taatacgactcactatagggacctcccgcacatcagctttgtatttttggaacagaggagaccaaaaatgcaaagctgaaacctggcggcagcgcaaaagatg

SEQ ID NO: 207 - DNA, 103 bp, Artificial Sequence
  Synthetic Polynucleotide
taatacgactcactatagggtccaaacctcccgcacatcagctttgtattaacagaggagaaatacaatgctgatgtgcaacctggcggcagcgcaaaagatg

SEQ ID NO: 208 - DNA, 103 bp, Artificial Sequence
  Synthetic Polynucleotide
taatacgactcactatagggtggtatccaaacctcccgcacatcagctttaacagaggagaaaagctatggtgcgggagaacctggcggcagcgcaaaagatg

SEQ ID NO: 209 - DNA, 103 bp, Artificial Sequence
  Synthetic Polynucleotide
taatacgactcactatagggacggttggtatccaaacctcccgcacatcaaacagaggagatgatgtatgggaggtttgaacctggcggcagcgcaaaagatg

SEQ ID NO: 210 - DNA, 103 bp, Artificial Sequence
  Synthetic Polynucleotide
taatacgactcactatagggtgacaacggttggtatccaaacctcccgcaaacagaggagatgcgggatgtttggatacaacctggcggcagcgcaaaagatg

SEQ ID NO: 211 - DNA, 103 bp, Artificial Sequence
  Synthetic Polynucleotide
taatacgactcactatagggattagtgacaacggttggtatccaaacctcaacagaggagagaggttatgataccaaccaacctggcggcagcgcaaaagatg

SEQ ID NO: 212 - DNA, 103 bp, Artificial Sequence
  Synthetic Polynucleotide
taatacgactcactatagggtgctcattagtgacaacggttggtatccaaaacagaggagattggatatgaaccgttgtaacctggcggcagcgcaaaagatg

SEQ ID NO: 213 - DNA, 103 bp, Artificial Sequence
  Synthetic Polynucleotide
taatacgactcactatagggctaagcattgaccagttctgaagccgctagaacagaggagactagcgatgtcagaactgaacctggcggcagcgcaaaagatg

SEQ ID NO: 214 - DNA, 103 bp, Artificial Sequence
  Synthetic Polynucleotide
taatacgactcactatagggtgcgttgctcattagtgacaacggttggtaaacagaggagataccaaatgttgtcactaaacctggcggcagcgcaaaagatg

SEQ ID NO: 215 - DNA, 103 bp, Artificial Sequence
  Synthetic Polynucleotide
taatacgactcactatagggattggtgcgttgctcattagtgacaacggtaacagaggagaaccgttatgactaatgagaacctggcggcagcgcaaaagatg

SEQ ID NO: 216 - DNA, 103 bp, Artificial Sequence
  Synthetic Polynucleotide
taatacgactcactatagggctgctattggtgcgttgctcattagtgacaaacagaggagatgtcacatgtgagcaacgaacctggcggcagcgcaaaagatg

SEQ ID NO: 217 - DNA, 103 bp, Artificial Sequence
  Synthetic Polynucleotide
taatacgactcactatagggggactctgctattggtgcgttgctcattagaacagaggagactaatgatgaacgcaccaaacctggcggcagcgcaaaagatg

SEQ ID NO: 218 - DNA, 103 bp, Artificial Sequence
  Synthetic Polynucleotide
taatacgactcactataggggtactggactctgctattggtgcgttgctcaacagaggagagagcaaatgaccaatagcaacctggcggcagcgcaaaagatg

SEQ ID NO: 219 - DNA, 103 bp, Artificial Sequence
  Synthetic Polynucleotide
taatacgactcactataggggaaatgtactggactctgctattggtgcgtaacagaggagaacgcacatgtagcagagtaacctggcggcagcgcaaaagatg

SEQ ID NO: 220 - DNA, 103 bp, Artificial Sequence
  Synthetic Polynucleotide
taatacgactcactatagggctctagaaatgtactggactctgctattggaacagaggagaccaataatggagtccagtaacctggcggcagcgcaaaagatg

SEQ ID NO: 221 - DNA, 103 bp, Artificial Sequence
  Synthetic Polynucleotide
taatacgactcactatagggacgaactctagaaatgtactggactctgctaacagaggagaagcagaatgcagtacattaacctggcggcagcgcaaaagatg

SEQ ID NO: 222 - DNA, 103 bp, Artificial Sequence
  Synthetic Polynucleotide
taatacgactcactatagggccagcacgaactctagaaatgtactggactaacagaggagaagtccaatgcatttctagaacctggcggcagcgcaaaagatg

SEQ ID NO: 223 - DNA, 103 bp, Artificial Sequence
  Synthetic Polynucleotide
taatacgactcactatagggttgtcccagcacgaactctagaaatgtactaacagaggagaagtacaatgctagagttcaacctggcggcagcgcaaaagatg

SEQ ID NO: 224 - DNA, 103 bp, Artificial Sequence
  Synthetic Polynucleotide
taatacgactcactatagggagggtcataaacttgagaccctttgggcttaacagaggagaaagcccatggggtctcaaaacctggcggcagcgcaaaagatg

SEQ ID NO: 225 - DNA, 103 bp, Artificial Sequence
  Synthetic Polynucleotide
taatacgactcactatagggactgtctaagcattgaccagttctgaagccaacagaggagaggcttcatgactggtcaaaacctggcggcagcgcaaaagatg

SEQ ID NO: 226 - DNA, 103 bp, Artificial Sequence
  Synthetic Polynucleotide
taatacgactcactatagggaactattgtcccagcacgaactctagaaataacagaggagaatttctatggttcgtgctaacctggcggcagcgcaaaagatg

SEQ ID NO: 227 - DNA, 103 bp, Artificial Sequence
  Synthetic Polynucleotide
taatacgactcactatagggagcacaactattgtcccagcacgaactctaaacagaggagatagagtatgtgctgggacaacctggcggcagcgcaaaagatg

SEQ ID NO: 228 - DNA, 103 bp, Artificial Sequence
  Synthetic Polynucleotide
taatacgactcactatagggaccaaagcacaactattgtcccagcacgaaaacagaggagattcgtgatgggacaatagaacctggcggcagcgcaaaagatg

SEQ ID NO: 229 - DNA, 103 bp, Artificial Sequence
  Synthetic Polynucleotide
taatacgactcactatagggtaagcaccaaagcacaactattgtcccagcaacagaggagagctgggatgatagttgtgaacctggcggcagcgcaaaagatg

SEQ ID NO: 230 - DNA, 103 bp, Artificial Sequence
  Synthetic Polynucleotide
taatacgactcactatagggctacctaagcaccaaagcacaactattgtcaacagaggagagacaatatgtgtgctttgaacctggcggcagcgcaaaagatg

SEQ ID NO: 231 - DNA, 103 bp, Artificial Sequence
  Synthetic Polynucleotide
taatacgactcactatagggtgtggctacctaagcaccaaagcacaactaaacagaggagatagttgatgtttggtgctaacctggcggcagcgcaaaagatg

SEQ ID NO: 232 - DNA, 103 bp, Artificial Sequence
  Synthetic Polynucleotide
taatacgactcactatagggaaaagtgtggctacctaagcaccaaagcacaacagaggagagtgcttatgtgcttaggtaacctggcggcagcgcaaaagatg

SEQ ID NO: 233 - DNA, 103 bp, Artificial Sequence
  Synthetic Polynucleotide
taatacgactcactatagggctctcaaaagtgtggctacctaagcaccaaaacagaggagattggtgatgaggtagccaaacctggcggcagcgcaaaagatg

SEQ ID NO: 234 - DNA, 103 bp, Artificial Sequence
  Synthetic Polynucleotide
taatacgactcactatagggttccactctcaaaagtgtggctacctaagcaacagaggagagcttagatggccacacttaacctggcggcagcgcaaaagatg

SEQ ID NO: 235 - DNA, 103 bp, Artificial Sequence
  Synthetic Polynucleotide
taatacgactcactataggggccagttccactctcaaaagtgtggctaccaacagaggagaggtagcatgacttttgagaacctggcggcagcgcaaaagatg

SEQ ID NO: 236 - DNA, 103 bp, Artificial Sequence
  Synthetic Polynucleotide
taatacgactcactatagggacatcactgtctaagcattgaccagttctgaacagaggagacagaacatgtcaatgcttaacctggcggcagcgcaaaagatg

SEQ ID NO: 237 - DNA, 103 bp, Artificial Sequence
  Synthetic Polynucleotide
taatacgactcactatagggcctttgccagttccactctcaaaagtgtggaacagaggagaccacacatgtgagagtggaacctggcggcagcgcaaaagatg

SEQ ID NO: 238 - DNA, 103 bp, Artificial Sequence
  Synthetic Polynucleotide
taatacgactcactatagggtggtacctttgccagttccactctcaaaagaacagaggagacttttgatggtggaactgaacctggcggcagcgcaaaagatg

SEQ ID NO: 239 - DNA, 103 bp, Artificial Sequence
  Synthetic Polynucleotide
taatacgactcactatagggaactatggtacctttgccagttccactctcaacagaggagagagagtatgactggcaaaaacctggcggcagcgcaaaagatg

SEQ ID NO: 240 - DNA, 103 bp, Artificial Sequence
  Synthetic Polynucleotide
taatacgactcactatagggttagaaactatggtacctttgccagttccaaacagaggagatggaacatgcaaaggtacaacctggcggcagcgcaaaagatg

SEQ ID NO: 241 - DNA, 103 bp, Artificial Sequence
  Synthetic Polynucleotide
taatacgactcactatagggtatccttagaaactatggtacctttgccagaacagaggagactggcaatggtaccatagaacctggcggcagcgcaaaagatg

SEQ ID NO: 242 - DNA, 103 bp, Artificial Sequence
  Synthetic Polynucleotide
taatacgactcactatagggatagttatccttagaaactatggtacctttaacagaggagaaaaggtatgatagtttctaacctggcggcagcgcaaaagatg

SEQ ID NO: 243 - DNA, 103 bp, Artificial Sequence
  Synthetic Polynucleotide
taatacgactcactataggggcaccatagttatccttagaaactatggtaaacagaggagataccatatgttctaaggaaacctggcggcagcgcaaaagatg

SEQ ID NO: 244 - DNA, 103 bp, Artificial Sequence
  Synthetic Polynucleotide
taatacgactcactatagggcataagcaccatagttatccttagaaactaaacagaggagatagtttatgaggataactaacctggcggcagcgcaaaagatg

SEQ ID NO: 245 - DNA, 103 bp, Artificial Sequence
  Synthetic Polynucleotide
taatacgactcactatagggctggccataagcaccatagttatccttagaaacagaggagatctaagatgaactatggtaacctggcggcagcgcaaaagatg

SEQ ID NO: 246 - DNA, 103 bp, Artificial Sequence
  Synthetic Polynucleotide
taatacgactcactatagggggtaactggccataagcaccatagttatccaacagaggagaggataaatgtggtgcttaaacctggcggcagcgcaaaagatg

SEQ ID NO: 247 - DNA, 103 bp, Artificial Sequence
  Synthetic Polynucleotide
taatacgactcactatagggcactaacatcactgtctaagcattgaccagaacagaggagactggtcatggcttagacaaacctggcggcagcgcaaaagatg

SEQ ID NO: 248 - DNA, 103 bp, Artificial Sequence
  Synthetic Polynucleotide
taatacgactcactatagggtagtgggtaactggccataagcaccatagtaacagaggagaactatgatgcttatggccaacctggcggcagcgcaaaagatg

SEQ ID NO: 249 - DNA, 103 bp, Artificial Sequence
  Synthetic Polynucleotide
taatacgactcactatagggcatcttagtgggtaactggccataagcaccaacagaggagaggtgctatgggccagttaaacctggcggcagcgcaaaagatg

SEQ ID NO: 250 - DNA, 103 bp, Artificial Sequence
  Synthetic Polynucleotide
taatacgactcactataggggtagacatcttagtgggtaactggccataaaacagaggagattatggatggttacccacaacctggcggcagcgcaaaagatg

SEQ ID NO: 251 - DNA, 103 bp, Artificial Sequence
  Synthetic Polynucleotide
taatacgactcactatagggctgtagtagacatcttagtgggtaactggcaacagaggagagccagtatgccactaagaaacctggcggcagcgcaaaagatg

SEQ ID NO: 252 - DNA, 103 bp, Artificial Sequence
  Synthetic Polynucleotide
taatacgactcactatagggtagccctgtagtagacatcttagtgggtaaaacagaggagattacccatgaagatgtctaacctggcggcagcgcaaaagatg

SEQ ID NO: 253 - DNA, 103 bp, Artificial Sequence
  Synthetic Polynucleotide
taatacgactcactatagggtgccatagccctgtagtagacatcttagtgaacagaggagacactaaatggtctactacaacctggcggcagcgcaaaagatg

SEQ ID NO: 254 - DNA, 103 bp, Artificial Sequence
  Synthetic Polynucleotide
taatacgactcactatagggctctgtgccatagccctgtagtagacatctaacagaggagaagatgtatgctacagggcaacctggcggcagcgcaaaagatg

SEQ ID NO: 255 - DNA, 103 bp, Artificial Sequence
  Synthetic Polynucleotide
taatacgactcactatagggcagagctctgtgccatagccctgtagtagaaacagaggagatctactatggggctatggaacctggcggcagcgcaaaagatg

SEQ ID NO: 256 - DNA, 103 bp, Artificial Sequence
  Synthetic Polynucleotide
taatacgactcactataggggttgacagagctctgtgccatagccctgtaaacagaggagatacaggatgatggcacagaacctggcggcagcgcaaaagatg

SEQ ID NO: 257 - DNA, 103 bp, Artificial Sequence
  Synthetic Polynucleotide
taatacgactcactatagggccactgttgacagagctctgtgccatagccaacagaggagaggctatatgacagagctcaacctggcggcagcgcaaaagatg

SEQ ID NO: 258 - DNA, 103 bp, Artificial Sequence
  Synthetic Polynucleotide
taatacgactcactatagggtgtttcactaacatcactgtctaagcattgaacagaggagacaatgcatggacagtgataacctggcggcagcgcaaaagatg

SEQ ID NO: 259 - DNA, 103 bp, Artificial Sequence
  Synthetic Polynucleotide
taatacgactcactatagggtggccccactgttgacagagctctgtgccaaacagaggagatggcacatggctctgtcaaacctggcggcagcgcaaaagatg

SEQ ID NO: 260 - DNA, 103 bp, Artificial Sequence
  Synthetic Polynucleotide
taatacgactcactataggggtggatggccccactgttgacagagctctgaacagaggagacagagcatggtcaacagtaacctggcggcagcgcaaaagatg

SEQ ID NO: 261 - DNA, 103 bp, Artificial Sequence
  Synthetic Polynucleotide
taatacgactcactatagggaatcagtggatggccccactgttgacagagaacagaggagactctgtatgcagtggggcaacctggcggcagcgcaaaagatg

SEQ ID NO: 262 - DNA, 103 bp, Artificial Sequence
  Synthetic Polynucleotide
taatacgactcactatagggaagccaatcagtggatggccccactgttgaaacagaggagatcaacaatggggccatccaacctggcggcagcgcaaaagatg

SEQ ID NO: 263 - DNA, 103 bp, Artificial Sequence
  Synthetic Polynucleotide
taatacgactcactatagggacagtaagccaatcagtggatggccccactaacagaggagaagtgggatgatccactgaaacctggcggcagcgcaaaagatg

SEQ ID NO: 264 - DNA, 103 bp, Artificial Sequence
  Synthetic Polynucleotide
taatacgactcactatagggaagcaacagtaagccaatcagtggatggccaacagaggagaggccatatgctgattggcaacctggcggcagcgcaaaagatg

SEQ ID NO: 265 - DNA, 103 bp, Artificial Sequence
  Synthetic Polynucleotide
taatacgactcactatagggatcaaaagcaacagtaagccaatcagtggaaacagaggagatccactatgtggcttactaacctggcggcagcgcaaaagatg

SEQ ID NO: 266 - DNA, 103 bp, Artificial Sequence
  Synthetic Polynucleotide
taatacgactcactatagggtgtgcatcaaaagcaacagtaagccaatcaaacagaggagatgattgatgtactgttgcaacctggcggcagcgcaaaagatg

SEQ ID NO: 267 - DNA, 103 bp, Artificial Sequence
  Synthetic Polynucleotide
taatacgactcactatagggcggcatgtgcatcaaaagcaacagtaagccaacagaggagaggcttaatgttgcttttgaacctggcggcagcgcaaaagatg

SEQ ID NO: 268 - DNA, 103 bp, Artificial Sequence
  Synthetic Polynucleotide
taatacgactcactatagggcacggcggcatgtgcatcaaaagcaacagtaacagaggagaactgttatgtttgatgcaaacctggcggcagcgcaaaagatg

SEQ ID NO: 269 - DNA, 103 bp, Artificial Sequence
  Synthetic Polynucleotide
taatacgactcactatagggttgagtgtttcactaacatcactgtctaagaacagaggagacttagaatgtgatgttagaacctggcggcagcgcaaaagatg

SEQ ID NO: 270 - DNA, 103 bp, Artificial Sequence
  Synthetic Polynucleotide
taatacgactcactatagggcttgtcacggcggcatgtgcatcaaaagcaaacagaggagatgctttatgtgcacatgcaacctggcggcagcgcaaaagatg

SEQ ID NO: 271 - DNA, 103 bp, Artificial Sequence
  Synthetic Polynucleotide
taatacgactcactatagggcatcacttgtcacggcggcatgtgcatcaaaacagaggagattgatgatgatgccgccgaacctggcggcagcgcaaaagatg

SEQ ID NO: 272 - DNA, 103 bp, Artificial Sequence
  Synthetic Polynucleotide
taatacgactcactatagggaatatcatcacttgtcacggcggcatgtgcaacagaggagagcacatatggccgtgacaaacctggcggcagcgcaaaagatg

SEQ ID NO: 273 - DNA, 103 bp, Artificial Sequence
  Synthetic Polynucleotide
taatacgactcactataggggtgacaatatcatcacttgtcacggcggcaaacagaggagatgccgcatggacaagtgaaacctggcggcagcgcaaaagatg

SEQ ID NO: 274 - DNA, 103 bp, Artificial Sequence
  Synthetic Polynucleotide
taatacgactcactataggggcttagtgacaatatcatcacttgtcacggaacagaggagaccgtgaatggtgatgataaacctggcggcagcgcaaaagatg

SEQ ID NO: 275 - DNA, 103 bp, Artificial Sequence
  Synthetic Polynucleotide
taatacgactcactatagggcagcagcttagtgacaatatcatcacttgtaacagaggagaacaagtatggatattgtcaacctggcggcagcgcaaaagatg

SEQ ID NO: 276 - DNA, 103 bp, Artificial Sequence
  Synthetic Polynucleotide
taatacgactcactatagggtcagccagcagcttagtgacaatatcatcaaacagaggagatgatgaatgtgtcactaaaacctggcggcagcgcaaaagatg

SEQ ID NO: 277 - DNA, 103 bp, Artificial Sequence
  Synthetic Polynucleotide
taatacgactcactatagggcaatttcagccagcagcttagtgacaatataacagaggagaatattgatgctaagctgcaacctggcggcagcgcaaaagatg

SEQ ID NO: 278 - DNA, 103 bp, Artificial Sequence
  Synthetic Polynucleotide
taatacgactcactatagggattctcaatttcagccagcagcttagtgacaacagaggagagtcactatgctgctggctaacctggcggcagcgcaaaagatg

SEQ ID NO: 279 - DNA, 103 bp, Artificial Sequence
  Synthetic Polynucleotide
taatacgactcactatagggtacttattctcaatttcagccagcagcttaaacagaggagataagctatgggctgaaataacctggcggcagcgcaaaagatg

SEQ ID NO: 280 - DNA, 103 bp, Artificial Sequence
  Synthetic Polynucleotide
taatacgactcactataggggtggcttgagtgtttcactaacatcactgtaacagaggagaacagtgatgttagtgaaaaacctggcggcagcgcaaaagatg

SEQ ID NO: 281 - DNA, 103 bp, Artificial Sequence
  Synthetic Polynucleotide
taatacgactcactataggggatcatacttattctcaatttcagccagcaaacagaggagatgctggatgaaattgagaaacctggcggcagcgcaaaagatg

SEQ ID NO: 282 - DNA, 103 bp, Artificial Sequence
  Synthetic Polynucleotide
taatacgactcactatagggttccagatcatacttattctcaatttcagcaacagaggagagctgaaatggagaataagaacctggcggcagcgcaaaagatg

SEQ ID NO: 283 - DNA, 103 bp, Artificial Sequence
  Synthetic Polynucleotide
taatacgactcactatagggcggggttccagatcatacttattctcaattaacagaggagaaattgaatgtaagtatgaaacctggcggcagcgcaaaagatg

SEQ ID NO: 284 - DNA, 103 bp, Artificial Sequence
  Synthetic Polynucleotide
taatacgactcactataggggtcttcggggttccagatcatacttattctaacagaggagaagaataatgatgatctggaacctggcggcagcgcaaaagatg

SEQ ID NO: 285 - DNA, 103 bp, Artificial Sequence
  Synthetic Polynucleotide
taatacgactcactatagggtctctgtcttcggggttccagatcatacttaacagaggagaaagtatatgctggaacccaacctggcggcagcgcaaaagatg

SEQ ID NO: 286 - DNA, 103 bp, Artificial Sequence
  Synthetic Polynucleotide
taatacgactcactatagggcgtgatctctgtcttcggggttccagatcaaacagaggagatgatctatgaccccgaagaacctggcggcagcgcaaaagatg

SEQ ID NO: 287 - DNA, 103 bp, Artificial Sequence
  Synthetic Polynucleotide
taatacgactcactataggggatcccgtgatctctgtcttcggggttccaaacagaggagatggaacatggaagacagaaacctggcggcagcgcaaaagatg

SEQ ID NO: 288 - DNA, 103 bp, Artificial Sequence
  Synthetic Polynucleotide
taatacgactcactatagggattatgatcccgtgatctctgtcttcggggaacagaggagaccccgaatgcagagatcaaacctggcggcagcgcaaaagatg

SEQ ID NO: 289 - DNA, 103 bp, Artificial Sequence
  Synthetic Polynucleotide
taatacgactcactatagggtctctattatgatcccgtgatctctgtcttaacagaggagaaagacaatgatcacgggaaacctggcggcagcgcaaaagatg

SEQ ID NO: 290 - DNA, 103 bp, Artificial Sequence
  Synthetic Polynucleotide
taatacgactcactatagggttaaatctctattatgatcccgtgatctctaacagaggagaagagatatggggatcataaacctggcggcagcgcaaaagatg

SEQ ID NO: 291 - DNA, 103 bp, Artificial Sequence
  Synthetic Polynucleotide
taatacgactcactatagggggtttgtggcttgagtgtttcactaacatcaacagaggagagatgttatggaaacactcaacctggcggcagcgcaaaagatg

SEQ ID NO: 292 - DNA, 103 bp, Artificial Sequence
  Synthetic Polynucleotide
taatacgactcactatagggtctggttaaatctctattatgatcccgtgaaacagaggagatcacggatgcataatagaaacctggcggcagcgcaaaagatg

SEQ ID NO: 293 - DNA, 103 bp, Artificial Sequence
  Synthetic Polynucleotide
taatacgactcactatagggtttaatctggttaaatctctattatgatccaacagaggagaggatcaatgtagagatttaacctggcggcagcgcaaaagatg

SEQ ID NO: 294 - DNA, 103 bp, Artificial Sequence
  Synthetic Polynucleotide
taatacgactcactatagggataattttaatctggttaaatctctattataacagaggagaataataatgatttaaccaaacctggcggcagcgcaaaagatg

SEQ ID NO: 295 - DNA, 103 bp, Artificial Sequence
  Synthetic Polynucleotide
taatacgactcactatagggttcatataattttaatctggttaaatctctaacagaggagaagagatatgaccagattaaacctggcggcagcgcaaaagatg

SEQ ID NO: 296 - DNA, 103 bp, Artificial Sequence
  Synthetic Polynucleotide
taatacgactcactatagggagtgcttcatataattttaatctggttaaaaacagaggagatttaacatgattaaaattaacctggcggcagcgcaaaagatg

SEQ ID NO: 297 - DNA, 103 bp, Artificial Sequence
  Synthetic Polynucleotide
taatacgactcactatagggcacgtagtgcttcatataattttaatctggaacagaggagaccagatatgaattatatgaacctggcggcagcgcaaaagatg

SEQ ID NO: 298 - DNA, 103 bp, Artificial Sequence
  Synthetic Polynucleotide
taatacgactcactatagggagcatcacgtagtgcttcatataattttaaaacagaggagattaaaaatgtatgaagcaaacctggcggcagcgcaaaagatg

SEQ ID NO: 299 - DNA, 103 bp, Artificial Sequence
  Synthetic Polynucleotide
taatacgactcactatagggcaatcagcatcacgtagtgcttcatataataacagaggagaattataatgagcactacgaacctggcggcagcgcaaaagatg

SEQ ID NO: 300 - DNA, 103 bp, Artificial Sequence
  Synthetic Polynucleotide
taatacgactcactataggggttcccaatcagcatcacgtagtgcttcataacagaggagaatgaagatgtacgtgatgaacctggcggcagcgcaaaagatg

SEQ ID NO: 301 - DNA, 103 bp, Artificial Sequence
  Synthetic Polynucleotide
taatacgactcactataggggagatgttcccaatcagcatcacgtagtgcaacagaggagagcactaatggatgctgataacctggcggcagcgcaaaagatg

SEQ ID NO: 302 - DNA, 103 bp, Artificial Sequence
  Synthetic Polynucleotide
taatacgactcactatagggatgcaggtttgtggcttgagtgtttcactaaacagaggagatagtgaatgactcaagccaacctggcggcagcgcaaaagatg

SEQ ID NO: 303 - DNA, 103 bp, Artificial Sequence
  Synthetic Polynucleotide
taatacgactcactataggggcagggagatgttcccaatcagcatcacgtaacagaggagaacgtgaatgtgattgggaaacctggcggcagcgcaaaagatg

SEQ ID NO: 304 - DNA, 103 bp, Artificial Sequence
  Synthetic Polynucleotide
taatacgactcactatagggcctctgcagggagatgttcccaatcagcataacagaggagaatgctgatggggaacatcaacctggcggcagcgcaaaagatg

SEQ ID NO: 305 - DNA, 103 bp, Artificial Sequence
  Synthetic Polynucleotide
taatacgactcactatagggcattccctctgcagggagatgttcccaatcaacagaggagagattggatgcatctccctaacctggcggcagcgcaaaagatg

SEQ ID NO: 306 - DNA, 103 bp, Artificial Sequence
  Synthetic Polynucleotide
taatacgactcactataggggagctcattccctctgcagggagatgttccaacagaggagaggaacaatgccctgcagaaacctggcggcagcgcaaaagatg

SEQ ID NO: 307 - DNA, 103 bp, Artificial Sequence
  Synthetic Polynucleotide
taatacgactcactataggggcactgagctcattccctctgcagggagataacagaggagaatctccatgcagagggaaaacctggcggcagcgcaaaagatg

SEQ ID NO: 308 - DNA, 103 bp, Artificial Sequence
  Synthetic Polynucleotide
taatacgactcactatagggctgaagcactgagctcattccctctgcaggaacagaggagacctgcaatgggaatgagcaacctggcggcagcgcaaaagatg

SEQ ID NO: 309 - DNA, 103 bp, Artificial Sequence
  Synthetic Polynucleotide
taatacgactcactatagggatttactgaagcactgagctcattccctctaacagaggagaagagggatggagctcagtaacctggcggcagcgcaaaagatg

SEQ ID NO: 310 - DNA, 103 bp, Artificial Sequence
  Synthetic Polynucleotide
taatacgactcactatagggcggggatttactgaagcactgagctcattcaacagaggagagaatgaatgcagtgcttcaacctggcggcagcgcaaaagatg

SEQ ID NO: 311 - DNA, 103 bp, Artificial Sequence
  Synthetic Polynucleotide
taatacgactcactatagggggcctcggggatttactgaagcactgagctaacagaggagaagctcaatgcttcagtaaaacctggcggcagcgcaaaagatg

SEQ ID NO: 312 - DNA, 103 bp, Artificial Sequence
  Synthetic Polynucleotide
taatacgactcactatagggggcgtggcctcggggatttactgaagcactaacagaggagaagtgctatggtaaatcccaacctggcggcagcgcaaaagatg

SEQ ID NO: 313 - DNA, 103 bp, Artificial Sequence
  Synthetic Polynucleotide
taatacgactcactatagggagttaatgcaggtttgtggcttgagtgtttaacagaggagaaaacacatgagccacaaaaacctggcggcagcgcaaaagatg

SEQ ID NO: 314 - DNA, 103 bp, Artificial Sequence
  Synthetic Polynucleotide
taatacgactcactatagggtactcggcgtggcctcggggatttactgaaaacagaggagattcagtatgtccccgaggaacctggcggcagcgcaaaagatg

SEQ ID NO: 315 - DNA, 103 bp, Artificial Sequence
  Synthetic Polynucleotide
taatacgactcactataggggatcctactcggcgtggcctcggggatttaaacagaggagataaatcatggaggccacgaacctggcggcagcgcaaaagatg

SEQ ID NO: 316 - DNA, 103 bp, Artificial Sequence
  Synthetic Polynucleotide
taatacgactcactatagggccctcgatcctactcggcgtggcctcggggaacagaggagaccccgaatgcacgccgagaacctggcggcagcgcaaaagatg

SEQ ID NO: 317 - DNA, 103 bp, Artificial Sequence
  Synthetic Polynucleotide
taatacgactcactatagggctgtaccctcgatcctactcggcgtggcctaacagaggagaaggccaatgcgagtaggaaacctggcggcagcgcaaaagatg

SEQ ID NO: 318 - DNA, 103 bp, Artificial Sequence
  Synthetic Polynucleotide
taatacgactcactatagggtatccctgtaccctcgatcctactcggcgtaacagaggagaacgccgatgaggatcgagaacctggcggcagcgcaaaagatg

SEQ ID NO: 319 - DNA, 103 bp, Artificial Sequence
  Synthetic Polynucleotide
taatacgactcactatagggtagtgtatccctgtaccctcgatcctactcaacagaggagagagtagatgcgagggtacaacctggcggcagcgcaaaagatg

SEQ ID NO: 320 - DNA, 103 bp, Artificial Sequence
  Synthetic Polynucleotide
taatacgactcactatagggacaattagtgtatccctgtaccctcgatccaacagaggagaggatcgatggtacagggaaacctggcggcagcgcaaaagatg

SEQ ID NO: 321 - DNA, 103 bp, Artificial Sequence
  Synthetic Polynucleotide
taatacgactcactatagggacaagacaattagtgtatccctgtaccctcaacagaggagagagggtatggggatacacaacctggcggcagcgcaaaagatg

SEQ ID NO: 322 - DNA, 103 bp, Artificial Sequence
  Synthetic Polynucleotide
taatacgactcactatagggaaaccacaagacaattagtgtatccctgtaaacagaggagatacaggatgacactaattaacctggcggcagcgcaaaagatg

SEQ ID NO: 323 - DNA, 103 bp, Artificial Sequence
  Synthetic Polynucleotide
taatacgactcactataggggattcaaaccacaagacaattagtgtatccaacagaggagaggatacatgaattgtcttaacctggcggcagcgcaaaagatg

SEQ ID NO: 324 - DNA, 103 bp, Artificial Sequence
  Synthetic Polynucleotide
taatacgactcactatagggtttccagttaatgcaggtttgtggcttgagaacagaggagactcaagatgcaaacctgcaacctggcggcagcgcaaaagatg

SEQ ID NO: 325 - DNA, 103 bp, Artificial Sequence
  Synthetic Polynucleotide
taatacgactcactatagggtgaatgattcaaaccacaagacaattagtgaacagaggagacactaaatgtcttgtggtaacctggcggcagcgcaaaagatg

SEQ ID NO: 326 - DNA, 103 bp, Artificial Sequence
  Synthetic Polynucleotide
taatacgactcactatagggtataatgaatgattcaaaccacaagacaataacagaggagaattgtcatgtggtttgaaaacctggcggcagcgcaaaagatg

SEQ ID NO: 327 - DNA, 103 bp, Artificial Sequence
  Synthetic Polynucleotide
taatacgactcactatagggtcacatataatgaatgattcaaaccacaagaacagaggagacttgtgatgtgaatcattaacctggcggcagcgcaaaagatg

SEQ ID NO: 328 - DNA, 103 bp, Artificial Sequence
  Synthetic Polynucleotide
taatacgactcactatagggaataatcacatataatgaatgattcaaaccaacagaggagaggtttgatgcattcattaaacctggcggcagcgcaaaagatg

SEQ ID NO: 329 - DNA, 103 bp, Artificial Sequence
  Synthetic Polynucleotide
taatacgactcactatagggcattgaataatcacatataatgaatgattcaacagaggagagaatcaatgattatatgtaacctggcggcagcgcaaaagatg

SEQ ID NO: 330 - DNA, 103 bp, Artificial Sequence
  Synthetic Polynucleotide
taatacgactcactatagggtaattcattgaataatcacatataatgaataacagaggagaattcatatgatgtgattaaacctggcggcagcgcaaaagatg

SEQ ID NO: 331 - DNA, 103 bp, Artificial Sequence
  Synthetic Polynucleotide
taatacgactcactatagggcacactaattcattgaataatcacatataaaacagaggagattatatatgattattcaaaacctggcggcagcgcaaaagatg

SEQ ID NO: 332 - DNA, 103 bp, Artificial Sequence
  Synthetic Polynucleotide
taatacgactcactatagggcaattcacactaattcattgaataatcacaaacagaggagatgtgatatgtcaatgaataacctggcggcagcgcaaaagatg

SEQ ID NO: 333 - DNA, 103 bp, Artificial Sequence
  Synthetic Polynucleotide
taatacgactcactatagggaaaatcaattcacactaattcattgaataaaacagaggagattattcatggaattagtgaacctggcggcagcgcaaaagatg

SEQ ID NO: 334 - DNA, 103 bp, Artificial Sequence
  Synthetic Polynucleotide
taatacgactcactatagggtcataagggtcataaacttgagaccctttgaacagaggagacaaaggatgtcaagtttaaacctggcggcagcgcaaaagatg

SEQ ID NO: 335 - DNA, 103 bp, Artificial Sequence
  Synthetic Polynucleotide
taatacgactcactatagggtcccatttccagttaatgcaggtttgtggcaacagaggagagccacaatgctgcattaaaacctggcggcagcgcaaaagatg

SEQ ID NO: 336 - DNA, 103 bp, Artificial Sequence
  Synthetic Polynucleotide
taatacgactcactatagggcaccatcccatttccagttaatgcaggtttaacagaggagaaaacctatgttaactggaaacctggcggcagcgcaaaagatg

SEQ ID NO: 337 - DNA, 103 bp, Artificial Sequence
  Synthetic Polynucleotide
taatacgactcactatagggaatcccaccatcccatttccagttaatgcaaacagaggagatgcattatgtggaaatggaacctggcggcagcgcaaaagatg

SEQ ID NO: 338 - DNA, 103 bp, Artificial Sequence
  Synthetic Polynucleotide
taatacgactcactatagggggagcaatcccaccatcccatttccagttaaacagaggagataactgatgatgggatggaacctggcggcagcgcaaaagatg

SEQ ID NO: 339 - DNA, 103 bp, Artificial Sequence
  Synthetic Polynucleotide
taatacgactcactatagggtatctggagcaatcccaccatcccatttccaacagaggagaggaaatatgatggtgggaaacctggcggcagcgcaaaagatg

SEQ ID NO: 340 - DNA, 103 bp, Artificial Sequence
  Synthetic Polynucleotide
taatacgactcactatagggatccgtatctggagcaatcccaccatcccaaacagaggagatgggatatggggattgctaacctggcggcagcgcaaaagatg

SEQ ID NO: 341 - DNA, 103 bp, Artificial Sequence
  Synthetic Polynucleotide
taatacgactcactataggggggacatccgtatctggagcaatcccaccaaacagaggagatggtggatgtgctccagaaacctggcggcagcgcaaaagatg

SEQ ID NO: 342 - DNA, 103 bp, Artificial Sequence
  Synthetic Polynucleotide
taatacgactcactatagggtaaatgggacatccgtatctggagcaatccaacagaggagaggattgatgcagatacggaacctggcggcagcgcaaaagatg

SEQ ID NO: 343 - DNA, 103 bp, Artificial Sequence
  Synthetic Polynucleotide
taatacgactcactatagggttccataaatgggacatccgtatctggagcaacagaggagagctccaatgacggatgtcaacctggcggcagcgcaaaagatg

SEQ ID NO: 344 - DNA, 103 bp, Artificial Sequence
  Synthetic Polynucleotide
taatacgactcactatagggaacctttccataaatgggacatccgtatctaacagaggagaagatacatgtgtcccattaacctggcggcagcgcaaaagatg

SEQ ID NO: 345 - DNA, 103 bp, Artificial Sequence
  Synthetic Polynucleotide
taatacgactcactatagggcccgatcataagggtcataaacttgagaccaacagaggagaggtctcatgtttatgaccaacctggcggcagcgcaaaagatg

SEQ ID NO: 346 - DNA, 103 bp, Artificial Sequence
  Synthetic Polynucleotide
taatacgactcactatagggcactcaacctttccataaatgggacatccgaacagaggagacggatgatgcatttatggaacctggcggcagcgcaaaagatg

SEQ ID NO: 347 - DNA, 103 bp, Artificial Sequence
  Synthetic Polynucleotide
taatacgactcactatagggccatgcactcaacctttccataaatgggacaacagaggagagtcccaatgatggaaaggaacctggcggcagcgcaaaagatg

SEQ ID NO: 348 - DNA, 103 bp, Artificial Sequence
  Synthetic Polynucleotide
taatacgactcactataggggtataccatgcactcaacctttccataaataacagaggagaatttatatgaaggttgagaacctggcggcagcgcaaaagatg

SEQ ID NO: 349 - DNA, 103 bp, Artificial Sequence
  Synthetic Polynucleotide
taatacgactcactatagggatcctgtataccatgcactcaacctttccaaacagaggagatggaaaatgtgagtgcataacctggcggcagcgcaaaagatg

SEQ ID NO: 350 - DNA, 103 bp, Artificial Sequence
  Synthetic Polynucleotide
taatacgactcactatagggtttaaatcctgtataccatgcactcaacctaacagaggagaaggttgatggcatggtataacctggcggcagcgcaaaagatg

SEQ ID NO: 351 - DNA, 103 bp, Artificial Sequence
  Synthetic Polynucleotide
taatacgactcactatagggtgttgtttaaatcctgtataccatgcactcaacagaggagagagtgcatggtatacaggaacctggcggcagcgcaaaagatg

SEQ ID NO: 352 - DNA, 103 bp, Artificial Sequence
  Synthetic Polynucleotide
taatacgactcactatagggtcacttgttgtttaaatcctgtataccatgaacagaggagacatggtatgcaggatttaaacctggcggcagcgcaaaagatg

SEQ ID NO: 353 - DNA, 103 bp, Artificial Sequence
  Synthetic Polynucleotide
taatacgactcactatagggctctctcacttgttgtttaaatcctgtataaacagaggagatatacaatgtttaaacaaaacctggcggcagcgcaaaagatg

SEQ ID NO: 354 - DNA, 103 bp, Artificial Sequence
  Synthetic Polynucleotide
taatacgactcactatagggtagtactctctcacttgttgtttaaatcctaacagaggagaaggattatgacaacaagtaacctggcggcagcgcaaaagatg

SEQ ID NO: 355 - DNA, 103 bp, Artificial Sequence
  Synthetic Polynucleotide
taatacgactcactatagggttgtgtagtactctctcacttgttgtttaaaacagaggagattaaacatgaagtgagagaacctggcggcagcgcaaaagatg

SEQ ID NO: 356 - DNA, 103 bp, Artificial Sequence
  Synthetic Polynucleotide
taatacgactcactatagggtaaaacccgatcataagggtcataaacttgaacagaggagacaagttatggacccttataacctggcggcagcgcaaaagatg

SEQ ID NO: 357 - DNA, 103 bp, Artificial Sequence
  Synthetic Polynucleotide
taatacgactcactatagggactatttgtgtagtactctctcacttgttgaacagaggagacaacaaatgagagagtacaacctggcggcagcgcaaaagatg

SEQ ID NO: 358 - DNA, 103 bp, Artificial Sequence
  Synthetic Polynucleotide
taatacgactcactatagggacagcactatttgtgtagtactctctcactaacagaggagaagtgagatggtactacacaacctggcggcagcgcaaaagatg

SEQ ID NO: 359 - DNA, 103 bp, Artificial Sequence
  Synthetic Polynucleotide
taatacgactcactatagggcaaaaacagcactatttgtgtagtactctcaacagaggagagagagtatgacacaaataaacctggcggcagcgcaaaagatg

SEQ ID NO: 360 - DNA, 103 bp, Artificial Sequence
  Synthetic Polynucleotide
taatacgactcactatagggccactcaaaaacagcactatttgtgtagtaaacagaggagatactacatgaatagtgctaacctggcggcagcgcaaaagatg

SEQ ID NO: 361 - DNA, 103 bp, Artificial Sequence
  Synthetic Polynucleotide
taatacgactcactatagggagcatccactcaaaaacagcactatttgtgaacagaggagacacaaaatgtgctgttttaacctggcggcagcgcaaaagatg

SEQ ID NO: 362 - DNA, 103 bp, Artificial Sequence
  Synthetic Polynucleotide
taatacgactcactatagggtgaacagcatccactcaaaaacagcactataacagaggagaatagtgatgtttttgagtaacctggcggcagcgcaaaagatg

SEQ ID NO: 363 - DNA, 103 bp, Artificial Sequence
  Synthetic Polynucleotide
taatacgactcactatagggggtcatgaacagcatccactcaaaaacagcaacagaggagagctgttatggagtggatgaacctggcggcagcgcaaaagatg

SEQ ID NO: 364 - DNA, 103 bp, Artificial Sequence
  Synthetic Polynucleotide
taatacgactcactatagggtaaccggtcatgaacagcatccactcaaaaaacagaggagattttgaatggatgctgttaacctggcggcagcgcaaaagatg

SEQ ID NO: 365 - DNA, 103 bp, Artificial Sequence
  Synthetic Polynucleotide
taatacgactcactatagggaaagataaccggtcatgaacagcatccactaacagaggagaagtggaatgtgttcatgaaacctggcggcagcgcaaaagatg

SEQ ID NO: 366 - DNA, 103 bp, Artificial Sequence
  Synthetic Polynucleotide
taatacgactcactatagggcgtacaaagataaccggtcatgaacagcataacagaggagaatgctgatgatgaccggtaacctggcggcagcgcaaaagatg

SEQ ID NO: 367 - DNA, 103 bp, Artificial Sequence
  Synthetic Polynucleotide
taatacgactcactatagggtgttgtaaaacccgatcataagggtcataaaacagaggagattatgaatgttatgatcgaacctggcggcagcgcaaaagatg

SEQ ID NO: 368 - DNA, 103 bp, Artificial Sequence
  Synthetic Polynucleotide
taatacgactcactataggggtccacgtacaaagataaccggtcatgaacaacagaggagagttcatatgcggttatctaacctggcggcagcgcaaaagatg

SEQ ID NO: 369 - DNA, 103 bp, Artificial Sequence
  Synthetic Polynucleotide
taatacgactcactatagggcagctgtccacgtacaaagataaccggtcaaacagaggagatgaccgatgatctttgtaaacctggcggcagcgcaaaagatg

SEQ ID NO: 370 - DNA, 103 bp, Artificial Sequence
  Synthetic Polynucleotide
taatacgactcactatagggtgcaacagctgtccacgtacaaagataaccaacagaggagaggttatatgtgtacgtggaacctggcggcagcgcaaaagatg

SEQ ID NO: 371 - DNA, 103 bp, Artificial Sequence
  Synthetic Polynucleotide
taatacgactcactatagggagtgttgcaacagctgtccacgtacaaagaaacagaggagatctttgatggtggacagcaacctggcggcagcgcaaaagatg

SEQ ID NO: 372 - DNA, 103 bp, Artificial Sequence
  Synthetic Polynucleotide
taatacgactcactatagggcaataagtgttgcaacagctgtccacgtacaacagaggagagtacgtatgcagctgttgaacctggcggcagcgcaaaagatg

SEQ ID NO: 373 - DNA, 103 bp, Artificial Sequence
  Synthetic Polynucleotide
taatacgactcactatagggtgctccaataagtgttgcaacagctgtccaaacagaggagatggacaatggttgcaacaaacctggcggcagcgcaaaagatg

SEQ ID NO: 374 - DNA, 103 bp, Artificial Sequence
  Synthetic Polynucleotide
taatacgactcactatagggtaatatgctccaataagtgttgcaacagctaacagaggagaagctgtatgaacacttataacctggcggcagcgcaaaagatg

SEQ ID NO: 375 - DNA, 103 bp, Artificial Sequence
  Synthetic Polynucleotide
taatacgactcactatagggacatgtaatatgctccaataagtgttgcaaaacagaggagattgcaaatgttattggagaacctggcggcagcgcaaaagatg

SEQ ID NO: 376 - DNA, 103 bp, Artificial Sequence
  Synthetic Polynucleotide
taatacgactcactatagggcctaaacatgtaatatgctccaataagtgtaacagaggagaacacttatgggagcatataacctggcggcagcgcaaaagatg

SEQ ID NO: 377 - DNA, 103 bp, Artificial Sequence
  Synthetic Polynucleotide
taatacgactcactatagggtctgccctaaacatgtaatatgctccaataaacagaggagatattggatgatattacataacctggcggcagcgcaaaagatg

SEQ ID NO: 378 - DNA, 103 bp, Artificial Sequence
  Synthetic Polynucleotide
taatacgactcactatagggtcccatgttgtaaaacccgatcataagggtaacagaggagaacccttatgatcgggtttaacctggcggcagcgcaaaagatg

SEQ ID NO: 379 - DNA, 103 bp, Artificial Sequence
  Synthetic Polynucleotide
taatacgactcactataggggattatctgccctaaacatgtaatatgctcaacagaggagagagcatatgacatgtttaaacctggcggcagcgcaaaagatg

SEQ ID NO: 380 - DNA, 103 bp, Artificial Sequence
  Synthetic Polynucleotide
taatacgactcactatagggcagtggattatctgccctaaacatgtaataaacagaggagatattacatgtttagggcaaacctggcggcagcgcaaaagatg

SEQ ID NO: 381 - DNA, 103 bp, Artificial Sequence
  Synthetic Polynucleotide
taatacgactcactatagggatgtacagtggattatctgccctaaacatgaacagaggagacatgttatgggcagataaaacctggcggcagcgcaaaagatg

SEQ ID NO: 382 - DNA, 103 bp, Artificial Sequence
  Synthetic Polynucleotide
taatacgactcactatagggatagcatgtacagtggattatctgccctaaaacagaggagattagggatgataatccacaacctggcggcagcgcaaaagatg

SEQ ID NO: 383 - DNA, 103 bp, Artificial Sequence
  Synthetic Polynucleotide
taatacgactcactatagggagttaatagcatgtacagtggattatctgcaacagaggagagcagatatgccactgtacaacctggcggcagcgcaaaagatg

SEQ ID NO: 384 - DNA, 103 bp, Artificial Sequence
  Synthetic Polynucleotide
taatacgactcactataggggctatagttaatagcatgtacagtggattaaacagaggagataatccatggtacatgctaacctggcggcagcgcaaaagatg

SEQ ID NO: 385 - DNA, 103 bp, Artificial Sequence
  Synthetic Polynucleotide
taatacgactcactatagggctaaagctatagttaatagcatgtacagtgaacagaggagacactgtatgtgctattaaaacctggcggcagcgcaaaagatg

SEQ ID NO: 386 - DNA, 103 bp, Artificial Sequence
  Synthetic Polynucleotide
taatacgactcactatagggtgtagctaaagctatagttaatagcatgtaaacagaggagatacatgatgttaactataaacctggcggcagcgcaaaagatg

SEQ ID NO: 387 - DNA, 103 bp, Artificial Sequence
  Synthetic Polynucleotide
taatacgactcactataggggagactgtagctaaagctatagttaatagcaacagaggagagctattatgtatagctttaacctggcggcagcgcaaaagatg

SEQ ID NO: 388 - DNA, 103 bp, Artificial Sequence
  Synthetic Polynucleotide
taatacgactcactatagggttttagagactgtagctaaagctatagttaaacagaggagataactaatgctttagctaaacctggcggcagcgcaaaagatg

SEQ ID NO: 389 - DNA, 103 bp, Artificial Sequence
  Synthetic Polynucleotide
taatacgactcactatagggtctgctcccatgttgtaaaacccgatcataaacagaggagatatgatatggttttacaaaacctggcggcagcgcaaaagatg

SEQ ID NO: 390 - DNA, 103 bp, Artificial Sequence
  Synthetic Polynucleotide
taatacgactcactatagggctgtattttagagactgtagctaaagctataacagaggagaatagctatggctacagtcaacctggcggcagcgcaaaagatg

SEQ ID NO: 391 - DNA, 103 bp, Artificial Sequence
  Synthetic Polynucleotide
taatacgactcactatagggaatagctgtattttagagactgtagctaaaaacagaggagatttagcatgagtctctaaaacctggcggcagcgcaaaagatg

SEQ ID NO: 392 - DNA, 103 bp, Artificial Sequence
  Synthetic Polynucleotide
taatacgactcactatagggtagccaatagctgtattttagagactgtagaacagaggagactacagatgctaaaatacaacctggcggcagcgcaaaagatg

SEQ ID NO: 393 - DNA, 103 bp, Artificial Sequence
  Synthetic Polynucleotide
taatacgactcactatagggtgctatagccaatagctgtattttagagacaacagaggagagtctctatgatacagctaaacctggcggcagcgcaaaagatg

SEQ ID NO: 394 - DNA, 103 bp, Artificial Sequence
  Synthetic Polynucleotide
taatacgactcactatagggactgctgctatagccaatagctgtattttaaacagaggagataaaatatggctattggcaacctggcggcagcgcaaaagatg

SEQ ID NO: 395 - DNA, 103 bp, Artificial Sequence
  Synthetic Polynucleotide
taatacgactcactatagggttgggactgctgctatagccaatagctgtaaacagaggagatacagcatgtggctatagaacctggcggcagcgcaaaagatg

SEQ ID NO: 396 - DNA, 103 bp, Artificial Sequence
  Synthetic Polynucleotide
taatacgactcactatagggcatgcttgggactgctgctatagccaatagaacagaggagactattgatgatagcagcaaacctggcggcagcgcaaaagatg

SEQ ID NO: 397 - DNA, 103 bp, Artificial Sequence
  Synthetic Polynucleotide
taatacgactcactatagggatttccatgcttgggactgctgctatagccaacagaggagaggctatatgagcagtcccaacctggcggcagcgcaaaagatg

SEQ ID NO: 398 - DNA, 103 bp, Artificial Sequence
  Synthetic Polynucleotide
taatacgactcactatagggaagtgatttccatgcttgggactgctgctaaacagaggagatagcagatgtcccaagcaaacctggcggcagcgcaaaagatg

SEQ ID NO: 399 - DNA, 103 bp, Artificial Sequence
  Synthetic Polynucleotide
taatacgactcactatagggtgttgaagtgatttccatgcttgggactgcaacagaggagagcagtcatgagcatggaaaacctggcggcagcgcaaaagatg

SEQ ID NO: 400 - DNA, 103 bp, Artificial Sequence
  Synthetic Polynucleotide
taatacgactcactataggggcacttctgctcccatgttgtaaaacccgaaacagaggagatcgggtatgacaacatggaacctggcggcagcgcaaaagatg

SEQ ID NO: 401 - DNA, 103 bp, Artificial Sequence
  Synthetic Polynucleotide
taatacgactcactataggggaaaatgttgaagtgatttccatgcttgggaacagaggagacccaagatgggaaatcacaacctggcggcagcgcaaaagatg

SEQ ID NO: 402 - DNA, 103 bp, Artificial Sequence
  Synthetic Polynucleotide
taatacgactcactatagggacagagaaaatgttgaagtgatttccatgcaacagaggagagcatggatgtcacttcaaaacctggcggcagcgcaaaagatg

SEQ ID NO: 403 - DNA, 103 bp, Artificial Sequence
  Synthetic Polynucleotide
taatacgactcactatagggggaccacagagaaaatgttgaagtgatttcaacagaggagagaaatcatgtcaacatttaacctggcggcagcgcaaaagatg

SEQ ID NO: 404 - DNA, 103 bp, Artificial Sequence
  Synthetic Polynucleotide
taatacgactcactatagggatacaggaccacagagaaaatgttgaagtgaacagaggagacacttcatgattttctctaacctggcggcagcgcaaaagatg

SEQ ID NO: 405 - DNA, 103 bp, Artificial Sequence
  Synthetic Polynucleotide
taatacgactcactatagggcaaccatacaggaccacagagaaaatgttgaacagaggagacaacatatgctctgtggtaacctggcggcagcgcaaaagatg

SEQ ID NO: 406 - DNA, 103 bp, Artificial Sequence
  Synthetic Polynucleotide
taatacgactcactatagggatagacaaccatacaggaccacagagaaaaaacagaggagattttctatgtggtcctgtaacctggcggcagcgcaaaagatg

SEQ ID NO: 407 - DNA, 103 bp, Artificial Sequence
  Synthetic Polynucleotide
taatacgactcactatagggaaataatagacaaccatacaggaccacagaaacagaggagatctgtgatgctgtatggtaacctggcggcagcgcaaaagatg

SEQ ID NO: 408 - DNA, 103 bp, Artificial Sequence
  Synthetic Polynucleotide
taatacgactcactataggggattgaaataatagacaaccatacaggaccaacagaggagaggtcctatgtggttgtctaacctggcggcagcgcaaaagatg

SEQ ID NO: 409 - DNA, 103 bp, Artificial Sequence
  Synthetic Polynucleotide
taatacgactcactatagggcacctgattgaaataatagacaaccatacaaacagaggagatgtatgatggtctattataacctggcggcagcgcaaaagatg

SEQ ID NO: 410 - DNA, 103 bp, Artificial Sequence
  Synthetic Polynucleotide
taatacgactcactataggggctgccacctgattgaaataatagacaaccaacagaggagaggttgtatgttatttcaaaacctggcggcagcgcaaaagatg

SEQ ID NO: 411 - DNA, 103 bp, Artificial Sequence
  Synthetic Polynucleotide
taatacgactcactatagggccccccagatgccaaaaggcaccaaccctcaacagaggagagagggtatgtgccttttgaacctggcggcagcgcaaaagatg

SEQ ID NO: 412 - DNA, 103 bp, Artificial Sequence
  Synthetic Polynucleotide
taatacgactcactatagggttcttgcacttctgctcccatgttgtaaaaaacagaggagattttacatgatgggagcaaacctggcggcagcgcaaaagatg

SEQ ID NO: 413 - DNA, 103 bp, Artificial Sequence
  Synthetic Polynucleotide
taatacgactcactatagggacatagctgccacctgattgaaataatagaaacagaggagatctattatgtcaatcaggaacctggcggcagcgcaaaagatg

SEQ ID NO: 414 - DNA, 103 bp, Artificial Sequence
  Synthetic Polynucleotide
taatacgactcactatagggtgcgcacatagctgccacctgattgaaataaacagaggagatatttcatgcaggtggcaaacctggcggcagcgcaaaagatg

SEQ ID NO: 415 - DNA, 103 bp, Artificial Sequence
  Synthetic Polynucleotide
taatacgactcactatagggagtgatgcgcacatagctgccacctgattgaacagaggagacaatcaatgggcagctataacctggcggcagcgcaaaagatg

SEQ ID NO: 416 - DNA, 103 bp, Artificial Sequence
  Synthetic Polynucleotide
taatacgactcactatagggttattagtgatgcgcacatagctgccacctaacagaggagaaggtggatgctatgtgcgaacctggcggcagcgcaaaagatg

SEQ ID NO: 417 - DNA, 103 bp, Artificial Sequence
  Synthetic Polynucleotide
taatacgactcactatagggcgttattattagtgatgcgcacatagctgcaacagaggagagcagctatgtgcgcatcaaacctggcggcagcgcaaaagatg

SEQ ID NO: 418 - DNA, 103 bp, Artificial Sequence
  Synthetic Polynucleotide
taatacgactcactatagggactgccgttattattagtgatgcgcacataaacagaggagatatgtgatgatcactaataacctggcggcagcgcaaaagatg

SEQ ID NO: 419 - DNA, 103 bp, Artificial Sequence
  Synthetic Polynucleotide
taatacgactcactatagggaacaaactgccgttattattagtgatgcgcaacagaggagagcgcatatgtaataataaaacctggcggcagcgcaaaagatg

SEQ ID NO: 420 - DNA, 103 bp, Artificial Sequence
  Synthetic Polynucleotide
taatacgactcactatagggaactaaacaaactgccgttattattagtgaaacagaggagatcactaatgataacggcaaacctggcggcagcgcaaaagatg

SEQ ID NO: 421 - DNA, 103 bp, Artificial Sequence
  Synthetic Polynucleotide
taatacgactcactatagggcacacaactaaacaaactgccgttattattaacagaggagaaataatatgggcagtttgaacctggcggcagcgcaaaagatg

SEQ ID NO: 422 - DNA, 103 bp, Artificial Sequence
  Synthetic Polynucleotide
taatacgactcactatagggacatgcacacaactaaacaaactgccgttaaacagaggagataacggatgtttgtttagaacctggcggcagcgcaaaagatg

SEQ ID NO: 423 - DNA, 103 bp, Artificial Sequence
  Synthetic Polynucleotide
taatacgactcactatagggcttaattcttgcacttctgctcccatgttgaacagaggagacaacatatgagcagaagtaacctggcggcagcgcaaaagatg

SEQ ID NO: 424 - DNA, 103 bp, Artificial Sequence
  Synthetic Polynucleotide
taatacgactcactatagggcataaacatgcacacaactaaacaaactgcaacagaggagagcagttatgttagttgtgaacctggcggcagcgcaaaagatg

SEQ ID NO: 425 - DNA, 103 bp, Artificial Sequence
  Synthetic Polynucleotide
taatacgactcactatagggtctgacataaacatgcacacaactaaacaaaacagaggagattgtttatgtgtgtgcataacctggcggcagcgcaaaagatg

SEQ ID NO: 426 - DNA, 103 bp, Artificial Sequence
  Synthetic Polynucleotide
taatacgactcactatagggcaacatctgacataaacatgcacacaactaaacagaggagatagttgatggcatgtttaaacctggcggcagcgcaaaagatg

SEQ ID NO: 427 - DNA, 103 bp, Artificial Sequence
  Synthetic Polynucleotide
taatacgactcactatagggatattcaacatctgacataaacatgcacacaacagaggagagtgtgcatgtttatgtcaaacctggcggcagcgcaaaagatg

SEQ ID NO: 428 - DNA, 103 bp, Artificial Sequence
  Synthetic Polynucleotide
taatacgactcactatagggtgaatatattcaacatctgacataaacatgaacagaggagacatgttatggtcagatgtaacctggcggcagcgcaaaagatg

SEQ ID NO: 429 - DNA, 103 bp, Artificial Sequence
  Synthetic Polynucleotide
taatacgactcactatagggttagctgaatatattcaacatctgacataaaacagaggagattatgtatgatgttgaataacctggcggcagcgcaaaagatg

SEQ ID NO: 430 - DNA, 103 bp, Artificial Sequence
  Synthetic Polynucleotide
taatacgactcactatagggccttattagctgaatatattcaacatctgaaacagaggagatcagatatggaatatattaacctggcggcagcgcaaaagatg

SEQ ID NO: 431 - DNA, 103 bp, Artificial Sequence
  Synthetic Polynucleotide
taatacgactcactatagggtggccccttattagctgaatatattcaacaaacagaggagatgttgaatgtattcagctaacctggcggcagcgcaaaagatg

SEQ ID NO: 432 - DNA, 103 bp, Artificial Sequence
  Synthetic Polynucleotide
taatacgactcactatagggctccatggccccttattagctgaatatattaacagaggagaaatataatgagctaataaaacctggcggcagcgcaaaagatg

SEQ ID NO: 433 - DNA, 103 bp, Artificial Sequence
  Synthetic Polynucleotide
taatacgactcactatagggcacaactccatggccccttattagctgaataacagaggagaattcagatgataaggggcaacctggcggcagcgcaaaagatg

SEQ ID NO: 434 - DNA, 103 bp, Artificial Sequence
  Synthetic Polynucleotide
taatacgactcactatagggatccccttaattcttgcacttctgctcccaaacagaggagatgggagatgaagtgcaagaacctggcggcagcgcaaaagatg

SEQ ID NO: 435 - DNA, 103 bp, Artificial Sequence
  Synthetic Polynucleotide
taatacgactcactatagggaaaatcacaactccatggccccttattagcaacagaggagagctaatatggggccatggaacctggcggcagcgcaaaagatg

SEQ ID NO: 436 - DNA, 103 bp, Artificial Sequence
  Synthetic Polynucleotide
taatacgactcactatagggttgtcaaaatcacaactccatggccccttaaacagaggagataagggatgatggagttgaacctggcggcagcgcaaaagatg

SEQ ID NO: 437 - DNA, 103 bp, Artificial Sequence
  Synthetic Polynucleotide
taatacgactcactatagggaaagattgtcaaaatcacaactccatggccaacagaggagaggccatatggttgtgattaacctggcggcagcgcaaaagatg

SEQ ID NO: 438 - DNA, 103 bp, Artificial Sequence
  Synthetic Polynucleotide
taatacgactcactataggggatgcaaagattgtcaaaatcacaactccaaacagaggagatggagtatggattttgacaacctggcggcagcgcaaaagatg

SEQ ID NO: 439 - DNA, 103 bp, Artificial Sequence
  Synthetic Polynucleotide
taatacgactcactatagggaatgagatgcaaagattgtcaaaatcacaaaacagaggagattgtgaatgtgacaatctaacctggcggcagcgcaaaagatg

SEQ ID NO: 440 - DNA, 103 bp, Artificial Sequence
  Synthetic Polynucleotide
taatacgactcactataggggaacaaatgagatgcaaagattgtcaaaataacagaggagaattttgatgatctttgcaaacctggcggcagcgcaaaagatg

SEQ ID NO: 441 - DNA, 103 bp, Artificial Sequence
  Synthetic Polynucleotide
taatacgactcactatagggatatggaacaaatgagatgcaaagattgtcaacagaggagagacaatatgtgcatctcaaacctggcggcagcgcaaaagatg

SEQ ID NO: 442 - DNA, 103 bp, Artificial Sequence
  Synthetic Polynucleotide
taatacgactcactataggggtaaaatatggaacaaatgagatgcaaagaaacagaggagatctttgatgctcatttgtaacctggcggcagcgcaaaagatg

SEQ ID NO: 443 - DNA, 103 bp, Artificial Sequence
  Synthetic Polynucleotide
taatacgactcactatagggtacttgtaaaatatggaacaaatgagatgcaacagaggagagcatctatgttgttccataacctggcggcagcgcaaaagatg

SEQ ID NO: 444 - DNA, 103 bp, Artificial Sequence
  Synthetic Polynucleotide
taatacgactcactatagggctaggtacttgtaaaatatggaacaaatgaaacagaggagatcatttatgccatattttaacctggcggcagcgcaaaagatg

SEQ ID NO: 445 - DNA, 103 bp, Artificial Sequence
  Synthetic Polynucleotide
taatacgactcactatagggattgcatccccttaattcttgcacttctgcaacagaggagagcagaaatgcaagaattaaacctggcggcagcgcaaaagatg

SEQ ID NO: 446 - DNA, 103 bp, Artificial Sequence
  Synthetic Polynucleotide
taatacgactcactatagggcccagctaggtacttgtaaaatatggaacaaacagaggagatgttccatgttttacaagaacctggcggcagcgcaaaagatg

SEQ ID NO: 447 - DNA, 103 bp, Artificial Sequence
  Synthetic Polynucleotide
taatacgactcactatagggggtcacccagctaggtacttgtaaaatatgaacagaggagacatattatgcaagtacctaacctggcggcagcgcaaaagatg

SEQ ID NO: 448 - DNA, 103 bp, Artificial Sequence
  Synthetic Polynucleotide
taatacgactcactatagggacaatggtcacccagctaggtacttgtaaaaacagaggagatttacaatgacctagctgaacctggcggcagcgcaaaagatg

SEQ ID NO: 449 - DNA, 103 bp, Artificial Sequence
  Synthetic Polynucleotide
taatacgactcactatagggtaattacaatggtcacccagctaggtacttaacagaggagaaagtacatggctgggtgaaacctggcggcagcgcaaaagatg

SEQ ID NO: 450 - DNA, 103 bp, Artificial Sequence
  Synthetic Polynucleotide
taatacgactcactatagggcaccataattacaatggtcacccagctaggaacagaggagacctagcatggtgaccattaacctggcggcagcgcaaaagatg

SEQ ID NO: 451 - DNA, 103 bp, Artificial Sequence
  Synthetic Polynucleotide
taatacgactcactatagggtaagacaccataattacaatggtcacccagaacagaggagactgggtatgcattgtaataacctggcggcagcgcaaaagatg

SEQ ID NO: 452 - DNA, 103 bp, Artificial Sequence
  Synthetic Polynucleotide
taatacgactcactatagggctctataagacaccataattacaatggtcaaacagaggagatgaccaatgtaattatggaacctggcggcagcgcaaaagatg

SEQ ID NO: 453 - DNA, 103 bp, Artificial Sequence
  Synthetic Polynucleotide
taatacgactcactatagggggcgactctataagacaccataattacaataacagaggagaattgtaatgatggtgtctaacctggcggcagcgcaaaagatg

SEQ ID NO: 454 - DNA, 103 bp, Artificial Sequence
  Synthetic Polynucleotide
taatacgactcactatagggaatttggcgactctataagacaccataattaacagaggagaaattatatggtcttatagaacctggcggcagcgcaaaagatg

SEQ ID NO: 455 - DNA, 103 bp, Artificial Sequence
  Synthetic Polynucleotide
taatacgactcactatagggttgttaatttggcgactctataagacaccaaacagaggagatggtgtatgatagagtcgaacctggcggcagcgcaaaagatg

SEQ ID NO: 456 - DNA, 103 bp, Artificial Sequence
  Synthetic Polynucleotide
taatacgactcactataggggtccaattgcatccccttaattcttgcactaacagaggagaagtgcaatgattaaggggaacctggcggcagcgcaaaagatg

SEQ ID NO: 457 - DNA, 103 bp, Artificial Sequence
  Synthetic Polynucleotide
taatacgactcactatagggaaagcttgttaatttggcgactctataagaaacagaggagatcttatatggtcgccaaaaacctggcggcagcgcaaaagatg

SEQ ID NO: 458 - DNA, 103 bp, Artificial Sequence
  Synthetic Polynucleotide
taatacgactcactatagggaatataaagcttgttaatttggcgactctaaacagaggagatagagtatgcaaattaacaacctggcggcagcgcaaaagatg

SEQ ID NO: 459 - DNA, 103 bp, Artificial Sequence
  Synthetic Polynucleotide
taatacgactcactatagggcgccaaatataaagcttgttaatttggcgaaacagaggagatcgccaatgtaacaagctaacctggcggcagcgcaaaagatg

SEQ ID NO: 460 - DNA, 103 bp, Artificial Sequence
  Synthetic Polynucleotide
taatacgactcactatagggtttctcgccaaatataaagcttgttaatttaacagaggagaaaattaatgagctttataaacctggcggcagcgcaaaagatg

SEQ ID NO: 461 - DNA, 103 bp, Artificial Sequence
  Synthetic Polynucleotide
taatacgactcactatagggtctattttctcgccaaatataaagcttgttaacagaggagaaacaagatgtatatttggaacctggcggcagcgcaaaagatg

SEQ ID NO: 462 - DNA, 103 bp, Artificial Sequence
  Synthetic Polynucleotide
taatacgactcactatagggtagcttctattttctcgccaaatataaagcaacagaggagagctttaatgttggcgagaaacctggcggcagcgcaaaagatg

SEQ ID NO: 463 - DNA, 103 bp, Artificial Sequence
  Synthetic Polynucleotide
taatacgactcactatagggtcctctagcttctattttctcgccaaatataacagaggagaatatttatggagaaaataaacctggcggcagcgcaaaagatg

SEQ ID NO: 464 - DNA, 103 bp, Artificial Sequence
  Synthetic Polynucleotide
taatacgactcactatagggtcaagtcctctagcttctattttctcgccaaacagaggagatggcgaatgaatagaagcaacctggcggcagcgcaaaagatg

SEQ ID NO: 465 - DNA, 103 bp, Artificial Sequence
  Synthetic Polynucleotide
taatacgactcactatagggtaccatcaagtcctctagcttctattttctaacagaggagaagaaaaatgaagctagagaacctggcggcagcgcaaaagatg

SEQ ID NO: 466 - DNA, 103 bp, Artificial Sequence
  Synthetic Polynucleotide
taatacgactcactatagggaatcttaccatcaagtcctctagcttctataacagaggagaatagaaatgagaggacttaacctggcggcagcgcaaaagatg

SEQ ID NO: 467 - DNA, 103 bp, Artificial Sequence
  Synthetic Polynucleotide
taatacgactcactatagggaccttgtccaattgcatccccttaattcttaacagaggagaaagaatatgggggatgcaaacctggcggcagcgcaaaagatg

SEQ ID NO: 468 - DNA, 103 bp, Artificial Sequence
  Synthetic Polynucleotide
taatacgactcactataggggcaacaatcttaccatcaagtcctctagctaacagaggagaagctagatgacttgatggaacctggcggcagcgcaaaagatg

SEQ ID NO: 469 - DNA, 103 bp, Artificial Sequence
  Synthetic Polynucleotide
taatacgactcactatagggtcgttgcaacaatcttaccatcaagtcctcaacagaggagagaggacatgatggtaagaaacctggcggcagcgcaaaagatg

SEQ ID NO: 470 - DNA, 103 bp, Artificial Sequence
  Synthetic Polynucleotide
taatacgactcactatagggaggtatcgttgcaacaatcttaccatcaagaacagaggagacttgatatgaagattgttaacctggcggcagcgcaaaagatg

SEQ ID NO: 471 - DNA, 103 bp, Artificial Sequence
  Synthetic Polynucleotide
taatacgactcactatagggtgactaggtatcgttgcaacaatcttaccaaacagaggagatggtaaatgtgttgcaacaacctggcggcagcgcaaaagatg

SEQ ID NO: 472 - DNA, 103 bp, Artificial Sequence
  Synthetic Polynucleotide
taatacgactcactatagggatgtctgactaggtatcgttgcaacaatctaacagaggagaagattgatgcaacgatacaacctggcggcagcgcaaaagatg

SEQ ID NO: 473 - DNA, 103 bp, Artificial Sequence
  Synthetic Polynucleotide
taatacgactcactatagggccaggatgtctgactaggtatcgttgcaacaacagaggagagttgcaatgatacctagtaacctggcggcagcgcaaaagatg

SEQ ID NO: 474 - DNA, 103 bp, Artificial Sequence
  Synthetic Polynucleotide
taatacgactcactatagggtttaaccaggatgtctgactaggtatcgttaacagaggagaaacgatatgtagtcagacaacctggcggcagcgcaaaagatg

SEQ ID NO: 475 - DNA, 103 bp, Artificial Sequence
  Synthetic Polynucleotide
taatacgactcactatagggccttgtttaaccaggatgtctgactaggtaaacagaggagatacctaatgagacatcctaacctggcggcagcgcaaaagatg

SEQ ID NO: 476 - DNA, 103 bp, Artificial Sequence
  Synthetic Polynucleotide
taatacgactcactatagggtgacaccttgtttaaccaggatgtctgactaacagaggagaagtcagatgtcctggttaaacctggcggcagcgcaaaagatg

SEQ ID NO: 477 - DNA, 103 bp, Artificial Sequence
  Synthetic Polynucleotide
taatacgactcactatagggaaccttgacaccttgtttaaccaggatgtcaacagaggagagacatcatggttaaacaaaacctggcggcagcgcaaaagatg

SEQ ID NO: 478 - DNA, 103 bp, Artificial Sequence
  Synthetic Polynucleotide
taatacgactcactatagggttgaaaccttgtccaattgcatccccttaaaacagaggagattaaggatgtgcaattggaacctggcggcagcgcaaaagatg

SEQ ID NO: 479 - DNA, 103 bp, Artificial Sequence
  Synthetic Polynucleotide
taatacgactcactataggggaacaaaccttgacaccttgtttaaccaggaacagaggagacctggtatgacaaggtgtaacctggcggcagcgcaaaagatg

SEQ ID NO: 480 - DNA, 103 bp, Artificial Sequence
  Synthetic Polynucleotide
taatacgactcactataggggccttgaacaaaccttgacaccttgtttaaaacagaggagattaaacatggtgtcaaggaacctggcggcagcgcaaaagatg

SEQ ID NO: 481 - DNA, 103 bp, Artificial Sequence
  Synthetic Polynucleotide
taatacgactcactatagggaatttgccttgaacaaaccttgacaccttgaacagaggagacaaggtatgaaggtttgtaacctggcggcagcgcaaaagatg

SEQ ID NO: 482 - DNA, 103 bp, Artificial Sequence
  Synthetic Polynucleotide
taatacgactcactataggggcctgaatttgccttgaacaaaccttgacaaacagaggagatgtcaaatgttgttcaagaacctggcggcagcgcaaaagatg

SEQ ID NO: 483 - DNA, 103 bp, Artificial Sequence
  Synthetic Polynucleotide
taatacgactcactatagggcccctgcctgaatttgccttgaacaaacctaacagaggagaaggtttatgcaaggcaaaaacctggcggcagcgcaaaagatg

SEQ ID NO: 484 - DNA, 103 bp, Artificial Sequence
  Synthetic Polynucleotide
taatacgactcactatagggctgaccccctgcctgaatttgccttgaacaaacagaggagatgttcaatgcaaattcagaacctggcggcagcgcaaaagatg

SEQ ID NO: 485 - DNA, 103 bp, Artificial Sequence
  Synthetic Polynucleotide
taatacgactcactatagggctgttctgaccccctgcctgaatttgccttaacagaggagaaaggcaatgtcaggcaggaacctggcggcagcgcaaaagatg

SEQ ID NO: 486 - DNA, 103 bp, Artificial Sequence
  Synthetic Polynucleotide
taatacgactcactatagggtattcctgttctgaccccctgcctgaatttaacagaggagaaaattcatgcagggggtcaacctggcggcagcgcaaaagatg

SEQ ID NO: 487 - DNA, 103 bp, Artificial Sequence
  Synthetic Polynucleotide
taatacgactcactataggggatgatattcctgttctgaccccctgcctgaacagaggagacaggcaatgggtcagaacaacctggcggcagcgcaaaagatg

SEQ ID NO: 488 - DNA, 103 bp, Artificial Sequence
  Synthetic Polynucleotide
taatacgactcactatagggccgttgatgatattcctgttctgaccccctaacagaggagaagggggatggaacaggaaaacctggcggcagcgcaaaagatg

SEQ ID NO: 489 - DNA, 103 bp, Artificial Sequence
  Synthetic Polynucleotide
taatacgactcactataggggttctttgaaaccttgtccaattgcatcccaacagaggagagggatgatgttggacaagaacctggcggcagcgcaaaagatg

SEQ ID NO: 490 - DNA, 103 bp, Artificial Sequence
  Synthetic Polynucleotide
taatacgactcactatagggacgcgccgttgatgatattcctgttctgacaacagaggagagtcagaatgggaatatcaaacctggcggcagcgcaaaagatg

SEQ ID NO: 491 - DNA, 103 bp, Artificial Sequence
  Synthetic Polynucleotide
taatacgactcactatagggatcacacgcgccgttgatgatattcctgttaacagaggagaaacaggatgatcatcaacaacctggcggcagcgcaaaagatg

SEQ ID NO: 492 - DNA, 103 bp, Artificial Sequence
  Synthetic Polynucleotide
taatacgactcactatagggttggaatcacacgcgccgttgatgatattcaacagaggagagaatatatgcaacggcgcaacctggcggcagcgcaaaagatg

SEQ ID NO: 493 - DNA, 103 bp, Artificial Sequence
  Synthetic Polynucleotide
taatacgactcactataggggccatttggaatcacacgcgccgttgatgaaacagaggagatcatcaatggcgcgtgtgaacctggcggcagcgcaaaagatg

SEQ ID NO: 494 - DNA, 103 bp, Artificial Sequence
  Synthetic Polynucleotide
taatacgactcactatagggacaacgccatttggaatcacacgcgccgttaacagaggagaaacggcatgtgtgattccaacctggcggcagcgcaaaagatg

SEQ ID NO: 495 - DNA, 103 bp, Artificial Sequence
  Synthetic Polynucleotide
taatacgactcactatagggtagtaacaacgccatttggaatcacacgcgaacagaggagacgcgtgatgttccaaatgaacctggcggcagcgcaaaagatg

SEQ ID NO: 496 - DNA, 103 bp, Artificial Sequence
  Synthetic Polynucleotide
taatacgactcactatagggttcaatagtaacaacgccatttggaatcacaacagaggagagtgattatgaatggcgttaacctggcggcagcgcaaaagatg

SEQ ID NO: 497 - DNA, 103 bp, Artificial Sequence
  Synthetic Polynucleotide
taatacgactcactatagggttagtttcaatagtaacaacgccatttggaaacagaggagatccaaaatgcgttgttacaacctggcggcagcgcaaaagatg

SEQ ID NO: 498 - DNA, 103 bp, Artificial Sequence
  Synthetic Polynucleotide
taatacgactcactatagggtttccttagtttcaatagtaacaacgccataacagaggagaatggcgatgttactattgaacctggcggcagcgcaaaagatg

SEQ ID NO: 499 - DNA, 103 bp, Artificial Sequence
  Synthetic Polynucleotide
taatacgactcactatagggcactgtttccttagtttcaatagtaacaacaacagaggagagttgttatgattgaaactaacctggcggcagcgcaaaagatg

SEQ ID NO: 500 - DNA, 103 bp, Artificial Sequence
  Synthetic Polynucleotide
taatacgactcactatagggagcttgttctttgaaaccttgtccaattgcaacagaggagagcaattatgcaaggtttcaacctggcggcagcgcaaaagatg

SEQ ID NO: 501 - DNA, 103 bp, Artificial Sequence
  Synthetic Polynucleotide
taatacgactcactataggggttcccactgtttccttagtttcaatagtaaacagaggagatactatatgaactaaggaaacctggcggcagcgcaaaagatg

SEQ ID NO: 502 - DNA, 103 bp, Artificial Sequence
  Synthetic Polynucleotide
taatacgactcactatagggagccagttcccactgtttccttagtttcaaaacagaggagattgaaaatgaggaaacagaacctggcggcagcgcaaaagatg

SEQ ID NO: 503 - DNA, 103 bp, Artificial Sequence
  Synthetic Polynucleotide
taatacgactcactatagggtctaaagccagttcccactgtttccttagtaacagaggagaactaagatgacagtgggaaacctggcggcagcgcaaaagatg

SEQ ID NO: 504 - DNA, 103 bp, Artificial Sequence
  Synthetic Polynucleotide
taatacgactcactatagggtgaactctaaagccagttcccactgtttccaacagaggagaggaaacatggggaactggaacctggcggcagcgcaaaagatg

SEQ ID NO: 505 - DNA, 103 bp, Artificial Sequence
  Synthetic Polynucleotide
taatacgactcactatagggaattctgaactctaaagccagttcccactgaacagaggagacagtggatgctggctttaaacctggcggcagcgcaaaagatg

SEQ ID NO: 506 - DNA, 103 bp, Artificial Sequence
  Synthetic Polynucleotide
taatacgactcactatagggtatgtaattctgaactctaaagccagttccaacagaggagaggaactatgtttagagttaacctggcggcagcgcaaaagatg

SEQ ID NO: 507 - DNA, 103 bp, Artificial Sequence
  Synthetic Polynucleotide
taatacgactcactataggggtcactatgtaattctgaactctaaagccaaacagaggagatggcttatgagttcagaaaacctggcggcagcgcaaaagatg

SEQ ID NO: 508 - DNA, 103 bp, Artificial Sequence
  Synthetic Polynucleotide
taatacgactcactatagggcagctgtcactatgtaattctgaactctaaaacagaggagattagagatgagaattacaaacctggcggcagcgcaaaagatg

SEQ ID NO: 509 - DNA, 103 bp, Artificial Sequence
  Synthetic Polynucleotide
taatacgactcactatagggatgtgcagctgtcactatgtaattctgaacaacagaggagagttcagatgtacatagtgaacctggcggcagcgcaaaagatg

SEQ ID NO: 510 - DNA, 103 bp, Artificial Sequence
  Synthetic Polynucleotide
taatacgactcactatagggacaacatgtgcagctgtcactatgtaattcaacagaggagagaattaatgagtgacagcaacctggcggcagcgcaaaagatg

SEQ ID NO: 511 - DNA, 103 bp, Artificial Sequence
  Synthetic Polynucleotide
taatacgactcactatagggccgagagcttgttctttgaaaccttgtccaaacagaggagatggacaatgtttcaaagaaacctggcggcagcgcaaaagatg

SEQ ID NO: 512 - DNA, 103 bp, Artificial Sequence
  Synthetic Polynucleotide
taatacgactcactatagggtgccaacaacatgtgcagctgtcactatgtaacagaggagaacatagatgcagctgcacaacctggcggcagcgcaaaagatg

SEQ ID NO: 513 - DNA, 103 bp, Artificial Sequence
  Synthetic Polynucleotide
taatacgactcactatagggctcattgccaacaacatgtgcagctgtcacaacagaggagagtgacaatggcacatgttaacctggcggcagcgcaaaagatg

SEQ ID NO: 514 - DNA, 103 bp, Artificial Sequence
  Synthetic Polynucleotide
taatacgactcactatagggtgtgtctcattgccaacaacatgtgcagctaacagaggagaagctgcatgtgttgttggaacctggcggcagcgcaaaagatg

SEQ ID NO: 515 - DNA, 103 bp, Artificial Sequence
  Synthetic Polynucleotide
taatacgactcactataggggaacttgtgtctcattgccaacaacatgtgaacagaggagacacatgatgttggcaatgaacctggcggcagcgcaaaagatg

SEQ ID NO: 516 - DNA, 103 bp, Artificial Sequence
  Synthetic Polynucleotide
taatacgactcactatagggcacacgaacttgtgtctcattgccaacaacaacagaggagagttgttatgaatgagacaaacctggcggcagcgcaaaagatg

SEQ ID NO: 517 - DNA, 103 bp, Artificial Sequence
  Synthetic Polynucleotide
taatacgactcactatagggcacttcacacgaacttgtgtctcattgccaaacagaggagatggcaaatggacacaagtaacctggcggcagcgcaaaagatg

SEQ ID NO: 518 - DNA, 103 bp, Artificial Sequence
  Synthetic Polynucleotide
taatacgactcactatagggcgccccacttcacacgaacttgtgtctcataacagaggagaatgagaatgaagttcgtgaacctggcggcagcgcaaaagatg

SEQ ID NO: 519 - DNA, 103 bp, Artificial Sequence
  Synthetic Polynucleotide
taatacgactcactataggggacatcgccccacttcacacgaacttgtgtaacagaggagaacacaaatgcgtgtgaagaacctggcggcagcgcaaaagatg

SEQ ID NO: 520 - DNA, 103 bp, Artificial Sequence
  Synthetic Polynucleotide
taatacgactcactataggggcagagacatcgccccacttcacacgaactaacagaggagaagttcgatggaagtggggaacctggcggcagcgcaaaagatg

SEQ ID NO: 521 - DNA, 103 bp, Artificial Sequence
  Synthetic Polynucleotide
taatacgactcactatagggcaaaagcagagacatcgccccacttcacacaacagaggagagtgtgaatgggggcgatgaacctggcggcagcgcaaaagatg

SEQ ID NO: 522 - DNA, 103 bp, Artificial Sequence
  Synthetic Polynucleotide
taatacgactcactatagggggctaccccccagatgccaaaaggcaccaaaacagaggagattggtgatgtttggcatcaacctggcggcagcgcaaaagatg

SEQ ID NO: 523 - DNA, 103 bp, Artificial Sequence
  Synthetic Polynucleotide
taatacgactcactatagggtatgtccgagagcttgttctttgaaaccttaacagaggagaaaggttatgaagaacaagaacctggcggcagcgcaaaagatg

SEQ ID NO: 524 - DNA, 103 bp, Artificial Sequence
  Synthetic Polynucleotide
taatacgactcactatagggcttagcaaaagcagagacatcgccccacttaacagaggagaaagtggatggatgtctctaacctggcggcagcgcaaaagatg

SEQ ID NO: 525 - DNA, 103 bp, Artificial Sequence
  Synthetic Polynucleotide
taatacgactcactatagggcaaaccttagcaaaagcagagacatcgcccaacagaggagagggcgaatgctctgctttaacctggcggcagcgcaaaagatg

SEQ ID NO: 526 - DNA, 103 bp, Artificial Sequence
  Synthetic Polynucleotide
taatacgactcactatagggtatagcaaaccttagcaaaagcagagacataacagaggagaatgtctatgcttttgctaaacctggcggcagcgcaaaagatg

SEQ ID NO: 527 - DNA, 103 bp, Artificial Sequence
  Synthetic Polynucleotide
taatacgactcactataggggtgtatatagcaaaccttagcaaaagcagaaacagaggagatctgctatggctaaggttaacctggcggcagcgcaaaagatg

SEQ ID NO: 528 - DNA, 103 bp, Artificial Sequence
  Synthetic Polynucleotide
taatacgactcactatagggtcagggtgtatatagcaaaccttagcaaaaaacagaggagattttgcatgggtttgctaaacctggcggcagcgcaaaagatg

SEQ ID NO: 529 - DNA, 103 bp, Artificial Sequence
  Synthetic Polynucleotide
taatacgactcactatagggccttttcagggtgtatatagcaaaccttagaacagaggagactaaggatggctatatacaacctggcggcagcgcaaaagatg

SEQ ID NO: 530 - DNA, 103 bp, Artificial Sequence
  Synthetic Polynucleotide
taatacgactcactatagggaacatccttttcagggtgtatatagcaaacaacagaggagagtttgcatgatacaccctaacctggcggcagcgcaaaagatg

SEQ ID NO: 531 - DNA, 103 bp, Artificial Sequence
  Synthetic Polynucleotide
taatacgactcactatagggtatgcaacatccttttcagggtgtatatagaacagaggagactatatatgccctgaaaaaacctggcggcagcgcaaaagatg

SEQ ID NO: 532 - DNA, 103 bp, Artificial Sequence
  Synthetic Polynucleotide
taatacgactcactatagggttaggtatgcaacatccttttcagggtgtaaacagaggagatacaccatgaaaaggatgaacctggcggcagcgcaaaagatg

SEQ ID NO: 533 - DNA, 103 bp, Artificial Sequence
  Synthetic Polynucleotide
taatacgactcactatagggcaatgttaggtatgcaacatccttttcaggaacagaggagacctgaaatggatgttgcaaacctggcggcagcgcaaaagatg

SEQ ID NO: 534 - DNA, 103 bp, Artificial Sequence
  Synthetic Polynucleotide
taatacgactcactatagggtgaaatatgtccgagagcttgttctttgaaaacagaggagattcaaaatgcaagctctcaacctggcggcagcgcaaaagatg

SEQ ID NO: 535 - DNA, 103 bp, Artificial Sequence
  Synthetic Polynucleotide
taatacgactcactataggggatggcaatgttaggtatgcaacatcctttaacagaggagaaaaggaatgtgcatacctaacctggcggcagcgcaaaagatg

SEQ ID NO: 536 - DNA, 103 bp, Artificial Sequence
  Synthetic Polynucleotide
taatacgactcactataggggttctgatggcaatgttaggtatgcaacataacagaggagaatgttgatgacctaacataacctggcggcagcgcaaaagatg

SEQ ID NO: 537 - DNA, 103 bp, Artificial Sequence
  Synthetic Polynucleotide
taatacgactcactatagggttgatgttctgatggcaatgttaggtatgcaacagaggagagcatacatgacattgccaaacctggcggcagcgcaaaagatg

SEQ ID NO: 538 - DNA, 103 bp, Artificial Sequence
  Synthetic Polynucleotide
taatacgactcactatagggaaaccttgatgttctgatggcaatgttaggaacagaggagacctaacatggccatcagaaacctggcggcagcgcaaaagatg

SEQ ID NO: 539 - DNA, 103 bp, Artificial Sequence
  Synthetic Polynucleotide
taatacgactcactatagggttggcaaaccttgatgttctgatggcaatgaacagaggagacattgcatgcagaacatcaacctggcggcagcgcaaaagatg

SEQ ID NO: 540 - DNA, 103 bp, Artificial Sequence
  Synthetic Polynucleotide
taatacgactcactataggggtatgttggcaaaccttgatgttctgatggaacagaggagaccatcaatgcatcaaggtaacctggcggcagcgcaaaagatg

SEQ ID NO: 541 - DNA, 103 bp, Artificial Sequence
  Synthetic Polynucleotide
taatacgactcactatagggaatttgtatgttggcaaaccttgatgttctaacagaggagaagaacaatgaggtttgccaacctggcggcagcgcaaaagatg

SEQ ID NO: 542 - DNA, 103 bp, Artificial Sequence
  Synthetic Polynucleotide
taatacgactcactatagggtggcgaatttgtatgttggcaaaccttgataacagaggagaatcaagatgtgccaacataacctggcggcagcgcaaaagatg

SEQ ID NO: 543 - DNA, 103 bp, Artificial Sequence
  Synthetic Polynucleotide
taatacgactcactataggggtttttggcgaatttgtatgttggcaaaccaacagaggagaggtttgatgacatacaaaaacctggcggcagcgcaaaagatg

SEQ ID NO: 544 - DNA, 103 bp, Artificial Sequence
  Synthetic Polynucleotide
taatacgactcactatagggacaatgtttttggcgaatttgtatgttggcaacagaggagagccaacatgcaaattcgcaacctggcggcagcgcaaaagatg

SEQ ID NO: 545 - DNA, 103 bp, Artificial Sequence
  Synthetic Polynucleotide
taatacgactcactatagggcgtcttgaaatatgtccgagagcttgttctaacagaggagaagaacaatgtctcggacaaacctggcggcagcgcaaaagatg

SEQ ID NO: 546 - DNA, 103 bp, Artificial Sequence
  Synthetic Polynucleotide
taatacgactcactatagggcatcaacaatgtttttggcgaatttgtatgaacagaggagacatacaatgtcgccaaaaaacctggcggcagcgcaaaagatg

SEQ ID NO: 547 - DNA, 103 bp, Artificial Sequence
  Synthetic Polynucleotide
taatacgactcactatagggagtaccatcaacaatgtttttggcgaatttaacagaggagaaaattcatgaaaaacattaacctggcggcagcgcaaaagatg

SEQ ID NO: 548 - DNA, 103 bp, Artificial Sequence
  Synthetic Polynucleotide
taatacgactcactatagggacaacagtaccatcaacaatgtttttggcgaacagaggagacgccaaatgcattgttgaaacctggcggcagcgcaaaagatg

SEQ ID NO: 549 - DNA, 103 bp, Artificial Sequence
  Synthetic Polynucleotide
taatacgactcactatagggtgatcacaacagtaccatcaacaatgttttaacagaggagaaaaacaatgttgatggtaaacctggcggcagcgcaaaagatg

SEQ ID NO: 550 - DNA, 103 bp, Artificial Sequence
  Synthetic Polynucleotide
taatacgactcactatagggtgatgtgatcacaacagtaccatcaacaataacagaggagaattgttatgggtactgttaacctggcggcagcgcaaaagatg

SEQ ID NO: 551 - DNA, 103 bp, Artificial Sequence
  Synthetic Polynucleotide
taatacgactcactatagggtcaagtgatgtgatcacaacagtaccatcaaacagaggagatgatggatgtgttgtgataacctggcggcagcgcaaaagatg

SEQ ID NO: 552 - DNA, 103 bp, Artificial Sequence
  Synthetic Polynucleotide
taatacgactcactatagggattcctcaagtgatgtgatcacaacagtacaacagaggagagtactgatgtgatcacataacctggcggcagcgcaaaagatg

SEQ ID NO: 553 - DNA, 103 bp, Artificial Sequence
  Synthetic Polynucleotide
taatacgactcactataggggccgcattcctcaagtgatgtgatcacaacaacagaggagagttgtgatgacatcacttaacctggcggcagcgcaaaagatg

SEQ ID NO: 554 - DNA, 103 bp, Artificial Sequence
  Synthetic Polynucleotide
taatacgactcactatagggagtgtgccgcattcctcaagtgatgtgatcaacagaggagagatcacatgacttgaggaaacctggcggcagcgcaaaagatg

SEQ ID NO: 555 - DNA, 103 bp, Artificial Sequence
  Synthetic Polynucleotide
taatacgactcactatagggcggcgagtgtgccgcattcctcaagtgatgaacagaggagacatcacatgaggaatgcgaacctggcggcagcgcaaaagatg

SEQ ID NO: 556 - DNA, 103 bp, Artificial Sequence
  Synthetic Polynucleotide
taatacgactcactatagggcccaccgtcttgaaatatgtccgagagcttaacagaggagaaagctcatggacatatttaacctggcggcagcgcaaaagatg

SEQ ID NO: 557 - DNA, 103 bp, Artificial Sequence
  Synthetic Polynucleotide
taatacgactcactatagggggcaacggcgagtgtgccgcattcctcaagaacagaggagacttgagatgtgcggcacaaacctggcggcagcgcaaaagatg

SEQ ID NO: 558 - DNA, 103 bp, Artificial Sequence
  Synthetic Polynucleotide
taatacgactcactataggggttatggcaacggcgagtgtgccgcattccaacagaggagaggaatgatgcacactcgcaacctggcggcagcgcaaaagatg

SEQ ID NO: 559 - DNA, 103 bp, Artificial Sequence
  Synthetic Polynucleotide
taatacgactcactatagggcctctgttatggcaacggcgagtgtgccgcaacagaggagagcggcaatgtcgccgttgaacctggcggcagcgcaaaagatg

SEQ ID NO: 560 - DNA, 103 bp, Artificial Sequence
  Synthetic Polynucleotide
taatacgactcactatagggaacaccctctgttatggcaacggcgagtgtaacagaggagaacactcatggttgccataaacctggcggcagcgcaaaagatg

SEQ ID NO: 561 - DNA, 103 bp, Artificial Sequence
  Synthetic Polynucleotide
taatacgactcactatagggaccacaacaccctctgttatggcaacggcgaacagaggagacgccgtatgcataacagaaacctggcggcagcgcaaaagatg

SEQ ID NO: 562 - DNA, 103 bp, Artificial Sequence
  Synthetic Polynucleotide
taatacgactcactatagggtagacaccacaacaccctctgttatggcaaaacagaggagattgccaatgcagagggtgaacctggcggcagcgcaaaagatg

SEQ ID NO: 563 - DNA, 103 bp, Artificial Sequence
  Synthetic Polynucleotide
taatacgactcactataggggttgttagacaccacaacaccctctgttataacagaggagaataacaatgggtgttgtgaacctggcggcagcgcaaaagatg

SEQ ID NO: 564 - DNA, 103 bp, Artificial Sequence
  Synthetic Polynucleotide
taatacgactcactataggggtcatgttgttagacaccacaacaccctctaacagaggagaagagggatgtgtggtgtcaacctggcggcagcgcaaaagatg

SEQ ID NO: 565 - DNA, 103 bp, Artificial Sequence
  Synthetic Polynucleotide
taatacgactcactatagggcatatgtcatgttgttagacaccacaacacaacagaggagagtgttgatgtgtctaacaaacctggcggcagcgcaaaagatg

SEQ ID NO: 566 - DNA, 103 bp, Artificial Sequence
  Synthetic Polynucleotide
taatacgactcactataggggacggcatatgtcatgttgttagacaccacaacagaggagagtggtgatgaacaacatgaacctggcggcagcgcaaaagatg

SEQ ID NO: 567 - DNA, 103 bp, Artificial Sequence
  Synthetic Polynucleotide
taatacgactcactatagggaatggcccaccgtcttgaaatatgtccgagaacagaggagactcggaatgatttcaagaaacctggcggcagcgcaaaagatg

SEQ ID NO: 568 - DNA, 103 bp, Artificial Sequence
  Synthetic Polynucleotide
taatacgactcactataggggtattgacggcatatgtcatgttgttagacaacagaggagagtctaaatgcatgacataaacctggcggcagcgcaaaagatg

SEQ ID NO: 569 - DNA, 103 bp, Artificial Sequence
  Synthetic Polynucleotide
taatacgactcactatagggtttttgtattgacggcatatgtcatgttgtaacagaggagaacaacaatgcatatgccgaacctggcggcagcgcaaaagatg

SEQ ID NO: 570 - DNA, 103 bp, Artificial Sequence
  Synthetic Polynucleotide
taatacgactcactataggggccattttttgtattgacggcatatgtcataacagaggagaatgacaatggccgtcaataacctggcggcagcgcaaaagatg

SEQ ID NO: 571 - DNA, 103 bp, Artificial Sequence
  Synthetic Polynucleotide
taatacgactcactatagggctcatgccattttttgtattgacggcatataacagaggagaatatgcatgcaatacaaaaacctggcggcagcgcaaaagatg

SEQ ID NO: 572 - DNA, 103 bp, Artificial Sequence
  Synthetic Polynucleotide
taatacgactcactatagggaaccactcatgccattttttgtattgacggaacagaggagaccgtcaatgcaaaaaatgaacctggcggcagcgcaaaagatg

SEQ ID NO: 573 - DNA, 103 bp, Artificial Sequence
  Synthetic Polynucleotide
taatacgactcactatagggaggtgaaccactcatgccattttttgtattaacagaggagaaatacaatgaatggcatgaacctggcggcagcgcaaaagatg

SEQ ID NO: 574 - DNA, 103 bp, Artificial Sequence
  Synthetic Polynucleotide
taatacgactcactataggggtcacaggtgaaccactcatgccattttttaacagaggagaaaaaaaatgcatgagtggaacctggcggcagcgcaaaagatg

SEQ ID NO: 575 - DNA, 103 bp, Artificial Sequence
  Synthetic Polynucleotide
taatacgactcactatagggcatttgtcacaggtgaaccactcatgccataacagaggagaatggcaatggtggttcacaacctggcggcagcgcaaaagatg

SEQ ID NO: 576 - DNA, 103 bp, Artificial Sequence
  Synthetic Polynucleotide
taatacgactcactatagggatccacatttgtcacaggtgaaccactcataacagaggagaatgagtatgtcacctgtgaacctggcggcagcgcaaaagatg

SEQ ID NO: 577 - DNA, 103 bp, Artificial Sequence
  Synthetic Polynucleotide
taatacgactcactatagggcttccatccacatttgtcacaggtgaaccaaacagaggagatggttcatgtgtgacaaaaacctggcggcagcgcaaaagatg

SEQ ID NO: 578 - DNA, 103 bp, Artificial Sequence
  Synthetic Polynucleotide
taatacgactcactatagggaacacaatggcccaccgtcttgaaatatgtaacagaggagaacatatatgaagacggtgaacctggcggcagcgcaaaagatg

SEQ ID NO: 579 - DNA, 103 bp, Artificial Sequence
  Synthetic Polynucleotide
taatacgactcactatagggctatccttccatccacatttgtcacaggtgaacagaggagacacctgatgcaaatgtggaacctggcggcagcgcaaaagatg

SEQ ID NO: 580 - DNA, 103 bp, Artificial Sequence
  Synthetic Polynucleotide
taatacgactcactatagggtccaactatccttccatccacatttgtcacaacagaggagagtgacaatggtggatggaaacctggcggcagcgcaaaagatg

SEQ ID NO: 581 - DNA, 103 bp, Artificial Sequence
  Synthetic Polynucleotide
taatacgactcactatagggtgtactccaactatccttccatccacatttaacagaggagaaaatgtatgtggaaggataacctggcggcagcgcaaaagatg

SEQ ID NO: 582 - DNA, 103 bp, Artificial Sequence
  Synthetic Polynucleotide
taatacgactcactatagggtttgatgtactccaactatccttccatccaaacagaggagatggatgatgggatagttgaacctggcggcagcgcaaaagatg

SEQ ID NO: 583 - DNA, 103 bp, Artificial Sequence
  Synthetic Polynucleotide
taatacgactcactatagggattggtttgatgtactccaactatccttccaacagaggagaggaaggatggttggagtaaacctggcggcagcgcaaaagatg

SEQ ID NO: 584 - DNA, 103 bp, Artificial Sequence
  Synthetic Polynucleotide
taatacgactcactatagggccagtattggtttgatgtactccaactatcaacagaggagagatagtatgagtacatcaaacctggcggcagcgcaaaagatg

SEQ ID NO: 585 - DNA, 103 bp, Artificial Sequence
  Synthetic Polynucleotide
taatacgactcactatagggtgaacccagtattggtttgatgtactccaaaacagaggagattggagatgatcaaaccaaacctggcggcagcgcaaaagatg

SEQ ID NO: 586 - DNA, 103 bp, Artificial Sequence
  Synthetic Polynucleotide
taatacgactcactatagggacctgtgaacccagtattggtttgatgtacaacagaggagagtacatatgaccaatactaacctggcggcagcgcaaaagatg

SEQ ID NO: 587 - DNA, 103 bp, Artificial Sequence
  Synthetic Polynucleotide
taatacgactcactataggggctccacctgtgaacccagtattggtttgaaacagaggagatcaaacatgtactgggttaacctggcggcagcgcaaaagatg

SEQ ID NO: 588 - DNA, 103 bp, Artificial Sequence
  Synthetic Polynucleotide
taatacgactcactatagggttacggctccacctgtgaacccagtattggaacagaggagaccaataatgggttcacagaacctggcggcagcgcaaaagatg

SEQ ID NO: 589 - DNA, 103 bp, Artificial Sequence
  Synthetic Polynucleotide
taatacgactcactatagggaccaaaacacaatggcccaccgtcttgaaaaacagaggagatttcaaatgggtgggccaaacctggcggcagcgcaaaagatg

SEQ ID NO: 590 - DNA, 103 bp, Artificial Sequence
  Synthetic Polynucleotide
taatacgactcactatagggtaatattacggctccacctgtgaacccagtaacagaggagaactgggatgacaggtggaaacctggcggcagcgcaaaagatg

SEQ ID NO: 591 - DNA, 103 bp, Artificial Sequence
  Synthetic Polynucleotide
taatacgactcactatagggtgatataatattacggctccacctgtgaacaacagaggagagttcacatgtggagccgtaacctggcggcagcgcaaaagatg

SEQ ID NO: 592 - DNA, 103 bp, Artificial Sequence
  Synthetic Polynucleotide
taatacgactcactatagggcatcttgatataatattacggctccacctgaacagaggagacaggtgatgccgtaatataacctggcggcagcgcaaaagatg

SEQ ID NO: 593 - DNA, 103 bp, Artificial Sequence
  Synthetic Polynucleotide
taatacgactcactatagggcaaatcatcttgatataatattacggctccaacagaggagaggagccatgatattatataacctggcggcagcgcaaaagatg

SEQ ID NO: 594 - DNA, 103 bp, Artificial Sequence
  Synthetic Polynucleotide
taatacgactcactatagggggtggcaaatcatcttgatataatattacgaacagaggagacgtaatatgatatcaagaaacctggcggcagcgcaaaagatg

SEQ ID NO: 595 - DNA, 103 bp, Artificial Sequence
  Synthetic Polynucleotide
taatacgactcactatagggtctggggtggcaaatcatcttgatataataaacagaggagatattatatgaagatgattaacctggcggcagcgcaaaagatg

SEQ ID NO: 596 - DNA, 103 bp, Artificial Sequence
  Synthetic Polynucleotide
taatacgactcactatagggtttcttctggggtggcaaatcatcttgataaacagaggagatatcaaatggatttgccaaacctggcggcagcgcaaaagatg

SEQ ID NO: 597 - DNA, 103 bp, Artificial Sequence
  Synthetic Polynucleotide
taatacgactcactatagggagaggtttcttctggggtggcaaatcatctaacagaggagaagatgaatggccaccccaaacctggcggcagcgcaaaagatg

SEQ ID NO: 598 - DNA, 103 bp, Artificial Sequence
  Synthetic Polynucleotide
taatacgactcactatagggcccgtagaggtttcttctggggtggcaaataacagaggagaatttgcatgcccagaagaaacctggcggcagcgcaaaagatg

SEQ ID NO: 599 - DNA, 103 bp, Artificial Sequence
  Synthetic Polynucleotide
taatacgactcactatagggttgttcccgtagaggtttcttctggggtggaacagaggagaccacccatgaagaaacctaacctggcggcagcgcaaaagatg

SEQ ID NO: 600 - DNA, 103 bp, Artificial Sequence
  Synthetic Polynucleotide
taatacgactcactatagggccataaccaaaacacaatggcccaccgtctaacagaggagaagacggatggccattgtgaacctggcggcagcgcaaaagatg

SEQ ID NO: 601 - DNA, 103 bp, Artificial Sequence
  Synthetic Polynucleotide
taatacgactcactatagggagttcttgttcccgtagaggtttcttctggaacagaggagaccagaaatgacctctacgaacctggcggcagcgcaaaagatg

SEQ ID NO: 602 - DNA, 103 bp, Artificial Sequence
  Synthetic Polynucleotide
taatacgactcactatagggcttcaagttcttgttcccgtagaggtttctaacagaggagaagaaacatgtacgggaacaacctggcggcagcgcaaaagatg

SEQ ID NO: 603 - DNA, 103 bp, Artificial Sequence
  Synthetic Polynucleotide
taatacgactcactatagggcctggcttcaagttcttgttcccgtagaggaacagaggagacctctaatggaacaagaaaacctggcggcagcgcaaaagatg

SEQ ID NO: 604 - DNA, 103 bp, Artificial Sequence
  Synthetic Polynucleotide
taatacgactcactatagggtttatcctggcttcaagttcttgttcccgtaacagaggagaacgggaatgagaacttgaaacctggcggcagcgcaaaagatg

SEQ ID NO: 605 - DNA, 103 bp, Artificial Sequence
  Synthetic Polynucleotide
taatacgactcactataggggatcttttatcctggcttcaagttcttgttaacagaggagaaacaagatgttgaagccaaacctggcggcagcgcaaaagatg

SEQ ID NO: 606 - DNA, 103 bp, Artificial Sequence
  Synthetic Polynucleotide
taatacgactcactatagggttctagatcttttatcctggcttcaagttcaacagaggagagaacttatggccaggataaacctggcggcagcgcaaaagatg

SEQ ID NO: 607 - DNA, 103 bp, Artificial Sequence
  Synthetic Polynucleotide
taatacgactcactataggggctgcttctagatcttttatcctggcttcaaacagaggagatgaagcatggataaaagaaacctggcggcagcgcaaaagatg

SEQ ID NO: 608 - DNA, 103 bp, Artificial Sequence
  Synthetic Polynucleotide
taatacgactcactatagggcaagagctgcttctagatcttttatcctggaacagaggagaccaggaatgaagatctagaacctggcggcagcgcaaaagatg

SEQ ID NO: 609 - DNA, 103 bp, Artificial Sequence
  Synthetic Polynucleotide
taatacgactcactatagggggcatcaagagctgcttctagatcttttataacagaggagaataaaaatgctagaagcaaacctggcggcagcgcaaaagatg

SEQ ID NO: 610 - DNA, 103 bp, Artificial Sequence
  Synthetic Polynucleotide
taatacgactcactatagggattttggcatcaagagctgcttctagatctaacagaggagaagatctatgagcagctctaacctggcggcagcgcaaaagatg

SEQ ID NO: 611 - DNA, 103 bp, Artificial Sequence
  Synthetic Polynucleotide
taatacgactcactataggggctcgccataaccaaaacacaatggcccacaacagaggagagtgggcatgtgtgttttgaacctggcggcagcgcaaaagatg

SEQ ID NO: 612 - DNA, 103 bp, Artificial Sequence
  Synthetic Polynucleotide
taatacgactcactataggggctgcattttggcatcaagagctgcttctaaacagaggagatagaagatgctcttgatgaacctggcggcagcgcaaaagatg

SEQ ID NO: 613 - DNA, 103 bp, Artificial Sequence
  Synthetic Polynucleotide
taatacgactcactatagggccgctgctgcattttggcatcaagagctgcaacagaggagagcagctatggatgccaaaaacctggcggcagcgcaaaagatg

SEQ ID NO: 614 - DNA, 103 bp, Artificial Sequence
  Synthetic Polynucleotide
taatacgactcactatagggctcatccgctgctgcattttggcatcaagaaacagaggagatcttgaatgcaaaatgcaaacctggcggcagcgcaaaagatg

SEQ ID NO: 615 - DNA, 103 bp, Artificial Sequence
  Synthetic Polynucleotide
taatacgactcactatagggcatcactcatccgctgctgcattttggcataacagaggagaatgccaatgtgcagcagcaacctggcggcagcgcaaaagatg

SEQ ID NO: 616 - DNA, 103 bp, Artificial Sequence
  Synthetic Polynucleotide
taatacgactcactatagggctgatcatcactcatccgctgctgcattttaacagaggagaaaaatgatgcagcggatgaacctggcggcagcgcaaaagatg

SEQ ID NO: 617 - DNA, 103 bp, Artificial Sequence
  Synthetic Polynucleotide
taatacgactcactatagggacgatctgatcatcactcatccgctgctgcaacagaggagagcagcaatggatgagtgaaacctggcggcagcgcaaaagatg

SEQ ID NO: 618 - DNA, 103 bp, Artificial Sequence
  Synthetic Polynucleotide
taatacgactcactataggggttcaacgatctgatcatcactcatccgctaacagaggagaagcggaatggtgatgatcaacctggcggcagcgcaaaagatg

SEQ ID NO: 619 - DNA, 103 bp, Artificial Sequence
  Synthetic Polynucleotide
taatacgactcactataggggacaagttcaacgatctgatcatcactcataacagaggagaatgagtatggatcagatcaacctggcggcagcgcaaaagatg

SEQ ID NO: 620 - DNA, 103 bp, Artificial Sequence
  Synthetic Polynucleotide
taatacgactcactatagggaaccggacaagttcaacgatctgatcatcaaacagaggagatgatgaatggatcgttgaaacctggcggcagcgcaaaagatg

SEQ ID NO: 621 - DNA, 103 bp, Artificial Sequence
  Synthetic Polynucleotide
taatacgactcactatagggcagctaaccggacaagttcaacgatctgataacagaggagaatcagaatgttgaacttgaacctggcggcagcgcaaaagatg

SEQ ID NO: 622 - DNA, 103 bp, Artificial Sequence
  Synthetic Polynucleotide
taatacgactcactatagggttctagctcgccataaccaaaacacaatggaacagaggagaccattgatgtttggttataacctggcggcagcgcaaaagatg

SEQ ID NO: 623 - DNA, 103 bp, Artificial Sequence
  Synthetic Polynucleotide
taatacgactcactatagggcccaacagctaaccggacaagttcaacgataacagaggagaatcgttatgcttgtccggaacctggcggcagcgcaaaagatg

SEQ ID NO: 624 - DNA, 103 bp, Artificial Sequence
  Synthetic Polynucleotide
taatacgactcactatagggtctctcccaacagctaaccggacaagttcaaacagaggagatgaactatgccggttagcaacctggcggcagcgcaaaagatg

SEQ ID NO: 625 - DNA, 103 bp, Artificial Sequence
  Synthetic Polynucleotide
taatacgactcactatagggtgagttctctcccaacagctaaccggacaaaacagaggagattgtccatgtagctgttgaacctggcggcagcgcaaaagatg

SEQ ID NO: 626 - DNA, 103 bp, Artificial Sequence
  Synthetic Polynucleotide
taatacgactcactataggggatcgtgagttctctcccaacagctaaccgaacagaggagacggttaatggttgggagaaacctggcggcagcgcaaaagatg

SEQ ID NO: 627 - DNA, 103 bp, Artificial Sequence
  Synthetic Polynucleotide
taatacgactcactatagggctcaggatcgtgagttctctcccaacagctaacagaggagaagctgtatggagagaactaacctggcggcagcgcaaaagatg

SEQ ID NO: 628 - DNA, 103 bp, Artificial Sequence
  Synthetic Polynucleotide
taatacgactcactatagggcatgtctcaggatcgtgagttctctcccaaaacagaggagattgggaatgaactcacgaaacctggcggcagcgcaaaagatg

SEQ ID NO: 629 - DNA, 103 bp, Artificial Sequence
  Synthetic Polynucleotide
taatacgactcactatagggtagttcatgtctcaggatcgtgagttctctaacagaggagaagagaaatgacgatcctgaacctggcggcagcgcaaaagatg

SEQ ID NO: 630 - DNA, 103 bp, Artificial Sequence
  Synthetic Polynucleotide
taatacgactcactatagggaagcttagttcatgtctcaggatcgtgagtaacagaggagaactcacatgcctgagacaaacctggcggcagcgcaaaagatg

SEQ ID NO: 631 - DNA, 103 bp, Artificial Sequence
  Synthetic Polynucleotide
taatacgactcactatagggggtttaagcttagttcatgtctcaggatcgaacagaggagacgatccatggacatgaacaacctggcggcagcgcaaaagatg

SEQ ID NO: 632 - DNA, 103 bp, Artificial Sequence
  Synthetic Polynucleotide
taatacgactcactatagggggcctggtttaagcttagttcatgtctcagaacagaggagactgagaatggaactaagcaacctggcggcagcgcaaaagatg

SEQ ID NO: 633 - DNA, 103 bp, Artificial Sequence
  Synthetic Polynucleotide
taatacgactcactatagggtccatggctaccccccagatgccaaaaggcaacagaggagagcctttatgcatctggggaacctggcggcagcgcaaaagatg

SEQ ID NO: 634 - DNA, 103 bp, Artificial Sequence
  Synthetic Polynucleotide
taatacgactcactataggggccatttctagctcgccataaccaaaacacaacagaggagagtgtttatgttatggcgaaacctggcggcagcgcaaaagatg

SEQ ID NO: 635 - DNA, 103 bp, Artificial Sequence
  Synthetic Polynucleotide
taatacgactcactatagggcctttggcctggtttaagcttagttcatgtaacagaggagaacatgaatgaagcttaaaaacctggcggcagcgcaaaagatg

SEQ ID NO: 636 - DNA, 103 bp, Artificial Sequence
  Synthetic Polynucleotide
taatacgactcactatagggtcttacctttggcctggtttaagcttagttaacagaggagaaactaaatgtaaaccaggaacctggcggcagcgcaaaagatg

SEQ ID NO: 637 - DNA, 103 bp, Artificial Sequence
  Synthetic Polynucleotide
taatacgactcactatagggtttgttcttacctttggcctggtttaagctaacagaggagaagcttaatgcaggccaaaaacctggcggcagcgcaaaagatg

SEQ ID NO: 638 - DNA, 103 bp, Artificial Sequence
  Synthetic Polynucleotide
taatacgactcactatagggttacctttgttcttacctttggcctggtttaacagaggagaaaaccaatgcaaaggtaaaacctggcggcagcgcaaaagatg

SEQ ID NO: 639 - DNA, 103 bp, Artificial Sequence
  Synthetic Polynucleotide
taatacgactcactatagggctttcttacctttgttcttacctttggcctaacagaggagaaggccaatggtaagaacaaacctggcggcagcgcaaaagatg

SEQ ID NO: 640 - DNA, 103 bp, Artificial Sequence
  Synthetic Polynucleotide
taatacgactcactatagggtccacctttcttacctttgttcttacctttaacagaggagaaaaggtatgaacaaaggtaacctggcggcagcgcaaaagatg

SEQ ID NO: 641 - DNA, 103 bp, Artificial Sequence
  Synthetic Polynucleotide
taatacgactcactatagggcgctttccacctttcttacctttgttcttaaacagaggagataagaaatgaggtaagaaaacctggcggcagcgcaaaagatg

SEQ ID NO: 642 - DNA, 103 bp, Artificial Sequence
  Synthetic Polynucleotide
taatacgactcactatagggtcccacgctttccacctttcttacctttgtaacagaggagaacaaagatgagaaaggtgaacctggcggcagcgcaaaagatg

SEQ ID NO: 643 - DNA, 103 bp, Artificial Sequence
  Synthetic Polynucleotide
taatacgactcactatagggctttttcccacgctttccacctttcttaccaacagaggagaggtaagatgggtggaaagaacctggcggcagcgcaaaagatg

SEQ ID NO: 644 - DNA, 103 bp, Artificial Sequence
  Synthetic Polynucleotide
taatacgactcactatagggcgtttctttttcccacgctttccacctttcaacagaggagagaaaggatgaaagcgtggaacctggcggcagcgcaaaagatg

SEQ ID NO: 645 - DNA, 103 bp, Artificial Sequence
  Synthetic Polynucleotide
taatacgactcactatagggtttttgccatttctagctcgccataaccaaaacagaggagattggttatggcgagctagaacctggcggcagcgcaaaagatg

SEQ ID NO: 646 - DNA, 103 bp, Artificial Sequence
  Synthetic Polynucleotide
taatacgactcactatagggacatgcgtttctttttcccacgctttccacaacagaggagagtggaaatggtgggaaaaaacctggcggcagcgcaaaagatg

SEQ ID NO: 647 - DNA, 103 bp, Artificial Sequence
  Synthetic Polynucleotide
taatacgactcactatagggagtccacatgcgtttctttttcccacgcttaacagaggagaaagcgtatgaaaaagaaaaacctggcggcagcgcaaaagatg

SEQ ID NO: 648 - DNA, 103 bp, Artificial Sequence
  Synthetic Polynucleotide
taatacgactcactatagggtcctcagtccacatgcgtttctttttcccaaacagaggagatgggaaatggaaacgcataacctggcggcagcgcaaaagatg

SEQ ID NO: 649 - DNA, 103 bp, Artificial Sequence
  Synthetic Polynucleotide
taatacgactcactatagggactcttcctcagtccacatgcgtttcttttaacagaggagaaaaagaatggcatgtggaaacctggcggcagcgcaaaagatg

SEQ ID NO: 650 - DNA, 103 bp, Artificial Sequence
  Synthetic Polynucleotide
taatacgactcactatagggtttgtactcttcctcagtccacatgcgtttaacagaggagaaaacgcatgtggactgagaacctggcggcagcgcaaaagatg

SEQ ID NO: 651 - DNA, 103 bp, Artificial Sequence
  Synthetic Polynucleotide
taatacgactcactatagggagttctttgtactcttcctcagtccacatgaacagaggagacatgtgatgtgaggaagaaacctggcggcagcgcaaaagatg

SEQ ID NO: 652 - DNA, 103 bp, Artificial Sequence
  Synthetic Polynucleotide
taatacgactcactatagggctaagagttctttgtactcttcctcagtccaacagaggagaggactgatgaagagtacaaacctggcggcagcgcaaaagatg

SEQ ID NO: 653 - DNA, 103 bp, Artificial Sequence
  Synthetic Polynucleotide
taatacgactcactatagggtttttctaagagttctttgtactcttcctcaacagaggagagaggaaatgtacaaagaaaacctggcggcagcgcaaaagatg

SEQ ID NO: 654 - DNA, 103 bp, Artificial Sequence
  Synthetic Polynucleotide
taatacgactcactatagggaagcctttttctaagagttctttgtactctaacagaggagaagagtaatgagaactcttaacctggcggcagcgcaaaagatg

SEQ ID NO: 655 - DNA, 103 bp, Artificial Sequence
  Synthetic Polynucleotide
taatacgactcactatagggtagtaaagcctttttctaagagttctttgtaacagaggagaacaaagatgtcttagaaaaacctggcggcagcgcaaaagatg

SEQ ID NO: 656 - DNA, 103 bp, Artificial Sequence
  Synthetic Polynucleotide
taatacgactcactatagggaacaatttttgccatttctagctcgccataaacagaggagatatggcatgctagaaatgaacctggcggcagcgcaaaagatg

SEQ ID NO: 657 - DNA, 103 bp, Artificial Sequence
  Synthetic Polynucleotide
taatacgactcactatagggttgtttagtaaagcctttttctaagagttcaacagaggagagaactcatggaaaaaggcaacctggcggcagcgcaaaagatg

SEQ ID NO: 658 - DNA, 103 bp, Artificial Sequence
  Synthetic Polynucleotide
taatacgactcactatagggaattgttgtttagtaaagcctttttctaagaacagaggagacttagaatgaggctttacaacctggcggcagcgcaaaagatg

SEQ ID NO: 659 - DNA, 103 bp, Artificial Sequence
  Synthetic Polynucleotide
taatacgactcactatagggctctcaattgttgtttagtaaagcctttttaacagaggagaaaaaagatgttactaaacaacctggcggcagcgcaaaagatg

SEQ ID NO: 660 - DNA, 103 bp, Artificial Sequence
  Synthetic Polynucleotide
taatacgactcactatagggcatatctctcaattgttgtttagtaaagccaacagaggagaggctttatgaaacaacaaaacctggcggcagcgcaaaagatg

SEQ ID NO: 661 - DNA, 103 bp, Artificial Sequence
  Synthetic Polynucleotide
taatacgactcactatagggtcagccatatctctcaattgttgtttagtaaacagaggagatactaaatgacaattgagaacctggcggcagcgcaaaagatg

SEQ ID NO: 662 - DNA, 103 bp, Artificial Sequence
  Synthetic Polynucleotide
taatacgactcactatagggatgcctcagccatatctctcaattgttgttaacagaggagaaacaacatgtgagagataaacctggcggcagcgcaaaagatg

SEQ ID NO: 663 - DNA, 103 bp, Artificial Sequence
  Synthetic Polynucleotide
taatacgactcactatagggacgcaatgcctcagccatatctctcaattgaacagaggagacaattgatggatatggctaacctggcggcagcgcaaaagatg

SEQ ID NO: 664 - DNA, 103 bp, Artificial Sequence
  Synthetic Polynucleotide
taatacgactcactataggggcttcacgcaatgcctcagccatatctctcaacagaggagagagagaatgggctgaggcaacctggcggcagcgcaaaagatg

SEQ ID NO: 665 - DNA, 103 bp, Artificial Sequence
  Synthetic Polynucleotide
taatacgactcactatagggactcagcttcacgcaatgcctcagccatataacagaggagaatatggatgaggcattgcaacctggcggcagcgcaaaagatg

SEQ ID NO: 666 - DNA, 103 bp, Artificial Sequence
  Synthetic Polynucleotide
taatacgactcactatagggagagtactcagcttcacgcaatgcctcagcaacagaggagagctgagatgttgcgtgaaaacctggcggcagcgcaaaagatg

SEQ ID NO: 667 - DNA, 103 bp, Artificial Sequence
  Synthetic Polynucleotide
taatacgactcactatagggccagaaacaatttttgccatttctagctcgaacagaggagacgagctatgaatggcaaaaacctggcggcagcgcaaaagatg

SEQ ID NO: 668 - DNA, 103 bp, Artificial Sequence
  Synthetic Polynucleotide
taatacgactcactatagggtcatcagagtactcagcttcacgcaatgccaacagaggagaggcattatgtgaagctgaaacctggcggcagcgcaaaagatg

SEQ ID NO: 669 - DNA, 103 bp, Artificial Sequence
  Synthetic Polynucleotide
taatacgactcactatagggtgtcttcatcagagtactcagcttcacgcaaacagaggagatgcgtgatgctgagtactaacctggcggcagcgcaaaagatg

SEQ ID NO: 670 - DNA, 103 bp, Artificial Sequence
  Synthetic Polynucleotide
taatacgactcactataggggtcactgtcttcatcagagtactcagcttcaacagaggagagaagctatgtactctgataacctggcggcagcgcaaaagatg

SEQ ID NO: 671 - DNA, 103 bp, Artificial Sequence
  Synthetic Polynucleotide
taatacgactcactatagggtactcgtcactgtcttcatcagagtactcaaacagaggagatgagtaatgtgatgaagaaacctggcggcagcgcaaaagatg

SEQ ID NO: 672 - DNA, 103 bp, Artificial Sequence
  Synthetic Polynucleotide
taatacgactcactatagggcttcatactcgtcactgtcttcatcagagtaacagaggagaactctgatgaagacagtgaacctggcggcagcgcaaaagatg

SEQ ID NO: 673 - DNA, 103 bp, Artificial Sequence
  Synthetic Polynucleotide
taatacgactcactatagggtccagcttcatactcgtcactgtcttcatcaacagaggagagatgaaatgagtgacgagaacctggcggcagcgcaaaagatg

SEQ ID NO: 674 - DNA, 103 bp, Artificial Sequence
  Synthetic Polynucleotide
taatacgactcactataggggggtatccagcttcatactcgtcactgtctaacagaggagaagacagatgcgagtatgaaacctggcggcagcgcaaaagatg

SEQ ID NO: 675 - DNA, 103 bp, Artificial Sequence
  Synthetic Polynucleotide
taatacgactcactatagggattgggggtatccagcttcatactcgtcacaacagaggagagtgacgatgatgaagctgaacctggcggcagcgcaaaagatg

SEQ ID NO: 676 - DNA, 103 bp, Artificial Sequence
  Synthetic Polynucleotide
taatacgactcactatagggtgaccattgggggtatccagcttcatactcaacagaggagagagtatatggctggatacaacctggcggcagcgcaaaagatg

SEQ ID NO: 677 - DNA, 103 bp, Artificial Sequence
  Synthetic Polynucleotide
taatacgactcactatagggggatctgaccattgggggtatccagcttcaaacagaggagatgaagcatgatacccccaaacctggcggcagcgcaaaagatg

SEQ ID NO: 678 - DNA, 103 bp, Artificial Sequence
  Synthetic Polynucleotide
taatacgactcactatagggctgagccagaaacaatttttgccatttctaaacagaggagatagaaaatgcaaaaattgaacctggcggcagcgcaaaagatg

SEQ ID NO: 679 - DNA, 103 bp, Artificial Sequence
  Synthetic Polynucleotide
taatacgactcactatagggcctcaggatctgaccattgggggtatccagaacagaggagactggatatgcccaatggtaacctggcggcagcgcaaaagatg

SEQ ID NO: 680 - DNA, 103 bp, Artificial Sequence
  Synthetic Polynucleotide
taatacgactcactatagggatcatcctcaggatctgaccattgggggtaaacagaggagataccccatgtggtcagataacctggcggcagcgcaaaagatg

SEQ ID NO: 681 - DNA, 103 bp, Artificial Sequence
  Synthetic Polynucleotide
taatacgactcactatagggtcgtcatcatcctcaggatctgaccattggaacagaggagaccaatgatgagatcctgaaacctggcggcagcgcaaaagatg

SEQ ID NO: 682 - DNA, 103 bp, Artificial Sequence
  Synthetic Polynucleotide
taatacgactcactatagggccaactcgtcatcatcctcaggatctgaccaacagaggagaggtcagatgctgaggatgaacctggcggcagcgcaaaagatg

SEQ ID NO: 683 - DNA, 103 bp, Artificial Sequence
  Synthetic Polynucleotide
taatacgactcactatagggagcctccaactcgtcatcatcctcaggatcaacagaggagagatcctatggatgatgacaacctggcggcagcgcaaaagatg

SEQ ID NO: 684 - DNA, 103 bp, Artificial Sequence
  Synthetic Polynucleotide
taatacgactcactatagggcactcagcctccaactcgtcatcatcctcaaacagaggagatgaggaatgtgacgagttaacctggcggcagcgcaaaagatg

SEQ ID NO: 685 - DNA, 103 bp, Artificial Sequence
  Synthetic Polynucleotide
taatacgactcactatagggcaaaccactcagcctccaactcgtcatcataacagaggagaatgatgatgagttggaggaacctggcggcagcgcaaaagatg

SEQ ID NO: 686 - DNA, 103 bp, Artificial Sequence
  Synthetic Polynucleotide
taatacgactcactatagggtggtccaaaccactcagcctccaactcgtcaacagaggagagacgagatggaggctgagaacctggcggcagcgcaaaagatg

SEQ ID NO: 687 - DNA, 103 bp, Artificial Sequence
  Synthetic Polynucleotide
taatacgactcactatagggttctttggtccaaaccactcagcctccaacaacagaggagagttggaatgtgagtggttaacctggcggcagcgcaaaagatg

SEQ ID NO: 688 - DNA, 103 bp, Artificial Sequence
  Synthetic Polynucleotide
taatacgactcactatagggtcttcttctttggtccaaaccactcagcctaacagaggagaaggctgatgggtttggacaacctggcggcagcgcaaaagatg

SEQ ID NO: 689 - DNA, 103 bp, Artificial Sequence
  Synthetic Polynucleotide
taatacgactcactatagggtttgactgagccagaaacaatttttgccataacagaggagaatggcaatgattgtttctaacctggcggcagcgcaaaagatg

SEQ ID NO: 690 - DNA, 103 bp, Artificial Sequence
  Synthetic Polynucleotide
taatacgactcactataggggaggatcttcttctttggtccaaaccactcaacagaggagagagtggatgggaccaaagaacctggcggcagcgcaaaagatg

SEQ ID NO: 691 - DNA, 103 bp, Artificial Sequence
  Synthetic Polynucleotide
taatacgactcactatagggtcatcgaggatcttcttctttggtccaaacaacagaggagagtttggatgaaagaagaaaacctggcggcagcgcaaaagatg

SEQ ID NO: 692 - DNA, 103 bp, Artificial Sequence
  Synthetic Polynucleotide
taatacgactcactatagggcaacctcatcgaggatcttcttctttggtcaacagaggagagaccaaatgagaagatccaacctggcggcagcgcaaaagatg

SEQ ID NO: 693 - DNA, 103 bp, Artificial Sequence
  Synthetic Polynucleotide
taatacgactcactatagggctcttcaacctcatcgaggatcttcttcttaacagaggagaaagaagatgatcctcgataacctggcggcagcgcaaaagatg

SEQ ID NO: 694 - DNA, 103 bp, Artificial Sequence
  Synthetic Polynucleotide
taatacgactcactatagggcaaccctcttcaacctcatcgaggatcttcaacagaggagagaagatatgcgatgaggtaacctggcggcagcgcaaaagatg

SEQ ID NO: 695 - DNA, 103 bp, Artificial Sequence
  Synthetic Polynucleotide
taatacgactcactatagggtggaccaaccctcttcaacctcatcgaggaaacagaggagatcctcgatgaggttgaagaacctggcggcagcgcaaaagatg

SEQ ID NO: 696 - DNA, 103 bp, Artificial Sequence
  Synthetic Polynucleotide
taatacgactcactatagggtgttttggaccaaccctcttcaacctcatcaacagaggagagatgagatggaagagggtaacctggcggcagcgcaaaagatg

SEQ ID NO: 697 - DNA, 103 bp, Artificial Sequence
  Synthetic Polynucleotide
taatacgactcactatagggaaatctgttttggaccaaccctcttcaaccaacagaggagaggttgaatggggttggtcaacctggcggcagcgcaaaagatg

SEQ ID NO: 698 - DNA, 103 bp, Artificial Sequence
  Synthetic Polynucleotide
taatacgactcactatagggcccagaaatctgttttggaccaaccctcttaacagaggagaaagaggatgggtccaaaaaacctggcggcagcgcaaaagatg

SEQ ID NO: 699 - DNA, 103 bp, Artificial Sequence
  Synthetic Polynucleotide
taatacgactcactatagggttgttcccagaaatctgttttggaccaaccaacagaggagaggttggatgaaaacagataacctggcggcagcgcaaaagatg

SEQ ID NO: 700 - DNA, 103 bp, Artificial Sequence
  Synthetic Polynucleotide
taatacgactcactatagggattggtttgactgagccagaaacaatttttaacagaggagaaaaaatatgttctggctcaacctggcggcagcgcaaaagatg

SEQ ID NO: 701 - DNA, 103 bp, Artificial Sequence
  Synthetic Polynucleotide
taatacgactcactatagggtggcattgttcccagaaatctgttttggacaacagaggagagtccaaatgagatttctgaacctggcggcagcgcaaaagatg

SEQ ID NO: 702 - DNA, 103 bp, Artificial Sequence
  Synthetic Polynucleotide
taatacgactcactatagggctttttggcattgttcccagaaatctgtttaacagaggagaaaacagatgtctgggaacaacctggcggcagcgcaaaagatg

SEQ ID NO: 703 - DNA, 103 bp, Artificial Sequence
  Synthetic Polynucleotide
taatacgactcactatagggccaaactttttggcattgttcccagaaatcaacagaggagagatttcatggaacaatgcaacctggcggcagcgcaaaagatg

SEQ ID NO: 704 - DNA, 103 bp, Artificial Sequence
  Synthetic Polynucleotide
taatacgactcactatagggtccttccaaactttttggcattgttcccagaacagaggagactgggaatgatgccaaaaaacctggcggcagcgcaaaagatg

SEQ ID NO: 705 - DNA, 103 bp, Artificial Sequence
  Synthetic Polynucleotide
taatacgactcactatagggctagttccttccaaactttttggcattgttaacagaggagaaacaatatgaaaaagtttaacctggcggcagcgcaaaagatg

SEQ ID NO: 706 - DNA, 103 bp, Artificial Sequence
  Synthetic Polynucleotide
taatacgactcactatagggtggctctagttccttccaaactttttggcaaacagaggagatgccaaatggtttggaagaacctggcggcagcgcaaaagatg

SEQ ID NO: 707 - DNA, 103 bp, Artificial Sequence
  Synthetic Polynucleotide
taatacgactcactatagggctcattggctctagttccttccaaacttttaacagaggagaaaaagtatggaaggaactaacctggcggcagcgcaaaagatg

SEQ ID NO: 708 - DNA, 103 bp, Artificial Sequence
  Synthetic Polynucleotide
taatacgactcactatagggcttcactcattggctctagttccttccaaaaacagaggagatttggaatgaactagagcaacctggcggcagcgcaaaagatg

SEQ ID NO: 709 - DNA, 103 bp, Artificial Sequence
  Synthetic Polynucleotide
taatacgactcactatagggggcttcttcactcattggctctagttccttaacagaggagaaaggaaatggagccaatgaacctggcggcagcgcaaaagatg

SEQ ID NO: 710 - DNA, 103 bp, Artificial Sequence
  Synthetic Polynucleotide
taatacgactcactatagggttgacggcttcttcactcattggctctagtaacagaggagaactagaatgaatgagtgaaacctggcggcagcgcaaaagatg

SEQ ID NO: 711 - DNA, 103 bp, Artificial Sequence
  Synthetic Polynucleotide
taatacgactcactatagggtatttattggtttgactgagccagaaacaaaacagaggagattgtttatggctcagtcaaacctggcggcagcgcaaaagatg

SEQ ID NO: 712 - DNA, 103 bp, Artificial Sequence
  Synthetic Polynucleotide
taatacgactcactatagggacgtgttgacggcttcttcactcattggctaacagaggagaagccaaatggtgaagaagaacctggcggcagcgcaaaagatg

SEQ ID NO: 713 - DNA, 103 bp, Artificial Sequence
  Synthetic Polynucleotide
taatacgactcactatagggaggtaacgtgttgacggcttcttcactcataacagaggagaatgagtatggaagccgtcaacctggcggcagcgcaaaagatg

SEQ ID NO: 714 - DNA, 103 bp, Artificial Sequence
  Synthetic Polynucleotide
taatacgactcactatagggtgggaaggtaacgtgttgacggcttcttcaaacagaggagatgaagaatgcgtcaacacaacctggcggcagcgcaaaagatg

SEQ ID NO: 715 - DNA, 103 bp, Artificial Sequence
  Synthetic Polynucleotide
taatacgactcactatagggtaaggtgggaaggtaacgtgttgacggcttaacagaggagaaagccgatgacacgttacaacctggcggcagcgcaaaagatg

SEQ ID NO: 716 - DNA, 103 bp, Artificial Sequence
  Synthetic Polynucleotide
taatacgactcactataggggtcattaaggtgggaaggtaacgtgttgacaacagaggagagtcaacatgttaccttccaacctggcggcagcgcaaaagatg

SEQ ID NO: 717 - DNA, 103 bp, Artificial Sequence
  Synthetic Polynucleotide
taatacgactcactatagggtacttgtcattaaggtgggaaggtaacgtgaacagaggagacacgttatgttcccacctaacctggcggcagcgcaaaagatg

SEQ ID NO: 718 - DNA, 103 bp, Artificial Sequence
  Synthetic Polynucleotide
taatacgactcactatagggtaccatacttgtcattaaggtgggaaggtaaacagaggagataccttatgaccttaatgaacctggcggcagcgcaaaagatg

SEQ ID NO: 719 - DNA, 103 bp, Artificial Sequence
  Synthetic Polynucleotide
taatacgactcactatagggagtaataccatacttgtcattaaggtgggaaacagaggagatcccacatgaatgacaagaacctggcggcagcgcaaaagatg

SEQ ID NO: 720 - DNA, 103 bp, Artificial Sequence
  Synthetic Polynucleotide
taatacgactcactatagggtaacaagtaataccatacttgtcattaaggaacagaggagaccttaaatgcaagtatggaacctggcggcagcgcaaaagatg

SEQ ID NO: 721 - DNA, 103 bp, Artificial Sequence
  Synthetic Polynucleotide
taatacgactcactatagggtaacataacaagtaataccatacttgtcataacagaggagaatgacaatgatggtattaaacctggcggcagcgcaaaagatg

SEQ ID NO: 722 - DNA, 103 bp, Artificial Sequence
  Synthetic Polynucleotide
taatacgactcactatagggcaaagtatttattggtttgactgagccagaaacagaggagatctggcatggtcaaaccaaacctggcggcagcgcaaaagatg

SEQ ID NO: 723 - DNA, 103 bp, Artificial Sequence
  Synthetic Polynucleotide
taatacgactcactatagggggtaataacataacaagtaataccatacttaacagaggagaaagtatatgattacttgtaacctggcggcagcgcaaaagatg

SEQ ID NO: 724 - DNA, 103 bp, Artificial Sequence
  Synthetic Polynucleotide
taatacgactcactataggggctttggtaataacataacaagtaataccaaacagaggagatggtatatgttgttatgtaacctggcggcagcgcaaaagatg

SEQ ID NO: 725 - DNA, 103 bp, Artificial Sequence
  Synthetic Polynucleotide
taatacgactcactatagggtatcagctttggtaataacataacaagtaaaacagaggagattacttatgatgttattaaacctggcggcagcgcaaaagatg

SEQ ID NO: 726 - DNA, 103 bp, Artificial Sequence
  Synthetic Polynucleotide
taatacgactcactatagggttccatatcagctttggtaataacataacaaacagaggagatgttatatgattaccaaaaacctggcggcagcgcaaaagatg

SEQ ID NO: 727 - DNA, 103 bp, Artificial Sequence
  Synthetic Polynucleotide
taatacgactcactatagggagggcttccatatcagctttggtaataacaaacagaggagatgttatatgcaaagctgaaacctggcggcagcgcaaaagatg

SEQ ID NO: 728 - DNA, 103 bp, Artificial Sequence
  Synthetic Polynucleotide
taatacgactcactatagggtagctagggcttccatatcagctttggtaaaacagaggagattaccaatgctgatatggaacctggcggcagcgcaaaagatg

SEQ ID NO: 729 - DNA, 103 bp, Artificial Sequence
  Synthetic Polynucleotide
taatacgactcactatagggatctttagctagggcttccatatcagctttaacagaggagaaaagctatgatggaagccaacctggcggcagcgcaaaagatg

SEQ ID NO: 730 - DNA, 103 bp, Artificial Sequence
  Synthetic Polynucleotide
taatacgactcactatagggtgcaaatctttagctagggcttccatatcaaacagaggagatgatatatgagccctagcaacctggcggcagcgcaaaagatg

SEQ ID NO: 731 - DNA, 103 bp, Artificial Sequence
  Synthetic Polynucleotide
taatacgactcactatagggatttttgcaaatctttagctagggcttccaaacagaggagatggaagatgtagctaaagaacctggcggcagcgcaaaagatg

SEQ ID NO: 732 - DNA, 103 bp, Artificial Sequence
  Synthetic Polynucleotide
taatacgactcactatagggctggtatttttgcaaatctttagctagggcaacagaggagagccctaatgaaagatttgaacctggcggcagcgcaaaagatg

SEQ ID NO: 733 - DNA, 103 bp, Artificial Sequence
  Synthetic Polynucleotide
taatacgactcactatagggttcaccaaagtatttattggtttgactgagaacagaggagactcagtatgaccaataaaaacctggcggcagcgcaaaagatg

SEQ ID NO: 734 - DNA, 103 bp, Artificial Sequence
  Synthetic Polynucleotide
taatacgactcactataggggccatctggtatttttgcaaatctttagctaacagaggagaagctaaatgtttgcaaaaaacctggcggcagcgcaaaagatg

SEQ ID NO: 735 - DNA, 103 bp, Artificial Sequence
  Synthetic Polynucleotide
taatacgactcactatagggcaacagccatctggtatttttgcaaatcttaacagaggagaaagattatgaaaaataccaacctggcggcagcgcaaaagatg

SEQ ID NO: 736 - DNA, 103 bp, Artificial Sequence
  Synthetic Polynucleotide
taatacgactcactatagggatcttcaacagccatctggtatttttgcaaaacagaggagattgcaaatgtaccagatgaacctggcggcagcgcaaaagatg

SEQ ID NO: 737 - DNA, 103 bp, Artificial Sequence
  Synthetic Polynucleotide
taatacgactcactatagggatcttatcttcaacagccatctggtattttaacagaggagaaaaataatggatggctgtaacctggcggcagcgcaaaagatg

SEQ ID NO: 738 - DNA, 103 bp, Artificial Sequence
  Synthetic Polynucleotide
taatacgactcactatagggccttgatcttatcttcaacagccatctggtaacagaggagaaccagaatgctgttgaagaacctggcggcagcgcaaaagatg

SEQ ID NO: 739 - DNA, 103 bp, Artificial Sequence
  Synthetic Polynucleotide
taatacgactcactatagggatttgccttgatcttatcttcaacagccataacagaggagaatggctatggaagataagaacctggcggcagcgcaaaagatg

SEQ ID NO: 740 - DNA, 103 bp, Artificial Sequence
  Synthetic Polynucleotide
taatacgactcactatagggataacatttgccttgatcttatcttcaacaaacagaggagatgttgaatgtaagatcaaaacctggcggcagcgcaaaagatg

SEQ ID NO: 741 - DNA, 103 bp, Artificial Sequence
  Synthetic Polynucleotide
taatacgactcactatagggccctaataacatttgccttgatcttatcttaacagaggagaaagataatgtcaaggcaaaacctggcggcagcgcaaaagatg

SEQ ID NO: 742 - DNA, 103 bp, Artificial Sequence
  Synthetic Polynucleotide
taatacgactcactatagggttgccccctaataacatttgccttgatcttaacagaggagaaagatcatggcaaatgttaacctggcggcagcgcaaaagatg

SEQ ID NO: 743 - DNA, 103 bp, Artificial Sequence
  Synthetic Polynucleotide
taatacgactcactatagggatccattgccccctaataacatttgccttgaacagaggagacaaggcatgtgttattagaacctggcggcagcgcaaaagatg

SEQ ID NO: 744 - DNA, 103 bp, Artificial Sequence
  Synthetic Polynucleotide
taatacgactcactatagggagcactccatggctaccccccagatgccaaaacagaggagattggcaatgggggggtagaacctggcggcagcgcaaaagatg

SEQ ID NO: 745 - DNA, 103 bp, Artificial Sequence
  Synthetic Polynucleotide
taatacgactcactatagggcagttttcaccaaagtatttattggtttgaaacagaggagatcaaacatgtaaatacttaacctggcggcagcgcaaaagatg

SEQ ID NO: 746 - DNA, 103 bp, Artificial Sequence
  Synthetic Polynucleotide
taatacgactcactatagggcttccatccattgccccctaataacatttgaacagaggagacaaatgatgttagggggcaacctggcggcagcgcaaaagatg

SEQ ID NO: 747 - DNA, 103 bp, Artificial Sequence
  Synthetic Polynucleotide
taatacgactcactatagggaacaccttccatccattgccccctaataacaacagaggagagttattatggggcaatggaacctggcggcagcgcaaaagatg

SEQ ID NO: 748 - DNA, 103 bp, Artificial Sequence
  Synthetic Polynucleotide
taatacgactcactatagggggatcaacaccttccatccattgccccctaaacagaggagataggggatgatggatggaaacctggcggcagcgcaaaagatg

SEQ ID NO: 749 - DNA, 103 bp, Artificial Sequence
  Synthetic Polynucleotide
taatacgactcactatagggttttaggatcaacaccttccatccattgccaacagaggagaggcaatatgtggaaggtgaacctggcggcagcgcaaaagatg

SEQ ID NO: 750 - DNA, 103 bp, Artificial Sequence
  Synthetic Polynucleotide
taatacgactcactataggggaccgttttaggatcaacaccttccatccaaacagaggagatggatgatgggtgttgataacctggcggcagcgcaaaagatg

SEQ ID NO: 751 - DNA, 103 bp, Artificial Sequence
  Synthetic Polynucleotide
taatacgactcactatagggttgatgaccgttttaggatcaacaccttccaacagaggagaggaaggatgtgatcctaaaacctggcggcagcgcaaaagatg

SEQ ID NO: 752 - DNA, 103 bp, Artificial Sequence
  Synthetic Polynucleotide
taatacgactcactataggggctcattgatgaccgttttaggatcaacacaacagaggagagtgttgatgctaaaacggaacctggcggcagcgcaaaagatg

SEQ ID NO: 753 - DNA, 103 bp, Artificial Sequence
  Synthetic Polynucleotide
taatacgactcactatagggatcaagctcattgatgaccgttttaggatcaacagaggagagatcctatgacggtcatcaacctggcggcagcgcaaaagatg

SEQ ID NO: 754 - DNA, 103 bp, Artificial Sequence
  Synthetic Polynucleotide
taatacgactcactatagggaattcatcaagctcattgatgaccgttttaaacagaggagataaaacatgcatcaatgaaacctggcggcagcgcaaaagatg

SEQ ID NO: 755 - DNA, 103 bp, Artificial Sequence
  Synthetic Polynucleotide
taatacgactcactatagggaccacaattcatcaagctcattgatgaccgaacagaggagacggtcaatgatgagcttgaacctggcggcagcgcaaaagatg

SEQ ID NO: 756 - DNA, 103 bp, Artificial Sequence
  Synthetic Polynucleotide
taatacgactcactatagggatagacagttttcaccaaagtatttattggaacagaggagaccaataatgactttggtgaacctggcggcagcgcaaaagatg

SEQ ID NO: 757 - DNA, 103 bp, Artificial Sequence
  Synthetic Polynucleotide
taatacgactcactatagggtcccaaccacaattcatcaagctcattgataacagaggagaatcaatatgcttgatgaaaacctggcggcagcgcaaaagatg

SEQ ID NO: 758 - DNA, 103 bp, Artificial Sequence
  Synthetic Polynucleotide
taatacgactcactatagggttaattcccaaccacaattcatcaagctcaaacagaggagatgagctatgtgaattgtgaacctggcggcagcgcaaaagatg

SEQ ID NO: 759 - DNA, 103 bp, Artificial Sequence
  Synthetic Polynucleotide
taatacgactcactatagggtatgattaattcccaaccacaattcatcaaaacagaggagattgatgatgtgtggttggaacctggcggcagcgcaaaagatg

SEQ ID NO: 760 - DNA, 103 bp, Artificial Sequence
  Synthetic Polynucleotide
taatacgactcactatagggcatgatatgattaattcccaaccacaattcaacagaggagagaattgatgttgggaattaacctggcggcagcgcaaaagatg

SEQ ID NO: 761 - DNA, 103 bp, Artificial Sequence
  Synthetic Polynucleotide
taatacgactcactatagggtcccacatgatatgattaattcccaaccacaacagaggagagtggttatgaattaatcaaacctggcggcagcgcaaaagatg

SEQ ID NO: 762 - DNA, 103 bp, Artificial Sequence
  Synthetic Polynucleotide
taatacgactcactatagggcattctcccacatgatatgattaattcccaaacagaggagatgggaaatgatcatatcaaacctggcggcagcgcaaaagatg

SEQ ID NO: 763 - DNA, 103 bp, Artificial Sequence
  Synthetic Polynucleotide
taatacgactcactatagggcaaaccattctcccacatgatatgattaataacagaggagaattaatatgatcatgtggaacctggcggcagcgcaaaagatg

SEQ ID NO: 764 - DNA, 103 bp, Artificial Sequence
  Synthetic Polynucleotide
taatacgactcactatagggggaaccaaaccattctcccacatgatatgaaacagaggagatcatatatggtgggagaaaacctggcggcagcgcaaaagatg

SEQ ID NO: 765 - DNA, 103 bp, Artificial Sequence
  Synthetic Polynucleotide
taatacgactcactatagggtaaatggaaccaaaccattctcccacatgaaacagaggagatcatgtatgagaatggttaacctggcggcagcgcaaaagatg

SEQ ID NO: 766 - DNA, 103 bp, Artificial Sequence
  Synthetic Polynucleotide
taatacgactcactatagggctgtgtaaatggaaccaaaccattctcccaaacagaggagatgggagatgggtttggttaacctggcggcagcgcaaaagatg

SEQ ID NO: 767 - DNA, 103 bp, Artificial Sequence
  Synthetic Polynucleotide
taatacgactcactataggggatacatagacagttttcaccaaagtatttaacagaggagaaaatacatgggtgaaaacaacctggcggcagcgcaaaagatg

SEQ ID NO: 768 - DNA, 103 bp, Artificial Sequence
  Synthetic Polynucleotide
taatacgactcactatagggttcctctgtgtaaatggaaccaaaccattcaacagaggagagaatggatgggttccattaacctggcggcagcgcaaaagatg

SEQ ID NO: 769 - DNA, 103 bp, Artificial Sequence
  Synthetic Polynucleotide
taatacgactcactatagggttttcttcctctgtgtaaatggaaccaaacaacagaggagagtttggatgcatttacacaacctggcggcagcgcaaaagatg

SEQ ID NO: 770 - DNA, 103 bp, Artificial Sequence
  Synthetic Polynucleotide
taatacgactcactataggggtttattttcttcctctgtgtaaatggaacaacagaggagagttccaatgacacagaggaacctggcggcagcgcaaaagatg

SEQ ID NO: 771 - DNA, 103 bp, Artificial Sequence
  Synthetic Polynucleotide
taatacgactcactatagggcgcctgtttattttcttcctctgtgtaaataacagaggagaatttacatggaggaagaaaacctggcggcagcgcaaaagatg

SEQ ID NO: 772 - DNA, 103 bp, Artificial Sequence
  Synthetic Polynucleotide
taatacgactcactataggggcttacgcctgtttattttcttcctctgtgaacagaggagacacagaatgagaaaataaaacctggcggcagcgcaaaagatg

SEQ ID NO: 773 - DNA, 103 bp, Artificial Sequence
  Synthetic Polynucleotide
taatacgactcactatagggtgcctgcttacgcctgtttattttcttcctaacagaggagaaggaagatgataaacaggaacctggcggcagcgcaaaagatg

SEQ ID NO: 774 - DNA, 103 bp, Artificial Sequence
  Synthetic Polynucleotide
taatacgactcactatagggttttttgcctgcttacgcctgtttattttcaacagaggagagaaaatatgcaggcgtaaaacctggcggcagcgcaaaagatg

SEQ ID NO: 775 - DNA, 103 bp, Artificial Sequence
  Synthetic Polynucleotide
taatacgactcactatagggtcaagttttttgcctgcttacgcctgtttaaacagaggagataaacaatggtaagcaggaacctggcggcagcgcaaaagatg

SEQ ID NO: 776 - DNA, 103 bp, Artificial Sequence
  Synthetic Polynucleotide
taatacgactcactatagggccccttcaagttttttgcctgcttacgcctaacagaggagaaggcgtatgcaggcaaaaaacctggcggcagcgcaaaagatg

SEQ ID NO: 777 - DNA, 103 bp, Artificial Sequence
  Synthetic Polynucleotide
taatacgactcactataggggggccccccttcaagttttttgcctgcttaaacagaggagataagcaatgaaaaaacttaacctggcggcagcgcaaaagatg

SEQ ID NO: 778 - DNA, 103 bp, Artificial Sequence
  Synthetic Polynucleotide
taatacgactcactatagggcacctgatacatagacagttttcaccaaagaacagaggagactttggatgaaactgtctaacctggcggcagcgcaaaagatg

SEQ ID NO: 779 - DNA, 103 bp, Artificial Sequence
  Synthetic Polynucleotide
taatacgactcactatagggtcctggggccccccttcaagttttttgcctaacagaggagaaggcaaatgacttgaaggaacctggcggcagcgcaaaagatg

SEQ ID NO: 780 - DNA, 103 bp, Artificial Sequence
  Synthetic Polynucleotide
taatacgactcactatagggccccatcctggggccccccttcaagtttttaacagaggagaaaaaacatgaaggggggcaacctggcggcagcgcaaaagatg

SEQ ID NO: 781 - DNA, 103 bp, Artificial Sequence
  Synthetic Polynucleotide
taatacgactcactatagggtggggccccatcctggggccccccttcaagaacagaggagacttgaaatggggccccagaacctggcggcagcgcaaaagatg

SEQ ID NO: 782 - DNA, 103 bp, Artificial Sequence
  Synthetic Polynucleotide
taatacgactcactatagggtctgttggggccccatcctggggcccccctaacagaggagaagggggatgccaggatggaacctggcggcagcgcaaaagatg

SEQ ID NO: 783 - DNA, 103 bp, Artificial Sequence
  Synthetic Polynucleotide
taatacgactcactatagggggtcttctgttggggccccatcctggggccaacagaggagaggccccatgatggggcccaacctggcggcagcgcaaaagatg

SEQ ID NO: 784 - DNA, 103 bp, Artificial Sequence
  Synthetic Polynucleotide
taatacgactcactatagggtaattggtcttctgttggggccccatcctgaacagaggagacaggatatggccccaacaaacctggcggcagcgcaaaagatg

SEQ ID NO: 785 - DNA, 103 bp, Artificial Sequence
  Synthetic Polynucleotide
taatacgactcactatagggaaccttaattggtcttctgttggggccccaaacagaggagatggggcatgaacagaagaaacctggcggcagcgcaaaagatg

SEQ ID NO: 786 - DNA, 103 bp, Artificial Sequence
  Synthetic Polynucleotide
taatacgactcactatagggagtccaaccttaattggtcttctgttggggaacagaggagaccccaaatgaagaccaataacctggcggcagcgcaaaagatg

SEQ ID NO: 787 - DNA, 103 bp, Artificial Sequence
  Synthetic Polynucleotide
taatacgactcactatagggccaatagtccaaccttaattggtcttctgtaacagaggagaacagaaatgcaattaaggaacctggcggcagcgcaaaagatg

SEQ ID NO: 788 - DNA, 103 bp, Artificial Sequence
  Synthetic Polynucleotide
taatacgactcactatagggcgttcccaatagtccaaccttaattggtctaacagaggagaagaccaatgaaggttggaaacctggcggcagcgcaaaagatg

SEQ ID NO: 789 - DNA, 103 bp, Artificial Sequence
  Synthetic Polynucleotide
taatacgactcactatagggctggacacctgatacatagacagttttcacaacagaggagagtgaaaatggtctatgtaaacctggcggcagcgcaaaagatg

SEQ ID NO: 790 - DNA, 103 bp, Artificial Sequence
  Synthetic Polynucleotide
taatacgactcactataggggtaggcgttcccaatagtccaaccttaattaacagaggagaaattaaatgtggactattaacctggcggcagcgcaaaagatg

SEQ ID NO: 791 - DNA, 103 bp, Artificial Sequence
  Synthetic Polynucleotide
taatacgactcactatagggttcaagtaggcgttcccaatagtccaacctaacagaggagaaggttgatgtattgggaaaacctggcggcagcgcaaaagatg

SEQ ID NO: 792 - DNA, 103 bp, Artificial Sequence
  Synthetic Polynucleotide
taatacgactcactatagggccaggttcaagtaggcgttcccaatagtccaacagaggagaggactaatgggaacgcctaacctggcggcagcgcaaaagatg

SEQ ID NO: 793 - DNA, 103 bp, Artificial Sequence
  Synthetic Polynucleotide
taatacgactcactatagggaatctccaggttcaagtaggcgttcccaataacagaggagaattgggatggcctacttgaacctggcggcagcgcaaaagatg

SEQ ID NO: 794 - DNA, 103 bp, Artificial Sequence
  Synthetic Polynucleotide
taatacgactcactataggggaaataatctccaggttcaagtaggcgttcaacagaggagagaacgcatgcttgaacctaacctggcggcagcgcaaaagatg

SEQ ID NO: 795 - DNA, 103 bp, Artificial Sequence
  Synthetic Polynucleotide
taatacgactcactataggggttaggaaataatctccaggttcaagtaggaacagaggagacctactatgacctggagaaacctggcggcagcgcaaaagatg

SEQ ID NO: 796 - DNA, 103 bp, Artificial Sequence
  Synthetic Polynucleotide
taatacgactcactatagggaaggtgttaggaaataatctccaggttcaaaacagaggagattgaacatggagattattaacctggcggcagcgcaaaagatg

SEQ ID NO: 797 - DNA, 103 bp, Artificial Sequence
  Synthetic Polynucleotide
taatacgactcactatagggtgtggaaggtgttaggaaataatctccaggaacagaggagacctggaatgtatttcctaaacctggcggcagcgcaaaagatg

SEQ ID NO: 798 - DNA, 103 bp, Artificial Sequence
  Synthetic Polynucleotide
taatacgactcactatagggggatatgtggaaggtgttaggaaataatctaacagaggagaagattaatgcctaacaccaacctggcggcagcgcaaaagatg

SEQ ID NO: 799 - DNA, 103 bp, Artificial Sequence
  Synthetic Polynucleotide
taatacgactcactatagggtcaatggatatgtggaaggtgttaggaaataacagaggagaatttccatgcaccttccaaacctggcggcagcgcaaaagatg

SEQ ID NO: 800 - DNA, 103 bp, Artificial Sequence
  Synthetic Polynucleotide
taatacgactcactatagggcctgcctggacacctgatacatagacagttaacagaggagaaactgtatgtgtatcaggaacctggcggcagcgcaaaagatg

SEQ ID NO: 801 - DNA, 103 bp, Artificial Sequence
  Synthetic Polynucleotide
taatacgactcactatagggtccaatcaatggatatgtggaaggtgttagaacagaggagactaacaatgtccacatataacctggcggcagcgcaaaagatg

SEQ ID NO: 802 - DNA, 103 bp, Artificial Sequence
  Synthetic Polynucleotide
taatacgactcactatagggaaaactccaatcaatggatatgtggaaggtaacagaggagaaccttcatgatatccattaacctggcggcagcgcaaaagatg

SEQ ID NO: 803 - DNA, 103 bp, Artificial Sequence
  Synthetic Polynucleotide
taatacgactcactatagggttggcaaaactccaatcaatggatatgtggaacagaggagaccacatatgcattgattgaacctggcggcagcgcaaaagatg

SEQ ID NO: 804 - DNA, 103 bp, Artificial Sequence
  Synthetic Polynucleotide
taatacgactcactatagggatcaattggcaaaactccaatcaatggataaacagaggagatatccaatgattggagttaacctggcggcagcgcaaaagatg

SEQ ID NO: 805 - DNA, 103 bp, Artificial Sequence
  Synthetic Polynucleotide
taatacgactcactatagggggacgatcaattggcaaaactccaatcaataacagaggagaattgatatgagttttgccaacctggcggcagcgcaaaagatg

SEQ ID NO: 806 - DNA, 103 bp, Artificial Sequence
  Synthetic Polynucleotide
taatacgactcactatagggtaattggacgatcaattggcaaaactccaaaacagaggagattggagatgtgccaattgaacctggcggcagcgcaaaagatg

SEQ ID NO: 807 - DNA, 103 bp, Artificial Sequence
  Synthetic Polynucleotide
taatacgactcactatagggatcactaattggacgatcaattggcaaaacaacagaggagagttttgatgattgatcgtaacctggcggcagcgcaaaagatg

SEQ ID NO: 808 - DNA, 103 bp, Artificial Sequence
  Synthetic Polynucleotide
taatacgactcactatagggtcataatcactaattggacgatcaattggcaacagaggagagccaatatgtcgtccaataacctggcggcagcgcaaaagatg

SEQ ID NO: 809 - DNA, 103 bp, Artificial Sequence
  Synthetic Polynucleotide
taatacgactcactataggggttcatcataatcactaattggacgatcaaaacagaggagattgatcatgcaattagtgaacctggcggcagcgcaaaagatg

SEQ ID NO: 810 - DNA, 103 bp, Artificial Sequence
  Synthetic Polynucleotide
taatacgactcactatagggtattggttcatcataatcactaattggacgaacagaggagacgtccaatgagtgattataacctggcggcagcgcaaaagatg

SEQ ID NO: 811 - DNA, 103 bp, Artificial Sequence
  Synthetic Polynucleotide
taatacgactcactatagggcattacctgcctggacacctgatacatagaaacagaggagatctatgatgcaggtgtccaacctggcggcagcgcaaaagatg

SEQ ID NO: 812 - DNA, 103 bp, Artificial Sequence
  Synthetic Polynucleotide
taatacgactcactatagggtcatctattggttcatcataatcactaattaacagaggagaaattagatgttatgatgaaacctggcggcagcgcaaaagatg

SEQ ID NO: 813 - DNA, 103 bp, Artificial Sequence
  Synthetic Polynucleotide
taatacgactcactatagggataaatcatctattggttcatcataatcacaacagaggagagtgattatgatgaaccaaaacctggcggcagcgcaaaagatg

SEQ ID NO: 814 - DNA, 103 bp, Artificial Sequence
  Synthetic Polynucleotide
taatacgactcactatagggatttaataaatcatctattggttcatcataaacagaggagatatgatatgccaatagataacctggcggcagcgcaaaagatg

SEQ ID NO: 815 - DNA, 103 bp, Artificial Sequence
  Synthetic Polynucleotide
taatacgactcactatagggaacaaatttaataaatcatctattggttcaaacagaggagatgaaccatgagatgatttaacctggcggcagcgcaaaagatg

SEQ ID NO: 816 - DNA, 103 bp, Artificial Sequence
  Synthetic Polynucleotide
taatacgactcactatagggttggcaacaaatttaataaatcatctattgaacagaggagacaatagatgatttattaaaacctggcggcagcgcaaaagatg

SEQ ID NO: 817 - DNA, 103 bp, Artificial Sequence
  Synthetic Polynucleotide
taatacgactcactatagggataatttggcaacaaatttaataaatcatcaacagaggagagatgatatgttaaatttgaacctggcggcagcgcaaaagatg

SEQ ID NO: 818 - DNA, 103 bp, Artificial Sequence
  Synthetic Polynucleotide
taatacgactcactatagggtcatcataatttggcaacaaatttaataaaaacagaggagatttattatgtttgttgccaacctggcggcagcgcaaaagatg

SEQ ID NO: 819 - DNA, 103 bp, Artificial Sequence
  Synthetic Polynucleotide
taatacgactcactatagggtctcatcatcataatttggcaacaaatttaaacagaggagataaattatgtgccaaattaacctggcggcagcgcaaaagatg

SEQ ID NO: 820 - DNA, 103 bp, Artificial Sequence
  Synthetic Polynucleotide
taatacgactcactatagggagcaatctcatcatcataatttggcaacaaaacagaggagattgttgatgaattatgataacctggcggcagcgcaaaagatg

SEQ ID NO: 821 - DNA, 103 bp, Artificial Sequence
  Synthetic Polynucleotide
taatacgactcactatagggccataagcaatctcatcatcataatttggcaacagaggagagccaaaatgtgatgatgaaacctggcggcagcgcaaaagatg

SEQ ID NO: 822 - DNA, 103 bp, Artificial Sequence
  Synthetic Polynucleotide
taatacgactcactatagggataatcattacctgcctggacacctgatacaacagaggagagtatcaatggtccaggcaaacctggcggcagcgcaaaagatg

SEQ ID NO: 823 - DNA, 103 bp, Artificial Sequence
  Synthetic Polynucleotide
taatacgactcactatagggttggaccataagcaatctcatcatcataataacagaggagaattatgatgatgagattgaacctggcggcagcgcaaaagatg

SEQ ID NO: 824 - DNA, 103 bp, Artificial Sequence
  Synthetic Polynucleotide
taatacgactcactatagggcactgttggaccataagcaatctcatcatcaacagaggagagatgatatgattgcttataacctggcggcagcgcaaaagatg

SEQ ID NO: 825 - DNA, 103 bp, Artificial Sequence
  Synthetic Polynucleotide
taatacgactcactatagggccccacactgttggaccataagcaatctcaaacagaggagatgagatatgttatggtccaacctggcggcagcgcaaaagatg

SEQ ID NO: 826 - DNA, 103 bp, Artificial Sequence
  Synthetic Polynucleotide
taatacgactcactatagggctggaccccacactgttggaccataagcaaaacagaggagattgcttatggtccaacagaacctggcggcagcgcaaaagatg

SEQ ID NO: 827 - DNA, 103 bp, Artificial Sequence
  Synthetic Polynucleotide
taatacgactcactatagggagcctctggaccccacactgttggaccataaacagaggagatatggtatgacagtgtggaacctggcggcagcgcaaaagatg

SEQ ID NO: 828 - DNA, 103 bp, Artificial Sequence
  Synthetic Polynucleotide
taatacgactcactatagggctataagcctctggaccccacactgttggaaacagaggagatccaacatggtggggtccaacctggcggcagcgcaaaagatg

SEQ ID NO: 829 - DNA, 103 bp, Artificial Sequence
  Synthetic Polynucleotide
taatacgactcactatagggattttctataagcctctggaccccacactgaacagaggagacagtgtatggtccagaggaacctggcggcagcgcaaaagatg

SEQ ID NO: 830 - DNA, 103 bp, Artificial Sequence
  Synthetic Polynucleotide
taatacgactcactatagggaaaagattttctataagcctctggaccccaaacagaggagatggggtatggaggcttataacctggcggcagcgcaaaagatg

SEQ ID NO: 831 - DNA, 103 bp, Artificial Sequence
  Synthetic Polynucleotide
taatacgactcactatagggttttgaaaagattttctataagcctctggaaacagaggagatccagaatgttatagaaaaacctggcggcagcgcaaaagatg

SEQ ID NO: 832 - DNA, 103 bp, Artificial Sequence
  Synthetic Polynucleotide
taatacgactcactatagggtaaatttttgaaaagattttctataagcctaacagaggagaaggcttatggaaaatcttaacctggcggcagcgcaaaagatg

SEQ ID NO: 833 - DNA, 103 bp, Artificial Sequence
  Synthetic Polynucleotide
taatacgactcactataggggttacataatcattacctgcctggacacctaacagaggagaaggtgtatgggcaggtaaaacctggcggcagcgcaaaagatg

SEQ ID NO: 834 - DNA, 103 bp, Artificial Sequence
  Synthetic Polynucleotide
taatacgactcactatagggatatgtaaatttttgaaaagattttctataaacagaggagatatagaatgtcttttcaaaacctggcggcagcgcaaaagatg

SEQ ID NO: 835 - DNA, 103 bp, Artificial Sequence
  Synthetic Polynucleotide
taatacgactcactatagggtccttatatgtaaatttttgaaaagattttaacagaggagaaaaatcatgtcaaaaattaacctggcggcagcgcaaaagatg

SEQ ID NO: 836 - DNA, 103 bp, Artificial Sequence
  Synthetic Polynucleotide
taatacgactcactataggggtggttccttatatgtaaatttttgaaaagaacagaggagacttttcatgaatttacataacctggcggcagcgcaaaagatg

SEQ ID NO: 837 - DNA, 103 bp, Artificial Sequence
  Synthetic Polynucleotide
taatacgactcactatagggttcctgtggttccttatatgtaaatttttgaacagaggagacaaaaaatgacatataagaacctggcggcagcgcaaaagatg

SEQ ID NO: 838 - DNA, 103 bp, Artificial Sequence
  Synthetic Polynucleotide
taatacgactcactatagggatattttcctgtggttccttatatgtaaataacagaggagaatttacatgtaaggaaccaacctggcggcagcgcaaaagatg

SEQ ID NO: 839 - DNA, 103 bp, Artificial Sequence
  Synthetic Polynucleotide
taatacgactcactatagggattcaatattttcctgtggttccttatatgaacagaggagacatataatgaaccacaggaacctggcggcagcgcaaaagatg

SEQ ID NO: 840 - DNA, 103 bp, Artificial Sequence
  Synthetic Polynucleotide
taatacgactcactatagggatttaattcaatattttcctgtggttccttaacagaggagaaaggaaatgcaggaaaataacctggcggcagcgcaaaagatg

SEQ ID NO: 841 - DNA, 103 bp, Artificial Sequence
  Synthetic Polynucleotide
taatacgactcactatagggggataatttaattcaatattttcctgtggtaacagaggagaaccacaatgaaatattgaaacctggcggcagcgcaaaagatg

SEQ ID NO: 842 - DNA, 103 bp, Artificial Sequence
  Synthetic Polynucleotide
taatacgactcactatagggctctaggataatttaattcaatattttcctaacagaggagaaggaaaatgttgaattaaaacctggcggcagcgcaaaagatg

SEQ ID NO: 843 - DNA, 103 bp, Artificial Sequence
  Synthetic Polynucleotide
taatacgactcactatagggccactctctaggataatttaattcaatattaacagaggagaaatattatgttaaattataacctggcggcagcgcaaaagatg

SEQ ID NO: 844 - DNA, 103 bp, Artificial Sequence
  Synthetic Polynucleotide
taatacgactcactatagggaaaaggttacataatcattacctgcctggaaacagaggagatccaggatggtaatgattaacctggcggcagcgcaaaagatg

SEQ ID NO: 845 - DNA, 103 bp, Artificial Sequence
  Synthetic Polynucleotide
taatacgactcactatagggaacttccactctctaggataatttaattcaaacagaggagatgaattatgttatcctagaacctggcggcagcgcaaaagatg

SEQ ID NO: 846 - DNA, 103 bp, Artificial Sequence
  Synthetic Polynucleotide
taatacgactcactatagggttgcaaacttccactctctaggataatttaaacagaggagataaattatgctagagagtaacctggcggcagcgcaaaagatg

SEQ ID NO: 847 - DNA, 103 bp, Artificial Sequence
  Synthetic Polynucleotide
taatacgactcactatagggcctcattgcaaacttccactctctaggataaacagaggagatatcctatggagtggaagaacctggcggcagcgcaaaagatg

SEQ ID NO: 848 - DNA, 103 bp, Artificial Sequence
  Synthetic Polynucleotide
taatacgactcactatagggagaaccctcattgcaaacttccactctctaaacagaggagatagagaatggaagtttgcaacctggcggcagcgcaaaagatg

SEQ ID NO: 849 - DNA, 103 bp, Artificial Sequence
  Synthetic Polynucleotide
taatacgactcactatagggttctaagaaccctcattgcaaacttccactaacagaggagaagtggaatgttgcaatgaaacctggcggcagcgcaaaagatg

SEQ ID NO: 850 - DNA, 103 bp, Artificial Sequence
  Synthetic Polynucleotide
taatacgactcactatagggttctcttctaagaaccctcattgcaaacttaacagaggagaaagtttatgatgagggttaacctggcggcagcgcaaaagatg

SEQ ID NO: 851 - DNA, 103 bp, Artificial Sequence
  Synthetic Polynucleotide
taatacgactcactatagggtcatattctcttctaagaaccctcattgcaaacagaggagatgcaatatgggttcttagaacctggcggcagcgcaaaagatg

SEQ ID NO: 852 - DNA, 103 bp, Artificial Sequence
  Synthetic Polynucleotide
taatacgactcactataggggaaaatcatattctcttctaagaaccctcaaacagaggagatgagggatgttagaagagaacctggcggcagcgcaaaagatg

SEQ ID NO: 853 - DNA, 103 bp, Artificial Sequence
  Synthetic Polynucleotide
taatacgactcactatagggtacaagaaaatcatattctcttctaagaacaacagaggagagttcttatgagagaatataacctggcggcagcgcaaaagatg

SEQ ID NO: 854 - DNA, 103 bp, Artificial Sequence
  Synthetic Polynucleotide
taatacgactcactataggggtgtctacaagaaaatcatattctcttctaaacagaggagatagaagatgatatgatttaacctggcggcagcgcaaaagatg

SEQ ID NO: 855 - DNA, 103 bp, Artificial Sequence
  Synthetic Polynucleotide
taatacgactcactataggggtatgagcactccatggctaccccccagataacagaggagaatctggatggtagccatgaacctggcggcagcgcaaaagatg

SEQ ID NO: 856 - DNA, 103 bp, Artificial Sequence
  Synthetic Polynucleotide
taatacgactcactataggggaagcaaaaggttacataatcattacctgcaacagaggagagcaggtatggattatgtaaacctggcggcagcgcaaaagatg

SEQ ID NO: 857 - DNA, 103 bp, Artificial Sequence
  Synthetic Polynucleotide
taatacgactcactataggggttgtgtgtctacaagaaaatcatattctcaacagaggagagagaatatgattttcttgaacctggcggcagcgcaaaagatg

SEQ ID NO: 858 - DNA, 103 bp, Artificial Sequence
  Synthetic Polynucleotide
taatacgactcactatagggagtcagttgtgtgtctacaagaaaatcataaacagaggagatatgatatgcttgtagacaacctggcggcagcgcaaaagatg

SEQ ID NO: 859 - DNA, 103 bp, Artificial Sequence
  Synthetic Polynucleotide
taatacgactcactatagggatatcagtcagttgtgtgtctacaagaaaaaacagaggagattttctatgagacacacaaacctggcggcagcgcaaaagatg

SEQ ID NO: 860 - DNA, 103 bp, Artificial Sequence
  Synthetic Polynucleotide
taatacgactcactatagggcagtgatatcagtcagttgtgtgtctacaaaacagaggagattgtagatgcacaactgaaacctggcggcagcgcaaaagatg

SEQ ID NO: 861 - DNA, 103 bp, Artificial Sequence
  Synthetic Polynucleotide
taatacgactcactatagggtgttgcagtgatatcagtcagttgtgtgtcaacagaggagagacacaatgctgactgataacctggcggcagcgcaaaagatg

SEQ ID NO: 862 - DNA, 103 bp, Artificial Sequence
  Synthetic Polynucleotide
taatacgactcactatagggtttgatgttgcagtgatatcagtcagttgtaacagaggagaacaactatgtgatatcacaacctggcggcagcgcaaaagatg

SEQ ID NO: 863 - DNA, 103 bp, Artificial Sequence
  Synthetic Polynucleotide
taatacgactcactatagggagttctttgatgttgcagtgatatcagtcaaacagaggagatgactgatgtcactgcaaaacctggcggcagcgcaaaagatg

SEQ ID NO: 864 - DNA, 103 bp, Artificial Sequence
  Synthetic Polynucleotide
taatacgactcactataggggtcagagttctttgatgttgcagtgatatcaacagaggagagatatcatggcaacatcaaacctggcggcagcgcaaaagatg

SEQ ID NO: 865 - DNA, 103 bp, Artificial Sequence
  Synthetic Polynucleotide
taatacgactcactataggggttgagtcagagttctttgatgttgcagtgaacagaggagacactgcatgatcaaagaaaacctggcggcagcgcaaaagatg

SEQ ID NO: 866 - DNA, 103 bp, Artificial Sequence
  Synthetic Polynucleotide
taatacgactcactatagggatgcggttgagtcagagttctttgatgttgaacagaggagacaacatatgagaactctgaacctggcggcagcgcaaaagatg

SEQ ID NO: 867 - DNA, 103 bp, Artificial Sequence
  Synthetic Polynucleotide
taatacgactcactatagggggcttgaagcaaaaggttacataatcattaaacagaggagataatgaatgtgtaaccttaacctggcggcagcgcaaaagatg

SEQ ID NO: 868 - DNA, 103 bp, Artificial Sequence
  Synthetic Polynucleotide
taatacgactcactataggggtatgatgcggttgagtcagagttctttgaaacagaggagatcaaagatgtctgactcaaacctggcggcagcgcaaaagatg

SEQ ID NO: 869 - DNA, 103 bp, Artificial Sequence
  Synthetic Polynucleotide
taatacgactcactatagggtttgggtatgatgcggttgagtcagagttcaacagaggagagaactcatgctcaaccgcaacctggcggcagcgcaaaagatg

SEQ ID NO: 870 - DNA, 103 bp, Artificial Sequence
  Synthetic Polynucleotide
taatacgactcactatagggagcattttgggtatgatgcggttgagtcagaacagaggagactgactatgccgcatcataacctggcggcagcgcaaaagatg

SEQ ID NO: 871 - DNA, 103 bp, Artificial Sequence
  Synthetic Polynucleotide
taatacgactcactatagggccacaagcattttgggtatgatgcggttgaaacagaggagatcaaccatgtcatacccaaacctggcggcagcgcaaaagatg

SEQ ID NO: 872 - DNA, 103 bp, Artificial Sequence
  Synthetic Polynucleotide
taatacgactcactatagggttccaccacaagcattttgggtatgatgcgaacagaggagacgcatcatgcccaaaatgaacctggcggcagcgcaaaagatg

SEQ ID NO: 873 - DNA, 103 bp, Artificial Sequence
  Synthetic Polynucleotide
taatacgactcactatagggccgttttccaccacaagcattttgggtatgaacagaggagacataccatgaatgcttgtaacctggcggcagcgcaaaagatg

SEQ ID NO: 874 - DNA, 103 bp, Artificial Sequence
  Synthetic Polynucleotide
taatacgactcactatagggtgactccgttttccaccacaagcattttggaacagaggagaccaaaaatgttgtggtggaacctggcggcagcgcaaaagatg

SEQ ID NO: 875 - DNA, 103 bp, Artificial Sequence
  Synthetic Polynucleotide
taatacgactcactatagggtactctgactccgttttccaccacaagcataacagaggagaatgcttatggtggaaaacaacctggcggcagcgcaaaagatg

SEQ ID NO: 876 - DNA, 103 bp, Artificial Sequence
  Synthetic Polynucleotide
taatacgactcactatagggttagatactctgactccgttttccaccacaaacagaggagatgtggtatgaaacggagtaacctggcggcagcgcaaaagatg

SEQ ID NO: 877 - DNA, 103 bp, Artificial Sequence
  Synthetic Polynucleotide
taatacgactcactatagggatcttttagatactctgactccgttttccaaacagaggagatggaaaatggagtcagagaacctggcggcagcgcaaaagatg

SEQ ID NO: 878 - DNA, 103 bp, Artificial Sequence
  Synthetic Polynucleotide
taatacgactcactatagggcgcctggcttgaagcaaaaggttacataataacagaggagaattatgatgccttttgctaacctggcggcagcgcaaaagatg

SEQ ID NO: 879 - DNA, 103 bp, Artificial Sequence
  Synthetic Polynucleotide
taatacgactcactatagggccacgatcttttagatactctgactccgttaacagaggagaaacggaatgagagtatctaacctggcggcagcgcaaaagatg

SEQ ID NO: 880 - DNA, 103 bp, Artificial Sequence
  Synthetic Polynucleotide
taatacgactcactatagggtataaccacgatcttttagatactctgactaacagaggagaagtcagatgatctaaaagaacctggcggcagcgcaaaagatg

SEQ ID NO: 881 - DNA, 103 bp, Artificial Sequence
  Synthetic Polynucleotide
taatacgactcactatagggatctttataaccacgatcttttagatactcaacagaggagagagtatatgaaagatcgtaacctggcggcagcgcaaaagatg

SEQ ID NO: 882 - DNA, 103 bp, Artificial Sequence
  Synthetic Polynucleotide
taatacgactcactatagggatataatctttataaccacgatcttttagaaacagaggagatctaaaatgtcgtggttaaacctggcggcagcgcaaaagatg

SEQ ID NO: 883 - DNA, 103 bp, Artificial Sequence
  Synthetic Polynucleotide
taatacgactcactataggggttggatataatctttataaccacgatcttaacagaggagaaagatcatggttataaagaacctggcggcagcgcaaaagatg

SEQ ID NO: 884 - DNA, 103 bp, Artificial Sequence
  Synthetic Polynucleotide
taatacgactcactatagggaaattgttggatataatctttataaccacgaacagaggagacgtggtatgaaagattataacctggcggcagcgcaaaagatg

SEQ ID NO: 885 - DNA, 103 bp, Artificial Sequence
  Synthetic Polynucleotide
taatacgactcactataggggagtcaaattgttggatataatctttataaaacagaggagattataaatgttatatccaaacctggcggcagcgcaaaagatg

SEQ ID NO: 886 - DNA, 103 bp, Artificial Sequence
  Synthetic Polynucleotide
taatacgactcactatagggaaatagagtcaaattgttggatataatcttaacagaggagaaagattatgtccaacaataacctggcggcagcgcaaaagatg

SEQ ID NO: 887 - DNA, 103 bp, Artificial Sequence
  Synthetic Polynucleotide
taatacgactcactatagggattcaaaatagagtcaaattgttggatataaacagaggagatatatcatgcaatttgacaacctggcggcagcgcaaaagatg

SEQ ID NO: 888 - DNA, 103 bp, Artificial Sequence
  Synthetic Polynucleotide
taatacgactcactatagggtcaccattcaaaatagagtcaaattgttggaacagaggagaccaacaatgtgactctataacctggcggcagcgcaaaagatg

SEQ ID NO: 889 - DNA, 103 bp, Artificial Sequence
  Synthetic Polynucleotide
taatacgactcactataggggtttacgcctggcttgaagcaaaaggttacaacagaggagagtaaccatgtgcttcaagaacctggcggcagcgcaaaagatg

SEQ ID NO: 890 - DNA, 103 bp, Artificial Sequence
  Synthetic Polynucleotide
taatacgactcactataggggtctttcaccattcaaaatagagtcaaattaacagaggagaaatttgatgctattttgaaacctggcggcagcgcaaaagatg

SEQ ID NO: 891 - DNA, 103 bp, Artificial Sequence
  Synthetic Polynucleotide
taatacgactcactatagggtttaggtctttcaccattcaaaatagagtcaacagaggagagactctatgttgaatggtaacctggcggcagcgcaaaagatg

SEQ ID NO: 892 - DNA, 103 bp, Artificial Sequence
  Synthetic Polynucleotide
taatacgactcactatagggaaaactttaggtctttcaccattcaaaataaacagaggagatattttatgtggtgaaagaacctggcggcagcgcaaaagatg

SEQ ID NO: 893 - DNA, 103 bp, Artificial Sequence
  Synthetic Polynucleotide
taatacgactcactatagggaccacaaaactttaggtctttcaccattcaaacagaggagatgaatgatgaaagacctaaacctggcggcagcgcaaaagatg

SEQ ID NO: 894 - DNA, 103 bp, Artificial Sequence
  Synthetic Polynucleotide
taatacgactcactatagggaagataccacaaaactttaggtctttcaccaacagaggagaggtgaaatgcctaaagttaacctggcggcagcgcaaaagatg

SEQ ID NO: 895 - DNA, 103 bp, Artificial Sequence
  Synthetic Polynucleotide
taatacgactcactatagggaagaaaagataccacaaaactttaggtcttaacagaggagaaagaccatgagttttgtgaacctggcggcagcgcaaaagatg

SEQ ID NO: 896 - DNA, 103 bp, Artificial Sequence
  Synthetic Polynucleotide
taatacgactcactatagggtcttcaagaaaagataccacaaaactttagaacagaggagactaaagatgtgtggtatcaacctggcggcagcgcaaaagatg

SEQ ID NO: 897 - DNA, 103 bp, Artificial Sequence
  Synthetic Polynucleotide
taatacgactcactatagggctctttcttcaagaaaagataccacaaaacaacagaggagagttttgatgtatcttttcaacctggcggcagcgcaaaagatg

SEQ ID NO: 898 - DNA, 103 bp, Artificial Sequence
  Synthetic Polynucleotide
taatacgactcactatagggtgtatctctttcttcaagaaaagataccacaacagaggagagtggtaatgtttcttgaaaacctggcggcagcgcaaaagatg

SEQ ID NO: 899 - DNA, 103 bp, Artificial Sequence
  Synthetic Polynucleotide
taatacgactcactatagggatttttgtatctctttcttcaagaaaagataacagaggagaatctttatgtgaagaaagaacctggcggcagcgcaaaagatg

SEQ ID NO: 900 - DNA, 103 bp, Artificial Sequence
  Synthetic Polynucleotide
taatacgactcactatagggcattcgtttacgcctggcttgaagcaaaagaacagaggagacttttgatgcaagccaggaacctggcggcagcgcaaaagatg

SEQ ID NO: 901 - DNA, 103 bp, Artificial Sequence
  Synthetic Polynucleotide
taatacgactcactataggggctcaatttttgtatctctttcttcaagaaaacagaggagattcttgatgaaagagataaacctggcggcagcgcaaaagatg

SEQ ID NO: 902 - DNA, 103 bp, Artificial Sequence
  Synthetic Polynucleotide
taatacgactcactatagggatcttgctcaatttttgtatctctttcttcaacagaggagagaagaaatggatacaaaaaacctggcggcagcgcaaaagatg

SEQ ID NO: 903 - DNA, 103 bp, Artificial Sequence
  Synthetic Polynucleotide
taatacgactcactatagggcctctatcttgctcaatttttgtatctcttaacagaggagaaagagaatgaaaaattgaaacctggcggcagcgcaaaagatg

SEQ ID NO: 904 - DNA, 103 bp, Artificial Sequence
  Synthetic Polynucleotide
taatacgactcactatagggactttcctctatcttgctcaatttttgtataacagaggagaatacaaatgttgagcaagaacctggcggcagcgcaaaagatg

SEQ ID NO: 905 - DNA, 103 bp, Artificial Sequence
  Synthetic Polynucleotide
taatacgactcactatagggatatcactttcctctatcttgctcaattttaacagaggagaaaaattatgcaagatagaaacctggcggcagcgcaaaagatg

SEQ ID NO: 906 - DNA, 103 bp, Artificial Sequence
  Synthetic Polynucleotide
taatacgactcactataggggcctgatatcactttcctctatcttgctcaaacagaggagatgagcaatgtagaggaaaaacctggcggcagcgcaaaagatg

SEQ ID NO: 907 - DNA, 103 bp, Artificial Sequence
  Synthetic Polynucleotide
taatacgactcactatagggtatttgcctgatatcactttcctctatcttaacagaggagaaagataatggaaagtgataacctggcggcagcgcaaaagatg

SEQ ID NO: 908 - DNA, 103 bp, Artificial Sequence
  Synthetic Polynucleotide
taatacgactcactatagggcaaactatttgcctgatatcactttcctctaacagaggagaagaggaatgtgatatcagaacctggcggcagcgcaaaagatg

SEQ ID NO: 909 - DNA, 103 bp, Artificial Sequence
  Synthetic Polynucleotide
taatacgactcactatagggctgaacaaactatttgcctgatatcactttaacagaggagaaaagtgatgtcaggcaaaaacctggcggcagcgcaaaagatg

SEQ ID NO: 910 - DNA, 103 bp, Artificial Sequence
  Synthetic Polynucleotide
taatacgactcactatagggcgggtctgaacaaactatttgcctgatatcaacagaggagagatatcatgcaaatagttaacctggcggcagcgcaaaagatg

SEQ ID NO: 911 - DNA, 103 bp, Artificial Sequence
  Synthetic Polynucleotide
taatacgactcactatagggcaacccattcgtttacgcctggcttgaagcaacagaggagagcttcaatgcaggcgtaaaacctggcggcagcgcaaaagatg

SEQ ID NO: 912 - DNA, 103 bp, Artificial Sequence
  Synthetic Polynucleotide
taatacgactcactatagggaaaatcgggtctgaacaaactatttgcctgaacagaggagacaggcaatgagtttgttcaacctggcggcagcgcaaaagatg

SEQ ID NO: 913 - DNA, 103 bp, Artificial Sequence
  Synthetic Polynucleotide
taatacgactcactatagggtggcaaaaatcgggtctgaacaaactatttaacagaggagaaaatagatggttcagaccaacctggcggcagcgcaaaagatg

SEQ ID NO: 914 - DNA, 103 bp, Artificial Sequence
  Synthetic Polynucleotide
taatacgactcactatagggaattctggcaaaaatcgggtctgaacaaacaacagaggagagtttgtatggacccgattaacctggcggcagcgcaaaagatg

SEQ ID NO: 915 - DNA, 103 bp, Artificial Sequence
  Synthetic Polynucleotide
taatacgactcactatagggcaaccaattctggcaaaaatcgggtctgaaaacagaggagattcagaatggatttttgcaacctggcggcagcgcaaaagatg

SEQ ID NO: 916 - DNA, 103 bp, Artificial Sequence
  Synthetic Polynucleotide
taatacgactcactatagggaaacacaaccaattctggcaaaaatcgggtaacagaggagaacccgaatgttgccagaaaacctggcggcagcgcaaaagatg

SEQ ID NO: 917 - DNA, 103 bp, Artificial Sequence
  Synthetic Polynucleotide
taatacgactcactatagggttcgaaaacacaaccaattctggcaaaaataacagaggagaatttttatgagaattggtaacctggcggcagcgcaaaagatg

SEQ ID NO: 918 - DNA, 103 bp, Artificial Sequence
  Synthetic Polynucleotide
taatacgactcactatagggtgttcttcgaaaacacaaccaattctggcaaacagaggagatgccagatgtggttgtgtaacctggcggcagcgcaaaagatg

SEQ ID NO: 919 - DNA, 103 bp, Artificial Sequence
  Synthetic Polynucleotide
taatacgactcactatagggtttgatgttcttcgaaaacacaaccaattcaacagaggagagaattgatggtgttttcgaacctggcggcagcgcaaaagatg

SEQ ID NO: 920 - DNA, 103 bp, Artificial Sequence
  Synthetic Polynucleotide
taatacgactcactatagggctgattttgatgttcttcgaaaacacaaccaacagaggagaggttgtatgttcgaagaaaacctggcggcagcgcaaaagatg

SEQ ID NO: 921 - DNA, 103 bp, Artificial Sequence
  Synthetic Polynucleotide
taatacgactcactatagggatcagctgattttgatgttcttcgaaaacaaacagaggagatgttttatgagaacatcaaacctggcggcagcgcaaaagatg

SEQ ID NO: 922 - DNA, 103 bp, Artificial Sequence
  Synthetic Polynucleotide
taatacgactcactatagggaacttcaacccattcgtttacgcctggcttaacagaggagaaagccaatggtaaacgaaaacctggcggcagcgcaaaagatg

SEQ ID NO: 923 - DNA, 103 bp, Artificial Sequence
  Synthetic Polynucleotide
taatacgactcactatagggttttcatcagctgattttgatgttcttcgaaacagaggagatcgaagatgatcaaaatcaacctggcggcagcgcaaaagatg

SEQ ID NO: 924 - DNA, 103 bp, Artificial Sequence
  Synthetic Polynucleotide
taatacgactcactatagggtcgatttttcatcagctgattttgatgttcaacagaggagagaacatatgaatcagctgaacctggcggcagcgcaaaagatg

SEQ ID NO: 925 - DNA, 103 bp, Artificial Sequence
  Synthetic Polynucleotide
taatacgactcactatagggtttgttcgatttttcatcagctgattttgaaacagaggagatcaaaaatggctgatgaaaacctggcggcagcgcaaaagatg

SEQ ID NO: 926 - DNA, 103 bp, Artificial Sequence
  Synthetic Polynucleotide
taatacgactcactatagggttgtctttgttcgatttttcatcagctgataacagaggagaatcagcatgtgaaaaatcaacctggcggcagcgcaaaagatg

SEQ ID NO: 927 - DNA, 103 bp, Artificial Sequence
  Synthetic Polynucleotide
taatacgactcactatagggcattcttgtctttgttcgatttttcatcagaacagaggagactgatgatgaatcgaacaaacctggcggcagcgcaaaagatg

SEQ ID NO: 928 - DNA, 103 bp, Artificial Sequence
  Synthetic Polynucleotide
taatacgactcactatagggtggcccattcttgtctttgttcgatttttcaacagaggagagaaaaaatgaacaaagacaacctggcggcagcgcaaaagatg

SEQ ID NO: 929 - DNA, 103 bp, Artificial Sequence
  Synthetic Polynucleotide
taatacgactcactatagggcacattggcccattcttgtctttgttcgataacagaggagaatcgaaatgagacaagaaaacctggcggcagcgcaaaagatg

SEQ ID NO: 930 - DNA, 103 bp, Artificial Sequence
  Synthetic Polynucleotide
taatacgactcactatagggccatccacattggcccattcttgtctttgtaacagaggagaacaaagatgagaatgggcaacctggcggcagcgcaaaagatg

SEQ ID NO: 931 - DNA, 103 bp, Artificial Sequence
  Synthetic Polynucleotide
taatacgactcactatagggggcgaccatccacattggcccattcttgtcaacagaggagagacaagatggggccaatgaacctggcggcagcgcaaaagatg

SEQ ID NO: 932 - DNA, 103 bp, Artificial Sequence
  Synthetic Polynucleotide
taatacgactcactatagggaaaagggcgaccatccacattggcccattcaacagaggagagaatggatgaatgtggataacctggcggcagcgcaaaagatg

SEQ ID NO: 933 - DNA, 103 bp, Artificial Sequence
  Synthetic Polynucleotide
taatacgactcactatagggggctcaacttcaacccattcgtttacgcctaacagaggagaaggcgtatgcgaatgggtaacctggcggcagcgcaaaagatg

SEQ ID NO: 934 - DNA, 103 bp, Artificial Sequence
  Synthetic Polynucleotide
taatacgactcactataggggcctgaaaagggcgaccatccacattggccaacagaggagaggccaaatgggatggtcgaacctggcggcagcgcaaaagatg

SEQ ID NO: 935 - DNA, 103 bp, Artificial Sequence
  Synthetic Polynucleotide
taatacgactcactatagggaagccgcctgaaaagggcgaccatccacataacagaggagaatgtggatggtcgcccttaacctggcggcagcgcaaaagatg

SEQ ID NO: 936 - DNA, 103 bp, Artificial Sequence
  Synthetic Polynucleotide
taatacgactcactatagggagtggaagccgcctgaaaagggcgaccatcaacagaggagagatggtatgccttttcagaacctggcggcagcgcaaaagatg

SEQ ID NO: 937 - DNA, 103 bp, Artificial Sequence
  Synthetic Polynucleotide
taatacgactcactatagggccttgagtggaagccgcctgaaaagggcgaaacagaggagatcgcccatgtcaggcggcaacctggcggcagcgcaaaagatg

SEQ ID NO: 938 - DNA, 103 bp, Artificial Sequence
  Synthetic Polynucleotide
taatacgactcactataggggatatccttgagtggaagccgcctgaaaagaacagaggagacttttcatgcggcttccaaacctggcggcagcgcaaaagatg

SEQ ID NO: 939 - DNA, 103 bp, Artificial Sequence
  Synthetic Polynucleotide
taatacgactcactatagggagcgggatatccttgagtggaagccgcctgaacagaggagacaggcgatgtccactcaaaacctggcggcagcgcaaaagatg

SEQ ID NO: 940 - DNA, 103 bp, Artificial Sequence
  Synthetic Polynucleotide
taatacgactcactatagggaaccaagcgggatatccttgagtggaagccaacagaggagaggcttcatgtcaaggataaacctggcggcagcgcaaaagatg

SEQ ID NO: 941 - DNA, 103 bp, Artificial Sequence
  Synthetic Polynucleotide
taatacgactcactatagggttgtcaaccaagcgggatatccttgagtggaacagaggagaccactcatggatatcccgaacctggcggcagcgcaaaagatg

SEQ ID NO: 942 - DNA, 103 bp, Artificial Sequence
  Synthetic Polynucleotide
taatacgactcactatagggtgcctttgtcaaccaagcgggatatccttgaacagaggagacaaggaatgcccgcttggaacctggcggcagcgcaaaagatg

SEQ ID NO: 943 - DNA, 103 bp, Artificial Sequence
  Synthetic Polynucleotide
taatacgactcactatagggcctgttgcctttgtcaaccaagcgggatataacagaggagaatatccatgttggttgacaacctggcggcagcgcaaaagatg

SEQ ID NO: 944 - DNA, 103 bp, Artificial Sequence
  Synthetic Polynucleotide
taatacgactcactatagggtatcaggctcaacttcaacccattcgtttaaacagaggagataaacgatggggttgaagaacctggcggcagcgcaaaagatg

SEQ ID NO: 945 - DNA, 103 bp, Artificial Sequence
  Synthetic Polynucleotide
taatacgactcactatagggaagtgcctgttgcctttgtcaaccaagcggaacagaggagaccgcttatgtgacaaaggaacctggcggcagcgcaaaagatg

SEQ ID NO: 946 - DNA, 103 bp, Artificial Sequence
  Synthetic Polynucleotide
taatacgactcactatagggcgacaaagtgcctgttgcctttgtcaaccaaacagaggagatggttgatgaaggcaacaaacctggcggcagcgcaaaagatg

SEQ ID NO: 947 - DNA, 103 bp, Artificial Sequence
  Synthetic Polynucleotide
taatacgactcactatagggaaattcgacaaagtgcctgttgcctttgtcaacagaggagagacaaaatgaacaggcacaacctggcggcagcgcaaaagatg

SEQ ID NO: 948 - DNA, 103 bp, Artificial Sequence
  Synthetic Polynucleotide
taatacgactcactatagggcaatcaaattcgacaaagtgcctgttgcctaacagaggagaaggcaaatggcactttgtaacctggcggcagcgcaaaagatg

SEQ ID NO: 949 - DNA, 103 bp, Artificial Sequence
  Synthetic Polynucleotide
taatacgactcactatagggtcgtccaatcaaattcgacaaagtgcctgtaacagaggagaacaggcatgttgtcgaataacctggcggcagcgcaaaagatg

SEQ ID NO: 950 - DNA, 103 bp, Artificial Sequence
  Synthetic Polynucleotide
taatacgactcactatagggatatctcgtccaatcaaattcgacaaagtgaacagaggagacactttatggaatttgataacctggcggcagcgcaaaagatg

SEQ ID NO: 951 - DNA, 103 bp, Artificial Sequence
  Synthetic Polynucleotide
taatacgactcactatagggccatcatatctcgtccaatcaaattcgacaaacagaggagatgtcgaatgtgattggacaacctggcggcagcgcaaaagatg

SEQ ID NO: 952 - DNA, 103 bp, Artificial Sequence
  Synthetic Polynucleotide
taatacgactcactatagggttgtgccatcatatctcgtccaatcaaattaacagaggagaaatttgatgggacgagataacctggcggcagcgcaaaagatg

SEQ ID NO: 953 - DNA, 103 bp, Artificial Sequence
  Synthetic Polynucleotide
taatacgactcactatagggaggtattgtgccatcatatctcgtccaatcaacagaggagagattggatgagatatgataacctggcggcagcgcaaaagatg

SEQ ID NO: 954 - DNA, 103 bp, Artificial Sequence
  Synthetic Polynucleotide
taatacgactcactatagggtcattaggtattgtgccatcatatctcgtcaacagaggagagacgagatgtgatggcacaacctggcggcagcgcaaaagatg

SEQ ID NO: 955 - DNA, 103 bp, Artificial Sequence
  Synthetic Polynucleotide
taatacgactcactatagggatgaatatcaggctcaacttcaacccattcaacagaggagagaatggatggaagttgagaacctggcggcagcgcaaaagatg

SEQ ID NO: 956 - DNA, 103 bp, Artificial Sequence
  Synthetic Polynucleotide
taatacgactcactatagggacacctcattaggtattgtgccatcatatcaacagaggagagatatgatggcacaatacaacctggcggcagcgcaaaagatg

SEQ ID NO: 957 - DNA, 103 bp, Artificial Sequence
  Synthetic Polynucleotide
taatacgactcactatagggaattaacacctcattaggtattgtgccatcaacagaggagagatggcatgatacctaataacctggcggcagcgcaaaagatg

SEQ ID NO: 958 - DNA, 103 bp, Artificial Sequence
  Synthetic Polynucleotide
taatacgactcactatagggatagcaattaacacctcattaggtattgtgaacagaggagacacaatatgtaatgaggtaacctggcggcagcgcaaaagatg

SEQ ID NO: 959 - DNA, 103 bp, Artificial Sequence
  Synthetic Polynucleotide
taatacgactcactatagggttttgatagcaattaacacctcattaggtaaacagaggagatacctaatgaggtgttaaaacctggcggcagcgcaaaagatg

SEQ ID NO: 960 - DNA, 103 bp, Artificial Sequence
  Synthetic Polynucleotide
taatacgactcactatagggaaactttttgatagcaattaacacctcattaacagaggagaaatgagatgttaattgctaacctggcggcagcgcaaaagatg

SEQ ID NO: 961 - DNA, 103 bp, Artificial Sequence
  Synthetic Polynucleotide
taatacgactcactatagggtatctaaactttttgatagcaattaacaccaacagaggagaggtgttatgtgctatcaaaacctggcggcagcgcaaaagatg

SEQ ID NO: 962 - DNA, 103 bp, Artificial Sequence
  Synthetic Polynucleotide
taatacgactcactatagggaagaatatctaaactttttgatagcaattaaacagaggagataattgatgtcaaaaagtaacctggcggcagcgcaaaagatg

SEQ ID NO: 963 - DNA, 103 bp, Artificial Sequence
  Synthetic Polynucleotide
taatacgactcactatagggaaggcaagaatatctaaactttttgatagcaacagaggagagctatcatgaagtttagaaacctggcggcagcgcaaaagatg

SEQ ID NO: 964 - DNA, 103 bp, Artificial Sequence
  Synthetic Polynucleotide
taatacgactcactatagggtctgaaaggcaagaatatctaaactttttgaacagaggagacaaaaaatgtagatattcaacctggcggcagcgcaaaagatg

SEQ ID NO: 965 - DNA, 103 bp, Artificial Sequence
  Synthetic Polynucleotide
taatacgactcactatagggaatgatctgaaaggcaagaatatctaaactaacagaggagaagtttaatgattcttgccaacctggcggcagcgcaaaagatg

SEQ ID NO: 966 - DNA, 103 bp, Artificial Sequence
  Synthetic Polynucleotide
taatacgactcactatagggggcttgtatgagcactccatggctacccccaacagaggagagggggtatgcatggagtgaacctggcggcagcgcaaaagatg

SEQ ID NO: 967 - DNA, 103 bp, Artificial Sequence
  Synthetic Polynucleotide
taatacgactcactatagggggctgatgaatatcaggctcaacttcaaccaacagaggagaggttgaatgtgagcctgaaacctggcggcagcgcaaaagatg

SEQ ID NO: 968 - DNA, 103 bp, Artificial Sequence
  Synthetic Polynucleotide
taatacgactcactatagggtttgcaatgatctgaaaggcaagaatatctaacagaggagaagatatatgtgcctttcaaacctggcggcagcgcaaaagatg

SEQ ID NO: 969 - DNA, 103 bp, Artificial Sequence
  Synthetic Polynucleotide
taatacgactcactataggggcacttttgcaatgatctgaaaggcaagaaaacagaggagattcttgatgttcagatcaaacctggcggcagcgcaaaagatg

SEQ ID NO: 970 - DNA, 103 bp, Artificial Sequence
  Synthetic Polynucleotide
taatacgactcactatagggatttagcacttttgcaatgatctgaaaggcaacagaggagagcctttatgatcattgcaaacctggcggcagcgcaaaagatg

SEQ ID NO: 971 - DNA, 103 bp, Artificial Sequence
  Synthetic Polynucleotide
taatacgactcactatagggcagcaatttagcacttttgcaatgatctgaaacagaggagatcagatatgtgcaaaagtaacctggcggcagcgcaaaagatg

SEQ ID NO: 972 - DNA, 103 bp, Artificial Sequence
  Synthetic Polynucleotide
taatacgactcactataggggcatccagcaatttagcacttttgcaatgaaacagaggagatcattgatgaagtgctaaaacctggcggcagcgcaaaagatg

SEQ ID NO: 973 - DNA, 103 bp, Artificial Sequence
  Synthetic Polynucleotide
taatacgactcactatagggtgtaggcatccagcaatttagcacttttgcaacagaggagagcaaaaatgctaaattgcaacctggcggcagcgcaaaagatg

SEQ ID NO: 974 - DNA, 103 bp, Artificial Sequence
  Synthetic Polynucleotide
taatacgactcactatagggccacttgtaggcatccagcaatttagcactaacagaggagaagtgctatgttgctggataacctggcggcagcgcaaaagatg

SEQ ID NO: 975 - DNA, 103 bp, Artificial Sequence
  Synthetic Polynucleotide
taatacgactcactatagggcaataccacttgtaggcatccagcaatttaaacagaggagataaattatgggatgcctaaacctggcggcagcgcaaaagatg

SEQ ID NO: 976 - DNA, 103 bp, Artificial Sequence
  Synthetic Polynucleotide
taatacgactcactatagggtgtggcaataccacttgtaggcatccagcaaacagaggagatgctggatgcctacaagtaacctggcggcagcgcaaaagatg

SEQ ID NO: 977 - DNA, 103 bp, Artificial Sequence
  Synthetic Polynucleotide
taatacgactcactataggggatgttgtggcaataccacttgtaggcatcaacagaggagagatgccatgaagtggtataacctggcggcagcgcaaaagatg

SEQ ID NO: 978 - DNA, 103 bp, Artificial Sequence
  Synthetic Polynucleotide
taatacgactcactatagggctgtaggctgatgaatatcaggctcaacttaacagaggagaaagttgatgctgatattcaacctggcggcagcgcaaaagatg

SEQ ID NO: 979 - DNA, 103 bp, Artificial Sequence
  Synthetic Polynucleotide
taatacgactcactatagggtgcatgatgttgtggcaataccacttgtagaacagaggagactacaaatggtattgccaaacctggcggcagcgcaaaagatg

SEQ ID NO: 980 - DNA, 103 bp, Artificial Sequence
  Synthetic Polynucleotide
taatacgactcactatagggatctatgcatgatgttgtggcaataccactaacagaggagaagtggtatggccacaacaaacctggcggcagcgcaaaagatg

SEQ ID NO: 981 - DNA, 103 bp, Artificial Sequence
  Synthetic Polynucleotide
taatacgactcactataggggacatatctatgcatgatgttgtggcaataaacagaggagatattgcatgaacatcatgaacctggcggcagcgcaaaagatg

SEQ ID NO: 982 - DNA, 103 bp, Artificial Sequence
  Synthetic Polynucleotide
taatacgactcactatagggaacatgacatatctatgcatgatgttgtggaacagaggagaccacaaatgcatgcatagaacctggcggcagcgcaaaagatg

SEQ ID NO: 983 - DNA, 103 bp, Artificial Sequence
  Synthetic Polynucleotide
taatacgactcactatagggatggtaacatgacatatctatgcatgatgtaacagaggagaacatcaatgatagatatgaacctggcggcagcgcaaaagatg

SEQ ID NO: 984 - DNA, 103 bp, Artificial Sequence
  Synthetic Polynucleotide
taatacgactcactatagggaccagatggtaacatgacatatctatgcataacagaggagaatgcatatgtatgtcatgaacctggcggcagcgcaaaagatg

SEQ ID NO: 985 - DNA, 103 bp, Artificial Sequence
  Synthetic Polynucleotide
taatacgactcactatagggacttcaccagatggtaacatgacatatctaaacagaggagatagataatgcatgttaccaacctggcggcagcgcaaaagatg

SEQ ID NO: 986 - DNA, 103 bp, Artificial Sequence
  Synthetic Polynucleotide
taatacgactcactatagggttgttacttcaccagatggtaacatgacataacagaggagaatgtcaatgtaccatctgaacctggcggcagcgcaaaagatg

SEQ ID NO: 987 - DNA, 103 bp, Artificial Sequence
  Synthetic Polynucleotide
taatacgactcactatagggttgtattgttacttcaccagatggtaacataacagaggagaatgttaatgtctggtgaaaacctggcggcagcgcaaaagatg

SEQ ID NO: 988 - DNA, 103 bp, Artificial Sequence
  Synthetic Polynucleotide
taatacgactcactatagggcgattttgtattgttacttcaccagatggtaacagaggagaaccatcatgtgaagtaacaacctggcggcagcgcaaaagatg

SEQ ID NO: 989 - DNA, 103 bp, Artificial Sequence
  Synthetic Polynucleotide
taatacgactcactatagggaagtgctgtaggctgatgaatatcaggctcaacagaggagagagcctatgattcatcagaacctggcggcagcgcaaaagatg

SEQ ID NO: 990 - DNA, 103 bp, Artificial Sequence
  Synthetic Polynucleotide
taatacgactcactatagggttccccgattttgtattgttacttcaccagaacagaggagactggtgatgtaacaatacaacctggcggcagcgcaaaagatg

SEQ ID NO: 991 - DNA, 103 bp, Artificial Sequence
  Synthetic Polynucleotide
taatacgactcactataggggggatttccccgattttgtattgttacttcaacagaggagagaagtaatgatacaaaataacctggcggcagcgcaaaagatg

SEQ ID NO: 992 - DNA, 103 bp, Artificial Sequence
  Synthetic Polynucleotide
taatacgactcactatagggccagagggatttccccgattttgtattgttaacagaggagaaacaatatgaaatcggggaacctggcggcagcgcaaaagatg

SEQ ID NO: 993 - DNA, 103 bp, Artificial Sequence
  Synthetic Polynucleotide
taatacgactcactatagggtctggccagagggatttccccgattttgtaaacagaggagatacaaaatgggggaaatcaacctggcggcagcgcaaaagatg

SEQ ID NO: 994 - DNA, 103 bp, Artificial Sequence
  Synthetic Polynucleotide
taatacgactcactatagggggaaatctggccagagggatttccccgattaacagaggagaaatcggatgaatccctctaacctggcggcagcgcaaaagatg

SEQ ID NO: 995 - DNA, 103 bp, Artificial Sequence
  Synthetic Polynucleotide
taatacgactcactataggggttgtggaaatctggccagagggatttcccaacagaggagagggaaaatgctctggccaaacctggcggcagcgcaaaagatg

SEQ ID NO: 996 - DNA, 103 bp, Artificial Sequence
  Synthetic Polynucleotide
taatacgactcactatagggccatagttgtggaaatctggccagagggataacagaggagaatccctatggccagatttaacctggcggcagcgcaaaagatg

SEQ ID NO: 997 - DNA, 103 bp, Artificial Sequence
  Synthetic Polynucleotide
taatacgactcactataggggttgtccatagttgtggaaatctggccagaaacagaggagatctggcatgatttccacaaacctggcggcagcgcaaaagatg

SEQ ID NO: 998 - DNA, 103 bp, Artificial Sequence
  Synthetic Polynucleotide
taatacgactcactatagggatgttgttgtccatagttgtggaaatctggaacagaggagaccagatatgcacaactataacctggcggcagcgcaaaagatg

SEQ ID NO: 999 - DNA, 103 bp, Artificial Sequence
  Synthetic Polynucleotide
taatacgactcactatagggtgcacatgttgttgtccatagttgtggaaaaacagaggagatttccaatgctatggacaaacctggcggcagcgcaaaagatg

SEQ ID NO: 1000 - DNA, 103 bp, Artificial Sequence
  Synthetic Polynucleotide
taatacgactcactatagggccaacaagtgctgtaggctgatgaatatcaaacagaggagatgatatatgtcagcctacaacctggcggcagcgcaaaagatg

SEQ ID NO: 1001 - DNA, 103 bp, Artificial Sequence
  Synthetic Polynucleotide
taatacgactcactatagggcacattgcacatgttgttgtccatagttgtaacagaggagaacaactatggacaacaacaacctggcggcagcgcaaaagatg

SEQ ID NO: 1002 - DNA, 103 bp, Artificial Sequence
  Synthetic Polynucleotide
taatacgactcactatagggaagaacacattgcacatgttgttgtccataaacagaggagatatggaatgcaacatgtgaacctggcggcagcgcaaaagatg

SEQ ID NO: 1003 - DNA, 103 bp, Artificial Sequence
  Synthetic Polynucleotide
taatacgactcactatagggcctggaagaacacattgcacatgttgttgtaacagaggagaacaacaatgtgtgcaatgaacctggcggcagcgcaaaagatg

SEQ ID NO: 1004 - DNA, 103 bp, Artificial Sequence
  Synthetic Polynucleotide
taatacgactcactatagggaaatgcctggaagaacacattgcacatgttaacagaggagaaacatgatgaatgtgttcaacctggcggcagcgcaaaagatg

SEQ ID NO: 1005 - DNA, 103 bp, Artificial Sequence
  Synthetic Polynucleotide
taatacgactcactatagggtactcaaatgcctggaagaacacattgcacaacagaggagagtgcaaatggttcttccaaacctggcggcagcgcaaaagatg

SEQ ID NO: 1006 - DNA, 103 bp, Artificial Sequence
  Synthetic Polynucleotide
taatacgactcactatagggatgcatactcaaatgcctggaagaacacataacagaggagaatgtgtatgtccaggcataacctggcggcagcgcaaaagatg

SEQ ID NO: 1007 - DNA, 103 bp, Artificial Sequence
  Synthetic Polynucleotide
taatacgactcactatagggtatgaatgcatactcaaatgcctggaagaaaacagaggagattcttcatggcatttgagaacctggcggcagcgcaaaagatg

SEQ ID NO: 1008 - DNA, 103 bp, Artificial Sequence
  Synthetic Polynucleotide
taatacgactcactatagggggatgtatgaatgcatactcaaatgcctggaacagaggagaccaggcatgtgagtatgcaacctggcggcagcgcaaaagatg

SEQ ID NO: 1009 - DNA, 103 bp, Artificial Sequence
  Synthetic Polynucleotide
taatacgactcactatagggtgtttggatgtatgaatgcatactcaaatgaacagaggagacatttgatgatgcattcaaacctggcggcagcgcaaaagatg

SEQ ID NO: 1010 - DNA, 103 bp, Artificial Sequence
  Synthetic Polynucleotide
taatacgactcactatagggtgttttgtttggatgtatgaatgcatactcaacagaggagagagtatatgttcatacataacctggcggcagcgcaaaagatg

SEQ ID NO: 1011 - DNA, 103 bp, Artificial Sequence
  Synthetic Polynucleotide
taatacgactcactatagggaaacgccaacaagtgctgtaggctgatgaaaacagaggagattcatcatgctacagcacaacctggcggcagcgcaaaagatg

SEQ ID NO: 1012 - DNA, 103 bp, Artificial Sequence
  Synthetic Polynucleotide
taatacgactcactatagggtcaactgttttgtttggatgtatgaatgcaaacagaggagatgcattatgacatccaaaaacctggcggcagcgcaaaagatg

SEQ ID NO: 1013 - DNA, 103 bp, Artificial Sequence
  Synthetic Polynucleotide
taatacgactcactataggggctcttcaactgttttgtttggatgtatgaaacagaggagatcatacatgcaaacaaaaaacctggcggcagcgcaaaagatg

SEQ ID NO: 1014 - DNA, 103 bp, Artificial Sequence
  Synthetic Polynucleotide
taatacgactcactatagggacaaagctcttcaactgttttgtttggatgaacagaggagacatccaatgaaaacagttaacctggcggcagcgcaaaagatg

SEQ ID NO: 1015 - DNA, 103 bp, Artificial Sequence
  Synthetic Polynucleotide
taatacgactcactatagggatgtcacaaagctcttcaactgttttgtttaacagaggagaaaacaaatgagttgaagaaacctggcggcagcgcaaaagatg

SEQ ID NO: 1016 - DNA, 103 bp, Artificial Sequence
  Synthetic Polynucleotide
taatacgactcactatagggcccacatgtcacaaagctcttcaactgtttaacagaggagaaaacagatgaagagctttaacctggcggcagcgcaaaagatg

SEQ ID NO: 1017 - DNA, 103 bp, Artificial Sequence
  Synthetic Polynucleotide
taatacgactcactatagggtttatcccacatgtcacaaagctcttcaacaacagaggagagttgaaatgctttgtgacaacctggcggcagcgcaaaagatg

SEQ ID NO: 1018 - DNA, 103 bp, Artificial Sequence
  Synthetic Polynucleotide
taatacgactcactatagggtcgactttatcccacatgtcacaaagctctaacagaggagaagagctatgtgacatgtgaacctggcggcagcgcaaaagatg

SEQ ID NO: 1019 - DNA, 103 bp, Artificial Sequence
  Synthetic Polynucleotide
taatacgactcactataggggtgaatcgactttatcccacatgtcacaaaaacagaggagatttgtgatgtgtgggataaacctggcggcagcgcaaaagatg

SEQ ID NO: 1020 - DNA, 103 bp, Artificial Sequence
  Synthetic Polynucleotide
taatacgactcactatagggaattagtgaatcgactttatcccacatgtcaacagaggagagacatgatggataaagtcaacctggcggcagcgcaaaagatg

SEQ ID NO: 1021 - DNA, 103 bp, Artificial Sequence
  Synthetic Polynucleotide
taatacgactcactatagggccataaattagtgaatcgactttatcccacaacagaggagagtgggaatgagtcgattcaacctggcggcagcgcaaaagatg

SEQ ID NO: 1022 - DNA, 103 bp, Artificial Sequence
  Synthetic Polynucleotide
taatacgactcactatagggatacaaaacgccaacaagtgctgtaggctgaacagaggagacagcctatggcacttgttaacctggcggcagcgcaaaagatg

SEQ ID NO: 1023 - DNA, 103 bp, Artificial Sequence
  Synthetic Polynucleotide
taatacgactcactatagggcatcaccataaattagtgaatcgactttataacagaggagaataaagatgattcactaaaacctggcggcagcgcaaaagatg

SEQ ID NO: 1024 - DNA, 103 bp, Artificial Sequence
  Synthetic Polynucleotide
taatacgactcactatagggcctgtcatcaccataaattagtgaatcgacaacagaggagagtcgatatgctaatttataacctggcggcagcgcaaaagatg

SEQ ID NO: 1025 - DNA, 103 bp, Artificial Sequence
  Synthetic Polynucleotide
taatacgactcactataggggaaagcctgtcatcaccataaattagtgaaaacagaggagattcactatgttatggtgaaacctggcggcagcgcaaaagatg

SEQ ID NO: 1026 - DNA, 103 bp, Artificial Sequence
  Synthetic Polynucleotide
taatacgactcactatagggaagtggaaagcctgtcatcaccataaattaaacagaggagataatttatggtgatgacaaacctggcggcagcgcaaaagatg

SEQ ID NO: 1027 - DNA, 103 bp, Artificial Sequence
  Synthetic Polynucleotide
taatacgactcactatagggaggataagtggaaagcctgtcatcaccataaacagaggagatatggtatggacaggcttaacctggcggcagcgcaaaagatg

SEQ ID NO: 1028 - DNA, 103 bp, Artificial Sequence
  Synthetic Polynucleotide
taatacgactcactatagggaactcaggataagtggaaagcctgtcatcaaacagaggagatgatgaatggctttccacaacctggcggcagcgcaaaagatg

SEQ ID NO: 1029 - DNA, 103 bp, Artificial Sequence
  Synthetic Polynucleotide
taatacgactcactatagggcaggtaactcaggataagtggaaagcctgtaacagaggagaacaggcatgccacttatcaacctggcggcagcgcaaaagatg

SEQ ID NO: 1030 - DNA, 103 bp, Artificial Sequence
  Synthetic Polynucleotide
taatacgactcactataggggttatcaggtaactcaggataagtggaaagaacagaggagactttccatgtatcctgagaacctggcggcagcgcaaaagatg

SEQ ID NO: 1031 - DNA, 103 bp, Artificial Sequence
  Synthetic Polynucleotide
taatacgactcactatagggttatagttatcaggtaactcaggataagtgaacagaggagacacttaatgtgagttaccaacctggcggcagcgcaaaagatg

SEQ ID NO: 1032 - DNA, 103 bp, Artificial Sequence
  Synthetic Polynucleotide
taatacgactcactatagggtatccttatagttatcaggtaactcaggataacagaggagaatcctgatgtacctgataaacctggcggcagcgcaaaagatg

SEQ ID NO: 1033 - DNA, 103 bp, Artificial Sequence
  Synthetic Polynucleotide
taatacgactcactatagggtcctgatacaaaacgccaacaagtgctgtaaacagaggagatacagcatgtgttggcgtaacctggcggcagcgcaaaagatg

SEQ ID NO: 1034 - DNA, 103 bp, Artificial Sequence
  Synthetic Polynucleotide
taatacgactcactataggggacaatatccttatagttatcaggtaactcaacagaggagagagttaatggataactataacctggcggcagcgcaaaagatg

SEQ ID NO: 1035 - DNA, 103 bp, Artificial Sequence
  Synthetic Polynucleotide
taatacgactcactatagggctaatgacaatatccttatagttatcaggtaacagaggagaacctgaatgctataaggaaacctggcggcagcgcaaaagatg

SEQ ID NO: 1036 - DNA, 103 bp, Artificial Sequence
  Synthetic Polynucleotide
taatacgactcactatagggacatactaatgacaatatccttatagttataacagaggagaataactatgaggatattgaacctggcggcagcgcaaaagatg

SEQ ID NO: 1037 - DNA, 103 bp, Artificial Sequence
  Synthetic Polynucleotide
taatacgactcactatagggtgcatacatactaatgacaatatccttataaacagaggagatataagatgattgtcattaacctggcggcagcgcaaaagatg

SEQ ID NO: 1038 - DNA, 103 bp, Artificial Sequence
  Synthetic Polynucleotide
taatacgactcactatagggatgtctgcatacatactaatgacaatatccaacagaggagaggatatatgcattagtataacctggcggcagcgcaaaagatg

SEQ ID NO: 1039 - DNA, 103 bp, Artificial Sequence
  Synthetic Polynucleotide
taatacgactcactatagggcaaatatgtctgcatacatactaatgacaaaacagaggagattgtcaatggtatgtatgaacctggcggcagcgcaaaagatg

SEQ ID NO: 1040 - DNA, 103 bp, Artificial Sequence
  Synthetic Polynucleotide
taatacgactcactatagggcataccaaatatgtctgcatacatactaataacagaggagaattagtatgtatgcagacaacctggcggcagcgcaaaagatg

SEQ ID NO: 1041 - DNA, 103 bp, Artificial Sequence
  Synthetic Polynucleotide
taatacgactcactatagggacccacataccaaatatgtctgcatacataaacagaggagatatgtaatgagacatattaacctggcggcagcgcaaaagatg

SEQ ID NO: 1042 - DNA, 103 bp, Artificial Sequence
  Synthetic Polynucleotide
taatacgactcactataggggtttgacccacataccaaatatgtctgcataacagaggagaatgcagatgtatttggtaaacctggcggcagcgcaaaagatg

SEQ ID NO: 1043 - DNA, 103 bp, Artificial Sequence
  Synthetic Polynucleotide
taatacgactcactataggggtcaggtttgacccacataccaaatatgtcaacagaggagagacataatgggtatgtggaacctggcggcagcgcaaaagatg

SEQ ID NO: 1044 - DNA, 103 bp, Artificial Sequence
  Synthetic Polynucleotide
taatacgactcactatagggtgtactcctgatacaaaacgccaacaagtgaacagaggagacacttgatggcgttttgtaacctggcggcagcgcaaaagatg

SEQ ID NO: 1045 - DNA, 103 bp, Artificial Sequence
  Synthetic Polynucleotide
taatacgactcactatagggactttgtcaggtttgacccacataccaaataacagaggagaatttggatggtgggtcaaaacctggcggcagcgcaaaagatg

SEQ ID NO: 1046 - DNA, 103 bp, Artificial Sequence
  Synthetic Polynucleotide
taatacgactcactatagggctttaactttgtcaggtttgacccacatacaacagaggagagtatgtatgtcaaacctgaacctggcggcagcgcaaaagatg

SEQ ID NO: 1047 - DNA, 103 bp, Artificial Sequence
  Synthetic Polynucleotide
taatacgactcactatagggagaaactttaactttgtcaggtttgacccaaacagaggagatgggtcatgcctgacaaaaacctggcggcagcgcaaaagatg

SEQ ID NO: 1048 - DNA, 103 bp, Artificial Sequence
  Synthetic Polynucleotide
taatacgactcactataggggtgttagaaactttaactttgtcaggtttgaacagaggagacaaaccatgcaaagttaaaacctggcggcagcgcaaaagatg

SEQ ID NO: 1049 - DNA, 103 bp, Artificial Sequence
  Synthetic Polynucleotide
taatacgactcactatagggcaattgtgttagaaactttaactttgtcagaacagaggagactgacaatgttaaagtttaacctggcggcagcgcaaaagatg

SEQ ID NO: 1050 - DNA, 103 bp, Artificial Sequence
  Synthetic Polynucleotide
taatacgactcactatagggaccttcaattgtgttagaaactttaactttaacagaggagaaaagttatggtttctaacaacctggcggcagcgcaaaagatg

SEQ ID NO: 1051 - DNA, 103 bp, Artificial Sequence
  Synthetic Polynucleotide
taatacgactcactataggggtgagaccttcaattgtgttagaaactttaaacagaggagataaagtatgtaacacaataacctggcggcagcgcaaaagatg

SEQ ID NO: 1052 - DNA, 103 bp, Artificial Sequence
  Synthetic Polynucleotide
taatacgactcactatagggagaaagtgagaccttcaattgtgttagaaaaacagaggagatttctaatgcaattgaagaacctggcggcagcgcaaaagatg

SEQ ID NO: 1053 - DNA, 103 bp, Artificial Sequence
  Synthetic Polynucleotide
taatacgactcactatagggaccacagaaagtgagaccttcaattgtgttaacagaggagaaacacaatggaaggtctcaacctggcggcagcgcaaaagatg

SEQ ID NO: 1054 - DNA, 103 bp, Artificial Sequence
  Synthetic Polynucleotide
taatacgactcactataggggtaaaaccacagaaagtgagaccttcaattaacagaggagaaattgaatgtctcactttaacctggcggcagcgcaaaagatg

SEQ ID NO: 1055 - DNA, 103 bp, Artificial Sequence
  Synthetic Polynucleotide
taatacgactcactatagggcttcttgtactcctgatacaaaacgccaacaacagaggagagttggcatgttgtatcagaacctggcggcagcgcaaaagatg

SEQ ID NO: 1056 - DNA, 103 bp, Artificial Sequence
  Synthetic Polynucleotide
taatacgactcactatagggcaacagtaaaaccacagaaagtgagaccttaacagaggagaaaggtcatgctttctgtgaacctggcggcagcgcaaaagatg

SEQ ID NO: 1057 - DNA, 103 bp, Artificial Sequence
  Synthetic Polynucleotide
taatacgactcactatagggtttaacaacagtaaaaccacagaaagtgagaacagaggagactcactatgtgtggttttaacctggcggcagcgcaaaagatg

SEQ ID NO: 1058 - DNA, 103 bp, Artificial Sequence
  Synthetic Polynucleotide
taatacgactcactatagggttatctttaacaacagtaaaaccacagaaaaacagaggagatttctgatgttttactgtaacctggcggcagcgcaaaagatg

SEQ ID NO: 1059 - DNA, 103 bp, Artificial Sequence
  Synthetic Polynucleotide
taatacgactcactatagggtgttcttatctttaacaacagtaaaaccacaacagaggagagtggttatgctgttgttaaacctggcggcagcgcaaaagatg

SEQ ID NO: 1060 - DNA, 103 bp, Artificial Sequence
  Synthetic Polynucleotide
taatacgactcactatagggatacatgttcttatctttaacaacagtaaaaacagaggagatttactatggttaaagataacctggcggcagcgcaaaagatg

SEQ ID NO: 1061 - DNA, 103 bp, Artificial Sequence
  Synthetic Polynucleotide
taatacgactcactataggggggacatacatgttcttatctttaacaacaaacagaggagatgttgtatgagataagaaaacctggcggcagcgcaaaagatg

SEQ ID NO: 1062 - DNA, 103 bp, Artificial Sequence
  Synthetic Polynucleotide
taatacgactcactataggggaacagggacatacatgttcttatctttaaaacagaggagattaaagatgagaacatgtaacctggcggcagcgcaaaagatg

SEQ ID NO: 1063 - DNA, 103 bp, Artificial Sequence
  Synthetic Polynucleotide
taatacgactcactatagggagttggaacagggacatacatgttcttatcaacagaggagagataagatgatgtatgtcaacctggcggcagcgcaaaagatg

SEQ ID NO: 1064 - DNA, 103 bp, Artificial Sequence
  Synthetic Polynucleotide
taatacgactcactataggggtttcagttggaacagggacatacatgttcaacagaggagagaacatatgtgtccctgtaacctggcggcagcgcaaaagatg

SEQ ID NO: 1065 - DNA, 103 bp, Artificial Sequence
  Synthetic Polynucleotide
taatacgactcactatagggtttctgtttcagttggaacagggacatacaaacagaggagatgtatgatgctgttccaaaacctggcggcagcgcaaaagatg

SEQ ID NO: 1066 - DNA, 103 bp, Artificial Sequence
  Synthetic Polynucleotide
taatacgactcactataggggcaaccttcttgtactcctgatacaaaacgaacagaggagacgttttatgtcaggagtaaacctggcggcagcgcaaaagatg

SEQ ID NO: 1067 - DNA, 103 bp, Artificial Sequence
  Synthetic Polynucleotide
taatacgactcactatagggcagcttttctgtttcagttggaacagggacaacagaggagagtccctatgccaactgaaaacctggcggcagcgcaaaagatg

SEQ ID NO: 1068 - DNA, 103 bp, Artificial Sequence
  Synthetic Polynucleotide
taatacgactcactataggggcaatcagcttttctgtttcagttggaacaaacagaggagatgttccatgtgaaacagaaacctggcggcagcgcaaaagatg

SEQ ID NO: 1069 - DNA, 103 bp, Artificial Sequence
  Synthetic Polynucleotide
taatacgactcactatagggatccagcaatcagcttttctgtttcagttgaacagaggagacaactgatgcagaaaagcaacctggcggcagcgcaaaagatg

SEQ ID NO: 1070 - DNA, 103 bp, Artificial Sequence
  Synthetic Polynucleotide
taatacgactcactataggggaccaatccagcaatcagcttttctgtttcaacagaggagagaaacaatgaagctgattaacctggcggcagcgcaaaagatg

SEQ ID NO: 1071 - DNA, 103 bp, Artificial Sequence
  Synthetic Polynucleotide
taatacgactcactatagggggcttgaccaatccagcaatcagcttttctaacagaggagaagaaaaatggattgctggaacctggcggcagcgcaaaagatg

SEQ ID NO: 1072 - DNA, 103 bp, Artificial Sequence
  Synthetic Polynucleotide
taatacgactcactatagggttgttggcttgaccaatccagcaatcagctaacagaggagaagctgaatgctggattggaacctggcggcagcgcaaaagatg

SEQ ID NO: 1073 - DNA, 103 bp, Artificial Sequence
  Synthetic Polynucleotide
taatacgactcactatagggtttctttgttggcttgaccaatccagcaataacagaggagaattgctatgttggtcaagaacctggcggcagcgcaaaagatg

SEQ ID NO: 1074 - DNA, 103 bp, Artificial Sequence
  Synthetic Polynucleotide
taatacgactcactatagggggtaatttctttgttggcttgaccaatccaaacagaggagatggattatgcaagccaacaacctggcggcagcgcaaaagatg

SEQ ID NO: 1075 - DNA, 103 bp, Artificial Sequence
  Synthetic Polynucleotide
taatacgactcactatagggcatcaggtaatttctttgttggcttgaccaaacagaggagatggtcaatgcaacaaagaaacctggcggcagcgcaaaagatg

SEQ ID NO: 1076 - DNA, 103 bp, Artificial Sequence
  Synthetic Polynucleotide
taatacgactcactatagggaagaacatcaggtaatttctttgttggcttaacagaggagaaagccaatgaagaaattaaacctggcggcagcgcaaaagatg

SEQ ID NO: 1077 - DNA, 103 bp, Artificial Sequence
  Synthetic Polynucleotide
taatacgactcactatagggctttgggcttgtatgagcactccatggctaaacagaggagatagccaatgagtgctcataacctggcggcagcgcaaaagatg

SEQ ID NO: 1078 - DNA, 103 bp, Artificial Sequence
  Synthetic Polynucleotide
taatacgactcactatagggtggcagcaaccttcttgtactcctgatacaaacagaggagatgtatcatgagtacaagaaacctggcggcagcgcaaaagatg

SEQ ID NO: 1079 - DNA, 103 bp, Artificial Sequence
  Synthetic Polynucleotide
taatacgactcactatagggagcgaaagaacatcaggtaatttctttgttaacagaggagaaacaaaatgattacctgaaacctggcggcagcgcaaaagatg

SEQ ID NO: 1080 - DNA, 103 bp, Artificial Sequence
  Synthetic Polynucleotide
taatacgactcactatagggcatacagcgaaagaacatcaggtaatttctaacagaggagaagaaatatgctgatgttcaacctggcggcagcgcaaaagatg

SEQ ID NO: 1081 - DNA, 103 bp, Artificial Sequence
  Synthetic Polynucleotide
taatacgactcactatagggtttcccatacagcgaaagaacatcaggtaaaacagaggagattacctatggttctttcgaacctggcggcagcgcaaaagatg

SEQ ID NO: 1082 - DNA, 103 bp, Artificial Sequence
  Synthetic Polynucleotide
taatacgactcactatagggaggagtttcccatacagcgaaagaacatcaaacagaggagatgatgtatgttcgctgtaaacctggcggcagcgcaaaagatg

SEQ ID NO: 1083 - DNA, 103 bp, Artificial Sequence
  Synthetic Polynucleotide
taatacgactcactatagggagcaaaggagtttcccatacagcgaaagaaaacagaggagattctttatgtgtatgggaaacctggcggcagcgcaaaagatg

SEQ ID NO: 1084 - DNA, 103 bp, Artificial Sequence
  Synthetic Polynucleotide
taatacgactcactataggggcgatagcaaaggagtttcccatacagcgaaacagaggagatcgctgatggggaaactcaacctggcggcagcgcaaaagatg

SEQ ID NO: 1085 - DNA, 103 bp, Artificial Sequence
  Synthetic Polynucleotide
taatacgactcactatagggagtatgcgatagcaaaggagtttcccatacaacagaggagagtatggatgactcctttgaacctggcggcagcgcaaaagatg

SEQ ID NO: 1086 - DNA, 103 bp, Artificial Sequence
  Synthetic Polynucleotide
taatacgactcactatagggggctaagtatgcgatagcaaaggagtttccaacagaggagaggaaacatgtttgctatcaacctggcggcagcgcaaaagatg

SEQ ID NO: 1087 - DNA, 103 bp, Artificial Sequence
  Synthetic Polynucleotide
taatacgactcactatagggattgtggctaagtatgcgatagcaaaggagaacagaggagactccttatgtatcgcataaacctggcggcagcgcaaaagatg

SEQ ID NO: 1088 - DNA, 103 bp, Artificial Sequence
  Synthetic Polynucleotide
taatacgactcactatagggggcaaattgtggctaagtatgcgatagcaaaacagaggagattgctaatgcatacttagaacctggcggcagcgcaaaagatg

SEQ ID NO: 1089 - DNA, 103 bp, Artificial Sequence
  Synthetic Polynucleotide
taatacgactcactatagggttcactggcagcaaccttcttgtactcctgaacagaggagacaggagatgaagaaggttaacctggcggcagcgcaaaagatg

SEQ ID NO: 1090 - DNA, 103 bp, Artificial Sequence
  Synthetic Polynucleotide
taatacgactcactatagggcatctggcaaattgtggctaagtatgcgataacagaggagaatcgcaatgttagccacaaacctggcggcagcgcaaaagatg

SEQ ID NO: 1091 - DNA, 103 bp, Artificial Sequence
  Synthetic Polynucleotide
taatacgactcactataggggtggtcatctggcaaattgtggctaagtataacagaggagaatacttatgcacaatttgaacctggcggcagcgcaaaagatg

SEQ ID NO: 1092 - DNA, 103 bp, Artificial Sequence
  Synthetic Polynucleotide
taatacgactcactatagggaatttgtggtcatctggcaaattgtggctaaacagaggagatagccaatgtttgccagaaacctggcggcagcgcaaaagatg

SEQ ID NO: 1093 - DNA, 103 bp, Artificial Sequence
  Synthetic Polynucleotide
taatacgactcactatagggtcttaaatttgtggtcatctggcaaattgtaacagaggagaacaattatgcagatgaccaacctggcggcagcgcaaaagatg

SEQ ID NO: 1094 - DNA, 103 bp, Artificial Sequence
  Synthetic Polynucleotide
taatacgactcactatagggatagttcttaaatttgtggtcatctggcaaaacagaggagattgccaatggaccacaaaaacctggcggcagcgcaaaagatg

SEQ ID NO: 1095 - DNA, 103 bp, Artificial Sequence
  Synthetic Polynucleotide
taatacgactcactatagggaaaatatagttcttaaatttgtggtcatctaacagaggagaagatgaatgcaaatttaaaacctggcggcagcgcaaaagatg

SEQ ID NO: 1096 - DNA, 103 bp, Artificial Sequence
  Synthetic Polynucleotide
taatacgactcactatagggccaccaaaatatagttcttaaatttgtggtaacagaggagaaccacaatgttaagaactaacctggcggcagcgcaaaagatg

SEQ ID NO: 1097 - DNA, 103 bp, Artificial Sequence
  Synthetic Polynucleotide
taatacgactcactatagggtagcgccaccaaaatatagttcttaaatttaacagaggagaaaatttatgaactatattaacctggcggcagcgcaaaagatg

SEQ ID NO: 1098 - DNA, 103 bp, Artificial Sequence
  Synthetic Polynucleotide
taatacgactcactatagggacctctagcgccaccaaaatatagttcttaaacagaggagataagaaatgtattttggtaacctggcggcagcgcaaaagatg

SEQ ID NO: 1099 - DNA, 103 bp, Artificial Sequence
  Synthetic Polynucleotide
taatacgactcactatagggccactacctctagcgccaccaaaatatagtaacagaggagaactataatgtggtggcgcaacctggcggcagcgcaaaagatg

SEQ ID NO: 1100 - DNA, 103 bp, Artificial Sequence
  Synthetic Polynucleotide
taatacgactcactatagggtcttgttcactggcagcaaccttcttgtacaacagaggagagtacaaatgggttgctgcaacctggcggcagcgcaaaagatg

SEQ ID NO: 1101 - DNA, 103 bp, Artificial Sequence
  Synthetic Polynucleotide
taatacgactcactatagggcctagccactacctctagcgccaccaaaataacagaggagaattttgatggcgctagagaacctggcggcagcgcaaaagatg

SEQ ID NO: 1102 - DNA, 103 bp, Artificial Sequence
  Synthetic Polynucleotide
taatacgactcactatagggatatgcctagccactacctctagcgccaccaacagaggagaggtggcatgagaggtagtaacctggcggcagcgcaaaagatg

SEQ ID NO: 1103 - DNA, 103 bp, Artificial Sequence
  Synthetic Polynucleotide
taatacgactcactatagggcacgaatatgcctagccactacctctagcgaacagaggagacgctagatgtagtggctaaacctggcggcagcgcaaaagatg

SEQ ID NO: 1104 - DNA, 103 bp, Artificial Sequence
  Synthetic Polynucleotide
taatacgactcactatagggcgcagcacgaatatgcctagccactacctcaacagaggagagaggtaatggctaggcataacctggcggcagcgcaaaagatg

SEQ ID NO: 1105 - DNA, 103 bp, Artificial Sequence
  Synthetic Polynucleotide
taatacgactcactatagggcctcccgcagcacgaatatgcctagccactaacagaggagaagtggcatggcatattcgaacctggcggcagcgcaaaagatg

SEQ ID NO: 1106 - DNA, 103 bp, Artificial Sequence
  Synthetic Polynucleotide
taatacgactcactatagggcttcgcctcccgcagcacgaatatgcctagaacagaggagactaggcatgttcgtgctgaacctggcggcagcgcaaaagatg

SEQ ID NO: 1107 - DNA, 103 bp, Artificial Sequence
  Synthetic Polynucleotide
taatacgactcactataggggggctcttcgcctcccgcagcacgaatatgaacagaggagacatattatggctgcgggaaacctggcggcagcgcaaaagatg

SEQ ID NO: 1108 - DNA, 103 bp, Artificial Sequence
  Synthetic Polynucleotide
taatacgactcactatagggtgaaagggctcttcgcctcccgcagcacgaaacagaggagatcgtgcatggggaggcgaaacctggcggcagcgcaaaagatg

SEQ ID NO: 1109 - DNA, 103 bp, Artificial Sequence
  Synthetic Polynucleotide
taatacgactcactatagggtgatgtgaaagggctcttcgcctcccgcagaacagaggagactgcggatggcgaagagcaacctggcggcagcgcaaaagatg

SEQ ID NO: 1110 - DNA, 103 bp, Artificial Sequence
  Synthetic Polynucleotide
taatacgactcactataggggtccgtgatgtgaaagggctcttcgcctccaacagaggagaggaggcatggagccctttaacctggcggcagcgcaaaagatg

SEQ ID NO: 1111 - DNA, 103 bp, Artificial Sequence
  Synthetic Polynucleotide
taatacgactcactatagggtaagctcttgttcactggcagcaaccttctaacagaggagaagaaggatgctgccagtgaacctggcggcagcgcaaaagatg

SEQ ID NO: 1112 - DNA, 103 bp, Artificial Sequence
  Synthetic Polynucleotide
taatacgactcactatagggatggtgtccgtgatgtgaaagggctcttcgaacagaggagacgaagaatgctttcacataacctggcggcagcgcaaaagatg

SEQ ID NO: 1113 - DNA, 103 bp, Artificial Sequence
  Synthetic Polynucleotide
taatacgactcactatagggccagcatggtgtccgtgatgtgaaagggctaacagaggagaagccctatgacatcacggaacctggcggcagcgcaaaagatg

SEQ ID NO: 1114 - DNA, 103 bp, Artificial Sequence
  Synthetic Polynucleotide
taatacgactcactatagggccgatccagcatggtgtccgtgatgtgaaaaacagaggagatttcacatgacggacaccaacctggcggcagcgcaaaagatg

SEQ ID NO: 1115 - DNA, 103 bp, Artificial Sequence
  Synthetic Polynucleotide
taatacgactcactatagggcaaagccgatccagcatggtgtccgtgatgaacagaggagacatcacatgcaccatgctaacctggcggcagcgcaaaagatg

SEQ ID NO: 1116 - DNA, 103 bp, Artificial Sequence
  Synthetic Polynucleotide
taatacgactcactatagggccctccaaagccgatccagcatggtgtccgaacagaggagacggacaatgtgctggatcaacctggcggcagcgcaaaagatg

SEQ ID NO: 1117 - DNA, 103 bp, Artificial Sequence
  Synthetic Polynucleotide
taatacgactcactatagggtccgcccctccaaagccgatccagcatggtaacagaggagaaccatgatggatcggcttaacctggcggcagcgcaaaagatg

SEQ ID NO: 1118 - DNA, 103 bp, Artificial Sequence
  Synthetic Polynucleotide
taatacgactcactatagggtttggtccgcccctccaaagccgatccagcaacagaggagagctggaatggctttggagaacctggcggcagcgcaaaagatg

SEQ ID NO: 1119 - DNA, 103 bp, Artificial Sequence
  Synthetic Polynucleotide
taatacgactcactatagggcacgctttggtccgcccctccaaagccgataacagaggagaatcggcatgggaggggcgaacctggcggcagcgcaaaagatg

SEQ ID NO: 1120 - DNA, 103 bp, Artificial Sequence
  Synthetic Polynucleotide
taatacgactcactatagggatctccacgctttggtccgcccctccaaagaacagaggagactttggatgggcggaccaaacctggcggcagcgcaaaagatg

SEQ ID NO: 1121 - DNA, 103 bp, Artificial Sequence
  Synthetic Polynucleotide
taatacgactcactatagggcagccatctccacgctttggtccgcccctcaacagaggagagaggggatgaccaaagcgaacctggcggcagcgcaaaagatg

SEQ ID NO: 1122 - DNA, 103 bp, Artificial Sequence
  Synthetic Polynucleotide
taatacgactcactatagggtttcttaagctcttgttcactggcagcaacaacagaggagagttgctatgagtgaacaaaacctggcggcagcgcaaaagatg

SEQ ID NO: 1123 - DNA, 103 bp, Artificial Sequence
  Synthetic Polynucleotide
taatacgactcactatagggcttaccagccatctccacgctttggtccgcaacagaggagagcggacatgagcgtggagaacctggcggcagcgcaaaagatg

SEQ ID NO: 1124 - DNA, 103 bp, Artificial Sequence
  Synthetic Polynucleotide
taatacgactcactatagggggctgcttaccagccatctccacgctttggaacagaggagaccaaagatgggagatggcaacctggcggcagcgcaaaagatg

SEQ ID NO: 1125 - DNA, 103 bp, Artificial Sequence
  Synthetic Polynucleotide
taatacgactcactataggggctggggctgcttaccagccatctccacgcaacagaggagagcgtggatgtggctggtaaacctggcggcagcgcaaaagatg

SEQ ID NO: 1126 - DNA, 103 bp, Artificial Sequence
  Synthetic Polynucleotide
taatacgactcactatagggggcatgctggggctgcttaccagccatctcaacagaggagagagatgatgggtaagcagaacctggcggcagcgcaaaagatg

SEQ ID NO: 1127 - DNA, 103 bp, Artificial Sequence
  Synthetic Polynucleotide
taatacgactcactataggggtagcggcatgctggggctgcttaccagccaacagaggagaggctggatggcagccccaaacctggcggcagcgcaaaagatg

SEQ ID NO: 1128 - DNA, 103 bp, Artificial Sequence
  Synthetic Polynucleotide
taatacgactcactatagggccttcgtagcggcatgctggggctgcttacaacagaggagagtaagcatgcccagcatgaacctggcggcagcgcaaaagatg

SEQ ID NO: 1129 - DNA, 103 bp, Artificial Sequence
  Synthetic Polynucleotide
taatacgactcactatagggggcagccttcgtagcggcatgctggggctgaacagaggagacagcccatgcatgccgctaacctggcggcagcgcaaaagatg

SEQ ID NO: 1130 - DNA, 103 bp, Artificial Sequence
  Synthetic Polynucleotide
taatacgactcactatagggttaatggcagccttcgtagcggcatgctggaacagaggagaccagcaatgcgctacgaaaacctggcggcagcgcaaaagatg

SEQ ID NO: 1131 - DNA, 103 bp, Artificial Sequence
  Synthetic Polynucleotide
taatacgactcactatagggctgccttaatggcagccttcgtagcggcataacagaggagaatgccgatgcgaaggctgaacctggcggcagcgcaaaagatg

SEQ ID NO: 1132 - DNA, 103 bp, Artificial Sequence
  Synthetic Polynucleotide
taatacgactcactatagggagccactgccttaatggcagccttcgtagcaacagaggagagctacgatggctgccattaacctggcggcagcgcaaaagatg

SEQ ID NO: 1133 - DNA, 103 bp, Artificial Sequence
  Synthetic Polynucleotide
taatacgactcactatagggttgtctttcttaagctcttgttcactggcaaacagaggagatgccagatgacaagagctaacctggcggcagcgcaaaagatg

SEQ ID NO: 1134 - DNA, 103 bp, Artificial Sequence
  Synthetic Polynucleotide
taatacgactcactatagggtccttagccactgccttaatggcagccttcaacagaggagagaaggcatgcattaaggcaacctggcggcagcgcaaaagatg

SEQ ID NO: 1135 - DNA, 103 bp, Artificial Sequence
  Synthetic Polynucleotide
taatacgactcactatagggcaacctccttagccactgccttaatggcagaacagaggagactgccaatgaggcagtggaacctggcggcagcgcaaaagatg

SEQ ID NO: 1136 - DNA, 103 bp, Artificial Sequence
  Synthetic Polynucleotide
taatacgactcactatagggcttaacaacctccttagccactgccttaataacagaggagaattaagatggtggctaagaacctggcggcagcgcaaaagatg

SEQ ID NO: 1137 - DNA, 103 bp, Artificial Sequence
  Synthetic Polynucleotide
taatacgactcactatagggtcctccttaacaacctccttagccactgccaacagaggagaggcagtatgtaaggaggtaacctggcggcagcgcaaaagatg

SEQ ID NO: 1138 - DNA, 103 bp, Artificial Sequence
  Synthetic Polynucleotide
taatacgactcactatagggtgttctcctccttaacaacctccttagccaaacagaggagatggctaatgaggttgttaaacctggcggcagcgcaaaagatg

SEQ ID NO: 1139 - DNA, 103 bp, Artificial Sequence
  Synthetic Polynucleotide
taatacgactcactatagggttgtttgttctcctccttaacaacctccttaacagaggagaaaggagatggttaaggagaacctggcggcagcgcaaaagatg

SEQ ID NO: 1140 - DNA, 103 bp, Artificial Sequence
  Synthetic Polynucleotide
taatacgactcactatagggtgctgttgtttgttctcctccttaacaaccaacagaggagaggttgtatgggaggagaaaacctggcggcagcgcaaaagatg

SEQ ID NO: 1141 - DNA, 103 bp, Artificial Sequence
  Synthetic Polynucleotide
taatacgactcactatagggttctttgctgttgtttgttctcctccttaaaacagaggagattaaggatgagaacaaacaacctggcggcagcgcaaaagatg

SEQ ID NO: 1142 - DNA, 103 bp, Artificial Sequence
  Synthetic Polynucleotide
taatacgactcactatagggttgttttctttgctgttgtttgttctcctcaacagaggagagaggagatgaaacaacagaacctggcggcagcgcaaaagatg

SEQ ID NO: 1143 - DNA, 103 bp, Artificial Sequence
  Synthetic Polynucleotide
taatacgactcactatagggcatttttgttttctttgctgttgtttgttcaacagaggagagaacaaatgacagcaaagaacctggcggcagcgcaaaagatg

SEQ ID NO: 1144 - DNA, 103 bp, Artificial Sequence
  Synthetic Polynucleotide
taatacgactcactataggggtgacttgtctttcttaagctcttgttcacaacagaggagagtgaacatgagcttaagaaacctggcggcagcgcaaaagatg

SEQ ID NO: 1145 - DNA, 103 bp, Artificial Sequence
  Synthetic Polynucleotide
taatacgactcactataggggttgccatttttgttttctttgctgttgttaacagaggagaaacaacatgaaagaaaacaacctggcggcagcgcaaaagatg

SEQ ID NO: 1146 - DNA, 103 bp, Artificial Sequence
  Synthetic Polynucleotide
taatacgactcactatagggacggggttgccatttttgttttctttgctgaacagaggagacagcaaatgaaacaaaaaaacctggcggcagcgcaaaagatg

SEQ ID NO: 1147 - DNA, 103 bp, Artificial Sequence
  Synthetic Polynucleotide
taatacgactcactatagggttcttacggggttgccatttttgttttcttaacagaggagaaagaaaatgaaaatggcaaacctggcggcagcgcaaaagatg

SEQ ID NO: 1148 - DNA, 103 bp, Artificial Sequence
  Synthetic Polynucleotide
taatacgactcactatagggcctgtttcttacggggttgccatttttgttaacagaggagaaacaaaatgggcaaccccaacctggcggcagcgcaaaagatg

SEQ ID NO: 1149 - DNA, 103 bp, Artificial Sequence
  Synthetic Polynucleotide
taatacgactcactatagggcttaccctgtttcttacggggttgccatttaacagaggagaaaatggatgccccgtaagaacctggcggcagcgcaaaagatg

SEQ ID NO: 1150 - DNA, 103 bp, Artificial Sequence
  Synthetic Polynucleotide
taatacgactcactatagggttagtcttaccctgtttcttacggggttgcaacagaggagagcaaccatgtaagaaacaaacctggcggcagcgcaaaagatg

SEQ ID NO: 1151 - DNA, 103 bp, Artificial Sequence
  Synthetic Polynucleotide
taatacgactcactatagggaccatttagtcttaccctgtttcttacgggaacagaggagacccgtaatgaacagggtaaacctggcggcagcgcaaaagatg

SEQ ID NO: 1152 - DNA, 103 bp, Artificial Sequence
  Synthetic Polynucleotide
taatacgactcactatagggattaaaccatttagtcttaccctgtttcttaacagaggagaaagaaaatgggtaagactaacctggcggcagcgcaaaagatg

SEQ ID NO: 1153 - DNA, 103 bp, Artificial Sequence
  Synthetic Polynucleotide
taatacgactcactatagggttcttattaaaccatttagtcttaccctgtaacagaggagaacagggatggactaaatgaacctggcggcagcgcaaaagatg

SEQ ID NO: 1154 - DNA, 103 bp, Artificial Sequence
  Synthetic Polynucleotide
taatacgactcactatagggcctgattcttattaaaccatttagtcttacaacagaggagagtaagaatgaatggtttaaacctggcggcagcgcaaaagatg

SEQ ID NO: 1155 - DNA, 103 bp, Artificial Sequence
  Synthetic Polynucleotide
taatacgactcactatagggcaattgtgacttgtctttcttaagctcttgaacagaggagacaagagatgaagaaagacaacctggcggcagcgcaaaagatg

SEQ ID NO: 1156 - DNA, 103 bp, Artificial Sequence
  Synthetic Polynucleotide
taatacgactcactatagggcttaacctgattcttattaaaccatttagtaacagaggagaactaaaatgtttaataagaacctggcggcagcgcaaaagatg

SEQ ID NO: 1157 - DNA, 103 bp, Artificial Sequence
  Synthetic Polynucleotide
taatacgactcactatagggtcatgcttaacctgattcttattaaaccataacagaggagaatggttatgtaagaatcaaacctggcggcagcgcaaaagatg

SEQ ID NO: 1158 - DNA, 103 bp, Artificial Sequence
  Synthetic Polynucleotide
taatacgactcactatagggtaacctcatgcttaacctgattcttattaaaacagaggagattaataatgatcaggttaaacctggcggcagcgcaaaagatg

SEQ ID NO: 1159 - DNA, 103 bp, Artificial Sequence
  Synthetic Polynucleotide
taatacgactcactatagggagtcttaacctcatgcttaacctgattcttaacagaggagaaagaatatggttaagcataacctggcggcagcgcaaaagatg

SEQ ID NO: 1160 - DNA, 103 bp, Artificial Sequence
  Synthetic Polynucleotide
taatacgactcactatagggagctcagtcttaacctcatgcttaacctgaaacagaggagatcaggtatggcatgaggtaacctggcggcagcgcaaaagatg

SEQ ID NO: 1161 - DNA, 103 bp, Artificial Sequence
  Synthetic Polynucleotide
taatacgactcactatagggtcttaagctcagtcttaacctcatgcttaaaacagaggagattaagcatgaggttaagaaacctggcggcagcgcaaaagatg

SEQ ID NO: 1162 - DNA, 103 bp, Artificial Sequence
  Synthetic Polynucleotide
taatacgactcactatagggcttcctcttaagctcagtcttaacctcatgaacagaggagacatgagatgaagactgagaacctggcggcagcgcaaaagatg

SEQ ID NO: 1163 - DNA, 103 bp, Artificial Sequence
  Synthetic Polynucleotide
taatacgactcactatagggaggcccttcctcttaagctcagtcttaaccaacagaggagaggttaaatgtgagcttaaaacctggcggcagcgcaaaagatg

SEQ ID NO: 1164 - DNA, 103 bp, Artificial Sequence
  Synthetic Polynucleotide
taatacgactcactatagggcttcaaggcccttcctcttaagctcagtctaacagaggagaagactgatgttaagaggaaacctggcggcagcgcaaaagatg

SEQ ID NO: 1165 - DNA, 103 bp, Artificial Sequence
  Synthetic Polynucleotide
taatacgactcactatagggtgggccttcaaggcccttcctcttaagctcaacagaggagagagcttatgaggaagggcaacctggcggcagcgcaaaagatg

SEQ ID NO: 1166 - DNA, 103 bp, Artificial Sequence
  Synthetic Polynucleotide
taatacgactcactatagggaactgcaattgtgacttgtctttcttaagcaacagaggagagcttaaatgagacaagtcaacctggcggcagcgcaaaagatg

SEQ ID NO: 1167 - DNA, 103 bp, Artificial Sequence
  Synthetic Polynucleotide
taatacgactcactataggggttcttgggccttcaaggcccttcctcttaaacagaggagataagagatggggccttgaaacctggcggcagcgcaaaagatg

SEQ ID NO: 1168 - DNA, 103 bp, Artificial Sequence
  Synthetic Polynucleotide
taatacgactcactatagggatttggttcttgggccttcaaggcccttccaacagaggagaggaaggatgttgaaggccaacctggcggcagcgcaaaagatg

SEQ ID NO: 1169 - DNA, 103 bp, Artificial Sequence
  Synthetic Polynucleotide
taatacgactcactatagggtgtgaatttggttcttgggccttcaaggccaacagaggagaggccttatgggcccaagaaacctggcggcagcgcaaaagatg

SEQ ID NO: 1170 - DNA, 103 bp, Artificial Sequence
  Synthetic Polynucleotide
taatacgactcactatagggtttactgtgaatttggttcttgggccttcaaacagaggagatgaaggatgaagaaccaaaacctggcggcagcgcaaaagatg

SEQ ID NO: 1171 - DNA, 103 bp, Artificial Sequence
  Synthetic Polynucleotide
taatacgactcactatagggaaacttttactgtgaatttggttcttgggcaacagaggagagcccaaatgccaaattcaaacctggcggcagcgcaaaagatg

SEQ ID NO: 1172 - DNA, 103 bp, Artificial Sequence
  Synthetic Polynucleotide
taatacgactcactatagggagctgaaacttttactgtgaatttggttctaacagaggagaagaaccatgttcacagtaaacctggcggcagcgcaaaagatg

SEQ ID NO: 1173 - DNA, 103 bp, Artificial Sequence
  Synthetic Polynucleotide
taatacgactcactatagggattgtagctgaaacttttactgtgaatttgaacagaggagacaaattatgagtaaaagtaacctggcggcagcgcaaaagatg

SEQ ID NO: 1174 - DNA, 103 bp, Artificial Sequence
  Synthetic Polynucleotide
taatacgactcactatagggtcccaattgtagctgaaacttttactgtgaaacagaggagatcacagatgaagtttcagaacctggcggcagcgcaaaagatg

SEQ ID NO: 1175 - DNA, 103 bp, Artificial Sequence
  Synthetic Polynucleotide
taatacgactcactatagggaatcttcccaattgtagctgaaacttttacaacagaggagagtaaaaatgtcagctacaaacctggcggcagcgcaaaagatg

SEQ ID NO: 1176 - DNA, 103 bp, Artificial Sequence
  Synthetic Polynucleotide
taatacgactcactatagggggtccaatcttcccaattgtagctgaaactaacagaggagaagtttcatgtacaattggaacctggcggcagcgcaaaagatg

SEQ ID NO: 1177 - DNA, 103 bp, Artificial Sequence
  Synthetic Polynucleotide
taatacgactcactatagggtttccaactgcaattgtgacttgtctttctaacagaggagaagaaagatgagtcacaataacctggcggcagcgcaaaagatg

SEQ ID NO: 1178 - DNA, 103 bp, Artificial Sequence
  Synthetic Polynucleotide
taatacgactcactatagggcatttggtccaatcttcccaattgtagctgaacagaggagacagctaatgttgggaagaaacctggcggcagcgcaaaagatg

SEQ ID NO: 1179 - DNA, 103 bp, Artificial Sequence
  Synthetic Polynucleotide
taatacgactcactatagggattaacatttggtccaatcttcccaattgtaacagaggagaacaattatgaagattggaaacctggcggcagcgcaaaagatg

SEQ ID NO: 1180 - DNA, 103 bp, Artificial Sequence
  Synthetic Polynucleotide
taatacgactcactatagggccagcattaacatttggtccaatcttcccaaacagaggagatgggaaatgtggaccaaaaacctggcggcagcgcaaaagatg

SEQ ID NO: 1181 - DNA, 103 bp, Artificial Sequence
  Synthetic Polynucleotide
taatacgactcactatagggcaggaccagcattaacatttggtccaatctaacagaggagaagattgatgcaaatgttaaacctggcggcagcgcaaaagatg

SEQ ID NO: 1182 - DNA, 103 bp, Artificial Sequence
  Synthetic Polynucleotide
taatacgactcactatagggtaattcaggaccagcattaacatttggtccaacagaggagaggaccaatggttaatgctaacctggcggcagcgcaaaagatg

SEQ ID NO: 1183 - DNA, 103 bp, Artificial Sequence
  Synthetic Polynucleotide
taatacgactcactatagggatttgtaattcaggaccagcattaacatttaacagaggagaaaatgtatgtgctggtccaacctggcggcagcgcaaaagatg

SEQ ID NO: 1184 - DNA, 103 bp, Artificial Sequence
  Synthetic Polynucleotide
taatacgactcactatagggttgatatttgtaattcaggaccagcattaaaacagaggagattaatgatggtcctgaataacctggcggcagcgcaaaagatg

SEQ ID NO: 1185 - DNA, 103 bp, Artificial Sequence
  Synthetic Polynucleotide
taatacgactcactatagggaaaagttgatatttgtaattcaggaccagcaacagaggagagctggtatggaattacaaaacctggcggcagcgcaaaagatg

SEQ ID NO: 1186 - DNA, 103 bp, Artificial Sequence
  Synthetic Polynucleotide
taatacgactcactatagggtgcataaaagttgatatttgtaattcaggaaacagaggagatcctgaatgacaaatatcaacctggcggcagcgcaaaagatg

SEQ ID NO: 1187 - DNA, 103 bp, Artificial Sequence
  Synthetic Polynucleotide
taatacgactcactatagggctggatgcataaaagttgatatttgtaattaacagaggagaaattacatgtatcaacttaacctggcggcagcgcaaaagatg

SEQ ID NO: 1188 - DNA, 103 bp, Artificial Sequence
  Synthetic Polynucleotide
taatacgactcactatagggagaccctttgggcttgtatgagcactccataacagaggagaatggagatgtcatacaagaacctggcggcagcgcaaaagatg

SEQ ID NO: 1189 - DNA, 103 bp, Artificial Sequence
  Synthetic Polynucleotide
taatacgactcactatagggggatatttccaactgcaattgtgacttgtcaacagaggagagacaagatgcaattgcagaacctggcggcagcgcaaaagatg

SEQ ID NO: 1190 - DNA, 103 bp, Artificial Sequence
  Synthetic Polynucleotide
taatacgactcactatagggtaatgctggatgcataaaagttgatatttgaacagaggagacaaataatgacttttatgaacctggcggcagcgcaaaagatg

SEQ ID NO: 1191 - DNA, 103 bp, Artificial Sequence
  Synthetic Polynucleotide
taatacgactcactatagggttcattaatgctggatgcataaaagttgataacagaggagaatcaacatgtatgcatccaacctggcggcagcgcaaaagatg

SEQ ID NO: 1192 - DNA, 103 bp, Artificial Sequence
  Synthetic Polynucleotide
taatacgactcactataggggctctttcattaatgctggatgcataaaagaacagaggagacttttaatgatccagcataacctggcggcagcgcaaaagatg

SEQ ID NO: 1193 - DNA, 103 bp, Artificial Sequence
  Synthetic Polynucleotide
taatacgactcactatagggattgggctctttcattaatgctggatgcataacagaggagaatgcatatggcattaatgaacctggcggcagcgcaaaagatg

SEQ ID NO: 1194 - DNA, 103 bp, Artificial Sequence
  Synthetic Polynucleotide
taatacgactcactatagggccatcattgggctctttcattaatgctggaaacagaggagatccagcatgaatgaaagaaacctggcggcagcgcaaaagatg

SEQ ID NO: 1195 - DNA, 103 bp, Artificial Sequence
  Synthetic Polynucleotide
taatacgactcactatagggtggtgccatcattgggctctttcattaatgaacagaggagacattaaatgaagagcccaaacctggcggcagcgcaaaagatg

SEQ ID NO: 1196 - DNA, 103 bp, Artificial Sequence
  Synthetic Polynucleotide
taatacgactcactatagggaaaattggtgccatcattgggctctttcataacagaggagaatgaaaatgcccaatgataacctggcggcagcgcaaaagatg

SEQ ID NO: 1197 - DNA, 103 bp, Artificial Sequence
  Synthetic Polynucleotide
taatacgactcactatagggggtccaaaattggtgccatcattgggctctaacagaggagaagagccatgtgatggcacaacctggcggcagcgcaaaagatg

SEQ ID NO: 1198 - DNA, 103 bp, Artificial Sequence
  Synthetic Polynucleotide
taatacgactcactataggggtaaaggtccaaaattggtgccatcattggaacagaggagaccaatgatggcaccaattaacctggcggcagcgcaaaagatg

SEQ ID NO: 1199 - DNA, 103 bp, Artificial Sequence
  Synthetic Polynucleotide
taatacgactcactatagggagcttgtaaaggtccaaaattggtgccatcaacagaggagagatggcatgaattttggaaacctggcggcagcgcaaaagatg

SEQ ID NO: 1200 - DNA, 103 bp, Artificial Sequence
  Synthetic Polynucleotide
taatacgactcactatagggagtagggatatttccaactgcaattgtgacaacagaggagagtcacaatggcagttggaaacctggcggcagcgcaaaagatg

SEQ ID NO: 1201 - DNA, 103 bp, Artificial Sequence
  Synthetic Polynucleotide
taatacgactcactataggggctgcagcttgtaaaggtccaaaattggtgaacagaggagacaccaaatgtggacctttaacctggcggcagcgcaaaagatg

SEQ ID NO: 1202 - DNA, 103 bp, Artificial Sequence
  Synthetic Polynucleotide
taatacgactcactataggggtgcggctgcagcttgtaaaggtccaaaataacagaggagaattttgatgctttacaagaacctggcggcagcgcaaaagatg

SEQ ID NO: 1203 - DNA, 103 bp, Artificial Sequence
  Synthetic Polynucleotide
taatacgactcactatagggccattgtgcggctgcagcttgtaaaggtccaacagaggagaggacctatgcaagctgcaaacctggcggcagcgcaaaagatg

SEQ ID NO: 1204 - DNA, 103 bp, Artificial Sequence
  Synthetic Polynucleotide
taatacgactcactatagggaaaccccattgtgcggctgcagcttgtaaaaacagaggagatttacaatgtgcagccgcaacctggcggcagcgcaaaagatg

SEQ ID NO: 1205 - DNA, 103 bp, Artificial Sequence
  Synthetic Polynucleotide
taatacgactcactataggggccacaaaccccattgtgcggctgcagcttaacagaggagaaagctgatgccgcacaataacctggcggcagcgcaaaagatg

SEQ ID NO: 1206 - DNA, 103 bp, Artificial Sequence
  Synthetic Polynucleotide
taatacgactcactatagggaagccgccacaaaccccattgtgcggctgcaacagaggagagcagccatgcaatggggtaacctggcggcagcgcaaaagatg

SEQ ID NO: 1207 - DNA, 103 bp, Artificial Sequence
  Synthetic Polynucleotide
taatacgactcactatagggtctgaaagccgccacaaaccccattgtgcgaacagaggagacgcacaatggggtttgtgaacctggcggcagcgcaaaagatg

SEQ ID NO: 1208 - DNA, 103 bp, Artificial Sequence
  Synthetic Polynucleotide
taatacgactcactatagggttagatctgaaagccgccacaaaccccattaacagaggagaaatgggatgtgtggcggcaacctggcggcagcgcaaaagatg

SEQ ID NO: 1209 - DNA, 103 bp, Artificial Sequence
  Synthetic Polynucleotide
taatacgactcactatagggaatttttagatctgaaagccgccacaaaccaacagaggagaggtttgatgcggctttcaaacctggcggcagcgcaaaagatg

SEQ ID NO: 1210 - DNA, 103 bp, Artificial Sequence
  Synthetic Polynucleotide
taatacgactcactatagggaactgaatttttagatctgaaagccgccacaacagaggagagtggcgatgttcagatctaacctggcggcagcgcaaaagatg

SEQ ID NO: 1211 - DNA, 103 bp, Artificial Sequence
  Synthetic Polynucleotide
taatacgactcactataggggccttagtagggatatttccaactgcaattaacagaggagaaattgcatgtggaaatataacctggcggcagcgcaaaagatg

SEQ ID NO: 1212 - DNA, 103 bp, Artificial Sequence
  Synthetic Polynucleotide
taatacgactcactataggggagtgaactgaatttttagatctgaaagccaacagaggagaggctttatgatctaaaaaaacctggcggcagcgcaaaagatg

SEQ ID NO: 1213 - DNA, 103 bp, Artificial Sequence
  Synthetic Polynucleotide
taatacgactcactatagggtagaggagtgaactgaatttttagatctgaaacagaggagatcagatatgaaaattcagaacctggcggcagcgcaaaagatg

SEQ ID NO: 1214 - DNA, 103 bp, Artificial Sequence
  Synthetic Polynucleotide
taatacgactcactatagggcctactagaggagtgaactgaatttttagaaacagaggagatctaaaatgtcagttcacaacctggcggcagcgcaaaagatg

SEQ ID NO: 1215 - DNA, 103 bp, Artificial Sequence
  Synthetic Polynucleotide
taatacgactcactatagggaagctcctactagaggagtgaactgaatttaacagaggagaaaattcatgtcactcctcaacctggcggcagcgcaaaagatg

SEQ ID NO: 1216 - DNA, 103 bp, Artificial Sequence
  Synthetic Polynucleotide
taatacgactcactatagggtgcagaagctcctactagaggagtgaactgaacagaggagacagttcatgcctctagtaaacctggcggcagcgcaaaagatg

SEQ ID NO: 1217 - DNA, 103 bp, Artificial Sequence
  Synthetic Polynucleotide
taatacgactcactataggggttaatgcagaagctcctactagaggagtgaacagaggagacactccatgagtaggagcaacctggcggcagcgcaaaagatg

SEQ ID NO: 1218 - DNA, 103 bp, Artificial Sequence
  Synthetic Polynucleotide
taatacgactcactatagggatccagttaatgcagaagctcctactagagaacagaggagactctagatggagcttctgaacctggcggcagcgcaaaagatg

SEQ ID NO: 1219 - DNA, 103 bp, Artificial Sequence
  Synthetic Polynucleotide
taatacgactcactatagggcatggatccagttaatgcagaagctcctacaacagaggagagtaggaatgtctgcattaaacctggcggcagcgcaaaagatg

SEQ ID NO: 1220 - DNA, 103 bp, Artificial Sequence
  Synthetic Polynucleotide
taatacgactcactatagggcgatacatggatccagttaatgcagaagctaacagaggagaagcttcatgattaactggaacctggcggcagcgcaaaagatg

SEQ ID NO: 1221 - DNA, 103 bp, Artificial Sequence
  Synthetic Polynucleotide
taatacgactcactatagggatgcacgatacatggatccagttaatgcagaacagaggagactgcatatgctggatccaaacctggcggcagcgcaaaagatg

SEQ ID NO: 1222 - DNA, 103 bp, Artificial Sequence
  Synthetic Polynucleotide
taatacgactcactatagggctcgtgccttagtagggatatttccaactgaacagaggagacagttgatgatatccctaaacctggcggcagcgcaaaagatg

SEQ ID NO: 1223 - DNA, 103 bp, Artificial Sequence
  Synthetic Polynucleotide
taatacgactcactatagggtaacgatgcacgatacatggatccagttaaaacagaggagattaactatgtccatgtataacctggcggcagcgcaaaagatg

SEQ ID NO: 1224 - DNA, 103 bp, Artificial Sequence
  Synthetic Polynucleotide
taatacgactcactatagggaggtttaacgatgcacgatacatggatccaaacagaggagatggatcatggtatcgtgcaacctggcggcagcgcaaaagatg

SEQ ID NO: 1225 - DNA, 103 bp, Artificial Sequence
  Synthetic Polynucleotide
taatacgactcactataggggtgtaaggtttaacgatgcacgatacatggaacagaggagaccatgtatggtgcatcgtaacctggcggcagcgcaaaagatg

SEQ ID NO: 1226 - DNA, 103 bp, Artificial Sequence
  Synthetic Polynucleotide
taatacgactcactatagggggactgtgtaaggtttaacgatgcacgataaacagaggagatatcgtatgtcgttaaacaacctggcggcagcgcaaaagatg

SEQ ID NO: 1227 - DNA, 103 bp, Artificial Sequence
  Synthetic Polynucleotide
taatacgactcactatagggcccggggactgtgtaaggtttaacgatgcaaacagaggagatgcatcatgaaaccttacaacctggcggcagcgcaaaagatg

SEQ ID NO: 1228 - DNA, 103 bp, Artificial Sequence
  Synthetic Polynucleotide
taatacgactcactatagggttgatcccggggactgtgtaaggtttaacgaacagaggagacgttaaatgttacacagtaacctggcggcagcgcaaaagatg

SEQ ID NO: 1229 - DNA, 103 bp, Artificial Sequence
  Synthetic Polynucleotide
taatacgactcactatagggagatgttgatcccggggactgtgtaaggttaacagaggagaaaccttatgcagtccccgaacctggcggcagcgcaaaagatg

SEQ ID NO: 1230 - DNA, 103 bp, Artificial Sequence
  Synthetic Polynucleotide
taatacgactcactatagggccccaagatgttgatcccggggactgtgtaaacagaggagatacacaatgcccgggatcaacctggcggcagcgcaaaagatg

SEQ ID NO: 1231 - DNA, 103 bp, Artificial Sequence
  Synthetic Polynucleotide
taatacgactcactatagggggcccccccaagatgttgatcccggggactaacagaggagaagtcccatggatcaacataacctggcggcagcgcaaaagatg

SEQ ID NO: 1232 - DNA, 103 bp, Artificial Sequence
  Synthetic Polynucleotide
taatacgactcactataggggccaaggcccccccaagatgttgatcccggaacagaggagaccgggaatgacatcttggaacctggcggcagcgcaaaagatg

SEQ ID NO: 1233 - DNA, 103 bp, Artificial Sequence
  Synthetic Polynucleotide
taatacgactcactatagggtccagctcgtgccttagtagggatatttccaacagaggagaggaaatatgcctactaagaacctggcggcagcgcaaaagatg

SEQ ID NO: 1234 - DNA, 103 bp, Artificial Sequence
  Synthetic Polynucleotide
taatacgactcactatagggctggcgccaaggcccccccaagatgttgataacagaggagaatcaacatgttgggggggaacctggcggcagcgcaaaagatg

SEQ ID NO: 1235 - DNA, 103 bp, Artificial Sequence
  Synthetic Polynucleotide
taatacgactcactataggggcttcctggcgccaaggcccccccaagatgaacagaggagacatcttatgggggccttgaacctggcggcagcgcaaaagatg

SEQ ID NO: 1236 - DNA, 103 bp, Artificial Sequence
  Synthetic Polynucleotide
taatacgactcactatagggtagatgcttcctggcgccaaggcccccccaaacagaggagatgggggatgcttggcgccaacctggcggcagcgcaaaagatg

SEQ ID NO: 1237 - DNA, 103 bp, Artificial Sequence
  Synthetic Polynucleotide
taatacgactcactatagggatatctagatgcttcctggcgccaaggcccaacagaggagagggcctatgcgccaggaaaacctggcggcagcgcaaaagatg

SEQ ID NO: 1238 - DNA, 103 bp, Artificial Sequence
  Synthetic Polynucleotide
taatacgactcactatagggcaggtatatctagatgcttcctggcgccaaaacagaggagattggcgatgggaagcatcaacctggcggcagcgcaaaagatg

SEQ ID NO: 1239 - DNA, 103 bp, Artificial Sequence
  Synthetic Polynucleotide
taatacgactcactatagggaccaacaggtatatctagatgcttcctggcaacagaggagagccaggatgcatctagataacctggcggcagcgcaaaagatg

SEQ ID NO: 1240 - DNA, 103 bp, Artificial Sequence
  Synthetic Polynucleotide
taatacgactcactataggggacacaccaacaggtatatctagatgcttcaacagaggagagaagcaatgagatataccaacctggcggcagcgcaaaagatg

SEQ ID NO: 1241 - DNA, 103 bp, Artificial Sequence
  Synthetic Polynucleotide
taatacgactcactatagggctcgagacacaccaacaggtatatctagataacagaggagaatctagatgtacctgttgaacctggcggcagcgcaaaagatg

SEQ ID NO: 1242 - DNA, 103 bp, Artificial Sequence
  Synthetic Polynucleotide
taatacgactcactatagggccagactcgagacacaccaacaggtatatcaacagaggagagatataatggttggtgtgaacctggcggcagcgcaaaagatg

SEQ ID NO: 1243 - DNA, 103 bp, Artificial Sequence
  Synthetic Polynucleotide
taatacgactcactatagggaaatgccagactcgagacacaccaacaggtaacagaggagaacctgtatgtgtgtctcgaacctggcggcagcgcaaaagatg

SEQ ID NO: 1244 - DNA, 103 bp, Artificial Sequence
  Synthetic Polynucleotide
taatacgactcactatagggctctctccagctcgtgccttagtagggataaacagaggagatatcccatgtaaggcacgaacctggcggcagcgcaaaagatg

SEQ ID NO: 1245 - DNA, 103 bp, Artificial Sequence
  Synthetic Polynucleotide
taatacgactcactatagggtcctcaaatgccagactcgagacacaccaaaacagaggagattggtgatgctcgagtctaacctggcggcagcgcaaaagatg

SEQ ID NO: 1246 - DNA, 103 bp, Artificial Sequence
  Synthetic Polynucleotide
taatacgactcactatagggacctttcctcaaatgccagactcgagacacaacagaggagagtgtctatggtctggcataacctggcggcagcgcaaaagatg

SEQ ID NO: 1247 - DNA, 103 bp, Artificial Sequence
  Synthetic Polynucleotide
taatacgactcactatagggaggtcacctttcctcaaatgccagactcgaaacagaggagatcgagtatggcatttgagaacctggcggcagcgcaaaagatg

SEQ ID NO: 1248 - DNA, 103 bp, Artificial Sequence
  Synthetic Polynucleotide
taatacgactcactatagggcagcaaggtcacctttcctcaaatgccagaaacagaggagatctggcatgtgaggaaagaacctggcggcagcgcaaaagatg

SEQ ID NO: 1249 - DNA, 103 bp, Artificial Sequence
  Synthetic Polynucleotide
taatacgactcactatagggcgggccagcaaggtcacctttcctcaaatgaacagaggagacatttgatgaaaggtgacaacctggcggcagcgcaaaagatg

SEQ ID NO: 1250 - DNA, 103 bp, Artificial Sequence
  Synthetic Polynucleotide
taatacgactcactatagggtcacgcgggccagcaaggtcacctttcctcaacagaggagagaggaaatgtgaccttgcaacctggcggcagcgcaaaagatg

SEQ ID NO: 1251 - DNA, 103 bp, Artificial Sequence
  Synthetic Polynucleotide
taatacgactcactatagggatgtttcacgcgggccagcaaggtcaccttaacagaggagaaaggtgatgttgctggccaacctggcggcagcgcaaaagatg

SEQ ID NO: 1252 - DNA, 103 bp, Artificial Sequence
  Synthetic Polynucleotide
taatacgactcactatagggccaccatgtttcacgcgggccagcaaggtcaacagaggagagaccttatgggcccgcgtaacctggcggcagcgcaaaagatg

SEQ ID NO: 1253 - DNA, 103 bp, Artificial Sequence
  Synthetic Polynucleotide
taatacgactcactataggggtcaaccaccatgtttcacgcgggccagcaaacagaggagatgctggatggcgtgaaacaacctggcggcagcgcaaaagatg

SEQ ID NO: 1254 - DNA, 103 bp, Artificial Sequence
  Synthetic Polynucleotide
taatacgactcactatagggtgtcagtcaaccaccatgtttcacgcgggcaacagaggagagcccgcatgaaacatggtaacctggcggcagcgcaaaagatg

SEQ ID NO: 1255 - DNA, 103 bp, Artificial Sequence
  Synthetic Polynucleotide
taatacgactcactatagggtcttgctctctccagctcgtgccttagtagaacagaggagactactaatgcacgagctgaacctggcggcagcgcaaaagatg

SEQ ID NO: 1256 - DNA, 103 bp, Artificial Sequence
  Synthetic Polynucleotide
taatacgactcactatagggattggtgtcagtcaaccaccatgtttcacgaacagaggagacgtgaaatgtggtggttgaacctggcggcagcgcaaaagatg

SEQ ID NO: 1257 - DNA, 103 bp, Artificial Sequence
  Synthetic Polynucleotide
taatacgactcactatagggtcctcattggtgtcagtcaaccaccatgttaacagaggagaaacatgatggttgactgaaacctggcggcagcgcaaaagatg

SEQ ID NO: 1258 - DNA, 103 bp, Artificial Sequence
  Synthetic Polynucleotide
taatacgactcactatagggcaccttcctcattggtgtcagtcaaccaccaacagaggagaggtggtatgctgacaccaaacctggcggcagcgcaaaagatg

SEQ ID NO: 1259 - DNA, 103 bp, Artificial Sequence
  Synthetic Polynucleotide
taatacgactcactatagggctgaccaccttcctcattggtgtcagtcaaaacagaggagattgactatgaccaatgagaacctggcggcagcgcaaaagatg

SEQ ID NO: 1260 - DNA, 103 bp, Artificial Sequence
  Synthetic Polynucleotide
taatacgactcactatagggcaactctgaccaccttcctcattggtgtcaaacagaggagatgacacatgtgaggaaggaacctggcggcagcgcaaaagatg

SEQ ID NO: 1261 - DNA, 103 bp, Artificial Sequence
  Synthetic Polynucleotide
taatacgactcactataggggaccacaactctgaccaccttcctcattggaacagaggagaccaatgatgaaggtggtcaacctggcggcagcgcaaaagatg

SEQ ID NO: 1262 - DNA, 103 bp, Artificial Sequence
  Synthetic Polynucleotide
taatacgactcactatagggcatgggaccacaactctgaccaccttcctcaacagaggagagaggaaatgggtcagagtaacctggcggcagcgcaaaagatg

SEQ ID NO: 1263 - DNA, 103 bp, Artificial Sequence
  Synthetic Polynucleotide
taatacgactcactatagggtcaagcatgggaccacaactctgaccacctaacagaggagaaggtggatggagttgtggaacctggcggcagcgcaaaagatg

SEQ ID NO: 1264 - DNA, 103 bp, Artificial Sequence
  Synthetic Polynucleotide
taatacgactcactataggggaatctcaagcatgggaccacaactctgacaacagaggagagtcagaatggtggtcccaaacctggcggcagcgcaaaagatg

SEQ ID NO: 1265 - DNA, 103 bp, Artificial Sequence
  Synthetic Polynucleotide
taatacgactcactatagggaccatgaatctcaagcatgggaccacaactaacagaggagaagttgtatgcccatgcttaacctggcggcagcgcaaaagatg

SEQ ID NO: 1266 - DNA, 103 bp, Artificial Sequence
  Synthetic Polynucleotide
taatacgactcactataggggtgggtcttgctctctccagctcgtgccttaacagaggagaaaggcaatggctggagagaacctggcggcagcgcaaaagatg

SEQ ID NO: 1267 - DNA, 103 bp, Artificial Sequence
  Synthetic Polynucleotide
taatacgactcactatagggcccaaaccatgaatctcaagcatgggaccaaacagaggagatggtccatggcttgagataacctggcggcagcgcaaaagatg

SEQ ID NO: 1268 - DNA, 103 bp, Artificial Sequence
  Synthetic Polynucleotide
taatacgactcactatagggtcttacccaaaccatgaatctcaagcatggaacagaggagaccatgcatgagattcatgaacctggcggcagcgcaaaagatg

SEQ ID NO: 1269 - DNA, 103 bp, Artificial Sequence
  Synthetic Polynucleotide
taatacgactcactatagggtgtagtcttacccaaaccatgaatctcaagaacagaggagacttgagatgcatggtttgaacctggcggcagcgcaaaagatg

SEQ ID NO: 1270 - DNA, 103 bp, Artificial Sequence
  Synthetic Polynucleotide
taatacgactcactataggggtggatgtagtcttacccaaaccatgaatcaacagaggagagattcaatgtttgggtaaaacctggcggcagcgcaaaagatg

SEQ ID NO: 1271 - DNA, 103 bp, Artificial Sequence
  Synthetic Polynucleotide
taatacgactcactatagggggtaagtggatgtagtcttacccaaaccataacagaggagaatggttatggtaagactaaacctggcggcagcgcaaaagatg

SEQ ID NO: 1272 - DNA, 103 bp, Artificial Sequence
  Synthetic Polynucleotide
taatacgactcactatagggatcacggtaagtggatgtagtcttacccaaaacagaggagattgggtatgactacatccaacctggcggcagcgcaaaagatg

SEQ ID NO: 1273 - DNA, 103 bp, Artificial Sequence
  Synthetic Polynucleotide
taatacgactcactatagggggtgcatcacggtaagtggatgtagtcttaaacagaggagataagacatgatccacttaaacctggcggcagcgcaaaagatg

SEQ ID NO: 1274 - DNA, 103 bp, Artificial Sequence
  Synthetic Polynucleotide
taatacgactcactataggggccatggtgcatcacggtaagtggatgtagaacagaggagactacatatgcttaccgtgaacctggcggcagcgcaaaagatg

SEQ ID NO: 1275 - DNA, 103 bp, Artificial Sequence
  Synthetic Polynucleotide
taatacgactcactatagggaccttgccatggtgcatcacggtaagtggaaacagaggagatccactatgcgtgatgcaaacctggcggcagcgcaaaagatg

SEQ ID NO: 1276 - DNA, 103 bp, Artificial Sequence
  Synthetic Polynucleotide
taatacgactcactatagggagatcaccttgccatggtgcatcacggtaaaacagaggagattaccgatgtgcaccatgaacctggcggcagcgcaaaagatg

SEQ ID NO: 1277 - DNA, 103 bp, Artificial Sequence
  Synthetic Polynucleotide
taatacgactcactatagggtagtggtgggtcttgctctctccagctcgtaacagaggagaacgagcatgagagagcaaaacctggcggcagcgcaaaagatg

SEQ ID NO: 1278 - DNA, 103 bp, Artificial Sequence
  Synthetic Polynucleotide
taatacgactcactatagggcaaagagatcaccttgccatggtgcatcacaacagaggagagtgatgatgcatggcaagaacctggcggcagcgcaaaagatg

SEQ ID NO: 1279 - DNA, 103 bp, Artificial Sequence
  Synthetic Polynucleotide
taatacgactcactatagggaacaacaaagagatcaccttgccatggtgcaacagaggagagcaccaatgcaaggtgataacctggcggcagcgcaaaagatg

SEQ ID NO: 1280 - DNA, 103 bp, Artificial Sequence
  Synthetic Polynucleotide
taatacgactcactatagggacctcaacaacaaagagatcaccttgccataacagaggagaatggcaatgtgatctcttaacctggcggcagcgcaaaagatg

SEQ ID NO: 1281 - DNA, 103 bp, Artificial Sequence
  Synthetic Polynucleotide
taatacgactcactatagggcagtaacctcaacaacaaagagatcaccttaacagaggagaaaggtgatgtctttgttgaacctggcggcagcgcaaaagatg

SEQ ID NO: 1282 - DNA, 103 bp, Artificial Sequence
  Synthetic Polynucleotide
taatacgactcactatagggaacaccagtaacctcaacaacaaagagatcaacagaggagagatctcatggttgttgagaacctggcggcagcgcaaaagatg

SEQ ID NO: 1283 - DNA, 103 bp, Artificial Sequence
  Synthetic Polynucleotide
taatacgactcactatagggtgccaaacaccagtaacctcaacaacaaagaacagaggagactttgtatgtgaggttacaacctggcggcagcgcaaaagatg

SEQ ID NO: 1284 - DNA, 103 bp, Artificial Sequence
  Synthetic Polynucleotide
taatacgactcactatagggtaaactgccaaacaccagtaacctcaacaaaacagaggagattgttgatgttactggtgaacctggcggcagcgcaaaagatg

SEQ ID NO: 1285 - DNA, 103 bp, Artificial Sequence
  Synthetic Polynucleotide
taatacgactcactataggggttggtaaactgccaaacaccagtaacctcaacagaggagagaggttatgggtgtttggaacctggcggcagcgcaaaagatg

SEQ ID NO: 1286 - DNA, 103 bp, Artificial Sequence
  Synthetic Polynucleotide
taatacgactcactatagggttgtagttggtaaactgccaaacaccagtaaacagaggagatactggatgttggcagttaacctggcggcagcgcaaaagatg

SEQ ID NO: 1287 - DNA, 103 bp, Artificial Sequence
  Synthetic Polynucleotide
taatacgactcactatagggttgcattgtagttggtaaactgccaaacacaacagaggagagtgtttatgagtttaccaaacctggcggcagcgcaaaagatg

SEQ ID NO: 1288 - DNA, 103 bp, Artificial Sequence
  Synthetic Polynucleotide
taatacgactcactatagggggtcctagtggtgggtcttgctctctccagaacagaggagactggagatggcaagacccaacctggcggcagcgcaaaagatg

SEQ ID NO: 1289 - DNA, 103 bp, Artificial Sequence
  Synthetic Polynucleotide
taatacgactcactataggggggttttgcattgtagttggtaaactgccaaacagaggagatggcagatgaccaactacaacctggcggcagcgcaaaagatg

SEQ ID NO: 1290 - DNA, 103 bp, Artificial Sequence
  Synthetic Polynucleotide
taatacgactcactatagggagagcgggttttgcattgtagttggtaaacaacagaggagagtttacatgctacaatgcaacctggcggcagcgcaaaagatg

SEQ ID NO: 1291 - DNA, 103 bp, Artificial Sequence
  Synthetic Polynucleotide
taatacgactcactatagggtaccaagagcgggttttgcattgtagttggaacagaggagaccaactatgatgcaaaacaacctggcggcagcgcaaaagatg

SEQ ID NO: 1292 - DNA, 103 bp, Artificial Sequence
  Synthetic Polynucleotide
taatacgactcactatagggcagtgtaccaagagcgggttttgcattgtaaacagaggagatacaatatgaaacccgctaacctggcggcagcgcaaaagatg

SEQ ID NO: 1293 - DNA, 103 bp, Artificial Sequence
  Synthetic Polynucleotide
taatacgactcactatagggcgattcagtgtaccaagagcgggttttgcaaacagaggagatgcaaaatgcgctcttggaacctggcggcagcgcaaaagatg

SEQ ID NO: 1294 - DNA, 103 bp, Artificial Sequence
  Synthetic Polynucleotide
taatacgactcactatagggccacacgattcagtgtaccaagagcgggttaacagaggagaaacccgatgttggtacacaacctggcggcagcgcaaaagatg

SEQ ID NO: 1295 - DNA, 103 bp, Artificial Sequence
  Synthetic Polynucleotide
taatacgactcactatagggttcaaccacacgattcagtgtaccaagagcaacagaggagagctcttatgacactgaataacctggcggcagcgcaaaagatg

SEQ ID NO: 1296 - DNA, 103 bp, Artificial Sequence
  Synthetic Polynucleotide
taatacgactcactataggggtttcttcaaccacacgattcagtgtaccaaacagaggagatggtacatggaatcgtgtaacctggcggcagcgcaaaagatg

SEQ ID NO: 1297 - DNA, 103 bp, Artificial Sequence
  Synthetic Polynucleotide
taatacgactcactatagggcattggtttcttcaaccacacgattcagtgaacagaggagacactgaatggtgtggttgaacctggcggcagcgcaaaagatg

SEQ ID NO: 1298 - DNA, 103 bp, Artificial Sequence
  Synthetic Polynucleotide
taatacgactcactatagggtgatgcattggtttcttcaaccacacgattaacagaggagaaatcgtatggttgaagaaaacctggcggcagcgcaaaagatg

SEQ ID NO: 1299 - DNA, 103 bp, Artificial Sequence
  Synthetic Polynucleotide
taatacgactcactataggggaagagatgtgggttggcactgtcgcaggtaacagaggagaacctgcatgagtgccaacaacctggcggcagcgcaaaagatg

SEQ ID NO: 1300 - DNA, 103 bp, Artificial Sequence
  Synthetic Polynucleotide
taatacgactcactataggggtcttttcaatggacctaaggcgggaaccgaacagaggagacggttcatgccttaggtcaacctggcggcagcgcaaaagatg

SEQ ID NO: 1301 - DNA, 103 bp, Artificial Sequence
  Synthetic Polynucleotide
taatacgactcactatagggaagaaggaaggggcaacacatacccttttcaacagaggagagaaaagatgatgtgttgcaacctggcggcagcgcaaaagatg

SEQ ID NO: 1302 - DNA, 103 bp, Artificial Sequence
  Synthetic Polynucleotide
taatacgactcactatagggcccagatcatccatgattactgaatattgaaacagaggagatcaataatgagtaatcataacctggcggcagcgcaaaagatg

SEQ ID NO: 1303 - DNA, 103 bp, Artificial Sequence
  Synthetic Polynucleotide
taatacgactcactatagggtttgtcccagatcatccatgattactgaataacagaggagaattcagatgtcatggatgaacctggcggcagcgcaaaagatg

SEQ ID NO: 1304 - DNA, 103 bp, Artificial Sequence
  Synthetic Polynucleotide
taatacgactcactataggggggattttgtcccagatcatccatgattacaacagaggagagtaatcatggatgatctgaacctggcggcagcgcaaaagatg

SEQ ID NO: 1305 - DNA, 103 bp, Artificial Sequence
  Synthetic Polynucleotide
taatacgactcactatagggccatcgggattttgtcccagatcatccatgaacagaggagacatggaatgtctgggacaaacctggcggcagcgcaaaagatg

SEQ ID NO: 1306 - DNA, 103 bp, Artificial Sequence
  Synthetic Polynucleotide
taatacgactcactatagggcttcgccatcgggattttgtcccagatcataacagaggagaatgatcatggacaaaatcaacctggcggcagcgcaaaagatg

SEQ ID NO: 1307 - DNA, 103 bp, Artificial Sequence
  Synthetic Polynucleotide
taatacgactcactataggggaaatcttcgccatcgggattttgtcccagaacagaggagactgggaatgaatcccgataacctggcggcagcgcaaaagatg

SEQ ID NO: 1308 - DNA, 103 bp, Artificial Sequence
  Synthetic Polynucleotide
taatacgactcactatagggactttgaaatcttcgccatcgggattttgtaacagaggagaacaaaaatgcgatggcgaaacctggcggcagcgcaaaagatg

SEQ ID NO: 1309 - DNA, 103 bp, Artificial Sequence
  Synthetic Polynucleotide
taatacgactcactatagggaaaatactttgaaatcttcgccatcgggataacagaggagaatcccgatggcgaagattaacctggcggcagcgcaaaagatg

SEQ ID NO: 1310 - DNA, 103 bp, Artificial Sequence
  Synthetic Polynucleotide
taatacgactcactatagggttgacaaaatactttgaaatcttcgccatcaacagaggagagatggcatggatttcaaaaacctggcggcagcgcaaaagatg

SEQ ID NO: 1311 - DNA, 103 bp, Artificial Sequence
  Synthetic Polynucleotide
taatacgactcactatagggaccatttgacaaaatactttgaaatcttcgaacagaggagacgaagaatgcaaagtattaacctggcggcagcgcaaaagatg

SEQ ID NO: 1312 - DNA, 103 bp, Artificial Sequence
  Synthetic Polynucleotide
taatacgactcactatagggctccaaagaaggaaggggcaacacatacccaacagaggagagggtatatgttgccccttaacctggcggcagcgcaaaagatg

SEQ ID NO: 1313 - DNA, 103 bp, Artificial Sequence
  Synthetic Polynucleotide
taatacgactcactatagggttgaaaccatttgacaaaatactttgaaataacagaggagaatttcaatgtattttgtcaacctggcggcagcgcaaaagatg

SEQ ID NO: 1314 - DNA, 103 bp, Artificial Sequence
  Synthetic Polynucleotide
taatacgactcactatagggtgtgcttgaaaccatttgacaaaatactttaacagaggagaaaagtaatgtgtcaaatgaacctggcggcagcgcaaaagatg

SEQ ID NO: 1315 - DNA, 103 bp, Artificial Sequence
  Synthetic Polynucleotide
taatacgactcactatagggaaatttgtgcttgaaaccatttgacaaaataacagaggagaattttgatgaatggtttcaacctggcggcagcgcaaaagatg

SEQ ID NO: 1316 - DNA, 103 bp, Artificial Sequence
  Synthetic Polynucleotide
taatacgactcactatagggggagaaaatttgtgcttgaaaccatttgacaacagaggagagtcaaaatgtttcaagcaaacctggcggcagcgcaaaagatg

SEQ ID NO: 1317 - DNA, 103 bp, Artificial Sequence
  Synthetic Polynucleotide
taatacgactcactataggggtttgggagaaaatttgtgcttgaaaccataacagaggagaatggttatgagcacaaataacctggcggcagcgcaaaagatg

SEQ ID NO: 1318 - DNA, 103 bp, Artificial Sequence
  Synthetic Polynucleotide
taatacgactcactataggggccatgtttgggagaaaatttgtgcttgaaaacagaggagattcaagatgaaattttctaacctggcggcagcgcaaaagatg

SEQ ID NO: 1319 - DNA, 103 bp, Artificial Sequence
  Synthetic Polynucleotide
taatacgactcactatagggggtgggccatgtttgggagaaaatttgtgcaacagaggagagcacaaatgttctcccaaaacctggcggcagcgcaaaagatg

SEQ ID NO: 1320 - DNA, 103 bp, Artificial Sequence
  Synthetic Polynucleotide
taatacgactcactatagggttccaggtgggccatgtttgggagaaaattaacagaggagaaattttatgccaaacatgaacctggcggcagcgcaaaagatg

SEQ ID NO: 1321 - DNA, 103 bp, Artificial Sequence
  Synthetic Polynucleotide
taatacgactcactatagggttcttttccaggtgggccatgtttgggagaaacagaggagatctcccatgcatggcccaaacctggcggcagcgcaaaagatg

SEQ ID NO: 1322 - DNA, 103 bp, Artificial Sequence
  Synthetic Polynucleotide
taatacgactcactatagggttcctttcttttccaggtgggccatgtttgaacagaggagacaaacaatgcccacctggaacctggcggcagcgcaaaagatg

SEQ ID NO: 1323 - DNA, 103 bp, Artificial Sequence
  Synthetic Polynucleotide
taatacgactcactatagggagattctccaaagaaggaaggggcaacacaaacagaggagatgtgttatgccttccttcaacctggcggcagcgcaaaagatg

SEQ ID NO: 1324 - DNA, 103 bp, Artificial Sequence
  Synthetic Polynucleotide
taatacgactcactatagggtggagttcctttcttttccaggtgggccataacagaggagaatggccatgctggaaaagaacctggcggcagcgcaaaagatg

SEQ ID NO: 1325 - DNA, 103 bp, Artificial Sequence
  Synthetic Polynucleotide
taatacgactcactataggggtgaatggagttcctttcttttccaggtggaacagaggagaccacctatgaaagaaaggaacctggcggcagcgcaaaagatg

SEQ ID NO: 1326 - DNA, 103 bp, Artificial Sequence
  Synthetic Polynucleotide
taatacgactcactatagggtagaagtgaatggagttcctttcttttccaaacagaggagatggaaaatgaaggaactcaacctggcggcagcgcaaaagatg

SEQ ID NO: 1327 - DNA, 103 bp, Artificial Sequence
  Synthetic Polynucleotide
taatacgactcactataggggaagttagaagtgaatggagttcctttcttaacagaggagaaagaaaatgactccattcaacctggcggcagcgcaaaagatg

SEQ ID NO: 1328 - DNA, 103 bp, Artificial Sequence
  Synthetic Polynucleotide
taatacgactcactatagggattatgaagttagaagtgaatggagttcctaacagaggagaaggaacatgattcacttcaacctggcggcagcgcaaaagatg

SEQ ID NO: 1329 - DNA, 103 bp, Artificial Sequence
  Synthetic Polynucleotide
taatacgactcactatagggttgctattatgaagttagaagtgaatggagaacagaggagactccatatgcttctaactaacctggcggcagcgcaaaagatg

SEQ ID NO: 1330 - DNA, 103 bp, Artificial Sequence
  Synthetic Polynucleotide
taatacgactcactatagggggtcgttgctattatgaagttagaagtgaaaacagaggagattcactatgaacttcataaacctggcggcagcgcaaaagatg

SEQ ID NO: 1331 - DNA, 103 bp, Artificial Sequence
  Synthetic Polynucleotide
taatacgactcactatagggaggttggtcgttgctattatgaagttagaaaacagaggagattctaaatgcataatagcaacctggcggcagcgcaaaagatg

SEQ ID NO: 1332 - DNA, 103 bp, Artificial Sequence
  Synthetic Polynucleotide
taatacgactcactatagggtgggaaggttggtcgttgctattatgaagtaacagaggagaacttcaatgtagcaacgaaacctggcggcagcgcaaaagatg

SEQ ID NO: 1333 - DNA, 103 bp, Artificial Sequence
  Synthetic Polynucleotide
taatacgactcactatagggaaacttgggaaggttggtcgttgctattataacagaggagaataataatgacgaccaacaacctggcggcagcgcaaaagatg

SEQ ID NO: 1334 - DNA, 103 bp, Artificial Sequence
  Synthetic Polynucleotide
taatacgactcactatagggcgcgcagattctccaaagaaggaaggggcaaacagaggagatgccccatgcttctttggaacctggcggcagcgcaaaagatg

SEQ ID NO: 1335 - DNA, 103 bp, Artificial Sequence
  Synthetic Polynucleotide
taatacgactcactatagggggccgaaacttgggaaggttggtcgttgctaacagaggagaagcaacatgcaaccttccaacctggcggcagcgcaaaagatg

SEQ ID NO: 1336 - DNA, 103 bp, Artificial Sequence
  Synthetic Polynucleotide
taatacgactcactatagggtgacaggccgaaacttgggaaggttggtcgaacagaggagacgaccaatgttcccaagtaacctggcggcagcgcaaaagatg

SEQ ID NO: 1337 - DNA, 103 bp, Artificial Sequence
  Synthetic Polynucleotide
taatacgactcactatagggtacggtgacaggccgaaacttgggaaggttaacagaggagaaaccttatgaagtttcggaacctggcggcagcgcaaaagatg

SEQ ID NO: 1338 - DNA, 103 bp, Artificial Sequence
  Synthetic Polynucleotide
taatacgactcactatagggtgtgctacggtgacaggccgaaacttgggaaacagaggagatcccaaatgtcggcctgtaacctggcggcagcgcaaaagatg

SEQ ID NO: 1339 - DNA, 103 bp, Artificial Sequence
  Synthetic Polynucleotide
taatacgactcactatagggggtagtgtgctacggtgacaggccgaaactaacagaggagaagtttcatgctgtcaccgaacctggcggcagcgcaaaagatg

SEQ ID NO: 1340 - DNA, 103 bp, Artificial Sequence
  Synthetic Polynucleotide
taatacgactcactatagggagctgggtagtgtgctacggtgacaggccgaacagaggagacggcctatgaccgtagcaaacctggcggcagcgcaaaagatg

SEQ ID NO: 1341 - DNA, 103 bp, Artificial Sequence
  Synthetic Polynucleotide
taatacgactcactatagggtcaacagctgggtagtgtgctacggtgacaaacagaggagatgtcacatgagcacactaaacctggcggcagcgcaaaagatg

SEQ ID NO: 1342 - DNA, 103 bp, Artificial Sequence
  Synthetic Polynucleotide
taatacgactcactatagggttctatcaacagctgggtagtgtgctacggaacagaggagaccgtagatgactacccagaacctggcggcagcgcaaaagatg

SEQ ID NO: 1343 - DNA, 103 bp, Artificial Sequence
  Synthetic Polynucleotide
taatacgactcactatagggaattcttctatcaacagctgggtagtgtgcaacagaggagagcacacatgccagctgttaacctggcggcagcgcaaaagatg

SEQ ID NO: 1344 - DNA, 103 bp, Artificial Sequence
  Synthetic Polynucleotide
taatacgactcactatagggaaggtaattcttctatcaacagctgggtagaacagaggagactacccatgtgttgatagaacctggcggcagcgcaaaagatg

SEQ ID NO: 1345 - DNA, 103 bp, Artificial Sequence
  Synthetic Polynucleotide
taatacgactcactatagggaccgccgcgcagattctccaaagaaggaagaacagaggagacttcctatgttggagaataacctggcggcagcgcaaaagatg

SEQ ID NO: 1346 - DNA, 103 bp, Artificial Sequence
  Synthetic Polynucleotide
taatacgactcactatagggaatcaaaggtaattcttctatcaacagctgaacagaggagacagctgatgatagaagaaaacctggcggcagcgcaaaagatg

SEQ ID NO: 1347 - DNA, 103 bp, Artificial Sequence
  Synthetic Polynucleotide
taatacgactcactatagggagtcaaatcaaaggtaattcttctatcaacaacagaggagagttgatatgagaattaccaacctggcggcagcgcaaaagatg

SEQ ID NO: 1348 - DNA, 103 bp, Artificial Sequence
  Synthetic Polynucleotide
taatacgactcactatagggtcaacagtcaaatcaaaggtaattcttctaaacagaggagatagaagatgtacctttgaaacctggcggcagcgcaaaagatg

SEQ ID NO: 1349 - DNA, 103 bp, Artificial Sequence
  Synthetic Polynucleotide
taatacgactcactatagggctgcttcaacagtcaaatcaaaggtaattcaacagaggagagaattaatgttgatttgaaacctggcggcagcgcaaaagatg

SEQ ID NO: 1350 - DNA, 103 bp, Artificial Sequence
  Synthetic Polynucleotide
taatacgactcactatagggatctcctgcttcaacagtcaaatcaaaggtaacagaggagaacctttatgttgactgttaacctggcggcagcgcaaaagatg

SEQ ID NO: 1351 - DNA, 103 bp, Artificial Sequence
  Synthetic Polynucleotide
taatacgactcactatagggcattcatctcctgcttcaacagtcaaatcaaacagaggagatgatttatgtgttgaagcaacctggcggcagcgcaaaagatg

SEQ ID NO: 1352 - DNA, 103 bp, Artificial Sequence
  Synthetic Polynucleotide
taatacgactcactatagggtgatacattcatctcctgcttcaacagtcaaacagaggagatgactgatgaagcaggagaacctggcggcagcgcaaaagatg

SEQ ID NO: 1353 - DNA, 103 bp, Artificial Sequence
  Synthetic Polynucleotide
taatacgactcactataggggtgggtgatacattcatctcctgcttcaacaacagaggagagttgaaatgggagatgaaaacctggcggcagcgcaaaagatg

SEQ ID NO: 1354 - DNA, 103 bp, Artificial Sequence
  Synthetic Polynucleotide
taatacgactcactatagggccattgtgggtgatacattcatctcctgctaacagaggagaagcaggatgtgaatgtataacctggcggcagcgcaaaagatg

SEQ ID NO: 1355 - DNA, 103 bp, Artificial Sequence
  Synthetic Polynucleotide
taatacgactcactataggggcattccattgtgggtgatacattcatctcaacagaggagagagatgatggtatcacccaacctggcggcagcgcaaaagatg

SEQ ID NO: 1356 - DNA, 103 bp, Artificial Sequence
  Synthetic Polynucleotide
taatacgactcactataggggaaagaccgccgcgcagattctccaaagaaaacagaggagattctttatggaatctgcgaacctggcggcagcgcaaaagatg

SEQ ID NO: 1357 - DNA, 103 bp, Artificial Sequence
  Synthetic Polynucleotide
taatacgactcactatagggatctagcattccattgtgggtgatacattcaacagaggagagaatgtatgacccacaataacctggcggcagcgcaaaagatg

SEQ ID NO: 1358 - DNA, 103 bp, Artificial Sequence
  Synthetic Polynucleotide
taatacgactcactatagggtctacatctagcattccattgtgggtgataaacagaggagatatcacatgcaatggaataacctggcggcagcgcaaaagatg

SEQ ID NO: 1359 - DNA, 103 bp, Artificial Sequence
  Synthetic Polynucleotide
taatacgactcactatagggctttttctacatctagcattccattgtgggaacagaggagacccacaatggaatgctagaacctggcggcagcgcaaaagatg

SEQ ID NO: 1360 - DNA, 103 bp, Artificial Sequence
  Synthetic Polynucleotide
taatacgactcactatagggaaaagctttttctacatctagcattccattaacagaggagaaatggaatgctagatgtaaacctggcggcagcgcaaaagatg

SEQ ID NO: 1361 - DNA, 103 bp, Artificial Sequence
  Synthetic Polynucleotide
taatacgactcactatagggtcttcaaaagctttttctacatctagcattaacagaggagaaatgctatgtgtagaaaaaacctggcggcagcgcaaaagatg

SEQ ID NO: 1362 - DNA, 103 bp, Artificial Sequence
  Synthetic Polynucleotide
taatacgactcactataggggagtttcttcaaaagctttttctacatctaaacagaggagatagatgatgaaaaagcttaacctggcggcagcgcaaaagatg

SEQ ID NO: 1363 - DNA, 103 bp, Artificial Sequence
  Synthetic Polynucleotide
taatacgactcactatagggccctggagtttcttcaaaagctttttctacaacagaggagagtagaaatggcttttgaaaacctggcggcagcgcaaaagatg

SEQ ID NO: 1364 - DNA, 103 bp, Artificial Sequence
  Synthetic Polynucleotide
taatacgactcactatagggggtttccctggagtttcttcaaaagcttttaacagaggagaaaaagcatgtgaagaaacaacctggcggcagcgcaaaagatg

SEQ ID NO: 1365 - DNA, 103 bp, Artificial Sequence
  Synthetic Polynucleotide
taatacgactcactatagggattgtggtttccctggagtttcttcaaaagaacagaggagacttttgatgaaactccagaacctggcggcagcgcaaaagatg

SEQ ID NO: 1366 - DNA, 103 bp, Artificial Sequence
  Synthetic Polynucleotide
taatacgactcactatagggatccaattgtggtttccctggagtttcttcaacagaggagagaagaaatgccagggaaaaacctggcggcagcgcaaaagatg

SEQ ID NO: 1367 - DNA, 103 bp, Artificial Sequence
  Synthetic Polynucleotide
taatacgactcactatagggagacggaaagaccgccgcgcagattctccaaacagaggagatggagaatgtgcgcggcgaacctggcggcagcgcaaaagatg

SEQ ID NO: 1368 - DNA, 103 bp, Artificial Sequence
  Synthetic Polynucleotide
taatacgactcactatagggaagcaatccaattgtggtttccctggagttaacagaggagaaactccatggaaaccacaaacctggcggcagcgcaaaagatg

SEQ ID NO: 1369 - DNA, 103 bp, Artificial Sequence
  Synthetic Polynucleotide
taatacgactcactatagggtgttgaagcaatccaattgtggtttccctgaacagaggagacagggaatgcacaattggaacctggcggcagcgcaaaagatg

SEQ ID NO: 1370 - DNA, 103 bp, Artificial Sequence
  Synthetic Polynucleotide
taatacgactcactataggggtcagtgttgaagcaatccaattgtggtttaacagaggagaaaaccaatgttggattgcaacctggcggcagcgcaaaagatg

SEQ ID NO: 1371 - DNA, 103 bp, Artificial Sequence
  Synthetic Polynucleotide
taatacgactcactatagggctacagtcagtgttgaagcaatccaattgtaacagaggagaacaattatgttgcttcaaaacctggcggcagcgcaaaagatg

SEQ ID NO: 1372 - DNA, 103 bp, Artificial Sequence
  Synthetic Polynucleotide
taatacgactcactataggggaagcctacagtcagtgttgaagcaatccaaacagaggagatggattatgtcaacactgaacctggcggcagcgcaaaagatg

SEQ ID NO: 1373 - DNA, 103 bp, Artificial Sequence
  Synthetic Polynucleotide
taatacgactcactatagggatgaagaagcctacagtcagtgttgaagcaaacagaggagatgcttcatgactgactgtaacctggcggcagcgcaaaagatg

SEQ ID NO: 1374 - DNA, 103 bp, Artificial Sequence
  Synthetic Polynucleotide
taatacgactcactatagggcttttatgaagaagcctacagtcagtgttgaacagaggagacaacacatgctgtaggctaacctggcggcagcgcaaaagatg

SEQ ID NO: 1375 - DNA, 103 bp, Artificial Sequence
  Synthetic Polynucleotide
taatacgactcactatagggcgcctcttttatgaagaagcctacagtcagaacagaggagactgactatgggcttcttcaacctggcggcagcgcaaaagatg

SEQ ID NO: 1376 - DNA, 103 bp, Artificial Sequence
  Synthetic Polynucleotide
taatacgactcactatagggtcgcacgcctcttttatgaagaagcctacaaacagaggagatgtaggatgcttcataaaaacctggcggcagcgcaaaagatg

SEQ ID NO: 1377 - DNA, 103 bp, Artificial Sequence
  Synthetic Polynucleotide
taatacgactcactatagggatgaatcgcacgcctcttttatgaagaagcaacagaggagagcttctatgtaaaagaggaacctggcggcagcgcaaaagatg

SEQ ID NO: 1378 - DNA, 103 bp, Artificial Sequence
  Synthetic Polynucleotide
taatacgactcactatagggttgagagacggaaagaccgccgcgcagattaacagaggagaaatctgatgggcggtcttaacctggcggcagcgcaaaagatg

SEQ ID NO: 1379 - DNA, 103 bp, Artificial Sequence
  Synthetic Polynucleotide
taatacgactcactatagggtgcaaatgaatcgcacgcctcttttatgaaaacagaggagattcataatggaggcgtgcaacctggcggcagcgcaaaagatg

SEQ ID NO: 1380 - DNA, 103 bp, Artificial Sequence
  Synthetic Polynucleotide
taatacgactcactataggggcggttgcaaatgaatcgcacgcctcttttaacagaggagaaaaagaatggtgcgattcaacctggcggcagcgcaaaagatg

SEQ ID NO: 1381 - DNA, 103 bp, Artificial Sequence
  Synthetic Polynucleotide
taatacgactcactatagggtttgtgcggttgcaaatgaatcgcacgcctaacagaggagaaggcgtatgattcatttgaacctggcggcagcgcaaaagatg

SEQ ID NO: 1382 - DNA, 103 bp, Artificial Sequence
  Synthetic Polynucleotide
taatacgactcactatagggtattttttgtgcggttgcaaatgaatcgcaaacagaggagatgcgatatgtttgcaaccaacctggcggcagcgcaaaagatg

SEQ ID NO: 1383 - DNA, 103 bp, Artificial Sequence
  Synthetic Polynucleotide
taatacgactcactataggggtagatattttttgtgcggttgcaaatgaaaacagaggagattcattatgaaccgcacaaacctggcggcagcgcaaaagatg

SEQ ID NO: 1384 - DNA, 103 bp, Artificial Sequence
  Synthetic Polynucleotide
taatacgactcactatagggaggttgtagatattttttgtgcggttgcaaaacagaggagattgcaaatgcacaaaaaaaacctggcggcagcgcaaaagatg

SEQ ID NO: 1385 - DNA, 103 bp, Artificial Sequence
  Synthetic Polynucleotide
taatacgactcactataggggttgaaggttgtagatattttttgtgcggtaacagaggagaaccgcaatgaaaatatctaacctggcggcagcgcaaaagatg

SEQ ID NO: 1386 - DNA, 103 bp, Artificial Sequence
  Synthetic Polynucleotide
taatacgactcactatagggcacttgttgaaggttgtagatattttttgtaacagaggagaacaaaaatgatctacaacaacctggcggcagcgcaaaagatg

SEQ ID NO: 1387 - DNA, 103 bp, Artificial Sequence
  Synthetic Polynucleotide
taatacgactcactatagggttaaccacttgttgaaggttgtagatatttaacagaggagaaaatatatgcaaccttcaaacctggcggcagcgcaaaagatg

SEQ ID NO: 1388 - DNA, 103 bp, Artificial Sequence
  Synthetic Polynucleotide
taatacgactcactatagggccatcttaaccacttgttgaaggttgtagaaacagaggagatctacaatgttcaacaagaacctggcggcagcgcaaaagatg

SEQ ID NO: 1389 - DNA, 103 bp, Artificial Sequence
  Synthetic Polynucleotide
taatacgactcactataggggcctgttgagagacggaaagaccgccgcgcaacagaggagagcgcggatgtctttccgtaacctggcggcagcgcaaaagatg

SEQ ID NO: 1390 - DNA, 103 bp, Artificial Sequence
  Synthetic Polynucleotide
taatacgactcactatagggctttaccatcttaaccacttgttgaaggttaacagaggagaaaccttatgcaagtggttaacctggcggcagcgcaaaagatg

SEQ ID NO: 1391 - DNA, 103 bp, Artificial Sequence
  Synthetic Polynucleotide
taatacgactcactataggggtattctttaccatcttaaccacttgttgaaacagaggagatcaacaatgggttaagataacctggcggcagcgcaaaagatg

SEQ ID NO: 1392 - DNA, 103 bp, Artificial Sequence
  Synthetic Polynucleotide
taatacgactcactatagggcgatggtattctttaccatcttaaccacttaacagaggagaaagtggatgagatggtaaaacctggcggcagcgcaaaagatg

SEQ ID NO: 1393 - DNA, 103 bp, Artificial Sequence
  Synthetic Polynucleotide
taatacgactcactataggggttatcgatggtattctttaccatcttaacaacagaggagagttaagatggtaaagaataacctggcggcagcgcaaaagatg

SEQ ID NO: 1394 - DNA, 103 bp, Artificial Sequence
  Synthetic Polynucleotide
taatacgactcactatagggactttgttatcgatggtattctttaccatcaacagaggagagatggtatggaataccataacctggcggcagcgcaaaagatg

SEQ ID NO: 1395 - DNA, 103 bp, Artificial Sequence
  Synthetic Polynucleotide
taatacgactcactatagggtttccactttgttatcgatggtattctttaaacagaggagataaagaatgccatcgataaacctggcggcagcgcaaaagatg

SEQ ID NO: 1396 - DNA, 103 bp, Artificial Sequence
  Synthetic Polynucleotide
taatacgactcactatagggcaagttttccactttgttatcgatggtattaacagaggagaaataccatggataacaaaaacctggcggcagcgcaaaagatg

SEQ ID NO: 1397 - DNA, 103 bp, Artificial Sequence
  Synthetic Polynucleotide
taatacgactcactatagggttcttcaagttttccactttgttatcgatgaacagaggagacatcgaatgcaaagtggaaacctggcggcagcgcaaaagatg

SEQ ID NO: 1398 - DNA, 103 bp, Artificial Sequence
  Synthetic Polynucleotide
taatacgactcactatagggtcattttcttcaagttttccactttgttataacagaggagaataacaatgtggaaaactaacctggcggcagcgcaaaagatg

SEQ ID NO: 1399 - DNA, 103 bp, Artificial Sequence
  Synthetic Polynucleotide
taatacgactcactatagggtgtgttcattttcttcaagttttccactttaacagaggagaaaagtgatgaacttgaagaacctggcggcagcgcaaaagatg

SEQ ID NO: 1400 - DNA, 103 bp, Artificial Sequence
  Synthetic Polynucleotide
taatacgactcactatagggtccacgcctgttgagagacggaaagaccgcaacagaggagagcggtcatgccgtctctcaacctggcggcagcgcaaaagatg

SEQ ID NO: 1401 - DNA, 103 bp, Artificial Sequence
  Synthetic Polynucleotide
taatacgactcactatagggaccaatgtgttcattttcttcaagttttccaacagaggagaggaaaaatggaagaaaataacctggcggcagcgcaaaagatg

SEQ ID NO: 1402 - DNA, 103 bp, Artificial Sequence
  Synthetic Polynucleotide
taatacgactcactataggggagcaaccaatgtgttcattttcttcaagtaacagaggagaacttgaatgaaatgaacaaacctggcggcagcgcaaaagatg

SEQ ID NO: 1403 - DNA, 103 bp, Artificial Sequence
  Synthetic Polynucleotide
taatacgactcactatagggtgattgagcaaccaatgtgttcattttcttaacagaggagaaagaaaatgaacacattgaacctggcggcagcgcaaaagatg

SEQ ID NO: 1404 - DNA, 103 bp, Artificial Sequence
  Synthetic Polynucleotide
taatacgactcactatagggccaggtgattgagcaaccaatgtgttcattaacagaggagaaatgaaatgattggttgcaacctggcggcagcgcaaaagatg

SEQ ID NO: 1405 - DNA, 103 bp, Artificial Sequence
  Synthetic Polynucleotide
taatacgactcactatagggcatttccaggtgattgagcaaccaatgtgtaacagaggagaacacatatgttgctcaataacctggcggcagcgcaaaagatg

SEQ ID NO: 1406 - DNA, 103 bp, Artificial Sequence
  Synthetic Polynucleotide
taatacgactcactatagggcatgtcatttccaggtgattgagcaaccaaaacagaggagattggttatgcaatcacctaacctggcggcagcgcaaaagatg

SEQ ID NO: 1407 - DNA, 103 bp, Artificial Sequence
  Synthetic Polynucleotide
taatacgactcactatagggtaatccatgtcatttccaggtgattgagcaaacagaggagatgctcaatgacctggaaaaacctggcggcagcgcaaaagatg

SEQ ID NO: 1408 - DNA, 103 bp, Artificial Sequence
  Synthetic Polynucleotide
taatacgactcactatagggacacgtaatccatgtcatttccaggtgattaacagaggagaaatcacatggaaatgacaaacctggcggcagcgcaaaagatg

SEQ ID NO: 1409 - DNA, 103 bp, Artificial Sequence
  Synthetic Polynucleotide
taatacgactcactatagggggtcaacacgtaatccatgtcatttccaggaacagaggagacctggaatggacatggataacctggcggcagcgcaaaagatg

SEQ ID NO: 1410 - DNA, 103 bp, Artificial Sequence
  Synthetic Polynucleotide
taatacgactcactatagggaaacaggtcaacacgtaatccatgtcatttaacagaggagaaaatgaatgggattacgtaacctggcggcagcgcaaaagatg

SEQ ID NO: 1411 - DNA, 103 bp, Artificial Sequence
  Synthetic Polynucleotide
taatacgactcactataggggtttggtcttttcaatggacctaaggcgggaacagaggagacccgccatgggtccattgaacctggcggcagcgcaaaagatg

SEQ ID NO: 1412 - DNA, 103 bp, Artificial Sequence
  Synthetic Polynucleotide
taatacgactcactatagggttgcatccacgcctgttgagagacggaaagaacagaggagactttccatgtctcaacagaacctggcggcagcgcaaaagatg

SEQ ID NO: 1413 - DNA, 103 bp, Artificial Sequence
  Synthetic Polynucleotide
taatacgactcactataggggtctcaaacaggtcaacacgtaatccatgtaacagaggagaacatggatgacgtgttgaaacctggcggcagcgcaaaagatg

SEQ ID NO: 1414 - DNA, 103 bp, Artificial Sequence
  Synthetic Polynucleotide
taatacgactcactatagggagtttgtctcaaacaggtcaacacgtaatcaacagaggagagattacatgttgacctgtaacctggcggcagcgcaaaagatg

SEQ ID NO: 1415 - DNA, 103 bp, Artificial Sequence
  Synthetic Polynucleotide
taatacgactcactataggggcattagtttgtctcaaacaggtcaacacgaacagaggagacgtgttatgctgtttgagaacctggcggcagcgcaaaagatg

SEQ ID NO: 1416 - DNA, 103 bp, Artificial Sequence
  Synthetic Polynucleotide
taatacgactcactatagggaagctgcattagtttgtctcaaacaggtcaaacagaggagatgacctatgtgagacaaaaacctggcggcagcgcaaaagatg

SEQ ID NO: 1417 - DNA, 103 bp, Artificial Sequence
  Synthetic Polynucleotide
taatacgactcactatagggttgcaaagctgcattagtttgtctcaaacaaacagaggagatgtttgatgcaaactaataacctggcggcagcgcaaaagatg

SEQ ID NO: 1418 - DNA, 103 bp, Artificial Sequence
  Synthetic Polynucleotide
taatacgactcactatagggtggtcttgcaaagctgcattagtttgtctcaacagaggagagagacaatgtaatgcagcaacctggcggcagcgcaaaagatg

SEQ ID NO: 1419 - DNA, 103 bp, Artificial Sequence
  Synthetic Polynucleotide
taatacgactcactatagggcaatttggtcttgcaaagctgcattagtttaacagaggagaaaactaatgcagctttgcaacctggcggcagcgcaaaagatg

SEQ ID NO: 1420 - DNA, 103 bp, Artificial Sequence
  Synthetic Polynucleotide
taatacgactcactatagggttcatcaatttggtcttgcaaagctgcattaacagaggagaaatgcaatgttgcaagacaacctggcggcagcgcaaaagatg

SEQ ID NO: 1421 - DNA, 103 bp, Artificial Sequence
  Synthetic Polynucleotide
taatacgactcactatagggtgaagttcatcaatttggtcttgcaaagctaacagaggagaagctttatgagaccaaataacctggcggcagcgcaaaagatg

SEQ ID NO: 1422 - DNA, 103 bp, Artificial Sequence
  Synthetic Polynucleotide
taatacgactcactatagggcctcttgaagttcatcaatttggtcttgcaaacagaggagatgcaagatgaaattgatgaacctggcggcagcgcaaaagatg

SEQ ID NO: 1423 - DNA, 103 bp, Artificial Sequence
  Synthetic Polynucleotide
taatacgactcactataggggcatgttgcatccacgcctgttgagagacgaacagaggagacgtctcatgacaggcgtgaacctggcggcagcgcaaaagatg

SEQ ID NO: 1424 - DNA, 103 bp, Artificial Sequence
  Synthetic Polynucleotide
taatacgactcactataggggaaagcctcttgaagttcatcaatttggtcaacagaggagagaccaaatggatgaacttaacctggcggcagcgcaaaagatg

SEQ ID NO: 1425 - DNA, 103 bp, Artificial Sequence
  Synthetic Polynucleotide
taatacgactcactatagggtgattgaaagcctcttgaagttcatcaattaacagaggagaaattgaatgacttcaagaaacctggcggcagcgcaaaagatg

SEQ ID NO: 1426 - DNA, 103 bp, Artificial Sequence
  Synthetic Polynucleotide
taatacgactcactataggggagcttgattgaaagcctcttgaagttcataacagaggagaatgaacatgaagaggcttaacctggcggcagcgcaaaagatg

SEQ ID NO: 1427 - DNA, 103 bp, Artificial Sequence
  Synthetic Polynucleotide
taatacgactcactatagggttcttgagcttgattgaaagcctcttgaagaacagaggagacttcaaatggctttcaataacctggcggcagcgcaaaagatg

SEQ ID NO: 1428 - DNA, 103 bp, Artificial Sequence
  Synthetic Polynucleotide
taatacgactcactatagggtgtctttcttgagcttgattgaaagcctctaacagaggagaagaggcatgcaatcaagcaacctggcggcagcgcaaaagatg

SEQ ID NO: 1429 - DNA, 103 bp, Artificial Sequence
  Synthetic Polynucleotide
taatacgactcactatagggaattttgtctttcttgagcttgattgaaagaacagaggagactttcaatgaagctcaagaacctggcggcagcgcaaaagatg

SEQ ID NO: 1430 - DNA, 103 bp, Artificial Sequence
  Synthetic Polynucleotide
taatacgactcactatagggtaagaaattttgtctttcttgagcttgattaacagaggagaaatcaaatgcaagaaagaaacctggcggcagcgcaaaagatg

SEQ ID NO: 1431 - DNA, 103 bp, Artificial Sequence
  Synthetic Polynucleotide
taatacgactcactatagggtcagataagaaattttgtctttcttgagctaacagaggagaagctcaatgaagacaaaaaacctggcggcagcgcaaaagatg

SEQ ID NO: 1432 - DNA, 103 bp, Artificial Sequence
  Synthetic Polynucleotide
taatacgactcactataggggccaatcagataagaaattttgtctttcttaacagaggagaaagaaaatgaaaatttctaacctggcggcagcgcaaaagatg

SEQ ID NO: 1433 - DNA, 103 bp, Artificial Sequence
  Synthetic Polynucleotide
taatacgactcactatagggcttgagccaatcagataagaaattttgtctaacagaggagaagacaaatgttcttatctaacctggcggcagcgcaaaagatg

SEQ ID NO: 1434 - DNA, 103 bp, Artificial Sequence
  Synthetic Polynucleotide
taatacgactcactatagggttccggcatgttgcatccacgcctgttgagaacagaggagactcaacatgcgtggatgcaacctggcggcagcgcaaaagatg

SEQ ID NO: 1435 - DNA, 103 bp, Artificial Sequence
  Synthetic Polynucleotide
taatacgactcactataggggaaaccttgagccaatcagataagaaatttaacagaggagaaaatttatgatctgattgaacctggcggcagcgcaaaagatg

SEQ ID NO: 1436 - DNA, 103 bp, Artificial Sequence
  Synthetic Polynucleotide
taatacgactcactatagggttgctgaaaccttgagccaatcagataagaaacagaggagatcttatatgattggctcaaacctggcggcagcgcaaaagatg

SEQ ID NO: 1437 - DNA, 103 bp, Artificial Sequence
  Synthetic Polynucleotide
taatacgactcactatagggaacaattgctgaaaccttgagccaatcagaaacagaggagatctgatatgctcaaggttaacctggcggcagcgcaaaagatg

SEQ ID NO: 1438 - DNA, 103 bp, Artificial Sequence
  Synthetic Polynucleotide
taatacgactcactataggggcaaaaacaattgctgaaaccttgagccaaaacagaggagattggctatgggtttcagcaacctggcggcagcgcaaaagatg

SEQ ID NO: 1439 - DNA, 103 bp, Artificial Sequence
  Synthetic Polynucleotide
taatacgactcactatagggtggatgcaaaaacaattgctgaaaccttgaaacagaggagatcaaggatgcagcaattgaacctggcggcagcgcaaaagatg

SEQ ID NO: 1440 - DNA, 103 bp, Artificial Sequence
  Synthetic Polynucleotide
taatacgactcactatagggagcaatggatgcaaaaacaattgctgaaacaacagaggagagtttcaatgattgtttttaacctggcggcagcgcaaaagatg

SEQ ID NO: 1441 - DNA, 103 bp, Artificial Sequence
  Synthetic Polynucleotide
taatacgactcactatagggaaagaagcaatggatgcaaaaacaattgctaacagaggagaagcaatatgttttgcatcaacctggcggcagcgcaaaagatg

SEQ ID NO: 1442 - DNA, 103 bp, Artificial Sequence
  Synthetic Polynucleotide
taatacgactcactatagggcagataaagaagcaatggatgcaaaaacaaaacagaggagattgtttatgcatccattgaacctggcggcagcgcaaaagatg

SEQ ID NO: 1443 - DNA, 103 bp, Artificial Sequence
  Synthetic Polynucleotide
taatacgactcactatagggaactgcagataaagaagcaatggatgcaaaaacagaggagatttgcaatgattgcttctaacctggcggcagcgcaaaagatg

SEQ ID NO: 1444 - DNA, 103 bp, Artificial Sequence
  Synthetic Polynucleotide
taatacgactcactatagggttgcaaactgcagataaagaagcaatggataacagaggagaatccatatgttctttatcaacctggcggcagcgcaaaagatg

SEQ ID NO: 1445 - DNA, 103 bp, Artificial Sequence
  Synthetic Polynucleotide
taatacgactcactatagggaccgtttccggcatgttgcatccacgcctgaacagaggagacaggcgatgatgcaacataacctggcggcagcgcaaaagatg

SEQ ID NO: 1446 - DNA, 103 bp, Artificial Sequence
  Synthetic Polynucleotide
taatacgactcactatagggccaacttgcaaactgcagataaagaagcaaaacagaggagattgcttatgtatctgcagaacctggcggcagcgcaaaagatg

SEQ ID NO: 1447 - DNA, 103 bp, Artificial Sequence
  Synthetic Polynucleotide
taatacgactcactatagggggaaaccaacttgcaaactgcagataaagaaacagaggagatctttaatggcagtttgcaacctggcggcagcgcaaaagatg

SEQ ID NO: 1448 - DNA, 103 bp, Artificial Sequence
  Synthetic Polynucleotide
taatacgactcactatagggaatctggaaaccaacttgcaaactgcagataacagaggagaatctgcatgttgcaagttaacctggcggcagcgcaaaagatg

SEQ ID NO: 1449 - DNA, 103 bp, Artificial Sequence
  Synthetic Polynucleotide
taatacgactcactatagggttttaaatctggaaaccaacttgcaaactgaacagaggagacagtttatgagttggtttaacctggcggcagcgcaaaagatg

SEQ ID NO: 1450 - DNA, 103 bp, Artificial Sequence
  Synthetic Polynucleotide
taatacgactcactatagggcaaatttttaaatctggaaaccaacttgcaaacagaggagatgcaagatggtttccagaaacctggcggcagcgcaaaagatg

SEQ ID NO: 1451 - DNA, 103 bp, Artificial Sequence
  Synthetic Polynucleotide
taatacgactcactatagggcataccaaatttttaaatctggaaaccaacaacagaggagagttggtatgcagatttaaaacctggcggcagcgcaaaagatg

SEQ ID NO: 1452 - DNA, 103 bp, Artificial Sequence
  Synthetic Polynucleotide
taatacgactcactatagggctggacataccaaatttttaaatctggaaaaacagaggagatttccaatgttaaaaattaacctggcggcagcgcaaaagatg

SEQ ID NO: 1453 - DNA, 103 bp, Artificial Sequence
  Synthetic Polynucleotide
taatacgactcactatagggaggggctggacataccaaatttttaaatctaacagaggagaagatttatgaatttggtaaacctggcggcagcgcaaaagatg

SEQ ID NO: 1454 - DNA, 103 bp, Artificial Sequence
  Synthetic Polynucleotide
taatacgactcactatagggtggacaggggctggacataccaaatttttaaacagaggagataaaaaatgggtatgtccaacctggcggcagcgcaaaagatg

SEQ ID NO: 1455 - DNA, 103 bp, Artificial Sequence
  Synthetic Polynucleotide
taatacgactcactataggggtatttggacaggggctggacataccaaataacagaggagaatttggatggtccagcccaacctggcggcagcgcaaaagatg

SEQ ID NO: 1456 - DNA, 103 bp, Artificial Sequence
  Synthetic Polynucleotide
taatacgactcactatagggtcttcaccgtttccggcatgttgcatccacaacagaggagagtggatatgacatgccggaacctggcggcagcgcaaaagatg

SEQ ID NO: 1457 - DNA, 103 bp, Artificial Sequence
  Synthetic Polynucleotide
taatacgactcactatagggcagctgtatttggacaggggctggacatacaacagaggagagtatgtatggcccctgtcaacctggcggcagcgcaaaagatg

SEQ ID NO: 1458 - DNA, 103 bp, Artificial Sequence
  Synthetic Polynucleotide
taatacgactcactatagggtcagacagctgtatttggacaggggctggaaacagaggagatccagcatgtgtccaaataacctggcggcagcgcaaaagatg

SEQ ID NO: 1459 - DNA, 103 bp, Artificial Sequence
  Synthetic Polynucleotide
taatacgactcactatagggctccttcagacagctgtatttggacaggggaacagaggagacccctgatgaaatacagcaacctggcggcagcgcaaaagatg

SEQ ID NO: 1460 - DNA, 103 bp, Artificial Sequence
  Synthetic Polynucleotide
taatacgactcactatagggttgttctccttcagacagctgtatttggacaacagaggagagtccaaatgcagctgtctaacctggcggcagcgcaaaagatg

SEQ ID NO: 1461 - DNA, 103 bp, Artificial Sequence
  Synthetic Polynucleotide
taatacgactcactataggggcagcttgttctccttcagacagctgtattaacagaggagaaatacaatggtctgaaggaacctggcggcagcgcaaaagatg

SEQ ID NO: 1462 - DNA, 103 bp, Artificial Sequence
  Synthetic Polynucleotide
taatacgactcactatagggagtaagcagcttgttctccttcagacagctaacagaggagaagctgtatgaaggagaacaacctggcggcagcgcaaaagatg

SEQ ID NO: 1463 - DNA, 103 bp, Artificial Sequence
  Synthetic Polynucleotide
taatacgactcactatagggtccagagtaagcagcttgttctccttcagaaacagaggagatctgaaatggaacaagctaacctggcggcagcgcaaaagatg

SEQ ID NO: 1464 - DNA, 103 bp, Artificial Sequence
  Synthetic Polynucleotide
taatacgactcactatagggttgcctccagagtaagcagcttgttctcctaacagaggagaaggagaatgagctgcttaaacctggcggcagcgcaaaagatg

SEQ ID NO: 1465 - DNA, 103 bp, Artificial Sequence
  Synthetic Polynucleotide
taatacgactcactatagggctttcttgcctccagagtaagcagcttgttaacagaggagaaacaagatgcttactctgaacctggcggcagcgcaaaagatg

SEQ ID NO: 1466 - DNA, 103 bp, Artificial Sequence
  Synthetic Polynucleotide
taatacgactcactatagggctcacctttcttgcctccagagtaagcagcaacagaggagagctgctatgtctggaggcaacctggcggcagcgcaaaagatg

SEQ ID NO: 1467 - DNA, 103 bp, Artificial Sequence
  Synthetic Polynucleotide
taatacgactcactatagggtgttttcttcaccgtttccggcatgttgcaaacagaggagatgcaacatgccggaaacgaacctggcggcagcgcaaaagatg

SEQ ID NO: 1468 - DNA, 103 bp, Artificial Sequence
  Synthetic Polynucleotide
taatacgactcactatagggtgcttctcacctttcttgcctccagagtaaaacagaggagattactcatgaggcaagaaaacctggcggcagcgcaaaagatg

SEQ ID NO: 1469 - DNA, 103 bp, Artificial Sequence
  Synthetic Polynucleotide
taatacgactcactataggggtgtttgcttctcacctttcttgcctccagaacagaggagactggagatgagaaaggtgaacctggcggcagcgcaaaagatg

SEQ ID NO: 1470 - DNA, 103 bp, Artificial Sequence
  Synthetic Polynucleotide
taatacgactcactatagggttgaagtgtttgcttctcacctttcttgccaacagaggagaggcaagatgggtgagaagaacctggcggcagcgcaaaagatg

SEQ ID NO: 1471 - DNA, 103 bp, Artificial Sequence
  Synthetic Polynucleotide
taatacgactcactatagggaaaatttgaagtgtttgcttctcacctttcaacagaggagagaaaggatggaagcaaacaacctggcggcagcgcaaaagatg

SEQ ID NO: 1472 - DNA, 103 bp, Artificial Sequence
  Synthetic Polynucleotide
taatacgactcactatagggcgtccaaaatttgaagtgtttgcttctcacaacagaggagagtgagaatgaaacacttcaacctggcggcagcgcaaaagatg

SEQ ID NO: 1473 - DNA, 103 bp, Artificial Sequence
  Synthetic Polynucleotide
taatacgactcactatagggttgtacgtccaaaatttgaagtgtttgcttaacagaggagaaagcaaatgcttcaaattaacctggcggcagcgcaaaagatg

SEQ ID NO: 1474 - DNA, 103 bp, Artificial Sequence
  Synthetic Polynucleotide
taatacgactcactatagggccgccttgtacgtccaaaatttgaagtgttaacagaggagaaacactatgaattttggaaacctggcggcagcgcaaaagatg

SEQ ID NO: 1475 - DNA, 103 bp, Artificial Sequence
  Synthetic Polynucleotide
taatacgactcactatagggttcctccgccttgtacgtccaaaatttgaaaacagaggagattcaaaatgtggacgtacaacctggcggcagcgcaaaagatg

SEQ ID NO: 1476 - DNA, 103 bp, Artificial Sequence
  Synthetic Polynucleotide
taatacgactcactataggggatctttcctccgccttgtacgtccaaaataacagaggagaattttgatggtacaaggcaacctggcggcagcgcaaaagatg

SEQ ID NO: 1477 - DNA, 103 bp, Artificial Sequence
  Synthetic Polynucleotide
taatacgactcactataggggctacgatctttcctccgccttgtacgtccaacagaggagaggacgtatgaggcggaggaacctggcggcagcgcaaaagatg

SEQ ID NO: 1478 - DNA, 103 bp, Artificial Sequence
  Synthetic Polynucleotide
taatacgactcactatagggaaaactgttttcttcaccgtttccggcatgaacagaggagacatgccatgaacggtgaaaacctggcggcagcgcaaaagatg

SEQ ID NO: 1479 - DNA, 103 bp, Artificial Sequence
  Synthetic Polynucleotide
taatacgactcactatagggcctgggctacgatctttcctccgccttgtaaacagaggagatacaagatggaggaaagaaacctggcggcagcgcaaaagatg

SEQ ID NO: 1480 - DNA, 103 bp, Artificial Sequence
  Synthetic Polynucleotide
taatacgactcactatagggtccagcctgggctacgatctttcctccgccaacagaggagaggcggaatgaagatcgtaaacctggcggcagcgcaaaagatg

SEQ ID NO: 1481 - DNA, 103 bp, Artificial Sequence
  Synthetic Polynucleotide
taatacgactcactataggggggtttccagcctgggctacgatctttcctaacagaggagaaggaaaatgcgtagcccaaacctggcggcagcgcaaaagatg

SEQ ID NO: 1482 - DNA, 103 bp, Artificial Sequence
  Synthetic Polynucleotide
taatacgactcactatagggtaattgggtttccagcctgggctacgatctaacagaggagaagatcgatgcccaggctgaacctggcggcagcgcaaaagatg

SEQ ID NO: 1483 - DNA, 103 bp, Artificial Sequence
  Synthetic Polynucleotide
taatacgactcactatagggatccataattgggtttccagcctgggctacaacagaggagagtagccatggctggaaacaacctggcggcagcgcaaaagatg

SEQ ID NO: 1484 - DNA, 103 bp, Artificial Sequence
  Synthetic Polynucleotide
taatacgactcactatagggtcataatccataattgggtttccagcctggaacagaggagaccaggcatgaaacccaataacctggcggcagcgcaaaagatg

SEQ ID NO: 1485 - DNA, 103 bp, Artificial Sequence
  Synthetic Polynucleotide
taatacgactcactatagggttacttcataatccataattgggtttccagaacagaggagactggaaatgcaattatggaacctggcggcagcgcaaaagatg

SEQ ID NO: 1486 - DNA, 103 bp, Artificial Sequence
  Synthetic Polynucleotide
taatacgactcactatagggaatgtttacttcataatccataattgggttaacagaggagaaacccaatgatggattataacctggcggcagcgcaaaagatg

SEQ ID NO: 1487 - DNA, 103 bp, Artificial Sequence
  Synthetic Polynucleotide
taatacgactcactatagggtttgcaatgtttacttcataatccataattaacagaggagaaattatatgttatgaagtaacctggcggcagcgcaaaagatg

SEQ ID NO: 1488 - DNA, 103 bp, Artificial Sequence
  Synthetic Polynucleotide
taatacgactcactatagggtattctttgcaatgtttacttcataatccaaacagaggagatggattatgaagtaaacaaacctggcggcagcgcaaaagatg

SEQ ID NO: 1489 - DNA, 103 bp, Artificial Sequence
  Synthetic Polynucleotide
taatacgactcactatagggcacagaaaactgttttcttcaccgtttccgaacagaggagacggaaaatgtgaagaaaaaacctggcggcagcgcaaaagatg

SEQ ID NO: 1490 - DNA, 103 bp, Artificial Sequence
  Synthetic Polynucleotide
taatacgactcactatagggaaccatattctttgcaatgtttacttcataaacagaggagatatgaaatgaacattgcaaacctggcggcagcgcaaaagatg

SEQ ID NO: 1491 - DNA, 103 bp, Artificial Sequence
  Synthetic Polynucleotide
taatacgactcactatagggggggtaaccatattctttgcaatgtttactaacagaggagaagtaaaatgtgcaaagaaaacctggcggcagcgcaaaagatg

SEQ ID NO: 1492 - DNA, 103 bp, Artificial Sequence
  Synthetic Polynucleotide
taatacgactcactatagggtgatgggggtaaccatattctttgcaatgtaacagaggagaacattgatgagaatatggaacctggcggcagcgcaaaagatg

SEQ ID NO: 1493 - DNA, 103 bp, Artificial Sequence
  Synthetic Polynucleotide
taatacgactcactataggggaaggtgatgggggtaaccatattctttgcaacagaggagagcaaagatgatggttaccaacctggcggcagcgcaaaagatg

SEQ ID NO: 1494 - DNA, 103 bp, Artificial Sequence
  Synthetic Polynucleotide
taatacgactcactatagggtaaaagaaggtgatgggggtaaccatattcaacagaggagagaatatatgtacccccataacctggcggcagcgcaaaagatg

SEQ ID NO: 1495 - DNA, 103 bp, Artificial Sequence
  Synthetic Polynucleotide
taatacgactcactatagggctgcataaaagaaggtgatgggggtaaccaaacagaggagatggttaatgccatcacctaacctggcggcagcgcaaaagatg

SEQ ID NO: 1496 - DNA, 103 bp, Artificial Sequence
  Synthetic Polynucleotide
taatacgactcactatagggcttgtctgcataaaagaaggtgatgggggtaacagaggagaacccccatgaccttctttaacctggcggcagcgcaaaagatg

SEQ ID NO: 1497 - DNA, 103 bp, Artificial Sequence
  Synthetic Polynucleotide
taatacgactcactatagggtgtgccttgtctgcataaaagaaggtgatgaacagaggagacatcacatgcttttatgcaacctggcggcagcgcaaaagatg

SEQ ID NO: 1498 - DNA, 103 bp, Artificial Sequence
  Synthetic Polynucleotide
taatacgactcactatagggtgacttgtgccttgtctgcataaaagaaggaacagaggagaccttctatgatgcagacaaacctggcggcagcgcaaaagatg

SEQ ID NO: 1499 - DNA, 103 bp, Artificial Sequence
  Synthetic Polynucleotide
taatacgactcactatagggttgtgtgacttgtgccttgtctgcataaaaaacagaggagattttatatggacaaggcaaacctggcggcagcgcaaaagatg

SEQ ID NO: 1500 - DNA, 103 bp, Artificial Sequence
  Synthetic Polynucleotide
taatacgactcactatagggatttccacagaaaactgttttcttcaccgtaacagaggagaacggtgatgaaaacagttaacctggcggcagcgcaaaagatg

SEQ ID NO: 1501 - DNA, 103 bp, Artificial Sequence
  Synthetic Polynucleotide
taatacgactcactatagggcaggattgtgtgacttgtgccttgtctgcaaacagaggagatgcagaatgggcacaagtaacctggcggcagcgcaaaagatg

SEQ ID NO: 1502 - DNA, 103 bp, Artificial Sequence
  Synthetic Polynucleotide
taatacgactcactatagggacaaacaggattgtgtgacttgtgccttgtaacagaggagaacaaggatgaagtcacacaacctggcggcagcgcaaaagatg

SEQ ID NO: 1503 - DNA, 103 bp, Artificial Sequence
  Synthetic Polynucleotide
taatacgactcactatagggaaccaacaaacaggattgtgtgacttgtgcaacagaggagagcacaaatgacacaatccaacctggcggcagcgcaaaagatg

SEQ ID NO: 1504 - DNA, 103 bp, Artificial Sequence
  Synthetic Polynucleotide
taatacgactcactatagggcctttaaccaacaaacaggattgtgtgactaacagaggagaagtcacatgatcctgtttaacctggcggcagcgcaaaagatg

SEQ ID NO: 1505 - DNA, 103 bp, Artificial Sequence
  Synthetic Polynucleotide
taatacgactcactataggggatgtcctttaaccaacaaacaggattgtgaacagaggagacacaatatggtttgttggaacctggcggcagcgcaaaagatg

SEQ ID NO: 1506 - DNA, 103 bp, Artificial Sequence
  Synthetic Polynucleotide
taatacgactcactatagggaaagagatgtcctttaaccaacaaacaggaaacagaggagatcctgtatgttggttaaaaacctggcggcagcgcaaaagatg

SEQ ID NO: 1507 - DNA, 103 bp, Artificial Sequence
  Synthetic Polynucleotide
taatacgactcactatagggaccacaaagagatgtcctttaaccaacaaaaacagaggagatttgttatgtaaaggacaaacctggcggcagcgcaaaagatg

SEQ ID NO: 1508 - DNA, 103 bp, Artificial Sequence
  Synthetic Polynucleotide
taatacgactcactatagggtattgaccacaaagagatgtcctttaaccaaacagaggagatggttaatggacatctctaacctggcggcagcgcaaaagatg

SEQ ID NO: 1509 - DNA, 103 bp, Artificial Sequence
  Synthetic Polynucleotide
taatacgactcactatagggatgtctattgaccacaaagagatgtcctttaacagaggagaaaaggaatgctctttgtgaacctggcggcagcgcaaaagatg

SEQ ID NO: 1510 - DNA, 103 bp, Artificial Sequence
  Synthetic Polynucleotide
taatacgactcactataggggccacatgtctattgaccacaaagagatgtaacagaggagaacatctatgtgtggtcaaaacctggcggcagcgcaaaagatg

SEQ ID NO: 1511 - DNA, 103 bp, Artificial Sequence
  Synthetic Polynucleotide
taatacgactcactatagggtctaaatttccacagaaaactgttttcttcaacagaggagagaagaaatgagttttctgaacctggcggcagcgcaaaagatg

SEQ ID NO: 1512 - DNA, 103 bp, Artificial Sequence
  Synthetic Polynucleotide
taatacgactcactatagggtttcggccacatgtctattgaccacaaagaaacagaggagatctttgatgtcaatagacaacctggcggcagcgcaaaagatg

SEQ ID NO: 1513 - DNA, 103 bp, Artificial Sequence
  Synthetic Polynucleotide
taatacgactcactataggggtctgtttcggccacatgtctattgaccacaacagaggagagtggtcatgagacatgtgaacctggcggcagcgcaaaagatg

SEQ ID NO: 1514 - DNA, 103 bp, Artificial Sequence
  Synthetic Polynucleotide
taatacgactcactatagggcaccagtctgtttcggccacatgtctattgaacagaggagacaatagatgtgtggccgaaacctggcggcagcgcaaaagatg

SEQ ID NO: 1515 - DNA, 103 bp, Artificial Sequence
  Synthetic Polynucleotide
taatacgactcactatagggaggcacaccagtctgtttcggccacatgtcaacagaggagagacatgatgccgaaacagaacctggcggcagcgcaaaagatg

SEQ ID NO: 1516 - DNA, 103 bp, Artificial Sequence
  Synthetic Polynucleotide
taatacgactcactatagggttcaaaggcacaccagtctgtttcggccacaacagaggagagtggccatgacagactggaacctggcggcagcgcaaaagatg

SEQ ID NO: 1517 - DNA, 103 bp, Artificial Sequence
  Synthetic Polynucleotide
taatacgactcactatagggctgagttcaaaggcacaccagtctgtttcgaacagaggagacgaaacatgctggtgtgcaacctggcggcagcgcaaaagatg

SEQ ID NO: 1518 - DNA, 103 bp, Artificial Sequence
  Synthetic Polynucleotide
taatacgactcactatagggtgcctctgagttcaaaggcacaccagtctgaacagaggagacagactatggtgcctttgaacctggcggcagcgcaaaagatg

SEQ ID NO: 1519 - DNA, 103 bp, Artificial Sequence
  Synthetic Polynucleotide
taatacgactcactatagggtcgtgtgcctctgagttcaaaggcacaccaaacagaggagatggtgtatgtttgaactcaacctggcggcagcgcaaaagatg

SEQ ID NO: 1520 - DNA, 103 bp, Artificial Sequence
  Synthetic Polynucleotide
taatacgactcactatagggtcatgtcgtgtgcctctgagttcaaaggcaaacagaggagatgccttatgactcagaggaacctggcggcagcgcaaaagatg

SEQ ID NO: 1521 - DNA, 103 bp, Artificial Sequence
  Synthetic Polynucleotide
taatacgactcactatagggctctctcatgtcgtgtgcctctgagttcaaaacagaggagattgaacatggaggcacacaacctggcggcagcgcaaaagatg

SEQ ID NO: 1522 - DNA, 103 bp, Artificial Sequence
  Synthetic Polynucleotide
taatacgactcactataggggacatgtttggtcttttcaatggacctaagaacagaggagacttaggatgattgaaaagaacctggcggcagcgcaaaagatg

SEQ ID NO: 1523 - DNA, 103 bp, Artificial Sequence
  Synthetic Polynucleotide
taatacgactcactatagggtccactctaaatttccacagaaaactgtttaacagaggagaaaacagatgtctgtggaaaacctggcggcagcgcaaaagatg

SEQ ID NO: 1524 - DNA, 103 bp, Artificial Sequence
  Synthetic Polynucleotide
taatacgactcactatagggcgagtctctctcatgtcgtgtgcctctgagaacagaggagactcagaatgacacgacataacctggcggcagcgcaaaagatg

SEQ ID NO: 1525 - DNA, 103 bp, Artificial Sequence
  Synthetic Polynucleotide
taatacgactcactatagggtgtaccgagtctctctcatgtcgtgtgcctaacagaggagaaggcacatgacatgagagaacctggcggcagcgcaaaagatg

SEQ ID NO: 1526 - DNA, 103 bp, Artificial Sequence
  Synthetic Polynucleotide
taatacgactcactatagggtcatctgtaccgagtctctctcatgtcgtgaacagaggagacacgacatgagagagactaacctggcggcagcgcaaaagatg

SEQ ID NO: 1527 - DNA, 103 bp, Artificial Sequence
  Synthetic Polynucleotide
taatacgactcactatagggtgatctcatctgtaccgagtctctctcatgaacagaggagacatgagatggactcggtaaacctggcggcagcgcaaaagatg

SEQ ID NO: 1528 - DNA, 103 bp, Artificial Sequence
  Synthetic Polynucleotide
taatacgactcactatagggtttattgatctcatctgtaccgagtctctcaacagaggagagagagaatgggtacagataacctggcggcagcgcaaaagatg

SEQ ID NO: 1529 - DNA, 103 bp, Artificial Sequence
  Synthetic Polynucleotide
taatacgactcactatagggatttgtttattgatctcatctgtaccgagtaacagaggagaactcggatgagatgagataacctggcggcagcgcaaaagatg

SEQ ID NO: 1530 - DNA, 103 bp, Artificial Sequence
  Synthetic Polynucleotide
taatacgactcactatagggtccagatttgtttattgatctcatctgtacaacagaggagagtacagatgagatcaataaacctggcggcagcgcaaaagatg

SEQ ID NO: 1531 - DNA, 103 bp, Artificial Sequence
  Synthetic Polynucleotide
taatacgactcactatagggtccattccagatttgtttattgatctcatcaacagaggagagatgagatgaataaacaaaacctggcggcagcgcaaaagatg

SEQ ID NO: 1532 - DNA, 103 bp, Artificial Sequence
  Synthetic Polynucleotide
taatacgactcactatagggcaacttccattccagatttgtttattgatcaacagaggagagatcaaatgacaaatctgaacctggcggcagcgcaaaagatg

SEQ ID NO: 1533 - DNA, 103 bp, Artificial Sequence
  Synthetic Polynucleotide
taatacgactcactatagggcaaatcaacttccattccagatttgtttataacagaggagaataaacatgtctggaatgaacctggcggcagcgcaaaagatg

SEQ ID NO: 1534 - DNA, 103 bp, Artificial Sequence
  Synthetic Polynucleotide
taatacgactcactatagggcgatgtccactctaaatttccacagaaaacaacagaggagagttttcatgggaaatttaaacctggcggcagcgcaaaagatg

SEQ ID NO: 1535 - DNA, 103 bp, Artificial Sequence
  Synthetic Polynucleotide
taatacgactcactatagggaaagtcaaatcaacttccattccagatttgaacagaggagacaaatcatgaatggaagtaacctggcggcagcgcaaaagatg

SEQ ID NO: 1536 - DNA, 103 bp, Artificial Sequence
  Synthetic Polynucleotide
taatacgactcactatagggtcacaaaagtcaaatcaacttccattccagaacagaggagactggaaatgaagttgattaacctggcggcagcgcaaaagatg

SEQ ID NO: 1537 - DNA, 103 bp, Artificial Sequence
  Synthetic Polynucleotide
taatacgactcactatagggaaccttcacaaaagtcaaatcaacttccataacagaggagaatggaaatggatttgactaacctggcggcagcgcaaaagatg

SEQ ID NO: 1538 - DNA, 103 bp, Artificial Sequence
  Synthetic Polynucleotide
taatacgactcactatagggttaacaaccttcacaaaagtcaaatcaactaacagaggagaagttgaatggacttttgtaacctggcggcagcgcaaaagatg

SEQ ID NO: 1539 - DNA, 103 bp, Artificial Sequence
  Synthetic Polynucleotide
taatacgactcactataggggtcctttaacaaccttcacaaaagtcaaataacagaggagaatttgaatgttgtgaaggaacctggcggcagcgcaaaagatg

SEQ ID NO: 1540 - DNA, 103 bp, Artificial Sequence
  Synthetic Polynucleotide
taatacgactcactatagggcaaaggtcctttaacaaccttcacaaaagtaacagaggagaacttttatgaaggttgttaacctggcggcagcgcaaaagatg

SEQ ID NO: 1541 - DNA, 103 bp, Artificial Sequence
  Synthetic Polynucleotide
taatacgactcactatagggttgaacaaaggtcctttaacaaccttcacaaacagaggagatgtgaaatgtgttaaaggaacctggcggcagcgcaaaagatg

SEQ ID NO: 1542 - DNA, 103 bp, Artificial Sequence
  Synthetic Polynucleotide
taatacgactcactatagggtgtccttgaacaaaggtcctttaacaacctaacagaggagaaggttgatgaaggaccttaacctggcggcagcgcaaaagatg

SEQ ID NO: 1543 - DNA, 103 bp, Artificial Sequence
  Synthetic Polynucleotide
taatacgactcactatagggagaattgtccttgaacaaaggtcctttaacaacagaggagagttaaaatgcctttgttcaacctggcggcagcgcaaaagatg

SEQ ID NO: 1544 - DNA, 103 bp, Artificial Sequence
  Synthetic Polynucleotide
taatacgactcactatagggttcctagaattgtccttgaacaaaggtcctaacagaggagaaggaccatggttcaaggaaacctggcggcagcgcaaaagatg

SEQ ID NO: 1545 - DNA, 103 bp, Artificial Sequence
  Synthetic Polynucleotide
taatacgactcactatagggtgtttcgatgtccactctaaatttccacagaacagaggagactgtggatgtttagagtgaacctggcggcagcgcaaaagatg

SEQ ID NO: 1546 - DNA, 103 bp, Artificial Sequence
  Synthetic Polynucleotide
taatacgactcactatagggaaaatttcctagaattgtccttgaacaaagaacagaggagactttgtatgaggacaattaacctggcggcagcgcaaaagatg

SEQ ID NO: 1547 - DNA, 103 bp, Artificial Sequence
  Synthetic Polynucleotide
taatacgactcactatagggagaacaaaatttcctagaattgtccttgaaaacagaggagattcaagatgaattctaggaacctggcggcagcgcaaaagatg

SEQ ID NO: 1548 - DNA, 103 bp, Artificial Sequence
  Synthetic Polynucleotide
taatacgactcactatagggtctttagaacaaaatttcctagaattgtccaacagaggagaggacaaatgtaggaaattaacctggcggcagcgcaaaagatg

SEQ ID NO: 1549 - DNA, 103 bp, Artificial Sequence
  Synthetic Polynucleotide
taatacgactcactatagggcatcatctttagaacaaaatttcctagaataacagaggagaattctaatgaattttgttaacctggcggcagcgcaaaagatg

SEQ ID NO: 1550 - DNA, 103 bp, Artificial Sequence
  Synthetic Polynucleotide
taatacgactcactataggggaagtcatcatctttagaacaaaatttcctaacagaggagaaggaaaatgtgttctaaaaacctggcggcagcgcaaaagatg

SEQ ID NO: 1551 - DNA, 103 bp, Artificial Sequence
  Synthetic Polynucleotide
taatacgactcactataggggccgggaagtcatcatctttagaacaaaataacagaggagaattttgatgtaaagatgaaacctggcggcagcgcaaaagatg

SEQ ID NO: 1552 - DNA, 103 bp, Artificial Sequence
  Synthetic Polynucleotide
taatacgactcactatagggttctagccgggaagtcatcatctttagaacaacagaggagagttctaatgatgatgactaacctggcggcagcgcaaaagatg

SEQ ID NO: 1553 - DNA, 103 bp, Artificial Sequence
  Synthetic Polynucleotide
taatacgactcactatagggctcgtttctagccgggaagtcatcatctttaacagaggagaaaagatatggacttcccgaacctggcggcagcgcaaaagatg

SEQ ID NO: 1554 - DNA, 103 bp, Artificial Sequence
  Synthetic Polynucleotide
taatacgactcactatagggacagtctcgtttctagccgggaagtcatcaaacagaggagatgatgaatgcccggctagaacctggcggcagcgcaaaagatg

SEQ ID NO: 1555 - DNA, 103 bp, Artificial Sequence
  Synthetic Polynucleotide
taatacgactcactatagggctgtaacagtctcgtttctagccgggaagtaacagaggagaacttccatgctagaaacgaacctggcggcagcgcaaaagatg

SEQ ID NO: 1556 - DNA, 103 bp, Artificial Sequence
  Synthetic Polynucleotide
taatacgactcactatagggacagctgtttcgatgtccactctaaatttcaacagaggagagaaattatgagtggacataacctggcggcagcgcaaaagatg

SEQ ID NO: 1557 - DNA, 103 bp, Artificial Sequence
  Synthetic Polynucleotide
taatacgactcactatagggaattcctgtaacagtctcgtttctagccggaacagaggagaccggctatgaacgagactaacctggcggcagcgcaaaagatg

SEQ ID NO: 1558 - DNA, 103 bp, Artificial Sequence
  Synthetic Polynucleotide
taatacgactcactatagggttcataattcctgtaacagtctcgtttctaaacagaggagatagaaaatggactgttacaacctggcggcagcgcaaaagatg

SEQ ID NO: 1559 - DNA, 103 bp, Artificial Sequence
  Synthetic Polynucleotide
taatacgactcactatagggcagtattcataattcctgtaacagtctcgtaacagaggagaacgagaatgttacaggaaaacctggcggcagcgcaaaagatg

SEQ ID NO: 1560 - DNA, 103 bp, Artificial Sequence
  Synthetic Polynucleotide
taatacgactcactataggggactccagtattcataattcctgtaacagtaacagaggagaactgttatgggaattatgaacctggcggcagcgcaaaagatg

SEQ ID NO: 1561 - DNA, 103 bp, Artificial Sequence
  Synthetic Polynucleotide
taatacgactcactatagggaaagggactccagtattcataattcctgtaaacagaggagatacaggatgtatgaatacaacctggcggcagcgcaaaagatg

SEQ ID NO: 1562 - DNA, 103 bp, Artificial Sequence
  Synthetic Polynucleotide
taatacgactcactatagggagacaaaagggactccagtattcataattcaacagaggagagaattaatgatactggagaacctggcggcagcgcaaaagatg

SEQ ID NO: 1563 - DNA, 103 bp, Artificial Sequence
  Synthetic Polynucleotide
taatacgactcactatagggagtgaagacaaaagggactccagtattcataacagaggagaatgaatatgggagtccctaacctggcggcagcgcaaaagatg

SEQ ID NO: 1564 - DNA, 103 bp, Artificial Sequence
  Synthetic Polynucleotide
taatacgactcactatagggtttccagtgaagacaaaagggactccagtaaacagaggagatactggatgcccttttgtaacctggcggcagcgcaaaagatg

SEQ ID NO: 1565 - DNA, 103 bp, Artificial Sequence
  Synthetic Polynucleotide
taatacgactcactatagggaaaactttccagtgaagacaaaagggactcaacagaggagagagtccatgttgtcttcaaacctggcggcagcgcaaaagatg

SEQ ID NO: 1566 - DNA, 103 bp, Artificial Sequence
  Synthetic Polynucleotide
taatacgactcactatagggaaccaaaaactttccagtgaagacaaaaggaacagaggagaccttttatgttcactggaaacctggcggcagcgcaaaagatg

SEQ ID NO: 1567 - DNA, 103 bp, Artificial Sequence
  Synthetic Polynucleotide
taatacgactcactatagggtcgctacagctgtttcgatgtccactctaaaacagaggagattagagatgacatcgaaaaacctggcggcagcgcaaaagatg

SEQ ID NO: 1568 - DNA, 103 bp, Artificial Sequence
  Synthetic Polynucleotide
taatacgactcactatagggttgccaaccaaaaactttccagtgaagacaaacagaggagatgtcttatgtggaaagttaacctggcggcagcgcaaaagatg

SEQ ID NO: 1569 - DNA, 103 bp, Artificial Sequence
  Synthetic Polynucleotide
taatacgactcactataggggctgattgccaaccaaaaactttccagtgaaacagaggagatcactgatgagtttttggaacctggcggcagcgcaaaagatg

SEQ ID NO: 1570 - DNA, 103 bp, Artificial Sequence
  Synthetic Polynucleotide
taatacgactcactatagggaaccggctgattgccaaccaaaaactttccaacagaggagaggaaagatgttggttggcaacctggcggcagcgcaaaagatg

SEQ ID NO: 1571 - DNA, 103 bp, Artificial Sequence
  Synthetic Polynucleotide
taatacgactcactataggggtgttaaccggctgattgccaaccaaaaacaacagaggagagtttttatgtggcaatcaaacctggcggcagcgcaaaagatg

SEQ ID NO: 1572 - DNA, 103 bp, Artificial Sequence
  Synthetic Polynucleotide
taatacgactcactatagggtggttgtgttaaccggctgattgccaaccaaacagaggagatggttgatgatcagccggaacctggcggcagcgcaaaagatg

SEQ ID NO: 1573 - DNA, 103 bp, Artificial Sequence
  Synthetic Polynucleotide
taatacgactcactatagggaccagtggttgtgttaaccggctgattgccaacagaggagaggcaatatgccggttaacaacctggcggcagcgcaaaagatg

SEQ ID NO: 1574 - DNA, 103 bp, Artificial Sequence
  Synthetic Polynucleotide
taatacgactcactatagggcatgcaccagtggttgtgttaaccggctgaaacagaggagatcagccatgtaacacaacaacctggcggcagcgcaaaagatg

SEQ ID NO: 1575 - DNA, 103 bp, Artificial Sequence
  Synthetic Polynucleotide
taatacgactcactatagggtgaaacatgcaccagtggttgtgttaaccgaacagaggagacggttaatgcaaccactgaacctggcggcagcgcaaaagatg

SEQ ID NO: 1576 - DNA, 103 bp, Artificial Sequence
  Synthetic Polynucleotide
taatacgactcactatagggatgattgaaacatgcaccagtggttgtgttaacagaggagaaacacaatgactggtgcaaacctggcggcagcgcaaaagatg

SEQ ID NO: 1577 - DNA, 103 bp, Artificial Sequence
  Synthetic Polynucleotide
taatacgactcactatagggatacaatgattgaaacatgcaccagtggttaacagaggagaaaccacatgtgcatgtttaacctggcggcagcgcaaaagatg

SEQ ID NO: 1578 - DNA, 103 bp, Artificial Sequence
  Synthetic Polynucleotide
taatacgactcactatagggtgaggtcgctacagctgtttcgatgtccacaacagaggagagtggacatggaaacagctaacctggcggcagcgcaaaagatg

SEQ ID NO: 1579 - DNA, 103 bp, Artificial Sequence
  Synthetic Polynucleotide
taatacgactcactatagggagtgtatacaatgattgaaacatgcaccagaacagaggagactggtgatggtttcaatcaacctggcggcagcgcaaaagatg

SEQ ID NO: 1580 - DNA, 103 bp, Artificial Sequence
  Synthetic Polynucleotide
taatacgactcactatagggtctatagtgtatacaatgattgaaacatgcaacagaggagagcatgtatgaatcattgtaacctggcggcagcgcaaaagatg

SEQ ID NO: 1581 - DNA, 103 bp, Artificial Sequence
  Synthetic Polynucleotide
taatacgactcactataggggtagctctatagtgtatacaatgattgaaaaacagaggagatttcaaatgttgtatacaaacctggcggcagcgcaaaagatg

SEQ ID NO: 1582 - DNA, 103 bp, Artificial Sequence
  Synthetic Polynucleotide
taatacgactcactataggggtgttgtagctctatagtgtatacaatgataacagaggagaatcattatgtacactataaacctggcggcagcgcaaaagatg

SEQ ID NO: 1583 - DNA, 103 bp, Artificial Sequence
  Synthetic Polynucleotide
taatacgactcactatagggtcgatgtgttgtagctctatagtgtatacaaacagaggagatgtataatgtatagagctaacctggcggcagcgcaaaagatg

SEQ ID NO: 1584 - DNA, 103 bp, Artificial Sequence
  Synthetic Polynucleotide
taatacgactcactatagggcatcctcgatgtgttgtagctctatagtgtaacagaggagaacactaatgagctacaacaacctggcggcagcgcaaaagatg

SEQ ID NO: 1585 - DNA, 103 bp, Artificial Sequence
  Synthetic Polynucleotide
taatacgactcactatagggcgcaccatcctcgatgtgttgtagctctataacagaggagaatagagatgcaacacatcaacctggcggcagcgcaaaagatg

SEQ ID NO: 1586 - DNA, 103 bp, Artificial Sequence
  Synthetic Polynucleotide
taatacgactcactatagggcgacccgcaccatcctcgatgtgttgtagcaacagaggagagctacaatgcatcgaggaaacctggcggcagcgcaaaagatg

SEQ ID NO: 1587 - DNA, 103 bp, Artificial Sequence
  Synthetic Polynucleotide
taatacgactcactatagggagtgccgacccgcaccatcctcgatgtgttaacagaggagaaacacaatgaggatggtgaacctggcggcagcgcaaaagatg

SEQ ID NO: 1588 - DNA, 103 bp, Artificial Sequence
  Synthetic Polynucleotide
taatacgactcactatagggagatgagtgccgacccgcaccatcctcgataacagaggagaatcgagatgggtgcgggtaacctggcggcagcgcaaaagatg

SEQ ID NO: 1589 - DNA, 103 bp, Artificial Sequence
  Synthetic Polynucleotide
taatacgactcactatagggtactgtgaggtcgctacagctgtttcgatgaacagaggagacatcgaatgagctgtagcaacctggcggcagcgcaaaagatg

SEQ ID NO: 1590 - DNA, 103 bp, Artificial Sequence
  Synthetic Polynucleotide
taatacgactcactatagggatgacagatgagtgccgacccgcaccatccaacagaggagaggatggatggggtcggcaaacctggcggcagcgcaaaagatg

SEQ ID NO: 1591 - DNA, 103 bp, Artificial Sequence
  Synthetic Polynucleotide
taatacgactcactatagggttgacatgacagatgagtgccgacccgcacaacagaggagagtgcggatgggcactcataacctggcggcagcgcaaaagatg

SEQ ID NO: 1592 - DNA, 103 bp, Artificial Sequence
  Synthetic Polynucleotide
taatacgactcactatagggtgccgttgacatgacagatgagtgccgaccaacagaggagaggtcggatgtcatctgtcaacctggcggcagcgcaaaagatg

SEQ ID NO: 1593 - DNA, 103 bp, Artificial Sequence
  Synthetic Polynucleotide
taatacgactcactatagggcttcttgccgttgacatgacagatgagtgcaacagaggagagcactcatgtgtcatgtcaacctggcggcagcgcaaaagatg

SEQ ID NO: 1594 - DNA, 103 bp, Artificial Sequence
  Synthetic Polynucleotide
taatacgactcactatagggacggccttcttgccgttgacatgacagatgaacagaggagacatctgatgtgtcaacggaacctggcggcagcgcaaaagatg

SEQ ID NO: 1595 - DNA, 103 bp, Artificial Sequence
  Synthetic Polynucleotide
taatacgactcactatagggcatacacggccttcttgccgttgacatgacaacagaggagagtcatgatgacggcaagaaacctggcggcagcgcaaaagatg

SEQ ID NO: 1596 - DNA, 103 bp, Artificial Sequence
  Synthetic Polynucleotide
taatacgactcactatagggcattgcatacacggccttcttgccgttgacaacagaggagagtcaacatgaagaaggccaacctggcggcagcgcaaaagatg

SEQ ID NO: 1597 - DNA, 103 bp, Artificial Sequence
  Synthetic Polynucleotide
taatacgactcactataggggagtgcattgcatacacggccttcttgccgaacagaggagacggcaaatgggccgtgtaaacctggcggcagcgcaaaagatg

SEQ ID NO: 1598 - DNA, 103 bp, Artificial Sequence
  Synthetic Polynucleotide
taatacgactcactatagggcagctgagtgcattgcatacacggccttctaacagaggagaagaaggatgtgtatgcaaaacctggcggcagcgcaaaagatg

SEQ ID NO: 1599 - DNA, 103 bp, Artificial Sequence
  Synthetic Polynucleotide
taatacgactcactatagggaccaccagctgagtgcattgcatacacggcaacagaggagagccgtgatggcaatgcacaacctggcggcagcgcaaaagatg

SEQ ID NO: 1600 - DNA, 103 bp, Artificial Sequence
  Synthetic Polynucleotide
taatacgactcactataggggctgctactgtgaggtcgctacagctgtttaacagaggagaaaacagatgtagcgacctaacctggcggcagcgcaaaagatg

SEQ ID NO: 1601 - DNA, 103 bp, Artificial Sequence
  Synthetic Polynucleotide
taatacgactcactatagggccgccaccaccagctgagtgcattgcatacaacagaggagagtatgcatggcactcagcaacctggcggcagcgcaaaagatg

SEQ ID NO: 1602 - DNA, 103 bp, Artificial Sequence
  Synthetic Polynucleotide
taatacgactcactatagggccatgccgccaccaccagctgagtgcattgaacagaggagacaatgcatgcagctggtgaacctggcggcagcgcaaaagatg

SEQ ID NO: 1603 - DNA, 103 bp, Artificial Sequence
  Synthetic Polynucleotide
taatacgactcactatagggggcagccatgccgccaccaccagctgagtgaacagaggagacactcaatgggtggtggcaacctggcggcagcgcaaaagatg

SEQ ID NO: 1604 - DNA, 103 bp, Artificial Sequence
  Synthetic Polynucleotide
taatacgactcactataggggtagcggcagccatgccgccaccaccagctaacagaggagaagctggatgtggcggcataacctggcggcagcgcaaaagatg

SEQ ID NO: 1605 - DNA, 103 bp, Artificial Sequence
  Synthetic Polynucleotide
taatacgactcactatagggttatcgtagcggcagccatgccgccaccacaacagaggagagtggtgatggcatggctgaacctggcggcagcgcaaaagatg

SEQ ID NO: 1606 - DNA, 103 bp, Artificial Sequence
  Synthetic Polynucleotide
taatacgactcactatagggagtgattatcgtagcggcagccatgccgccaacagaggagaggcggcatggctgccgctaacctggcggcagcgcaaaagatg

SEQ ID NO: 1607 - DNA, 103 bp, Artificial Sequence
  Synthetic Polynucleotide
taatacgactcactatagggtcctgagtgattatcgtagcggcagccatgaacagaggagacatggcatgcgctacgataacctggcggcagcgcaaaagatg

SEQ ID NO: 1608 - DNA, 103 bp, Artificial Sequence
  Synthetic Polynucleotide
taatacgactcactatagggtcatttcctgagtgattatcgtagcggcagaacagaggagactgccgatgcgataatcaaacctggcggcagcgcaaaagatg

SEQ ID NO: 1609 - DNA, 103 bp, Artificial Sequence
  Synthetic Polynucleotide
taatacgactcactatagggttcaatcatttcctgagtgattatcgtagcaacagaggagagctacgatgatcactcagaacctggcggcagcgcaaaagatg

SEQ ID NO: 1610 - DNA, 103 bp, Artificial Sequence
  Synthetic Polynucleotide
taatacgactcactataggggcagcttcaatcatttcctgagtgattatcaacagaggagagataatatgtcaggaaataacctggcggcagcgcaaaagatg

SEQ ID NO: 1611 - DNA, 103 bp, Artificial Sequence
  Synthetic Polynucleotide
taatacgactcactatagggaatccgctgctactgtgaggtcgctacagcaacagaggagagctgtaatgacctcacagaacctggcggcagcgcaaaagatg

SEQ ID NO: 1612 - DNA, 103 bp, Artificial Sequence
  Synthetic Polynucleotide
taatacgactcactatagggtttcagcagcttcaatcatttcctgagtgaaacagaggagatcactcatgaaatgattgaacctggcggcagcgcaaaagatg

SEQ ID NO: 1613 - DNA, 103 bp, Artificial Sequence
  Synthetic Polynucleotide
taatacgactcactatagggggccttttcagcagcttcaatcatttcctgaacagaggagacaggaaatgattgaagctaacctggcggcagcgcaaaagatg

SEQ ID NO: 1614 - DNA, 103 bp, Artificial Sequence
  Synthetic Polynucleotide
taatacgactcactatagggtccaaggccttttcagcagcttcaatcattaacagaggagaaatgatatgagctgctgaaacctggcggcagcgcaaaagatg

SEQ ID NO: 1615 - DNA, 103 bp, Artificial Sequence
  Synthetic Polynucleotide
taatacgactcactataggggacaatccaaggccttttcagcagcttcaaaacagaggagattgaagatgctgaaaaggaacctggcggcagcgcaaaagatg

SEQ ID NO: 1616 - DNA, 103 bp, Artificial Sequence
  Synthetic Polynucleotide
taatacgactcactatagggaattagacaatccaaggccttttcagcagcaacagaggagagctgctatgaaggccttgaacctggcggcagcgcaaaagatg

SEQ ID NO: 1617 - DNA, 103 bp, Artificial Sequence
  Synthetic Polynucleotide
taatacgactcactatagggtgaggaattagacaatccaaggccttttcaaacagaggagatgaaaaatgcttggattgaacctggcggcagcgcaaaagatg

SEQ ID NO: 1618 - DNA, 103 bp, Artificial Sequence
  Synthetic Polynucleotide
taatacgactcactatagggcaccctgaggaattagacaatccaaggcctaacagaggagaaggcctatgattgtctaaaacctggcggcagcgcaaaagatg

SEQ ID NO: 1619 - DNA, 103 bp, Artificial Sequence
  Synthetic Polynucleotide
taatacgactcactatagggtatagcaccctgaggaattagacaatccaaaacagaggagattggatatgctaattcctaacctggcggcagcgcaaaagatg

SEQ ID NO: 1620 - DNA, 103 bp, Artificial Sequence
  Synthetic Polynucleotide
taatacgactcactatagggtcaactatagcaccctgaggaattagacaaaacagaggagattgtctatgtcctcagggaacctggcggcagcgcaaaagatg

SEQ ID NO: 1621 - DNA, 103 bp, Artificial Sequence
  Synthetic Polynucleotide
taatacgactcactatagggcaatttcaactatagcaccctgaggaattaaacagaggagataattcatgagggtgctaaacctggcggcagcgcaaaagatg

SEQ ID NO: 1622 - DNA, 103 bp, Artificial Sequence
  Synthetic Polynucleotide
taatacgactcactatagggaggggaatccgctgctactgtgaggtcgctaacagaggagaagcgacatgacagtagcaaacctggcggcagcgcaaaagatg

SEQ ID NO: 1623 - DNA, 103 bp, Artificial Sequence
  Synthetic Polynucleotide
taatacgactcactatagggaatgccaatttcaactatagcaccctgaggaacagaggagacctcagatggctatagttaacctggcggcagcgcaaaagatg

SEQ ID NO: 1624 - DNA, 103 bp, Artificial Sequence
  Synthetic Polynucleotide
taatacgactcactataggggtgtcaatgccaatttcaactatagcacccaacagaggagagggtgcatgagttgaaataacctggcggcagcgcaaaagatg

SEQ ID NO: 1625 - DNA, 103 bp, Artificial Sequence
  Synthetic Polynucleotide
taatacgactcactatagggcaactgtgtcaatgccaatttcaactatagaacagaggagactatagatgaaattggcaaacctggcggcagcgcaaaagatg

SEQ ID NO: 1626 - DNA, 103 bp, Artificial Sequence
  Synthetic Polynucleotide
taatacgactcactataggggtgcacaactgtgtcaatgccaatttcaacaacagaggagagttgaaatgggcattgacaacctggcggcagcgcaaaagatg

SEQ ID NO: 1627 - DNA, 103 bp, Artificial Sequence
  Synthetic Polynucleotide
taatacgactcactatagggggaacgtgcacaactgtgtcaatgccaattaacagaggagaaattggatgtgacacagtaacctggcggcagcgcaaaagatg

SEQ ID NO: 1628 - DNA, 103 bp, Artificial Sequence
  Synthetic Polynucleotide
taatacgactcactatagggtccgcggaacgtgcacaactgtgtcaatgcaacagaggagagcattgatgcagttgtgcaacctggcggcagcgcaaaagatg

SEQ ID NO: 1629 - DNA, 103 bp, Artificial Sequence
  Synthetic Polynucleotide
taatacgactcactatagggggttttccgcggaacgtgcacaactgtgtcaacagaggagagacacaatggtgcacgttaacctggcggcagcgcaaaagatg

SEQ ID NO: 1630 - DNA, 103 bp, Artificial Sequence
  Synthetic Polynucleotide
taatacgactcactatagggagtttggttttccgcggaacgtgcacaactaacagaggagaagttgtatgcgttccgcgaacctggcggcagcgcaaaagatg

SEQ ID NO: 1631 - DNA, 103 bp, Artificial Sequence
  Synthetic Polynucleotide
taatacgactcactatagggtacgcagtttggttttccgcggaacgtgcaaacagaggagatgcacgatgcgcggaaaaaacctggcggcagcgcaaaagatg

SEQ ID NO: 1632 - DNA, 103 bp, Artificial Sequence
  Synthetic Polynucleotide
taatacgactcactatagggcgttctacgcagtttggttttccgcggaacaacagaggagagttccgatgaaaaccaaaaacctggcggcagcgcaaaagatg

SEQ ID NO: 1633 - DNA, 103 bp, Artificial Sequence
  Synthetic Polynucleotide
taatacgactcactataggggggatgacatgtttggtcttttcaatggacaacagaggagagtccatatgaaagaccaaaacctggcggcagcgcaaaagatg

SEQ ID NO: 1634 - DNA, 103 bp, Artificial Sequence
  Synthetic Polynucleotide
taatacgactcactatagggccaagaggggaatccgctgctactgtgaggaacagaggagacctcacatgagcagcggaaacctggcggcagcgcaaaagatg

SEQ ID NO: 1635 - DNA, 103 bp, Artificial Sequence
  Synthetic Polynucleotide
taatacgactcactataggggctaccgttctacgcagtttggttttccgcaacagaggagagcggaaatgcaaactgcgaacctggcggcagcgcaaaagatg

SEQ ID NO: 1636 - DNA, 103 bp, Artificial Sequence
  Synthetic Polynucleotide
taatacgactcactataggggatgtgctaccgttctacgcagtttggtttaacagaggagaaaaccaatgtgcgtagaaaacctggcggcagcgcaaaagatg

SEQ ID NO: 1637 - DNA, 103 bp, Artificial Sequence
  Synthetic Polynucleotide
taatacgactcactataggggcaaggatgtgctaccgttctacgcagtttaacagaggagaaaactgatgagaacggtaaacctggcggcagcgcaaaagatg

SEQ ID NO: 1638 - DNA, 103 bp, Artificial Sequence
  Synthetic Polynucleotide
taatacgactcactatagggtgaaagcaaggatgtgctaccgttctacgcaacagaggagagcgtagatgggtagcacaaacctggcggcagcgcaaaagatg

SEQ ID NO: 1639 - DNA, 103 bp, Artificial Sequence
  Synthetic Polynucleotide
taatacgactcactatagggttggttgaaagcaaggatgtgctaccgttcaacagaggagagaacggatgcacatccttaacctggcggcagcgcaaaagatg

SEQ ID NO: 1640 - DNA, 103 bp, Artificial Sequence
  Synthetic Polynucleotide
taatacgactcactatagggaaattttggttgaaagcaaggatgtgctacaacagaggagagtagcaatgccttgctttaacctggcggcagcgcaaaagatg

SEQ ID NO: 1641 - DNA, 103 bp, Artificial Sequence
  Synthetic Polynucleotide
taatacgactcactatagggggttcaaattttggttgaaagcaaggatgtaacagaggagaacatccatgctttcaaccaacctggcggcagcgcaaaagatg

SEQ ID NO: 1642 - DNA, 103 bp, Artificial Sequence
  Synthetic Polynucleotide
taatacgactcactatagggcagcaggttcaaattttggttgaaagcaagaacagaggagacttgctatgaaccaaaataacctggcggcagcgcaaaagatg

SEQ ID NO: 1643 - DNA, 103 bp, Artificial Sequence
  Synthetic Polynucleotide
taatacgactcactataggggagaacagcaggttcaaattttggttgaaaaacagaggagatttcaaatgaaatttgaaaacctggcggcagcgcaaaagatg

SEQ ID NO: 1644 - DNA, 103 bp, Artificial Sequence
  Synthetic Polynucleotide
taatacgactcactatagggcgtgagagaacagcaggttcaaattttggtaacagaggagaaccaaaatgtgaacctgcaacctggcggcagcgcaaaagatg

SEQ ID NO: 1645 - DNA, 103 bp, Artificial Sequence
  Synthetic Polynucleotide
taatacgactcactatagggtgtcgccaagaggggaatccgctgctactgaacagaggagacagtagatgcggattcccaacctggcggcagcgcaaaagatg

SEQ ID NO: 1646 - DNA, 103 bp, Artificial Sequence
  Synthetic Polynucleotide
taatacgactcactatagggcgtaacgtgagagaacagcaggttcaaattaacagaggagaaatttgatgctgctgttcaacctggcggcagcgcaaaagatg

SEQ ID NO: 1647 - DNA, 103 bp, Artificial Sequence
  Synthetic Polynucleotide
taatacgactcactatagggaggatcgtaacgtgagagaacagcaggttcaacagaggagagaacctatggttctctcaaacctggcggcagcgcaaaagatg

SEQ ID NO: 1648 - DNA, 103 bp, Artificial Sequence
  Synthetic Polynucleotide
taatacgactcactataggggtcctaggatcgtaacgtgagagaacagcaaacagaggagatgctgtatgctcacgttaaacctggcggcagcgcaaaagatg

SEQ ID NO: 1649 - DNA, 103 bp, Artificial Sequence
  Synthetic Polynucleotide
taatacgactcactatagggttgtagtcctaggatcgtaacgtgagagaaaacagaggagattctctatggttacgatcaacctggcggcagcgcaaaagatg

SEQ ID NO: 1650 - DNA, 103 bp, Artificial Sequence
  Synthetic Polynucleotide
taatacgactcactatagggatcttttgtagtcctaggatcgtaacgtgaaacagaggagatcacgtatggatcctaggaacctggcggcagcgcaaaagatg

SEQ ID NO: 1651 - DNA, 103 bp, Artificial Sequence
  Synthetic Polynucleotide
taatacgactcactatagggtctacatcttttgtagtcctaggatcgtaaaacagaggagattacgaatgtaggactacaacctggcggcagcgcaaaagatg

SEQ ID NO: 1652 - DNA, 103 bp, Artificial Sequence
  Synthetic Polynucleotide
taatacgactcactatagggcctgatctacatcttttgtagtcctaggataacagaggagaatcctaatgctacaaaagaacctggcggcagcgcaaaagatg

SEQ ID NO: 1653 - DNA, 103 bp, Artificial Sequence
  Synthetic Polynucleotide
taatacgactcactatagggagcgacctgatctacatcttttgtagtcctaacagaggagaaggactatgaaagatgtaaacctggcggcagcgcaaaagatg

SEQ ID NO: 1654 - DNA, 103 bp, Artificial Sequence
  Synthetic Polynucleotide
taatacgactcactataggggaaaaagcgacctgatctacatcttttgtaaacagaggagatacaaaatgtgtagatcaaacctggcggcagcgcaaaagatg

SEQ ID NO: 1655 - DNA, 103 bp, Artificial Sequence
  Synthetic Polynucleotide
taatacgactcactataggggtttggaaaaagcgacctgatctacatcttaacagaggagaaagatgatgatcaggtcgaacctggcggcagcgcaaaagatg

SEQ ID NO: 1656 - DNA, 103 bp, Artificial Sequence
  Synthetic Polynucleotide
taatacgactcactataggggctcttgtcgccaagaggggaatccgctgcaacagaggagagcagcgatgtcccctcttaacctggcggcagcgcaaaagatg

SEQ ID NO: 1657 - DNA, 103 bp, Artificial Sequence
  Synthetic Polynucleotide
taatacgactcactatagggtgtatgtttggaaaaagcgacctgatctacaacagaggagagtagatatggtcgcttttaacctggcggcagcgcaaaagatg

SEQ ID NO: 1658 - DNA, 103 bp, Artificial Sequence
  Synthetic Polynucleotide
taatacgactcactatagggttagttgtatgtttggaaaaagcgacctgaaacagaggagatcaggtatgtttttccaaaacctggcggcagcgcaaaagatg

SEQ ID NO: 1659 - DNA, 103 bp, Artificial Sequence
  Synthetic Polynucleotide
taatacgactcactatagggccaagttagttgtatgtttggaaaaagcgaaacagaggagatcgcttatgccaaacataaacctggcggcagcgcaaaagatg

SEQ ID NO: 1660 - DNA, 103 bp, Artificial Sequence
  Synthetic Polynucleotide
taatacgactcactatagggctcttccaagttagttgtatgtttggaaaaaacagaggagattttccatgcatacaactaacctggcggcagcgcaaaagatg

SEQ ID NO: 1661 - DNA, 103 bp, Artificial Sequence
  Synthetic Polynucleotide
taatacgactcactataggggggagctcttccaagttagttgtatgtttgaacagaggagacaaacaatgaactaacttaacctggcggcagcgcaaaagatg

SEQ ID NO: 1662 - DNA, 103 bp, Artificial Sequence
  Synthetic Polynucleotide
taatacgactcactatagggcagatgggagctcttccaagttagttgtataacagaggagaatacaaatgacttggaagaacctggcggcagcgcaaaagatg

SEQ ID NO: 1663 - DNA, 103 bp, Artificial Sequence
  Synthetic Polynucleotide
taatacgactcactataggggaaaacagatgggagctcttccaagttagtaacagaggagaactaacatggaagagctcaacctggcggcagcgcaaaagatg

SEQ ID NO: 1664 - DNA, 103 bp, Artificial Sequence
  Synthetic Polynucleotide
taatacgactcactatagggatggagaaaacagatgggagctcttccaagaacagaggagacttggaatggctcccatcaacctggcggcagcgcaaaagatg

SEQ ID NO: 1665 - DNA, 103 bp, Artificial Sequence
  Synthetic Polynucleotide
taatacgactcactatagggcaaccatggagaaaacagatgggagctcttaacagaggagaaagagcatgcatctgtttaacctggcggcagcgcaaaagatg

SEQ ID NO: 1666 - DNA, 103 bp, Artificial Sequence
  Synthetic Polynucleotide
taatacgactcactatagggtttcgcaaccatggagaaaacagatgggagaacagaggagactcccaatggttttctccaacctggcggcagcgcaaaagatg

SEQ ID NO: 1667 - DNA, 103 bp, Artificial Sequence
  Synthetic Polynucleotide
taatacgactcactatagggcagaggctcttgtcgccaagaggggaatccaacagaggagaggattcatgtcttggcgaaacctggcggcagcgcaaaagatg

SEQ ID NO: 1668 - DNA, 103 bp, Artificial Sequence
  Synthetic Polynucleotide
taatacgactcactatagggtattctttcgcaaccatggagaaaacagataacagaggagaatctgtatgctccatggtaacctggcggcagcgcaaaagatg

SEQ ID NO: 1669 - DNA, 103 bp, Artificial Sequence
  Synthetic Polynucleotide
taatacgactcactatagggtagcatattctttcgcaaccatggagaaaaaacagaggagattttctatgtggttgcgaaacctggcggcagcgcaaaagatg

SEQ ID NO: 1670 - DNA, 103 bp, Artificial Sequence
  Synthetic Polynucleotide
taatacgactcactatagggtctattagcatattctttcgcaaccatggaaacagaggagatccatgatggcgaaagaaaacctggcggcagcgcaaaagatg

SEQ ID NO: 1671 - DNA, 103 bp, Artificial Sequence
  Synthetic Polynucleotide
taatacgactcactatagggaacactctattagcatattctttcgcaaccaacagaggagaggttgcatgagaatatgcaacctggcggcagcgcaaaagatg

SEQ ID NO: 1672 - DNA, 103 bp, Artificial Sequence
  Synthetic Polynucleotide
taatacgactcactatagggttgtgaacactctattagcatattctttcgaacagaggagacgaaagatgatgctaataaacctggcggcagcgcaaaagatg

SEQ ID NO: 1673 - DNA, 103 bp, Artificial Sequence
  Synthetic Polynucleotide
taatacgactcactatagggtattgttgtgaacactctattagcatattcaacagaggagagaatatatgaatagagtgaacctggcggcagcgcaaaagatg

SEQ ID NO: 1674 - DNA, 103 bp, Artificial Sequence
  Synthetic Polynucleotide
taatacgactcactatagggttgcctattgttgtgaacactctattagcaaacagaggagatgctaaatgagtgttcacaacctggcggcagcgcaaaagatg

SEQ ID NO: 1675 - DNA, 103 bp, Artificial Sequence
  Synthetic Polynucleotide
taatacgactcactatagggtttctttgcctattgttgtgaacactctataacagaggagaatagagatgtcacaacaaaacctggcggcagcgcaaaagatg

SEQ ID NO: 1676 - DNA, 103 bp, Artificial Sequence
  Synthetic Polynucleotide
taatacgactcactatagggttggttttctttgcctattgttgtgaacacaacagaggagagtgttcatgacaataggcaacctggcggcagcgcaaaagatg

SEQ ID NO: 1677 - DNA, 103 bp, Artificial Sequence
  Synthetic Polynucleotide
taatacgactcactatagggagaatttggttttctttgcctattgttgtgaacagaggagacacaacatgaggcaaagaaacctggcggcagcgcaaaagatg

SEQ ID NO: 1678 - DNA, 103 bp, Artificial Sequence
  Synthetic Polynucleotide
taatacgactcactatagggggccgcagaggctcttgtcgccaagaggggaacagaggagacccctcatggcgacaagaaacctggcggcagcgcaaaagatg

SEQ ID NO: 1679 - DNA, 103 bp, Artificial Sequence
  Synthetic Polynucleotide
taatacgactcactataggggagttagaatttggttttctttgcctattgaacagaggagacaatagatgaagaaaaccaacctggcggcagcgcaaaagatg

SEQ ID NO: 1680 - DNA, 103 bp, Artificial Sequence
  Synthetic Polynucleotide
taatacgactcactatagggttctggagttagaatttggttttctttgccaacagaggagaggcaaaatgaaccaaattaacctggcggcagcgcaaaagatg

SEQ ID NO: 1681 - DNA, 103 bp, Artificial Sequence
  Synthetic Polynucleotide
taatacgactcactataggggcttgttctggagttagaatttggttttctaacagaggagaagaaaaatgaattctaacaacctggcggcagcgcaaaagatg

SEQ ID NO: 1682 - DNA, 103 bp, Artificial Sequence
  Synthetic Polynucleotide
taatacgactcactataggggaatagcttgttctggagttagaatttggtaacagaggagaaccaaaatgtaactccagaacctggcggcagcgcaaaagatg

SEQ ID NO: 1683 - DNA, 103 bp, Artificial Sequence
  Synthetic Polynucleotide
taatacgactcactatagggtcctagaatagcttgttctggagttagaataacagaggagaattctaatgccagaacaaaacctggcggcagcgcaaaagatg

SEQ ID NO: 1684 - DNA, 103 bp, Artificial Sequence
  Synthetic Polynucleotide
taatacgactcactatagggggtaatcctagaatagcttgttctggagttaacagaggagaaactccatgacaagctataacctggcggcagcgcaaaagatg

SEQ ID NO: 1685 - DNA, 103 bp, Artificial Sequence
  Synthetic Polynucleotide
taatacgactcactatagggtgcctggtaatcctagaatagcttgttctgaacagaggagacagaacatgctattctagaacctggcggcagcgcaaaagatg

SEQ ID NO: 1686 - DNA, 103 bp, Artificial Sequence
  Synthetic Polynucleotide
taatacgactcactataggggtccatgcctggtaatcctagaatagcttgaacagaggagacaagctatgctaggattaaacctggcggcagcgcaaaagatg

SEQ ID NO: 1687 - DNA, 103 bp, Artificial Sequence
  Synthetic Polynucleotide
taatacgactcactatagggatcgggtccatgcctggtaatcctagaataaacagaggagatattctatgattaccaggaacctggcggcagcgcaaaagatg

SEQ ID NO: 1688 - DNA, 103 bp, Artificial Sequence
  Synthetic Polynucleotide
taatacgactcactatagggtttccatcgggtccatgcctggtaatcctaaacagaggagataggatatgcaggcatggaacctggcggcagcgcaaaagatg

SEQ ID NO: 1689 - DNA, 103 bp, Artificial Sequence
  Synthetic Polynucleotide
taatacgactcactatagggcttttggccgcagaggctcttgtcgccaagaacagaggagacttggcatgaagagcctcaacctggcggcagcgcaaaagatg

SEQ ID NO: 1690 - DNA, 103 bp, Artificial Sequence
  Synthetic Polynucleotide
taatacgactcactataggggtctttttccatcgggtccatgcctggtaaaacagaggagattaccaatgatggacccgaacctggcggcagcgcaaaagatg

SEQ ID NO: 1691 - DNA, 103 bp, Artificial Sequence
  Synthetic Polynucleotide
taatacgactcactataggggatgtgtctttttccatcgggtccatgcctaacagaggagaaggcatatgcccgatggaaacctggcggcagcgcaaaagatg

SEQ ID NO: 1692 - DNA, 103 bp, Artificial Sequence
  Synthetic Polynucleotide
taatacgactcactatagggcaggcgatgtgtctttttccatcgggtccaaacagaggagatggaccatgtggaaaaagaacctggcggcagcgcaaaagatg

SEQ ID NO: 1693 - DNA, 103 bp, Artificial Sequence
  Synthetic Polynucleotide
taatacgactcactatagggcaaaccaggcgatgtgtctttttccatcggaacagaggagaccgatgatgaaagacacaaacctggcggcagcgcaaaagatg

SEQ ID NO: 1694 - DNA, 103 bp, Artificial Sequence
  Synthetic Polynucleotide
taatacgactcactatagggtaaggcaaaccaggcgatgtgtctttttccaacagaggagaggaaaaatgcacatcgccaacctggcggcagcgcaaaagatg

SEQ ID NO: 1695 - DNA, 103 bp, Artificial Sequence
  Synthetic Polynucleotide
taatacgactcactataggggagtgtaaggcaaaccaggcgatgtgtcttaacagaggagaaagacaatgcgcctggttaacctggcggcagcgcaaaagatg

SEQ ID NO: 1696 - DNA, 103 bp, Artificial Sequence
  Synthetic Polynucleotide
taatacgactcactatagggttgctgagtgtaaggcaaaccaggcgatgtaacagaggagaacatcgatgggtttgcctaacctggcggcagcgcaaaagatg

SEQ ID NO: 1697 - DNA, 103 bp, Artificial Sequence
  Synthetic Polynucleotide
taatacgactcactatagggaaaccttgctgagtgtaaggcaaaccaggcaacagaggagagcctggatggccttacacaacctggcggcagcgcaaaagatg

SEQ ID NO: 1698 - DNA, 103 bp, Artificial Sequence
  Synthetic Polynucleotide
taatacgactcactatagggttttcaaaccttgctgagtgtaaggcaaacaacagaggagagtttgcatgacactcagcaacctggcggcagcgcaaaagatg

SEQ ID NO: 1699 - DNA, 103 bp, Artificial Sequence
  Synthetic Polynucleotide
taatacgactcactatagggggcccttttcaaaccttgctgagtgtaaggaacagaggagaccttacatgcagcaaggtaacctggcggcagcgcaaaagatg

SEQ ID NO: 1700 - DNA, 103 bp, Artificial Sequence
  Synthetic Polynucleotide
taatacgactcactatagggcggggcttttggccgcagaggctcttgtcgaacagaggagacgacaaatgcctctgcggaacctggcggcagcgcaaaagatg

SEQ ID NO: 1701 - DNA, 103 bp, Artificial Sequence
  Synthetic Polynucleotide
taatacgactcactatagggaactgggcccttttcaaaccttgctgagtgaacagaggagacactcaatgaggtttgaaaacctggcggcagcgcaaaagatg

SEQ ID NO: 1702 - DNA, 103 bp, Artificial Sequence
  Synthetic Polynucleotide
taatacgactcactatagggttaccaactgggcccttttcaaaccttgctaacagaggagaagcaagatgtgaaaagggaacctggcggcagcgcaaaagatg

SEQ ID NO: 1703 - DNA, 103 bp, Artificial Sequence
  Synthetic Polynucleotide
taatacgactcactatagggaaaatttaccaactgggcccttttcaaaccaacagaggagaggtttgatgagggcccagaacctggcggcagcgcaaaagatg

SEQ ID NO: 1704 - DNA, 103 bp, Artificial Sequence
  Synthetic Polynucleotide
taatacgactcactatagggtgttcaaaatttaccaactgggcccttttcaacagaggagagaaaagatgccagttggtaacctggcggcagcgcaaaagatg

SEQ ID NO: 1705 - DNA, 103 bp, Artificial Sequence
  Synthetic Polynucleotide
taatacgactcactatagggtgccttgttcaaaatttaccaactgggcccaacagaggagagggcccatgtggtaaattaacctggcggcagcgcaaaagatg

SEQ ID NO: 1706 - DNA, 103 bp, Artificial Sequence
  Synthetic Polynucleotide
taatacgactcactatagggcatggtgccttgttcaaaatttaccaactgaacagaggagacagttgatgaattttgaaaacctggcggcagcgcaaaagatg

SEQ ID NO: 1707 - DNA, 103 bp, Artificial Sequence
  Synthetic Polynucleotide
taatacgactcactatagggtgtaccatggtgccttgttcaaaatttaccaacagaggagaggtaaaatgtgaacaaggaacctggcggcagcgcaaaagatg

SEQ ID NO: 1708 - DNA, 103 bp, Artificial Sequence
  Synthetic Polynucleotide
taatacgactcactatagggagtgttgtaccatggtgccttgttcaaaataacagaggagaattttgatgaaggcaccaaacctggcggcagcgcaaaagatg

SEQ ID NO: 1709 - DNA, 103 bp, Artificial Sequence
  Synthetic Polynucleotide
taatacgactcactatagggtttcaagtgttgtaccatggtgccttgttcaacagaggagagaacaaatgaccatggtaaacctggcggcagcgcaaaagatg

SEQ ID NO: 1710 - DNA, 103 bp, Artificial Sequence
  Synthetic Polynucleotide
taatacgactcactataggggcttctttcaagtgttgtaccatggtgcctaacagaggagaaggcacatgggtacaacaaacctggcggcagcgcaaaagatg

SEQ ID NO: 1711 - DNA, 103 bp, Artificial Sequence
  Synthetic Polynucleotide
taatacgactcactatagggatccacggggcttttggccgcagaggctctaacagaggagaagagccatggcggccaaaaacctggcggcagcgcaaaagatg

SEQ ID NO: 1712 - DNA, 103 bp, Artificial Sequence
  Synthetic Polynucleotide
taatacgactcactatagggtgtgtgcttctttcaagtgttgtaccatggaacagaggagaccatggatgaacacttgaaacctggcggcagcgcaaaagatg

SEQ ID NO: 1713 - DNA, 103 bp, Artificial Sequence
  Synthetic Polynucleotide
taatacgactcactatagggtttagtgtgtgcttctttcaagtgttgtacaacagaggagagtacaaatgttgaaagaaaacctggcggcagcgcaaaagatg

SEQ ID NO: 1714 - DNA, 103 bp, Artificial Sequence
  Synthetic Polynucleotide
taatacgactcactataggggtcaatttagtgtgtgcttctttcaagtgtaacagaggagaacacttatgagaagcacaaacctggcggcagcgcaaaagatg

SEQ ID NO: 1715 - DNA, 103 bp, Artificial Sequence
  Synthetic Polynucleotide
taatacgactcactatagggctttggtcaatttagtgtgtgcttctttcaaacagaggagatgaaagatgcacacactaaacctggcggcagcgcaaaagatg

SEQ ID NO: 1716 - DNA, 103 bp, Artificial Sequence
  Synthetic Polynucleotide
taatacgactcactatagggatttcctttggtcaatttagtgtgtgcttcaacagaggagagaagcaatgactaaattgaacctggcggcagcgcaaaagatg

SEQ ID NO: 1717 - DNA, 103 bp, Artificial Sequence
  Synthetic Polynucleotide
taatacgactcactatagggtcgtaatttcctttggtcaatttagtgtgtaacagaggagaacacacatgattgaccaaaacctggcggcagcgcaaaagatg

SEQ ID NO: 1718 - DNA, 103 bp, Artificial Sequence
  Synthetic Polynucleotide
taatacgactcactatagggtatcttcgtaatttcctttggtcaatttagaacagaggagactaaatatgccaaaggaaaacctggcggcagcgcaaaagatg

SEQ ID NO: 1719 - DNA, 103 bp, Artificial Sequence
  Synthetic Polynucleotide
taatacgactcactatagggcaagatatcttcgtaatttcctttggtcaaaacagaggagattgaccatgggaaattacaacctggcggcagcgcaaaagatg

SEQ ID NO: 1720 - DNA, 103 bp, Artificial Sequence
  Synthetic Polynucleotide
taatacgactcactatagggtggtacaagatatcttcgtaatttcctttgaacagaggagacaaaggatgttacgaagaaacctggcggcagcgcaaaagatg

SEQ ID NO: 1721 - DNA, 103 bp, Artificial Sequence
  Synthetic Polynucleotide
taatacgactcactatagggagctctggtacaagatatcttcgtaatttcaacagaggagagaaattatgaagatatctaacctggcggcagcgcaaaagatg

SEQ ID NO: 1722 - DNA, 103 bp, Artificial Sequence
  Synthetic Polynucleotide
taatacgactcactatagggatcttatccacggggcttttggccgcagagaacagaggagactctgcatgcaaaagcccaacctggcggcagcgcaaaagatg

SEQ ID NO: 1723 - DNA, 103 bp, Artificial Sequence
  Synthetic Polynucleotide
taatacgactcactatagggcaaaaagctctggtacaagatatcttcgtaaacagaggagatacgaaatgatcttgtacaacctggcggcagcgcaaaagatg

SEQ ID NO: 1724 - DNA, 103 bp, Artificial Sequence
  Synthetic Polynucleotide
taatacgactcactatagggtccttcaaaaagctctggtacaagatatctaacagaggagaagatatatggtaccagagaacctggcggcagcgcaaaagatg

SEQ ID NO: 1725 - DNA, 103 bp, Artificial Sequence
  Synthetic Polynucleotide
taatacgactcactatagggtttcgtccttcaaaaagctctggtacaagaaacagaggagatcttgtatgagagcttttaacctggcggcagcgcaaaagatg

SEQ ID NO: 1726 - DNA, 103 bp, Artificial Sequence
  Synthetic Polynucleotide
taatacgactcactatagggcctgatttcgtccttcaaaaagctctggtaaacagaggagataccagatgtttttgaagaacctggcggcagcgcaaaagatg

SEQ ID NO: 1727 - DNA, 103 bp, Artificial Sequence
  Synthetic Polynucleotide
taatacgactcactatagggatgggcctgatttcgtccttcaaaaagctcaacagaggagagagcttatggaaggacgaaacctggcggcagcgcaaaagatg

SEQ ID NO: 1728 - DNA, 103 bp, Artificial Sequence
  Synthetic Polynucleotide
taatacgactcactatagggtttctatgggcctgatttcgtccttcaaaaaacagaggagattttgaatgacgaaatcaaacctggcggcagcgcaaaagatg

SEQ ID NO: 1729 - DNA, 103 bp, Artificial Sequence
  Synthetic Polynucleotide
taatacgactcactatagggaatcttttctatgggcctgatttcgtccttaacagaggagaaaggacatgatcaggcccaacctggcggcagcgcaaaagatg

SEQ ID NO: 1730 - DNA, 103 bp, Artificial Sequence
  Synthetic Polynucleotide
taatacgactcactatagggtcatgaatcttttctatgggcctgatttcgaacagaggagacgaaatatggcccatagaaacctggcggcagcgcaaaagatg

SEQ ID NO: 1731 - DNA, 103 bp, Artificial Sequence
  Synthetic Polynucleotide
taatacgactcactatagggttgcttcatgaatcttttctatgggcctgaaacagaggagatcaggcatgtagaaaagaaacctggcggcagcgcaaaagatg

SEQ ID NO: 1732 - DNA, 103 bp, Artificial Sequence
  Synthetic Polynucleotide
taatacgactcactatagggagtctttgcttcatgaatcttttctatgggaacagaggagacccataatgaagattcataacctggcggcagcgcaaaagatg

SEQ ID NO: 1733 - DNA, 103 bp, Artificial Sequence
  Synthetic Polynucleotide
taatacgactcactatagggagtggatcttatccacggggcttttggccgaacagaggagacggccaatggccccgtggaacctggcggcagcgcaaaagatg

SEQ ID NO: 1734 - DNA, 103 bp, Artificial Sequence
  Synthetic Polynucleotide
taatacgactcactatagggattctagtctttgcttcatgaatcttttctaacagaggagaagaaaaatgtcatgaagcaacctggcggcagcgcaaaagatg

SEQ ID NO: 1735 - DNA, 103 bp, Artificial Sequence
  Synthetic Polynucleotide
taatacgactcactatagggctacaattctagtctttgcttcatgaatctaacagaggagaagattcatgaagcaaagaaacctggcggcagcgcaaaagatg

SEQ ID NO: 1736 - DNA, 103 bp, Artificial Sequence
  Synthetic Polynucleotide
taatacgactcactatagggtacgtctacaattctagtctttgcttcatgaacagaggagacatgaaatgaagactagaaacctggcggcagcgcaaaagatg

SEQ ID NO: 1737 - DNA, 103 bp, Artificial Sequence
  Synthetic Polynucleotide
taatacgactcactataggggggggtacgtctacaattctagtctttgctaacagaggagaagcaaaatgtagaattgtaacctggcggcagcgcaaaagatg

SEQ ID NO: 1738 - DNA, 103 bp, Artificial Sequence
  Synthetic Polynucleotide
taatacgactcactataggggaaatgggggtacgtctacaattctagtctaacagaggagaagactaatgttgtagacgaacctggcggcagcgcaaaagatg

SEQ ID NO: 1739 - DNA, 103 bp, Artificial Sequence
  Synthetic Polynucleotide
taatacgactcactataggggtgatgaaatgggggtacgtctacaattctaacagaggagaagaattatggacgtacccaacctggcggcagcgcaaaagatg

SEQ ID NO: 1740 - DNA, 103 bp, Artificial Sequence
  Synthetic Polynucleotide
taatacgactcactatagggatacagtgatgaaatgggggtacgtctacaaacagaggagatgtagaatgacccccattaacctggcggcagcgcaaaagatg

SEQ ID NO: 1741 - DNA, 103 bp, Artificial Sequence
  Synthetic Polynucleotide
taatacgactcactatagggcccatatacagtgatgaaatgggggtacgtaacagaggagaacgtacatgcatttcatcaacctggcggcagcgcaaaagatg

SEQ ID NO: 1742 - DNA, 103 bp, Artificial Sequence
  Synthetic Polynucleotide
taatacgactcactatagggacgtccccatatacagtgatgaaatgggggaacagaggagacccccaatgcatcactgtaacctggcggcagcgcaaaagatg

SEQ ID NO: 1743 - DNA, 103 bp, Artificial Sequence
  Synthetic Polynucleotide
taatacgactcactatagggagttgacgtccccatatacagtgatgaaataacagaggagaatttcaatgctgtatatgaacctggcggcagcgcaaaagatg

SEQ ID NO: 1744 - DNA, 103 bp, Artificial Sequence
  Synthetic Polynucleotide
taatacgactcactatagggtccaagggatgacatgtttggtcttttcaaaacagaggagattgaaaatgccaaacatgaacctggcggcagcgcaaaagatg

SEQ ID NO: 1745 - DNA, 103 bp, Artificial Sequence
  Synthetic Polynucleotide
taatacgactcactatagggacagcagtggatcttatccacggggcttttaacagaggagaaaaagcatggtggataagaacctggcggcagcgcaaaagatg

SEQ ID NO: 1746 - DNA, 103 bp, Artificial Sequence
  Synthetic Polynucleotide
taatacgactcactatagggctaatagttgacgtccccatatacagtgataacagaggagaatcactatgtatggggacaacctggcggcagcgcaaaagatg

SEQ ID NO: 1747 - DNA, 103 bp, Artificial Sequence
  Synthetic Polynucleotide
taatacgactcactataggggcgccctaatagttgacgtccccatatacaaacagaggagatgtataatgggacgtcaaaacctggcggcagcgcaaaagatg

SEQ ID NO: 1748 - DNA, 103 bp, Artificial Sequence
  Synthetic Polynucleotide
taatacgactcactataggggcaaagcgccctaatagttgacgtccccataacagaggagaatggggatgtcaactattaacctggcggcagcgcaaaagatg

SEQ ID NO: 1749 - DNA, 103 bp, Artificial Sequence
  Synthetic Polynucleotide
taatacgactcactatagggtagaagcaaagcgccctaatagttgacgtcaacagaggagagacgtcatgtattagggcaacctggcggcagcgcaaaagatg

SEQ ID NO: 1750 - DNA, 103 bp, Artificial Sequence
  Synthetic Polynucleotide
taatacgactcactatagggaaatctagaagcaaagcgccctaatagttgaacagaggagacaactaatggggcgctttaacctggcggcagcgcaaaagatg

SEQ ID NO: 1751 - DNA, 103 bp, Artificial Sequence
  Synthetic Polynucleotide
taatacgactcactataggggtttgaaatctagaagcaaagcgccctaataacagaggagaattaggatgctttgcttcaacctggcggcagcgcaaaagatg

SEQ ID NO: 1752 - DNA, 103 bp, Artificial Sequence
  Synthetic Polynucleotide
taatacgactcactataggggatttgtttgaaatctagaagcaaagcgccaacagaggagaggcgctatgcttctagataacctggcggcagcgcaaaagatg

SEQ ID NO: 1753 - DNA, 103 bp, Artificial Sequence
  Synthetic Polynucleotide
taatacgactcactataggggccaggatttgtttgaaatctagaagcaaaaacagaggagatttgctatgagatttcaaaacctggcggcagcgcaaaagatg

SEQ ID NO: 1754 - DNA, 103 bp, Artificial Sequence
  Synthetic Polynucleotide
taatacgactcactatagggtccaagccaggatttgtttgaaatctagaaaacagaggagattctagatgtcaaacaaaaacctggcggcagcgcaaaagatg

SEQ ID NO: 1755 - DNA, 103 bp, Artificial Sequence
  Synthetic Polynucleotide
taatacgactcactatagggcaagatccaagccaggatttgtttgaaatcaacagaggagagatttcatgcaaatcctgaacctggcggcagcgcaaaagatg

SEQ ID NO: 1756 - DNA, 103 bp, Artificial Sequence
  Synthetic Polynucleotide
taatacgactcactatagggcgctcacagcagtggatcttatccacggggaacagaggagaccccgtatgtaagatccaaacctggcggcagcgcaaaagatg

SEQ ID NO: 1757 - DNA, 103 bp, Artificial Sequence
  Synthetic Polynucleotide
taatacgactcactatagggtgaaccaagatccaagccaggatttgtttgaacagaggagacaaacaatgcctggcttgaacctggcggcagcgcaaaagatg

SEQ ID NO: 1758 - DNA, 103 bp, Artificial Sequence
  Synthetic Polynucleotide
taatacgactcactatagggatcgctgaaccaagatccaagccaggatttaacagaggagaaaatccatgcttggatctaacctggcggcagcgcaaaagatg

SEQ ID NO: 1759 - DNA, 103 bp, Artificial Sequence
  Synthetic Polynucleotide
taatacgactcactatagggtgccaatcgctgaaccaagatccaagccagaacagaggagactggctatgatcttggttaacctggcggcagcgcaaaagatg

SEQ ID NO: 1760 - DNA, 103 bp, Artificial Sequence
  Synthetic Polynucleotide
taatacgactcactataggggtccgtgccaatcgctgaaccaagatccaaaacagaggagattggatatgggttcagcgaacctggcggcagcgcaaaagatg

SEQ ID NO: 1761 - DNA, 103 bp, Artificial Sequence
  Synthetic Polynucleotide
taatacgactcactatagggtcagggtccgtgccaatcgctgaaccaagaaacagaggagatcttggatgagcgattggaacctggcggcagcgcaaaagatg

SEQ ID NO: 1762 - DNA, 103 bp, Artificial Sequence
  Synthetic Polynucleotide
taatacgactcactatagggctgtgtcagggtccgtgccaatcgctgaacaacagaggagagttcagatgttggcacggaacctggcggcagcgcaaaagatg

SEQ ID NO: 1763 - DNA, 103 bp, Artificial Sequence
  Synthetic Polynucleotide
taatacgactcactatagggccaatctgtgtcagggtccgtgccaatcgcaacagaggagagcgattatgacggaccctaacctggcggcagcgcaaaagatg

SEQ ID NO: 1764 - DNA, 103 bp, Artificial Sequence
  Synthetic Polynucleotide
taatacgactcactataggggcggtccaatctgtgtcagggtccgtgccaaacagaggagatggcacatgccctgacacaacctggcggcagcgcaaaagatg

SEQ ID NO: 1765 - DNA, 103 bp, Artificial Sequence
  Synthetic Polynucleotide
taatacgactcactatagggcgaaagcggtccaatctgtgtcagggtccgaacagaggagacggaccatgacacagattaacctggcggcagcgcaaaagatg

SEQ ID NO: 1766 - DNA, 103 bp, Artificial Sequence
  Synthetic Polynucleotide
taatacgactcactatagggaaaggcgaaagcggtccaatctgtgtcaggaacagaggagacctgacatggattggaccaacctggcggcagcgcaaaagatg

SEQ ID NO: 1767 - DNA, 103 bp, Artificial Sequence
  Synthetic Polynucleotide
taatacgactcactatagggtgcaccgctcacagcagtggatcttatccaaacagaggagatggataatgtccactgctaacctggcggcagcgcaaaagatg

SEQ ID NO: 1768 - DNA, 103 bp, Artificial Sequence
  Synthetic Polynucleotide
taatacgactcactatagggagttgaaaggcgaaagcggtccaatctgtgaacagaggagacacagaatggaccgctttaacctggcggcagcgcaaaagatg

SEQ ID NO: 1769 - DNA, 103 bp, Artificial Sequence
  Synthetic Polynucleotide
taatacgactcactataggggtaagagttgaaaggcgaaagcggtccaataacagaggagaattggaatgctttcgcctaacctggcggcagcgcaaaagatg

SEQ ID NO: 1770 - DNA, 103 bp, Artificial Sequence
  Synthetic Polynucleotide
taatacgactcactatagggatactgtaagagttgaaaggcgaaagcggtaacagaggagaaccgctatggcctttcaaaacctggcggcagcgcaaaagatg

SEQ ID NO: 1771 - DNA, 103 bp, Artificial Sequence
  Synthetic Polynucleotide
taatacgactcactatagggtacttatactgtaagagttgaaaggcgaaaaacagaggagatttcgcatgtcaactcttaacctggcggcagcgcaaaagatg

SEQ ID NO: 1772 - DNA, 103 bp, Artificial Sequence
  Synthetic Polynucleotide
taatacgactcactatagggagacatacttatactgtaagagttgaaaggaacagaggagacctttcatgtcttacagtaacctggcggcagcgcaaaagatg

SEQ ID NO: 1773 - DNA, 103 bp, Artificial Sequence
  Synthetic Polynucleotide
taatacgactcactatagggatcatagacatacttatactgtaagagttgaacagaggagacaactcatgcagtataagaacctggcggcagcgcaaaagatg

SEQ ID NO: 1774 - DNA, 103 bp, Artificial Sequence
  Synthetic Polynucleotide
taatacgactcactatagggtctacatcatagacatacttatactgtaagaacagaggagacttacaatgtaagtatgtaacctggcggcagcgcaaaagatg

SEQ ID NO: 1775 - DNA, 103 bp, Artificial Sequence
  Synthetic Polynucleotide
taatacgactcactatagggaatagtctacatcatagacatacttatactaacagaggagaagtataatgatgtctatgaacctggcggcagcgcaaaagatg

SEQ ID NO: 1776 - DNA, 103 bp, Artificial Sequence
  Synthetic Polynucleotide
taatacgactcactataggggttagaatagtctacatcatagacatacttaacagaggagaaagtatatgtatgatgtaaacctggcggcagcgcaaaagatg

SEQ ID NO: 1777 - DNA, 103 bp, Artificial Sequence
  Synthetic Polynucleotide
taatacgactcactatagggtcaaagttagaatagtctacatcatagacaaacagaggagatgtctaatgtgtagactaaacctggcggcagcgcaaaagatg

SEQ ID NO: 1778 - DNA, 103 bp, Artificial Sequence
  Synthetic Polynucleotide
taatacgactcactatagggggggttgcaccgctcacagcagtggatcttaacagaggagaaagatcatgtgctgtgagaacctggcggcagcgcaaaagatg

SEQ ID NO: 1779 - DNA, 103 bp, Artificial Sequence
  Synthetic Polynucleotide
taatacgactcactatagggaggcatcaaagttagaatagtctacatcataacagaggagaatgatgatgactattctaaacctggcggcagcgcaaaagatg

SEQ ID NO: 1780 - DNA, 103 bp, Artificial Sequence
  Synthetic Polynucleotide
taatacgactcactataggggtgtgaggcatcaaagttagaatagtctacaacagaggagagtagacatgtctaactttaacctggcggcagcgcaaaagatg

SEQ ID NO: 1781 - DNA, 103 bp, Artificial Sequence
  Synthetic Polynucleotide
taatacgactcactataggggtggagtgtgaggcatcaaagttagaatagaacagaggagactattcatgctttgatgcaacctggcggcagcgcaaaagatg

SEQ ID NO: 1782 - DNA, 103 bp, Artificial Sequence
  Synthetic Polynucleotide
taatacgactcactatagggttgcagtggagtgtgaggcatcaaagttagaacagaggagactaactatgatgcctcacaacctggcggcagcgcaaaagatg

SEQ ID NO: 1783 - DNA, 103 bp, Artificial Sequence
  Synthetic Polynucleotide
taatacgactcactatagggaaacattgcagtggagtgtgaggcatcaaaaacagaggagatttgatatgtcacactccaacctggcggcagcgcaaaagatg

SEQ ID NO: 1784 - DNA, 103 bp, Artificial Sequence
  Synthetic Polynucleotide
taatacgactcactatagggatttcaaacattgcagtggagtgtgaggcaaacagaggagatgcctcatgctccactgcaacctggcggcagcgcaaaagatg

SEQ ID NO: 1785 - DNA, 103 bp, Artificial Sequence
  Synthetic Polynucleotide
taatacgactcactatagggttagaatttcaaacattgcagtggagtgtgaacagaggagacacactatgctgcaatgtaacctggcggcagcgcaaaagatg

SEQ ID NO: 1786 - DNA, 103 bp, Artificial Sequence
  Synthetic Polynucleotide
taatacgactcactatagggttcaattagaatttcaaacattgcagtggaaacagaggagatccactatgatgtttgaaaacctggcggcagcgcaaaagatg

SEQ ID NO: 1787 - DNA, 103 bp, Artificial Sequence
  Synthetic Polynucleotide
taatacgactcactatagggaagttttcaattagaatttcaaacattgcaaacagaggagatgcaatatgtgaaattctaacctggcggcagcgcaaaagatg

SEQ ID NO: 1788 - DNA, 103 bp, Artificial Sequence
  Synthetic Polynucleotide
taatacgactcactatagggtaaagaagttttcaattagaatttcaaacaaacagaggagatgtttgatgttctaattgaacctggcggcagcgcaaaagatg

SEQ ID NO: 1789 - DNA, 103 bp, Artificial Sequence
  Synthetic Polynucleotide
taatacgactcactataggggtgctggggttgcaccgctcacagcagtggaacagaggagaccactgatgtgagcggtgaacctggcggcagcgcaaaagatg

SEQ ID NO: 1790 - DNA, 103 bp, Artificial Sequence
  Synthetic Polynucleotide
taatacgactcactatagggtgttgtaaagaagttttcaattagaatttcaacagaggagagaaattatgattgaaaacaacctggcggcagcgcaaaagatg

SEQ ID NO: 1791 - DNA, 103 bp, Artificial Sequence
  Synthetic Polynucleotide
taatacgactcactatagggttttctgttgtaaagaagttttcaattagaaacagaggagatctaatatgaaacttcttaacctggcggcagcgcaaaagatg

SEQ ID NO: 1792 - DNA, 103 bp, Artificial Sequence
  Synthetic Polynucleotide
taatacgactcactatagggatccattttctgttgtaaagaagttttcaaaacagaggagattgaaaatgtctttacaaaacctggcggcagcgcaaaagatg

SEQ ID NO: 1793 - DNA, 103 bp, Artificial Sequence
  Synthetic Polynucleotide
taatacgactcactatagggatcaaatccattttctgttgtaaagaagttaacagaggagaaacttcatgacaacagaaaacctggcggcagcgcaaaagatg

SEQ ID NO: 1794 - DNA, 103 bp, Artificial Sequence
  Synthetic Polynucleotide
taatacgactcactatagggctttcatcaaatccattttctgttgtaaagaacagaggagactttacatgagaaaatggaacctggcggcagcgcaaaagatg

SEQ ID NO: 1795 - DNA, 103 bp, Artificial Sequence
  Synthetic Polynucleotide
taatacgactcactatagggctattctttcatcaaatccattttctgttgaacagaggagacaacagatgatggatttgaacctggcggcagcgcaaaagatg

SEQ ID NO: 1796 - DNA, 103 bp, Artificial Sequence
  Synthetic Polynucleotide
taatacgactcactataggggtctcctattctttcatcaaatccattttcaacagaggagagaaaatatgtttgatgaaaacctggcggcagcgcaaaagatg

SEQ ID NO: 1797 - DNA, 103 bp, Artificial Sequence
  Synthetic Polynucleotide
taatacgactcactatagggaaatagtctcctattctttcatcaaatccaaacagaggagatggattatgtgaaagaataacctggcggcagcgcaaaagatg

SEQ ID NO: 1798 - DNA, 103 bp, Artificial Sequence
  Synthetic Polynucleotide
taatacgactcactatagggatcttaaatagtctcctattctttcatcaaaacagaggagattgatgatggaataggagaacctggcggcagcgcaaaagatg

SEQ ID NO: 1799 - DNA, 103 bp, Artificial Sequence
  Synthetic Polynucleotide
taatacgactcactatagggaagggatcttaaatagtctcctattctttcaacagaggagagaaagaatgggagactataacctggcggcagcgcaaaagatg

SEQ ID NO: 1800 - DNA, 103 bp, Artificial Sequence
  Synthetic Polynucleotide
taatacgactcactatagggccagggtgctggggttgcaccgctcacagcaacagaggagagctgtgatgggtgcaaccaacctggcggcagcgcaaaagatg

SEQ ID NO: 1801 - DNA, 103 bp, Artificial Sequence
  Synthetic Polynucleotide
taatacgactcactatagggactgcaagggatcttaaatagtctcctattaacagaggagaaataggatgctatttaagaacctggcggcagcgcaaaagatg

SEQ ID NO: 1802 - DNA, 103 bp, Artificial Sequence
  Synthetic Polynucleotide
taatacgactcactataggggtgaaactgcaagggatcttaaatagtctcaacagaggagagagactatgtaagatcccaacctggcggcagcgcaaaagatg

SEQ ID NO: 1803 - DNA, 103 bp, Artificial Sequence
  Synthetic Polynucleotide
taatacgactcactatagggatgtcgtgaaactgcaagggatcttaaataaacagaggagatatttaatgtcccttgcaaacctggcggcagcgcaaaagatg

SEQ ID NO: 1804 - DNA, 103 bp, Artificial Sequence
  Synthetic Polynucleotide
taatacgactcactatagggaaagcatgtcgtgaaactgcaagggatcttaacagaggagaaagatcatgtgcagtttcaacctggcggcagcgcaaaagatg

SEQ ID NO: 1805 - DNA, 103 bp, Artificial Sequence
  Synthetic Polynucleotide
taatacgactcactatagggcttcaaaagcatgtcgtgaaactgcaagggaacagaggagacccttgatgtttcacgacaacctggcggcagcgcaaaagatg

SEQ ID NO: 1806 - DNA, 103 bp, Artificial Sequence
  Synthetic Polynucleotide
taatacgactcactatagggtctctcttcaaaagcatgtcgtgaaactgcaacagaggagagcagttatgcgacatgctaacctggcggcagcgcaaaagatg

SEQ ID NO: 1807 - DNA, 103 bp, Artificial Sequence
  Synthetic Polynucleotide
taatacgactcactatagggactcttctctcttcaaaagcatgtcgtgaaaacagaggagattcacgatgtgcttttgaaacctggcggcagcgcaaaagatg

SEQ ID NO: 1808 - DNA, 103 bp, Artificial Sequence
  Synthetic Polynucleotide
taatacgactcactatagggctaacactcttctctcttcaaaagcatgtcaacagaggagagacatgatgttgaagagaaacctggcggcagcgcaaaagatg

SEQ ID NO: 1809 - DNA, 103 bp, Artificial Sequence
  Synthetic Polynucleotide
taatacgactcactatagggcttaactaacactcttctctcttcaaaagcaacagaggagagcttttatggagagaagaaacctggcggcagcgcaaaagatg

SEQ ID NO: 1810 - DNA, 103 bp, Artificial Sequence
  Synthetic Polynucleotide
taatacgactcactatagggccacccttaactaacactcttctctcttcaaacagaggagatgaagaatgaagagtgttaacctggcggcagcgcaaaagatg

SEQ ID NO: 1811 - DNA, 103 bp, Artificial Sequence
  Synthetic Polynucleotide
taatacgactcactatagggtcgaaccagggtgctggggttgcaccgctcaacagaggagagagcggatgaaccccagcaacctggcggcagcgcaaaagatg

SEQ ID NO: 1812 - DNA, 103 bp, Artificial Sequence
  Synthetic Polynucleotide
taatacgactcactatagggggagaccacccttaactaacactcttctctaacagaggagaagagaaatgtgttagttaaacctggcggcagcgcaaaagatg

SEQ ID NO: 1813 - DNA, 103 bp, Artificial Sequence
  Synthetic Polynucleotide
taatacgactcactatagggtgacgggagaccacccttaactaacactctaacagaggagaagagtgatggttaagggtaacctggcggcagcgcaaaagatg

SEQ ID NO: 1814 - DNA, 103 bp, Artificial Sequence
  Synthetic Polynucleotide
taatacgactcactatagggcaccctgacgggagaccacccttaactaacaacagaggagagttagtatggggtggtctaacctggcggcagcgcaaaagatg

SEQ ID NO: 1815 - DNA, 103 bp, Artificial Sequence
  Synthetic Polynucleotide
taatacgactcactatagggcggcacaccctgacgggagaccacccttaaaacagaggagattaaggatggtctcccgtaacctggcggcagcgcaaaagatg

SEQ ID NO: 1816 - DNA, 103 bp, Artificial Sequence
  Synthetic Polynucleotide
taatacgactcactatagggtgtagcggcacaccctgacgggagaccaccaacagaggagaggtggtatgccgtcagggaacctggcggcagcgcaaaagatg

SEQ ID NO: 1817 - DNA, 103 bp, Artificial Sequence
  Synthetic Polynucleotide
taatacgactcactatagggatgcttgtagcggcacaccctgacgggagaaacagaggagatctcccatgagggtgtgcaacctggcggcagcgcaaaagatg

SEQ ID NO: 1818 - DNA, 103 bp, Artificial Sequence
  Synthetic Polynucleotide
taatacgactcactatagggtcaacatgcttgtagcggcacaccctgacgaacagaggagacgtcagatggtgccgctaaacctggcggcagcgcaaaagatg

SEQ ID NO: 1819 - DNA, 103 bp, Artificial Sequence
  Synthetic Polynucleotide
taatacgactcactatagggtgtgttcaacatgcttgtagcggcacacccaacagaggagagggtgtatggctacaagcaacctggcggcagcgcaaaagatg

SEQ ID NO: 1820 - DNA, 103 bp, Artificial Sequence
  Synthetic Polynucleotide
taatacgactcactatagggataattgtgttcaacatgcttgtagcggcaaacagaggagatgccgcatgaagcatgttaacctggcggcagcgcaaaagatg

SEQ ID NO: 1821 - DNA, 103 bp, Artificial Sequence
  Synthetic Polynucleotide
taatacgactcactatagggtgtttataattgtgttcaacatgcttgtagaacagaggagactacaaatgtgttgaacaaacctggcggcagcgcaaaagatg

SEQ ID NO: 1822 - DNA, 103 bp, Artificial Sequence
  Synthetic Polynucleotide
taatacgactcactatagggggccatcgaaccagggtgctggggttgcacaacagaggagagtgcaaatgcagcaccctaacctggcggcagcgcaaaagatg

SEQ ID NO: 1823 - DNA, 103 bp, Artificial Sequence
  Synthetic Polynucleotide
taatacgactcactatagggtatgttgtttataattgtgttcaacatgctaacagaggagaagcatgatgaacacaattaacctggcggcagcgcaaaagatg

SEQ ID NO: 1824 - DNA, 103 bp, Artificial Sequence
  Synthetic Polynucleotide
taatacgactcactatagggattactatgttgtttataattgtgttcaacaacagaggagagttgaaatgaattataaaaacctggcggcagcgcaaaagatg

SEQ ID NO: 1825 - DNA, 103 bp, Artificial Sequence
  Synthetic Polynucleotide
taatacgactcactatagggctctgattactatgttgtttataattgtgtaacagaggagaacacaaatgtaaacaacaaacctggcggcagcgcaaaagatg

SEQ ID NO: 1826 - DNA, 103 bp, Artificial Sequence
  Synthetic Polynucleotide
taatacgactcactatagggagctgctctgattactatgttgtttataataacagaggagaattataatgaacatagtaaacctggcggcagcgcaaaagatg

SEQ ID NO: 1827 - DNA, 103 bp, Artificial Sequence
  Synthetic Polynucleotide
taatacgactcactatagggtgtaaagctgctctgattactatgttgtttaacagaggagaaaacaaatgagtaatcagaacctggcggcagcgcaaaagatg

SEQ ID NO: 1828 - DNA, 103 bp, Artificial Sequence
  Synthetic Polynucleotide
taatacgactcactatagggtcaagtgtaaagctgctctgattactatgtaacagaggagaacatagatgtcagagcagaacctggcggcagcgcaaaagatg

SEQ ID NO: 1829 - DNA, 103 bp, Artificial Sequence
  Synthetic Polynucleotide
taatacgactcactatagggataggtcaagtgtaaagctgctctgattacaacagaggagagtaatcatggcagctttaaacctggcggcagcgcaaaagatg

SEQ ID NO: 1830 - DNA, 103 bp, Artificial Sequence
  Synthetic Polynucleotide
taatacgactcactatagggttagaataggtcaagtgtaaagctgctctgaacagaggagacagagcatgtttacacttaacctggcggcagcgcaaaagatg

SEQ ID NO: 1831 - DNA, 103 bp, Artificial Sequence
  Synthetic Polynucleotide
taatacgactcactatagggcaaagttagaataggtcaagtgtaaagctgaacagaggagacagcttatgacttgacctaacctggcggcagcgcaaaagatg

SEQ ID NO: 1832 - DNA, 103 bp, Artificial Sequence
  Synthetic Polynucleotide
taatacgactcactatagggaaattcaaagttagaataggtcaagtgtaaaacagaggagattacacatgacctattctaacctggcggcagcgcaaaagatg

SEQ ID NO: 1833 - DNA, 103 bp, Artificial Sequence
  Synthetic Polynucleotide
taatacgactcactatagggagaatggccatcgaaccagggtgctggggtaacagaggagaaccccaatgccctggttcaacctggcggcagcgcaaaagatg

SEQ ID NO: 1834 - DNA, 103 bp, Artificial Sequence
  Synthetic Polynucleotide
taatacgactcactatagggtcatcaaattcaaagttagaataggtcaagaacagaggagacttgacatgttctaacttaacctggcggcagcgcaaaagatg

SEQ ID NO: 1835 - DNA, 103 bp, Artificial Sequence
  Synthetic Polynucleotide
taatacgactcactatagggtgatgtcatcaaattcaaagttagaataggaacagaggagacctattatgactttgaataacctggcggcagcgcaaaagatg

SEQ ID NO: 1836 - DNA, 103 bp, Artificial Sequence
  Synthetic Polynucleotide
taatacgactcactatagggaactttgatgtcatcaaattcaaagttagaaacagaggagatctaacatggaatttgataacctggcggcagcgcaaaagatg

SEQ ID NO: 1837 - DNA, 103 bp, Artificial Sequence
  Synthetic Polynucleotide
taatacgactcactataggggacaaaactttgatgtcatcaaattcaaagaacagaggagactttgaatgtgatgacataacctggcggcagcgcaaaagatg

SEQ ID NO: 1838 - DNA, 103 bp, Artificial Sequence
  Synthetic Polynucleotide
taatacgactcactatagggcataagacaaaactttgatgtcatcaaattaacagaggagaaatttgatgacatcaaagaacctggcggcagcgcaaaagatg

SEQ ID NO: 1839 - DNA, 103 bp, Artificial Sequence
  Synthetic Polynucleotide
taatacgactcactatagggatcaccataagacaaaactttgatgtcatcaacagaggagagatgacatgaaagttttgaacctggcggcagcgcaaaagatg

SEQ ID NO: 1840 - DNA, 103 bp, Artificial Sequence
  Synthetic Polynucleotide
taatacgactcactatagggaaatcatcaccataagacaaaactttgatgaacagaggagacatcaaatgtttgtcttaaacctggcggcagcgcaaaagatg

SEQ ID NO: 1841 - DNA, 103 bp, Artificial Sequence
  Synthetic Polynucleotide
taatacgactcactatagggtgagtaaatcatcaccataagacaaaacttaacagaggagaaagtttatgcttatggtgaacctggcggcagcgcaaaagatg

SEQ ID NO: 1842 - DNA, 103 bp, Artificial Sequence
  Synthetic Polynucleotide
taatacgactcactatagggggcaatgagtaaatcatcaccataagacaaaacagaggagattgtctatgggtgatgataacctggcggcagcgcaaaagatg

SEQ ID NO: 1843 - DNA, 103 bp, Artificial Sequence
  Synthetic Polynucleotide
taatacgactcactatagggtttgtggcaatgagtaaatcatcaccataaaacagaggagattatggatgtgatttactaacctggcggcagcgcaaaagatg

SEQ ID NO: 1844 - DNA, 103 bp, Artificial Sequence
  Synthetic Polynucleotide
taatacgactcactatagggcatagagaatggccatcgaaccagggtgctaacagaggagaagcaccatggttcgatggaacctggcggcagcgcaaaagatg

SEQ ID NO: 1845 - DNA, 103 bp, Artificial Sequence
  Synthetic Polynucleotide
taatacgactcactataggggataatttgtggcaatgagtaaatcatcacaacagaggagagtgatgatgtactcattgaacctggcggcagcgcaaaagatg

SEQ ID NO: 1846 - DNA, 103 bp, Artificial Sequence
  Synthetic Polynucleotide
taatacgactcactatagggaatttgataatttgtggcaatgagtaaatcaacagaggagagatttaatgattgccacaaacctggcggcagcgcaaaagatg

SEQ ID NO: 1847 - DNA, 103 bp, Artificial Sequence
  Synthetic Polynucleotide
taatacgactcactatagggaaattaatttgataatttgtggcaatgagtaacagaggagaactcatatgcacaaattaaacctggcggcagcgcaaaagatg

SEQ ID NO: 1848 - DNA, 103 bp, Artificial Sequence
  Synthetic Polynucleotide
taatacgactcactataggggattaaaattaatttgataatttgtggcaaaacagaggagattgccaatgattatcaaaaacctggcggcagcgcaaaagatg

SEQ ID NO: 1849 - DNA, 103 bp, Artificial Sequence
  Synthetic Polynucleotide
taatacgactcactatagggaacaagattaaaattaatttgataatttgtaacagaggagaacaaatatgcaaattaataacctggcggcagcgcaaaagatg

SEQ ID NO: 1850 - DNA, 103 bp, Artificial Sequence
  Synthetic Polynucleotide
taatacgactcactatagggtgtttaacaagattaaaattaatttgataaaacagaggagattatcaatgtaattttaaaacctggcggcagcgcaaaagatg

SEQ ID NO: 1851 - DNA, 103 bp, Artificial Sequence
  Synthetic Polynucleotide
taatacgactcactatagggatctttgtttaacaagattaaaattaatttaacagaggagaaaattaatgttaatcttgaacctggcggcagcgcaaaagatg

SEQ ID NO: 1852 - DNA, 103 bp, Artificial Sequence
  Synthetic Polynucleotide
taatacgactcactatagggggctaatctttgtttaacaagattaaaattaacagaggagaaattttatgcttgttaaaaacctggcggcagcgcaaaagatg

SEQ ID NO: 1853 - DNA, 103 bp, Artificial Sequence
  Synthetic Polynucleotide
taatacgactcactatagggaagggggctaatctttgtttaacaagattaaacagaggagataatctatgtaaacaaagaacctggcggcagcgcaaaagatg

SEQ ID NO: 1854 - DNA, 103 bp, Artificial Sequence
  Synthetic Polynucleotide
taatacgactcactatagggaattgaagggggctaatctttgtttaacaaaacagaggagattgttaatgaaagattagaacctggcggcagcgcaaaagatg

SEQ ID NO: 1855 - DNA, 103 bp, Artificial Sequence
  Synthetic Polynucleotide
taatacgactcactatagggcagcatccaagggatgacatgtttggtcttaacagaggagaaagaccatgcatgtcatcaacctggcggcagcgcaaaagatg

SEQ ID NO: 1856 - DNA, 103 bp, Artificial Sequence
  Synthetic Polynucleotide
taatacgactcactatagggggttccatagagaatggccatcgaaccaggaacagaggagacctggtatgatggccattaacctggcggcagcgcaaaagatg

SEQ ID NO: 1857 - DNA, 103 bp, Artificial Sequence
  Synthetic Polynucleotide
taatacgactcactatagggcttgtaattgaagggggctaatctttgtttaacagaggagaaaacaaatgttagcccccaacctggcggcagcgcaaaagatg

SEQ ID NO: 1858 - DNA, 103 bp, Artificial Sequence
  Synthetic Polynucleotide
taatacgactcactataggggtaatcttgtaattgaagggggctaatcttaacagaggagaaagattatgccccttcaaaacctggcggcagcgcaaaagatg

SEQ ID NO: 1859 - DNA, 103 bp, Artificial Sequence
  Synthetic Polynucleotide
taatacgactcactatagggcaggtgtaatcttgtaattgaagggggctaaacagaggagatagcccatgtcaattacaaacctggcggcagcgcaaaagatg

SEQ ID NO: 1860 - DNA, 103 bp, Artificial Sequence
  Synthetic Polynucleotide
taatacgactcactataggggttagcaggtgtaatcttgtaattgaagggaacagaggagacccttcatgtacaagattaacctggcggcagcgcaaaagatg

SEQ ID NO: 1861 - DNA, 103 bp, Artificial Sequence
  Synthetic Polynucleotide
taatacgactcactataggggtcttgttagcaggtgtaatcttgtaattgaacagaggagacaattaatggattacaccaacctggcggcagcgcaaaagatg

SEQ ID NO: 1862 - DNA, 103 bp, Artificial Sequence
  Synthetic Polynucleotide
taatacgactcactatagggcaacagtcttgttagcaggtgtaatcttgtaacagaggagaacaagaatgcacctgctaaacctggcggcagcgcaaaagatg

SEQ ID NO: 1863 - DNA, 103 bp, Artificial Sequence
  Synthetic Polynucleotide
taatacgactcactatagggaaattcaacagtcttgttagcaggtgtaataacagaggagaattacaatggctaacaagaacctggcggcagcgcaaaagatg

SEQ ID NO: 1864 - DNA, 103 bp, Artificial Sequence
  Synthetic Polynucleotide
taatacgactcactatagggtcaggaaattcaacagtcttgttagcaggtaacagaggagaacctgcatgcaagactgtaacctggcggcagcgcaaaagatg

SEQ ID NO: 1865 - DNA, 103 bp, Artificial Sequence
  Synthetic Polynucleotide
taatacgactcactatagggaaatttcaggaaattcaacagtcttgttagaacagaggagactaacaatgctgttgaataacctggcggcagcgcaaaagatg

SEQ ID NO: 1866 - DNA, 103 bp, Artificial Sequence
  Synthetic Polynucleotide
taatacgactcactatagggattagaaatttcaggaaattcaacagtcttaacagaggagaaagactatggaatttcctaacctggcggcagcgcaaaagatg

SEQ ID NO: 1867 - DNA, 103 bp, Artificial Sequence
  Synthetic Polynucleotide
taatacgactcactatagggtttctggttccatagagaatggccatcgaaaacagaggagattcgatatgcattctctaaacctggcggcagcgcaaaagatg

SEQ ID NO: 1868 - DNA, 103 bp, Artificial Sequence
  Synthetic Polynucleotide
taatacgactcactatagggtaaagattagaaatttcaggaaattcaacaaacagaggagatgttgaatgtcctgaaataacctggcggcagcgcaaaagatg

SEQ ID NO: 1869 - DNA, 103 bp, Artificial Sequence
  Synthetic Polynucleotide
taatacgactcactatagggcctcataaagattagaaatttcaggaaattaacagaggagaaatttcatgaaatttctaaacctggcggcagcgcaaaagatg

SEQ ID NO: 1870 - DNA, 103 bp, Artificial Sequence
  Synthetic Polynucleotide
taatacgactcactatagggagtaacctcataaagattagaaatttcaggaacagaggagacctgaaatgtctaatcttaacctggcggcagcgcaaaagatg

SEQ ID NO: 1871 - DNA, 103 bp, Artificial Sequence
  Synthetic Polynucleotide
taatacgactcactatagggagaaaagtaacctcataaagattagaaattaacagaggagaaatttcatgtctttatgaaacctggcggcagcgcaaaagatg

SEQ ID NO: 1872 - DNA, 103 bp, Artificial Sequence
  Synthetic Polynucleotide
taatacgactcactatagggtttttagaaaagtaacctcataaagattagaacagaggagactaatcatgatgaggttaaacctggcggcagcgcaaaagatg

SEQ ID NO: 1873 - DNA, 103 bp, Artificial Sequence
  Synthetic Polynucleotide
taatacgactcactatagggttttctttttagaaaagtaacctcataaagaacagaggagactttatatggttacttttaacctggcggcagcgcaaaagatg

SEQ ID NO: 1874 - DNA, 103 bp, Artificial Sequence
  Synthetic Polynucleotide
taatacgactcactatagggacaaattttctttttagaaaagtaacctcaaacagaggagatgaggtatgttttctaaaaacctggcggcagcgcaaaagatg

SEQ ID NO: 1875 - DNA, 103 bp, Artificial Sequence
  Synthetic Polynucleotide
taatacgactcactataggggcctaacaaattttctttttagaaaagtaaaacagaggagattacttatgtaaaaagaaaacctggcggcagcgcaaaagatg

SEQ ID NO: 1876 - DNA, 103 bp, Artificial Sequence
  Synthetic Polynucleotide
taatacgactcactatagggattgtgcctaacaaattttctttttagaaaaacagaggagatttctaatgagaaaatttaacctggcggcagcgcaaaagatg

SEQ ID NO: 1877 - DNA, 103 bp, Artificial Sequence
  Synthetic Polynucleotide
taatacgactcactatagggcaggaattgtgcctaacaaattttctttttaacagaggagaaaaaagatgatttgttagaacctggcggcagcgcaaaagatg

SEQ ID NO: 1878 - DNA, 103 bp, Artificial Sequence
  Synthetic Polynucleotide
taatacgactcactatagggaccattttctggttccatagagaatggccaaacagaggagatggccaatgtctatggaaaacctggcggcagcgcaaaagatg

SEQ ID NO: 1879 - DNA, 103 bp, Artificial Sequence
  Synthetic Polynucleotide
taatacgactcactatagggacaagcaggaattgtgcctaacaaattttcaacagaggagagaaaatatgttaggcacaaacctggcggcagcgcaaaagatg

SEQ ID NO: 1880 - DNA, 103 bp, Artificial Sequence
  Synthetic Polynucleotide
taatacgactcactatagggtttaaacaagcaggaattgtgcctaacaaaaacagaggagatttgttatgcacaattccaacctggcggcagcgcaaaagatg

SEQ ID NO: 1881 - DNA, 103 bp, Artificial Sequence
  Synthetic Polynucleotide
taatacgactcactatagggtgaggtttaaacaagcaggaattgtgcctaaacagaggagataggcaatgttcctgcttaacctggcggcagcgcaaaagatg

SEQ ID NO: 1882 - DNA, 103 bp, Artificial Sequence
  Synthetic Polynucleotide
taatacgactcactatagggccatttgaggtttaaacaagcaggaattgtaacagaggagaacaattatggcttgtttaaacctggcggcagcgcaaaagatg

SEQ ID NO: 1883 - DNA, 103 bp, Artificial Sequence
  Synthetic Polynucleotide
taatacgactcactatagggtgtatccatttgaggtttaaacaagcaggaaacagaggagatcctgcatgtttaaacctaacctggcggcagcgcaaaagatg

SEQ ID NO: 1884 - DNA, 103 bp, Artificial Sequence
  Synthetic Polynucleotide
taatacgactcactatagggttttctgtatccatttgaggtttaaacaagaacagaggagacttgttatgacctcaaataacctggcggcagcgcaaaagatg

SEQ ID NO: 1885 - DNA, 103 bp, Artificial Sequence
  Synthetic Polynucleotide
taatacgactcactatagggtcaaattttctgtatccatttgaggtttaaaacagaggagattaaacatgaaatggataaacctggcggcagcgcaaaagatg

SEQ ID NO: 1886 - DNA, 103 bp, Artificial Sequence
  Synthetic Polynucleotide
taatacgactcactatagggtgctttcaaattttctgtatccatttgaggaacagaggagacctcaaatggatacagaaaacctggcggcagcgcaaaagatg

SEQ ID NO: 1887 - DNA, 103 bp, Artificial Sequence
  Synthetic Polynucleotide
taatacgactcactatagggaccattgctttcaaattttctgtatccattaacagaggagaaatggaatgagaaaatttaacctggcggcagcgcaaaagatg

SEQ ID NO: 1888 - DNA, 103 bp, Artificial Sequence
  Synthetic Polynucleotide
taatacgactcactatagggaactaaccattgctttcaaattttctgtataacagaggagaatacagatgatttgaaagaacctggcggcagcgcaaaagatg

SEQ ID NO: 1889 - DNA, 103 bp, Artificial Sequence
  Synthetic Polynucleotide
taatacgactcactatagggagaaaaccattttctggttccatagagaataacagaggagaattctcatgggaaccagaaacctggcggcagcgcaaaagatg

SEQ ID NO: 1890 - DNA, 103 bp, Artificial Sequence
  Synthetic Polynucleotide
taatacgactcactatagggacaataactaaccattgctttcaaattttcaacagaggagagaaaatatgaaagcaatgaacctggcggcagcgcaaaagatg

SEQ ID NO: 1891 - DNA, 103 bp, Artificial Sequence
  Synthetic Polynucleotide
taatacgactcactatagggggtctacaataactaaccattgctttcaaaaacagaggagatttgaaatgaatggttagaacctggcggcagcgcaaaagatg

SEQ ID NO: 1892 - DNA, 103 bp, Artificial Sequence
  Synthetic Polynucleotide
taatacgactcactatagggtacctggtctacaataactaaccattgcttaacagaggagaaagcaaatgttagttattaacctggcggcagcgcaaaagatg

SEQ ID NO: 1893 - DNA, 103 bp, Artificial Sequence
  Synthetic Polynucleotide
taatacgactcactatagggtaaagtacctggtctacaataactaaccataacagaggagaatggttatgtattgtagaaacctggcggcagcgcaaaagatg

SEQ ID NO: 1894 - DNA, 103 bp, Artificial Sequence
  Synthetic Polynucleotide
taatacgactcactatagggtcctttaaagtacctggtctacaataactaaacagaggagatagttaatgtagaccaggaacctggcggcagcgcaaaagatg

SEQ ID NO: 1895 - DNA, 103 bp, Artificial Sequence
  Synthetic Polynucleotide
taatacgactcactataggggcttttcctttaaagtacctggtctacaataacagaggagaattgtaatgcaggtacttaacctggcggcagcgcaaaagatg

SEQ ID NO: 1896 - DNA, 103 bp, Artificial Sequence
  Synthetic Polynucleotide
taatacgactcactataggggttgagcttttcctttaaagtacctggtctaacagaggagaagaccaatgactttaaagaacctggcggcagcgcaaaagatg

SEQ ID NO: 1897 - DNA, 103 bp, Artificial Sequence
  Synthetic Polynucleotide
taatacgactcactatagggatagagttgagcttttcctttaaagtacctaacagaggagaaggtacatgaaaggaaaaaacctggcggcagcgcaaaagatg

SEQ ID NO: 1898 - DNA, 103 bp, Artificial Sequence
  Synthetic Polynucleotide
taatacgactcactataggggtgcaatagagttgagcttttcctttaaagaacagaggagactttaaatgaaaagctcaaacctggcggcagcgcaaaagatg

SEQ ID NO: 1899 - DNA, 103 bp, Artificial Sequence
  Synthetic Polynucleotide
taatacgactcactatagggcagcagtgcaatagagttgagcttttccttaacagaggagaaaggaaatgctcaactctaacctggcggcagcgcaaaagatg

SEQ ID NO: 1900 - DNA, 103 bp, Artificial Sequence
  Synthetic Polynucleotide
taatacgactcactataggggcttgagaaaaccattttctggttccatagaacagaggagactatggatgcagaaaatgaacctggcggcagcgcaaaagatg

SEQ ID NO: 1901 - DNA, 103 bp, Artificial Sequence
  Synthetic Polynucleotide
taatacgactcactatagggaccgccagcagtgcaatagagttgagctttaacagaggagaaaagctatgctctattgcaacctggcggcagcgcaaaagatg

SEQ ID NO: 1902 - DNA, 103 bp, Artificial Sequence
  Synthetic Polynucleotide
taatacgactcactatagggagtgcaccgccagcagtgcaatagagttgaaacagaggagatcaactatgttgcactgcaacctggcggcagcgcaaaagatg

SEQ ID NO: 1903 - DNA, 103 bp, Artificial Sequence
  Synthetic Polynucleotide
taatacgactcactatagggccctgagtgcaccgccagcagtgcaatagaaacagaggagatctattatgctgctggcgaacctggcggcagcgcaaaagatg

SEQ ID NO: 1904 - DNA, 103 bp, Artificial Sequence
  Synthetic Polynucleotide
taatacgactcactatagggctcttccctgagtgcaccgccagcagtgcaaacagaggagatgcactatgggcggtgcaaacctggcggcagcgcaaaagatg

SEQ ID NO: 1905 - DNA, 103 bp, Artificial Sequence
  Synthetic Polynucleotide
taatacgactcactatagggaaacactcttccctgagtgcaccgccagcaaacagaggagatgctggatgtgcactcagaacctggcggcagcgcaaaagatg

SEQ ID NO: 1906 - DNA, 103 bp, Artificial Sequence
  Synthetic Polynucleotide
taatacgactcactataggggtcgtaaacactcttccctgagtgcaccgcaacagaggagagcggtgatgtcagggaagaacctggcggcagcgcaaaagatg

SEQ ID NO: 1907 - DNA, 103 bp, Artificial Sequence
  Synthetic Polynucleotide
taatacgactcactatagggatttcgtcgtaaacactcttccctgagtgcaacagaggagagcactcatggaagagtgtaacctggcggcagcgcaaaagatg

SEQ ID NO: 1908 - DNA, 103 bp, Artificial Sequence
  Synthetic Polynucleotide
taatacgactcactatagggcaaaaatttcgtcgtaaacactcttccctgaacagaggagacagggaatggtgtttacgaacctggcggcagcgcaaaagatg

SEQ ID NO: 1909 - DNA, 103 bp, Artificial Sequence
  Synthetic Polynucleotide
taatacgactcactatagggtgggtcaaaaatttcgtcgtaaacactcttaacagaggagaaagagtatgtacgacgaaaacctggcggcagcgcaaaagatg

SEQ ID NO: 1910 - DNA, 103 bp, Artificial Sequence
  Synthetic Polynucleotide
taatacgactcactatagggcgaaatgggtcaaaaatttcgtcgtaaacaaacagaggagatgtttaatgcgaaattttaacctggcggcagcgcaaaagatg

SEQ ID NO: 1911 - DNA, 103 bp, Artificial Sequence
  Synthetic Polynucleotide
taatacgactcactatagggggagggcttgagaaaaccattttctggttcaacagaggagagaaccaatgaatggttttaacctggcggcagcgcaaaagatg

SEQ ID NO: 1912 - DNA, 103 bp, Artificial Sequence
  Synthetic Polynucleotide
taatacgactcactatagggtacgacgaaatgggtcaaaaatttcgtcgtaacagaggagaacgacgatgtttttgaccaacctggcggcagcgcaaaagatg

SEQ ID NO: 1913 - DNA, 103 bp, Artificial Sequence
  Synthetic Polynucleotide
taatacgactcactatagggtccgatacgacgaaatgggtcaaaaatttcaacagaggagagaaattatggacccatttaacctggcggcagcgcaaaagatg

SEQ ID NO: 1914 - DNA, 103 bp, Artificial Sequence
  Synthetic Polynucleotide
taatacgactcactatagggattattccgatacgacgaaatgggtcaaaaaacagaggagattttgaatgatttcgtcgaacctggcggcagcgcaaaagatg

SEQ ID NO: 1915 - DNA, 103 bp, Artificial Sequence
  Synthetic Polynucleotide
taatacgactcactataggggaactattattccgatacgacgaaatgggtaacagaggagaacccatatggtcgtatcgaacctggcggcagcgcaaaagatg

SEQ ID NO: 1916 - DNA, 103 bp, Artificial Sequence
  Synthetic Polynucleotide
taatacgactcactatagggttctggaactattattccgatacgacgaaaaacagaggagatttcgtatgatcggaataaacctggcggcagcgcaaaagatg

SEQ ID NO: 1917 - DNA, 103 bp, Artificial Sequence
  Synthetic Polynucleotide
taatacgactcactatagggctgtgttctggaactattattccgatacgaaacagaggagatcgtatatgaataatagtaacctggcggcagcgcaaaagatg

SEQ ID NO: 1918 - DNA, 103 bp, Artificial Sequence
  Synthetic Polynucleotide
taatacgactcactatagggtggtactgtgttctggaactattattccgaaacagaggagatcggaaatgtagttccagaacctggcggcagcgcaaaagatg

SEQ ID NO: 1919 - DNA, 103 bp, Artificial Sequence
  Synthetic Polynucleotide
taatacgactcactataggggagcatggtactgtgttctggaactattataacagaggagaataataatgccagaacacaacctggcggcagcgcaaaagatg

SEQ ID NO: 1920 - DNA, 103 bp, Artificial Sequence
  Synthetic Polynucleotide
taatacgactcactatagggctatagagcatggtactgtgttctggaactaacagaggagaagttccatgacacagtacaacctggcggcagcgcaaaagatg

SEQ ID NO: 1921 - DNA, 103 bp, Artificial Sequence
  Synthetic Polynucleotide
taatacgactcactataggggccatctatagagcatggtactgtgttctgaacagaggagacagaacatggtaccatgcaacctggcggcagcgcaaaagatg

SEQ ID NO: 1922 - DNA, 103 bp, Artificial Sequence
  Synthetic Polynucleotide
taatacgactcactatagggctaccggagggcttgagaaaaccattttctaacagaggagaagaaaaatgttttctcaaaacctggcggcagcgcaaaagatg

SEQ ID NO: 1923 - DNA, 103 bp, Artificial Sequence
  Synthetic Polynucleotide
taatacgactcactatagggattgagccatctatagagcatggtactgtgaacagaggagacacagtatgatgctctataacctggcggcagcgcaaaagatg

SEQ ID NO: 1924 - DNA, 103 bp, Artificial Sequence
  Synthetic Polynucleotide
taatacgactcactatagggaatagattgagccatctatagagcatggtaaacagaggagataccatatgctatagatgaacctggcggcagcgcaaaagatg

SEQ ID NO: 1925 - DNA, 103 bp, Artificial Sequence
  Synthetic Polynucleotide
taatacgactcactatagggatctaaatagattgagccatctatagagcaaacagaggagatgctctatggatggctcaaacctggcggcagcgcaaaagatg

SEQ ID NO: 1926 - DNA, 103 bp, Artificial Sequence
  Synthetic Polynucleotide
taatacgactcactatagggtgttcatctaaatagattgagccatctataaacagaggagatatagaatgctcaatctaaacctggcggcagcgcaaaagatg

SEQ ID NO: 1927 - DNA, 103 bp, Artificial Sequence
  Synthetic Polynucleotide
taatacgactcactataggggaggatgttcatctaaatagattgagccataacagaggagaatggctatgtctatttagaacctggcggcagcgcaaaagatg

SEQ ID NO: 1928 - DNA, 103 bp, Artificial Sequence
  Synthetic Polynucleotide
taatacgactcactatagggatcgagaggatgttcatctaaatagattgaaacagaggagatcaatcatgttagatgaaaacctggcggcagcgcaaaagatg

SEQ ID NO: 1929 - DNA, 103 bp, Artificial Sequence
  Synthetic Polynucleotide
taatacgactcactatagggatccgatcgagaggatgttcatctaaatagaacagaggagactatttatgtgaacatccaacctggcggcagcgcaaaagatg

SEQ ID NO: 1930 - DNA, 103 bp, Artificial Sequence
  Synthetic Polynucleotide
taatacgactcactatagggttgcgatccgatcgagaggatgttcatctaaacagaggagatagatgatgatcctctcgaacctggcggcagcgcaaaagatg

SEQ ID NO: 1931 - DNA, 103 bp, Artificial Sequence
  Synthetic Polynucleotide
taatacgactcactatagggacacgttgcgatccgatcgagaggatgttcaacagaggagagaacatatgctcgatcggaacctggcggcagcgcaaaagatg

SEQ ID NO: 1932 - DNA, 103 bp, Artificial Sequence
  Synthetic Polynucleotide
taatacgactcactataggggggtaacacgttgcgatccgatcgagaggaaacagaggagatcctctatgtcggatcgcaacctggcggcagcgcaaaagatg

SEQ ID NO: 1933 - DNA, 103 bp, Artificial Sequence
  Synthetic Polynucleotide
taatacgactcactatagggcttctctaccggagggcttgagaaaaccataacagaggagaatggttatgtcaagccctaacctggcggcagcgcaaaagatg

SEQ ID NO: 1934 - DNA, 103 bp, Artificial Sequence
  Synthetic Polynucleotide
taatacgactcactatagggttccagggtaacacgttgcgatccgatcgaaacagaggagatcgatcatgtcgcaacgtaacctggcggcagcgcaaaagatg

SEQ ID NO: 1935 - DNA, 103 bp, Artificial Sequence
  Synthetic Polynucleotide
taatacgactcactataggggtggattccagggtaacacgttgcgatccgaacagaggagacggatcatgacgtgttacaacctggcggcagcgcaaaagatg

SEQ ID NO: 1936 - DNA, 103 bp, Artificial Sequence
  Synthetic Polynucleotide
taatacgactcactatagggcccaagtggattccagggtaacacgttgcgaacagaggagacgcaacatgttaccctggaacctggcggcagcgcaaaagatg

SEQ ID NO: 1937 - DNA, 103 bp, Artificial Sequence
  Synthetic Polynucleotide
taatacgactcactataggggtacacccaagtggattccagggtaacacgaacagaggagacgtgttatgctggaatccaacctggcggcagcgcaaaagatg

SEQ ID NO: 1938 - DNA, 103 bp, Artificial Sequence
  Synthetic Polynucleotide
taatacgactcactataggggccgcgtacacccaagtggattccagggtaaacagaggagataccctatgatccacttgaacctggcggcagcgcaaaagatg

SEQ ID NO: 1939 - DNA, 103 bp, Artificial Sequence
  Synthetic Polynucleotide
taatacgactcactataggggaacggccgcgtacacccaagtggattccaaacagaggagatggaatatgcttgggtgtaacctggcggcagcgcaaaagatg

SEQ ID NO: 1940 - DNA, 103 bp, Artificial Sequence
  Synthetic Polynucleotide
taatacgactcactatagggcgtcagaacggccgcgtacacccaagtggaaacagaggagatccactatggtgtacgcgaacctggcggcagcgcaaaagatg

SEQ ID NO: 1941 - DNA, 103 bp, Artificial Sequence
  Synthetic Polynucleotide
taatacgactcactatagggtccaacgtcagaacggccgcgtacacccaaaacagaggagattgggtatgcgcggccgtaacctggcggcagcgcaaaagatg

SEQ ID NO: 1942 - DNA, 103 bp, Artificial Sequence
  Synthetic Polynucleotide
taatacgactcactatagggagaattccaacgtcagaacggccgcgtacaaacagaggagatgtacgatgccgttctgaaacctggcggcagcgcaaaagatg

SEQ ID NO: 1943 - DNA, 103 bp, Artificial Sequence
  Synthetic Polynucleotide
taatacgactcactatagggtctacagaattccaacgtcagaacggccgcaacagaggagagcggccatgctgacgttgaacctggcggcagcgcaaaagatg

SEQ ID NO: 1944 - DNA, 103 bp, Artificial Sequence
  Synthetic Polynucleotide
taatacgactcactatagggcttggcttctctaccggagggcttgagaaaaacagaggagatttctcatgccctccggtaacctggcggcagcgcaaaagatg

SEQ ID NO: 1945 - DNA, 103 bp, Artificial Sequence
  Synthetic Polynucleotide
taatacgactcactatagggtttcatctacagaattccaacgtcagaacgaacagaggagacgttctatggttggaattaacctggcggcagcgcaaaagatg

SEQ ID NO: 1946 - DNA, 103 bp, Artificial Sequence
  Synthetic Polynucleotide
taatacgactcactatagggctaactttcatctacagaattccaacgtcaaacagaggagatgacgtatgaattctgtaaacctggcggcagcgcaaaagatg

SEQ ID NO: 1947 - DNA, 103 bp, Artificial Sequence
  Synthetic Polynucleotide
taatacgactcactatagggcctaactaactttcatctacagaattccaaaacagaggagattggaaatgtgtagatgaaacctggcggcagcgcaaaagatg

SEQ ID NO: 1948 - DNA, 103 bp, Artificial Sequence
  Synthetic Polynucleotide
taatacgactcactatagggaagctcctaactaactttcatctacagaataacagaggagaattctgatgatgaaagttaacctggcggcagcgcaaaagatg

SEQ ID NO: 1949 - DNA, 103 bp, Artificial Sequence
  Synthetic Polynucleotide
taatacgactcactatagggattaaaagctcctaactaactttcatctacaacagaggagagtagatatgagttagttaaacctggcggcagcgcaaaagatg

SEQ ID NO: 1950 - DNA, 103 bp, Artificial Sequence
  Synthetic Polynucleotide
taatacgactcactatagggttccaattaaaagctcctaactaactttcaaacagaggagatgaaagatggttaggagcaacctggcggcagcgcaaaagatg

SEQ ID NO: 1951 - DNA, 103 bp, Artificial Sequence
  Synthetic Polynucleotide
taatacgactcactatagggctcatttccaattaaaagctcctaactaacaacagaggagagttagtatggagcttttaaacctggcggcagcgcaaaagatg

SEQ ID NO: 1952 - DNA, 103 bp, Artificial Sequence
  Synthetic Polynucleotide
taatacgactcactatagggtttttctcatttccaattaaaagctcctaaaacagaggagattaggaatgtttaattggaacctggcggcagcgcaaaagatg

SEQ ID NO: 1953 - DNA, 103 bp, Artificial Sequence
  Synthetic Polynucleotide
taatacgactcactatagggacattcttggcttctctaccggagggcttgaacagaggagacaagccatgcggtagagaaacctggcggcagcgcaaaagatg

SEQ ID NO: 1954 - DNA, 103 bp, Artificial Sequence
  Synthetic Polynucleotide
taatacgactcactatagggttagccagcatccaagggatgacatgtttgaacagaggagacaaacaatgcatcccttgaacctggcggcagcgcaaaagatg

SEQ ID NO: 1955 - DNA, 103 bp, Artificial Sequence
  Synthetic Polynucleotide
taatacgactcactatagggtcaggacattcttggcttctctaccggaggaacagaggagacctccgatggagaagccaaacctggcggcagcgcaaaagatg

SEQ ID NO: 1956 - DNA, 103 bp, Artificial Sequence
  Synthetic Polynucleotide
taatacgactcactatagggtaccttcaggacattcttggcttctctaccaacagaggagaggtagaatggccaagaataacctggcggcagcgcaaaagatg

SEQ ID NO: 1957 - DNA, 103 bp, Artificial Sequence
  Synthetic Polynucleotide
taatacgactcactatagggcggggtaccttcaggacattcttggcttctaacagaggagaagaagcatggaatgtcctaacctggcggcagcgcaaaagatg

SEQ ID NO: 1958 - DNA, 103 bp, Artificial Sequence
  Synthetic Polynucleotide
taatacgactcactataggggcgcgcggggtaccttcaggacattcttggaacagaggagaccaagaatgtcctgaaggaacctggcggcagcgcaaaagatg

SEQ ID NO: 1959 - DNA, 103 bp, Artificial Sequence
  Synthetic Polynucleotide
taatacgactcactatagggatcccgcgcgcggggtaccttcaggacattaacagaggagaaatgtcatgaaggtacccaacctggcggcagcgcaaaagatg

SEQ ID NO: 1960 - DNA, 103 bp, Artificial Sequence
  Synthetic Polynucleotide
taatacgactcactatagggatcagatcccgcgcgcggggtaccttcaggaacagaggagacctgaaatgaccccgcgcaacctggcggcagcgcaaaagatg

SEQ ID NO: 1961 - DNA, 103 bp, Artificial Sequence
  Synthetic Polynucleotide
taatacgactcactatagggtcctgatcagatcccgcgcgcggggtacctaacagaggagaaggtacatggcgcgcgggaacctggcggcagcgcaaaagatg

SEQ ID NO: 1962 - DNA, 103 bp, Artificial Sequence
  Synthetic Polynucleotide
taatacgactcactatagggtggtctcctgatcagatcccgcgcgcggggaacagaggagaccccgcatgcgggatctgaacctggcggcagcgcaaaagatg

SEQ ID NO: 1963 - DNA, 103 bp, Artificial Sequence
  Synthetic Polynucleotide
taatacgactcactatagggccaattggtctcctgatcagatcccgcgcgaacagaggagacgcgcgatgtctgatcagaacctggcggcagcgcaaaagatg

SEQ ID NO: 1964 - DNA, 103 bp, Artificial Sequence
  Synthetic Polynucleotide
taatacgactcactatagggcactgccaattggtctcctgatcagatcccaacagaggagagggatcatgtcaggagacaacctggcggcagcgcaaaagatg

SEQ ID NO: 1965 - DNA, 103 bp, Artificial Sequence
  Synthetic Polynucleotide
taatacgactcactatagggtctgattagccagcatccaagggatgacataacagaggagaatgtcaatgcttggatgcaacctggcggcagcgcaaaagatg

SEQ ID NO: 1966 - DNA, 103 bp, Artificial Sequence
  Synthetic Polynucleotide
taatacgactcactatagggtaaagcactgccaattggtctcctgatcagaacagaggagactgatcatgagaccaattaacctggcggcagcgcaaaagatg

SEQ ID NO: 1967 - DNA, 103 bp, Artificial Sequence
  Synthetic Polynucleotide
taatacgactcactatagggcagcgtaaagcactgccaattggtctcctgaacagaggagacaggagatgaattggcagaacctggcggcagcgcaaaagatg

SEQ ID NO: 1968 - DNA, 103 bp, Artificial Sequence
  Synthetic Polynucleotide
taatacgactcactatagggagtggcagcgtaaagcactgccaattggtcaacagaggagagaccaaatggcagtgcttaacctggcggcagcgcaaaagatg

SEQ ID NO: 1969 - DNA, 103 bp, Artificial Sequence
  Synthetic Polynucleotide
taatacgactcactatagggaccaaagtggcagcgtaaagcactgccaataacagaggagaattggcatggctttacgcaacctggcggcagcgcaaaagatg

SEQ ID NO: 1970 - DNA, 103 bp, Artificial Sequence
  Synthetic Polynucleotide
taatacgactcactatagggtttaaaccaaagtggcagcgtaaagcactgaacagaggagacagtgcatgacgctgccaaacctggcggcagcgcaaaagatg

SEQ ID NO: 1971 - DNA, 103 bp, Artificial Sequence
  Synthetic Polynucleotide
taatacgactcactatagggcagtttttaaaccaaagtggcagcgtaaagaacagaggagactttacatggccactttgaacctggcggcagcgcaaaagatg

SEQ ID NO: 1972 - DNA, 103 bp, Artificial Sequence
  Synthetic Polynucleotide
taatacgactcactatagggtgtgacagtttttaaaccaaagtggcagcgaacagaggagacgctgcatgtttggtttaaacctggcggcagcgcaaaagatg

SEQ ID NO: 1973 - DNA, 103 bp, Artificial Sequence
  Synthetic Polynucleotide
taatacgactcactataggggaagctgtgacagtttttaaaccaaagtggaacagaggagaccacttatgtttaaaaacaacctggcggcagcgcaaaagatg

SEQ ID NO: 1974 - DNA, 103 bp, Artificial Sequence
  Synthetic Polynucleotide
taatacgactcactatagggttggagaagctgtgacagtttttaaaccaaaacagaggagattggttatgaaactgtcaaacctggcggcagcgcaaaagatg

SEQ ID NO: 1975 - DNA, 103 bp, Artificial Sequence
  Synthetic Polynucleotide
taatacgactcactatagggttggtttggagaagctgtgacagtttttaaaacagaggagattaaaaatggtcacagctaacctggcggcagcgcaaaagatg

SEQ ID NO: 1976 - DNA, 103 bp, Artificial Sequence
  Synthetic Polynucleotide
taatacgactcactatagggtttcctctgattagccagcatccaagggataacagaggagaatccctatgatgctggctaacctggcggcagcgcaaaagatg

SEQ ID NO: 1977 - DNA, 103 bp, Artificial Sequence
  Synthetic Polynucleotide
taatacgactcactatagggaccacttggtttggagaagctgtgacagttaacagaggagaaactgtatgagcttctccaacctggcggcagcgcaaaagatg

SEQ ID NO: 1978 - DNA, 103 bp, Artificial Sequence
  Synthetic Polynucleotide
taatacgactcactatagggccaagaccacttggtttggagaagctgtgaaacagaggagatcacagatgctccaaaccaacctggcggcagcgcaaaagatg

SEQ ID NO: 1979 - DNA, 103 bp, Artificial Sequence
  Synthetic Polynucleotide
taatacgactcactataggggaaaaccaagaccacttggtttggagaagcaacagaggagagcttctatgaaccaagtgaacctggcggcagcgcaaaagatg

SEQ ID NO: 1980 - DNA, 103 bp, Artificial Sequence
  Synthetic Polynucleotide
taatacgactcactatagggaattggaaaaccaagaccacttggtttggaaacagaggagatccaaaatgagtggtcttaacctggcggcagcgcaaaagatg

SEQ ID NO: 1981 - DNA, 103 bp, Artificial Sequence
  Synthetic Polynucleotide
taatacgactcactatagggaacaaaattggaaaaccaagaccacttggtaacagaggagaaccaagatgtcttggtttaacctggcggcagcgcaaaagatg

SEQ ID NO: 1982 - DNA, 103 bp, Artificial Sequence
  Synthetic Polynucleotide
taatacgactcactatagggcagtcaacaaaattggaaaaccaagaccacaacagaggagagtggtcatggttttccaaaacctggcggcagcgcaaaagatg

SEQ ID NO: 1983 - DNA, 103 bp, Artificial Sequence
  Synthetic Polynucleotide
taatacgactcactatagggattgtcagtcaacaaaattggaaaaccaagaacagaggagacttggtatgccaattttgaacctggcggcagcgcaaaagatg

SEQ ID NO: 1984 - DNA, 103 bp, Artificial Sequence
  Synthetic Polynucleotide
taatacgactcactataggggccatattgtcagtcaacaaaattggaaaaaacagaggagattttccatgtttgttgacaacctggcggcagcgcaaaagatg

SEQ ID NO: 1985 - DNA, 103 bp, Artificial Sequence
  Synthetic Polynucleotide
taatacgactcactatagggtgcacgccatattgtcagtcaacaaaattgaacagaggagacaatttatgtgactgacaaacctggcggcagcgcaaaagatg

SEQ ID NO: 1986 - DNA, 103 bp, Artificial Sequence
  Synthetic Polynucleotide
taatacgactcactataggggtgtttgcacgccatattgtcagtcaacaaaacagaggagattgttgatggacaatatgaacctggcggcagcgcaaaagatg

SEQ ID NO: 1987 - DNA, 103 bp, Artificial Sequence
  Synthetic Polynucleotide
taatacgactcactatagggctgactttcctctgattagccagcatccaaaacagaggagattggatatgggctaatcaaacctggcggcagcgcaaaagatg

SEQ ID NO: 1988 - DNA, 103 bp, Artificial Sequence
  Synthetic Polynucleotide
taatacgactcactatagggtatccgtgtttgcacgccatattgtcagtcaacagaggagagactgaatgtatggcgtgaacctggcggcagcgcaaaagatg

SEQ ID NO: 1989 - DNA, 103 bp, Artificial Sequence
  Synthetic Polynucleotide
taatacgactcactataggggcggatatccgtgtttgcacgccatattgtaacagaggagaacaataatgcgtgcaaacaacctggcggcagcgcaaaagatg

SEQ ID NO: 1990 - DNA, 103 bp, Artificial Sequence
  Synthetic Polynucleotide
taatacgactcactatagggcataagcggatatccgtgtttgcacgccataacagaggagaatggcgatgaaacacggaaacctggcggcagcgcaaaagatg

SEQ ID NO: 1991 - DNA, 103 bp, Artificial Sequence
  Synthetic Polynucleotide
taatacgactcactataggggggcacataagcggatatccgtgtttgcacaacagaggagagtgcaaatgcggatatccaacctggcggcagcgcaaaagatg

SEQ ID NO: 1992 - DNA, 103 bp, Artificial Sequence
  Synthetic Polynucleotide
taatacgactcactatagggaaagagggcacataagcggatatccgtgttaacagaggagaaacacgatgatccgcttaaacctggcggcagcgcaaaagatg

SEQ ID NO: 1993 - DNA, 103 bp, Artificial Sequence
  Synthetic Polynucleotide
taatacgactcactatagggagtgcaaagagggcacataagcggatatccaacagaggagaggatatatgcttatgtgcaacctggcggcagcgcaaaagatg

SEQ ID NO: 1994 - DNA, 103 bp, Artificial Sequence
  Synthetic Polynucleotide
taatacgactcactatagggagagcagtgcaaagagggcacataagcggaaacagaggagatccgctatggtgccctctaacctggcggcagcgcaaaagatg

SEQ ID NO: 1995 - DNA, 103 bp, Artificial Sequence
  Synthetic Polynucleotide
taatacgactcactatagggtgtcgagagcagtgcaaagagggcacataaaacagaggagattatgtatgctctttgcaaacctggcggcagcgcaaaagatg

SEQ ID NO: 1996 - DNA, 103 bp, Artificial Sequence
  Synthetic Polynucleotide
taatacgactcactatagggagttttgtcgagagcagtgcaaagagggcaaacagaggagatgccctatgtgcactgctaacctggcggcagcgcaaaagatg

SEQ ID NO: 1997 - DNA, 103 bp, Artificial Sequence
  Synthetic Polynucleotide
taatacgactcactatagggtccgaagttttgtcgagagcagtgcaaagaaacagaggagatctttgatgtgctctcgaaacctggcggcagcgcaaaagatg

SEQ ID NO: 1998 - DNA, 103 bp, Artificial Sequence
  Synthetic Polynucleotide
taatacgactcactatagggagtgggaagagatgtgggttggcactgtcgaacagaggagacgacagatgcaacccacaaacctggcggcagcgcaaaagatg

SEQ ID NO: 1999 - DNA, 103 bp, Artificial Sequence
  Synthetic Polynucleotide
taatacgactcactatagggaaatgctgactttcctctgattagccagcaaacagaggagatgctggatgatcagaggaaacctggcggcagcgcaaaagatg

SEQ ID NO: 2000 - DNA, 103 bp, Artificial Sequence
  Synthetic Polynucleotide
taatacgactcactataggggtccgtccgaagttttgtcgagagcagtgcaacagaggagagcactgatgtcgacaaaaaacctggcggcagcgcaaaagatg

SEQ ID NO: 2001 - DNA, 103 bp, Artificial Sequence
  Synthetic Polynucleotide
taatacgactcactataggggaaaagtccgtccgaagttttgtcgagagcaacagaggagagctctcatgaaaacttcgaacctggcggcagcgcaaaagatg

SEQ ID NO: 2002 - DNA, 103 bp, Artificial Sequence
  Synthetic Polynucleotide
taatacgactcactatagggagggtgaaaagtccgtccgaagttttgtcgaacagaggagacgacaaatgttcggacggaacctggcggcagcgcaaaagatg

SEQ ID NO: 2003 - DNA, 103 bp, Artificial Sequence
  Synthetic Polynucleotide
taatacgactcactatagggacagaagggtgaaaagtccgtccgaagtttaacagaggagaaaacttatgacggactttaacctggcggcagcgcaaaagatg

SEQ ID NO: 2004 - DNA, 103 bp, Artificial Sequence
  Synthetic Polynucleotide
taatacgactcactataggggtcgaacagaagggtgaaaagtccgtccgaaacagaggagatcggacatgcttttcaccaacctggcggcagcgcaaaagatg

SEQ ID NO: 2005 - DNA, 103 bp, Artificial Sequence
  Synthetic Polynucleotide
taatacgactcactatagggtcattgtcgaacagaagggtgaaaagtccgaacagaggagacggactatgcacccttctaacctggcggcagcgcaaaagatg

SEQ ID NO: 2006 - DNA, 103 bp, Artificial Sequence
  Synthetic Polynucleotide
taatacgactcactatagggaccattcattgtcgaacagaagggtgaaaaaacagaggagattttcaatgttctgttcgaacctggcggcagcgcaaaagatg

SEQ ID NO: 2007 - DNA, 103 bp, Artificial Sequence
  Synthetic Polynucleotide
taatacgactcactatagggtgggtaccattcattgtcgaacagaagggtaacagaggagaacccttatgttcgacaataacctggcggcagcgcaaaagatg

SEQ ID NO: 2008 - DNA, 103 bp, Artificial Sequence
  Synthetic Polynucleotide
taatacgactcactatagggtcagttgggtaccattcattgtcgaacagaaacagaggagatctgttatgcaatgaatgaacctggcggcagcgcaaaagatg

SEQ ID NO: 2009 - DNA, 103 bp, Artificial Sequence
  Synthetic Polynucleotide
taatacgactcactatagggataggtcagttgggtaccattcattgtcgaaacagaggagatcgacaatgaatggtaccaacctggcggcagcgcaaaagatg

SEQ ID NO: 2010 - DNA, 103 bp, Artificial Sequence
  Synthetic Polynucleotide
taatacgactcactatagggccggaaaatgctgactttcctctgattagcaacagaggagagctaatatgaggaaagtcaacctggcggcagcgcaaaagatg

SEQ ID NO: 2011 - DNA, 103 bp, Artificial Sequence
  Synthetic Polynucleotide
taatacgactcactatagggagtcaataggtcagttgggtaccattcattaacagaggagaaatgaaatgtacccaactaacctggcggcagcgcaaaagatg

SEQ ID NO: 2012 - DNA, 103 bp, Artificial Sequence
  Synthetic Polynucleotide
taatacgactcactatagggtctacagtcaataggtcagttgggtaccataacagaggagaatggtaatgaactgacctaacctggcggcagcgcaaaagatg

SEQ ID NO: 2013 - DNA, 103 bp, Artificial Sequence
  Synthetic Polynucleotide
taatacgactcactatagggccaggtctacagtcaataggtcagttgggtaacagaggagaacccaaatgacctattgaaacctggcggcagcgcaaaagatg

SEQ ID NO: 2014 - DNA, 103 bp, Artificial Sequence
  Synthetic Polynucleotide
taatacgactcactatagggatcctccaggtctacagtcaataggtcagtaacagaggagaactgacatgttgactgtaaacctggcggcagcgcaaaagatg

SEQ ID NO: 2015 - DNA, 103 bp, Artificial Sequence
  Synthetic Polynucleotide
taatacgactcactatagggacttcatcctccaggtctacagtcaataggaacagaggagacctattatgtgtagacctaacctggcggcagcgcaaaagatg

SEQ ID NO: 2016 - DNA, 103 bp, Artificial Sequence
  Synthetic Polynucleotide
taatacgactcactatagggaaaacacttcatcctccaggtctacagtcaaacagaggagatgactgatgacctggaggaacctggcggcagcgcaaaagatg

SEQ ID NO: 2017 - DNA, 103 bp, Artificial Sequence
  Synthetic Polynucleotide
taatacgactcactatagggaggataaaacacttcatcctccaggtctacaacagaggagagtagacatggaggatgaaaacctggcggcagcgcaaaagatg

SEQ ID NO: 2018 - DNA, 103 bp, Artificial Sequence
  Synthetic Polynucleotide
taatacgactcactatagggtcatcaggataaaacacttcatcctccaggaacagaggagacctggaatgtgaagtgttaacctggcggcagcgcaaaagatg

SEQ ID NO: 2019 - DNA, 103 bp, Artificial Sequence
  Synthetic Polynucleotide
taatacgactcactataggggggggtcatcaggataaaacacttcatcctaacagaggagaaggatgatgtgttttatcaacctggcggcagcgcaaaagatg

SEQ ID NO: 2020 - DNA, 103 bp, Artificial Sequence
  Synthetic Polynucleotide
taatacgactcactatagggcatatgggggtcatcaggataaaacacttcaacagaggagagaagtgatgtatcctgataacctggcggcagcgcaaaagatg

SEQ ID NO: 2021 - DNA, 103 bp, Artificial Sequence
  Synthetic Polynucleotide
taatacgactcactatagggctgggccggaaaatgctgactttcctctgaaacagaggagatcagagatgagtcagcataacctggcggcagcgcaaaagatg

SEQ ID NO: 2022 - DNA, 103 bp, Artificial Sequence
  Synthetic Polynucleotide
taatacgactcactatagggcattccatatgggggtcatcaggataaaacaacagaggagagttttaatgtgatgacccaacctggcggcagcgcaaaagatg

SEQ ID NO: 2023 - DNA, 103 bp, Artificial Sequence
  Synthetic Polynucleotide
taatacgactcactatagggctgtccattccatatgggggtcatcaggataacagaggagaatcctgatgacccccataaacctggcggcagcgcaaaagatg

SEQ ID NO: 2024 - DNA, 103 bp, Artificial Sequence
  Synthetic Polynucleotide
taatacgactcactatagggtaaatctgtccattccatatgggggtcatcaacagaggagagatgacatgcatatggaaaacctggcggcagcgcaaaagatg

SEQ ID NO: 2025 - DNA, 103 bp, Artificial Sequence
  Synthetic Polynucleotide
taatacgactcactatagggagtggtaaatctgtccattccatatgggggaacagaggagacccccaatgggaatggacaacctggcggcagcgcaaaagatg

SEQ ID NO: 2026 - DNA, 103 bp, Artificial Sequence
  Synthetic Polynucleotide
taatacgactcactataggggaatcagtggtaaatctgtccattccatataacagaggagaatatggatgggacagattaacctggcggcagcgcaaaagatg

SEQ ID NO: 2027 - DNA, 103 bp, Artificial Sequence
  Synthetic Polynucleotide
taatacgactcactataggggtcttgaatcagtggtaaatctgtccattcaacagaggagagaatggatggatttaccaaacctggcggcagcgcaaaagatg

SEQ ID NO: 2028 - DNA, 103 bp, Artificial Sequence
  Synthetic Polynucleotide
taatacgactcactatagggtcaatgtcttgaatcagtggtaaatctgtcaacagaggagagacagaatgaccactgataacctggcggcagcgcaaaagatg

SEQ ID NO: 2029 - DNA, 103 bp, Artificial Sequence
  Synthetic Polynucleotide
taatacgactcactatagggccatttcaatgtcttgaatcagtggtaaataacagaggagaatttacatgtgattcaagaacctggcggcagcgcaaaagatg

SEQ ID NO: 2030 - DNA, 103 bp, Artificial Sequence
  Synthetic Polynucleotide
taatacgactcactatagggtggttccatttcaatgtcttgaatcagtggaacagaggagaccactgatgcaagacattaacctggcggcagcgcaaaagatg

SEQ ID NO: 2031 - DNA, 103 bp, Artificial Sequence
  Synthetic Polynucleotide
taatacgactcactatagggccttgtggttccatttcaatgtcttgaatcaacagaggagagattcaatgcattgaaataacctggcggcagcgcaaaagatg

SEQ ID NO: 2032 - DNA, 103 bp, Artificial Sequence
  Synthetic Polynucleotide
taatacgactcactatagggttagcctgggccggaaaatgctgactttccaacagaggagaggaaagatggcattttccaacctggcggcagcgcaaaagatg

SEQ ID NO: 2033 - DNA, 103 bp, Artificial Sequence
  Synthetic Polynucleotide
taatacgactcactatagggaattaccttgtggttccatttcaatgtcttaacagaggagaaagacaatgaaatggaacaacctggcggcagcgcaaaagatg

SEQ ID NO: 2034 - DNA, 103 bp, Artificial Sequence
  Synthetic Polynucleotide
taatacgactcactatagggatttgaattaccttgtggttccatttcaataacagaggagaattgaaatggaaccacaaaacctggcggcagcgcaaaagatg

SEQ ID NO: 2035 - DNA, 103 bp, Artificial Sequence
  Synthetic Polynucleotide
taatacgactcactataggggatgaatttgaattaccttgtggttccattaacagaggagaaatggaatgacaaggtaaaacctggcggcagcgcaaaagatg

SEQ ID NO: 2036 - DNA, 103 bp, Artificial Sequence
  Synthetic Polynucleotide
taatacgactcactatagggtgtcagatgaatttgaattaccttgtggttaacagaggagaaaccacatggtaattcaaaacctggcggcagcgcaaaagatg

SEQ ID NO: 2037 - DNA, 103 bp, Artificial Sequence
  Synthetic Polynucleotide
taatacgactcactataggggtttttgtcagatgaatttgaattaccttgaacagaggagacaaggtatgtcaaattcaaacctggcggcagcgcaaaagatg

SEQ ID NO: 2038 - DNA, 103 bp, Artificial Sequence
  Synthetic Polynucleotide
taatacgactcactataggggaattgtttttgtcagatgaatttgaattaaacagaggagataattcatgttcatctgaaacctggcggcagcgcaaaagatg

SEQ ID NO: 2039 - DNA, 103 bp, Artificial Sequence
  Synthetic Polynucleotide
taatacgactcactatagggactgtgaattgtttttgtcagatgaatttgaacagaggagacaaattatgctgacaaaaaacctggcggcagcgcaaaagatg

SEQ ID NO: 2040 - DNA, 103 bp, Artificial Sequence
  Synthetic Polynucleotide
taatacgactcactatagggtgaagactgtgaattgtttttgtcagatgaaacagaggagatcatctatgaaaaacaataacctggcggcagcgcaaaagatg

SEQ ID NO: 2041 - DNA, 103 bp, Artificial Sequence
  Synthetic Polynucleotide
taatacgactcactatagggttacctgaagactgtgaattgtttttgtcaaacagaggagatgacaaatgcaattcacaaacctggcggcagcgcaaaagatg

SEQ ID NO: 2042 - DNA, 103 bp, Artificial Sequence
  Synthetic Polynucleotide
taatacgactcactatagggcttcgttacctgaagactgtgaattgttttaacagaggagaaaaacaatgcacagtcttaacctggcggcagcgcaaaagatg

SEQ ID NO: 2043 - DNA, 103 bp, Artificial Sequence
  Synthetic Polynucleotide
taatacgactcactatagggttctcttagcctgggccggaaaatgctgacaacagaggagagtcagcatgttccggcccaacctggcggcagcgcaaaagatg

SEQ ID NO: 2044 - DNA, 103 bp, Artificial Sequence
  Synthetic Polynucleotide
taatacgactcactatagggtacgccttcgttacctgaagactgtgaattaacagaggagaaattcaatgtcttcaggtaacctggcggcagcgcaaaagatg

SEQ ID NO: 2045 - DNA, 103 bp, Artificial Sequence
  Synthetic Polynucleotide
taatacgactcactatagggatgattacgccttcgttacctgaagactgtaacagaggagaacagtcatgaggtaacgaaacctggcggcagcgcaaaagatg

SEQ ID NO: 2046 - DNA, 103 bp, Artificial Sequence
  Synthetic Polynucleotide
taatacgactcactatagggtgttgatgattacgccttcgttacctgaagaacagaggagacttcagatgacgaaggcgaacctggcggcagcgcaaaagatg

SEQ ID NO: 2047 - DNA, 103 bp, Artificial Sequence
  Synthetic Polynucleotide
taatacgactcactataggggtagttgttgatgattacgccttcgttaccaacagaggagaggtaacatgggcgtaatcaacctggcggcagcgcaaaagatg

SEQ ID NO: 2048 - DNA, 103 bp, Artificial Sequence
  Synthetic Polynucleotide
taatacgactcactataggggaatagtagttgttgatgattacgccttcgaacagaggagacgaaggatgaatcatcaaaacctggcggcagcgcaaaagatg

SEQ ID NO: 2049 - DNA, 103 bp, Artificial Sequence
  Synthetic Polynucleotide
taatacgactcactataggggatttgaatagtagttgttgatgattacgcaacagaggagagcgtaaatgtcaacaactaacctggcggcagcgcaaaagatg

SEQ ID NO: 2050 - DNA, 103 bp, Artificial Sequence
  Synthetic Polynucleotide
taatacgactcactataggggtattgatttgaatagtagttgttgatgataacagaggagaatcatcatgaactactataacctggcggcagcgcaaaagatg

SEQ ID NO: 2051 - DNA, 103 bp, Artificial Sequence
  Synthetic Polynucleotide
taatacgactcactatagggttttggtattgatttgaatagtagttgttgaacagaggagacaacaaatgctattcaaaaacctggcggcagcgcaaaagatg

SEQ ID NO: 2052 - DNA, 103 bp, Artificial Sequence
  Synthetic Polynucleotide
taatacgactcactatagggttgagttttggtattgatttgaatagtagtaacagaggagaactactatgcaaatcaataacctggcggcagcgcaaaagatg

SEQ ID NO: 2053 - DNA, 103 bp, Artificial Sequence
  Synthetic Polynucleotide
taatacgactcactatagggatcaattgagttttggtattgatttgaataaacagaggagatattcaatgcaataccaaaacctggcggcagcgcaaaagatg

SEQ ID NO: 2054 - DNA, 103 bp, Artificial Sequence
  Synthetic Polynucleotide
taatacgactcactatagggtatgtttctcttagcctgggccggaaaatgaacagaggagacattttatggcccaggctaacctggcggcagcgcaaaagatg

SEQ ID NO: 2055 - DNA, 103 bp, Artificial Sequence
  Synthetic Polynucleotide
taatacgactcactataggggaaagatcaattgagttttggtattgatttaacagaggagaaaatcaatgccaaaactcaacctggcggcagcgcaaaagatg

SEQ ID NO: 2056 - DNA, 103 bp, Artificial Sequence
  Synthetic Polynucleotide
taatacgactcactatagggtggctgaaagatcaattgagttttggtattaacagaggagaaataccatgactcaattgaacctggcggcagcgcaaaagatg

SEQ ID NO: 2057 - DNA, 103 bp, Artificial Sequence
  Synthetic Polynucleotide
taatacgactcactatagggggcattggctgaaagatcaattgagttttgaacagaggagacaaaacatgattgatcttaacctggcggcagcgcaaaagatg

SEQ ID NO: 2058 - DNA, 103 bp, Artificial Sequence
  Synthetic Polynucleotide
taatacgactcactatagggccgttggcattggctgaaagatcaattgagaacagaggagactcaatatgtctttcagcaacctggcggcagcgcaaaagatg

SEQ ID NO: 2059 - DNA, 103 bp, Artificial Sequence
  Synthetic Polynucleotide
taatacgactcactatagggcaacaccgttggcattggctgaaagatcaaaacagaggagattgatcatgcagccaatgaacctggcggcagcgcaaaagatg

SEQ ID NO: 2060 - DNA, 103 bp, Artificial Sequence
  Synthetic Polynucleotide
taatacgactcactatagggttttccaacaccgttggcattggctgaaagaacagaggagactttcaatgaatgccaacaacctggcggcagcgcaaaagatg

SEQ ID NO: 2061 - DNA, 103 bp, Artificial Sequence
  Synthetic Polynucleotide
taatacgactcactatagggttttcttttccaacaccgttggcattggctaacagaggagaagccaaatgcaacggtgtaacctggcggcagcgcaaaagatg

SEQ ID NO: 2062 - DNA, 103 bp, Artificial Sequence
  Synthetic Polynucleotide
taatacgactcactatagggttgaattttcttttccaacaccgttggcataacagaggagaatgccaatggtgttggaaaacctggcggcagcgcaaaagatg

SEQ ID NO: 2063 - DNA, 103 bp, Artificial Sequence
  Synthetic Polynucleotide
taatacgactcactatagggcggttttgaattttcttttccaacaccgttaacagaggagaaacggtatgggaaaagaaaacctggcggcagcgcaaaagatg

SEQ ID NO: 2064 - DNA, 103 bp, Artificial Sequence
  Synthetic Polynucleotide
taatacgactcactatagggccttgcggttttgaattttcttttccaacaaacagaggagatgttggatgagaaaattcaacctggcggcagcgcaaaagatg

SEQ ID NO: 2065 - DNA, 103 bp, Artificial Sequence
  Synthetic Polynucleotide
taatacgactcactatagggacttatatgtttctcttagcctgggccggaaacagaggagatccggcatgggctaagagaacctggcggcagcgcaaaagatg

SEQ ID NO: 2066 - DNA, 103 bp, Artificial Sequence
  Synthetic Polynucleotide
taatacgactcactatagggactgaccttgcggttttgaattttcttttcaacagaggagagaaaagatgattcaaaacaacctggcggcagcgcaaaagatg

SEQ ID NO: 2067 - DNA, 103 bp, Artificial Sequence
  Synthetic Polynucleotide
taatacgactcactatagggcatcaactgaccttgcggttttgaattttcaacagaggagagaaaatatgaaaccgcaaaacctggcggcagcgcaaaagatg

SEQ ID NO: 2068 - DNA, 103 bp, Artificial Sequence
  Synthetic Polynucleotide
taatacgactcactatagggatattcatcaactgaccttgcggttttgaaaacagaggagattcaaaatggcaaggtcaaacctggcggcagcgcaaaagatg

SEQ ID NO: 2069 - DNA, 103 bp, Artificial Sequence
  Synthetic Polynucleotide
taatacgactcactatagggcaagaatattcatcaactgaccttgcggttaacagaggagaaaccgcatggtcagttgaaacctggcggcagcgcaaaagatg

SEQ ID NO: 2070 - DNA, 103 bp, Artificial Sequence
  Synthetic Polynucleotide
taatacgactcactataggggctaccaagaatattcatcaactgaccttgaacagaggagacaaggtatgttgatgaataacctggcggcagcgcaaaagatg

SEQ ID NO: 2071 - DNA, 103 bp, Artificial Sequence
  Synthetic Polynucleotide
taatacgactcactataggggccgcgctaccaagaatattcatcaactgaaacagaggagatcagttatggaatattctaacctggcggcagcgcaaaagatg

SEQ ID NO: 2072 - DNA, 103 bp, Artificial Sequence
  Synthetic Polynucleotide
taatacgactcactatagggcatccgccgcgctaccaagaatattcatcaaacagaggagatgatgaatgttcttggtaaacctggcggcagcgcaaaagatg

SEQ ID NO: 2073 - DNA, 103 bp, Artificial Sequence
  Synthetic Polynucleotide
taatacgactcactataggggaatgcatccgccgcgctaccaagaatattaacagaggagaaatattatgggtagcgcgaacctggcggcagcgcaaaagatg

SEQ ID NO: 2074 - DNA, 103 bp, Artificial Sequence
  Synthetic Polynucleotide
taatacgactcactatagggttcttgaatgcatccgccgcgctaccaagaaacagaggagatcttggatgcgcggcggaaacctggcggcagcgcaaaagatg

SEQ ID NO: 2075 - DNA, 103 bp, Artificial Sequence
  Synthetic Polynucleotide
taatacgactcactatagggcgatgttcttgaatgcatccgccgcgctacaacagaggagagtagcgatgcggatgcataacctggcggcagcgcaaaagatg

SEQ ID NO: 2076 - DNA, 103 bp, Artificial Sequence
  Synthetic Polynucleotide
taatacgactcactatagggttctaacttatatgtttctcttagcctgggaacagaggagacccaggatgagagaaacaaacctggcggcagcgcaaaagatg

SEQ ID NO: 2077 - DNA, 103 bp, Artificial Sequence
  Synthetic Polynucleotide
taatacgactcactatagggaggcgcgatgttcttgaatgcatccgccgcaacagaggagagcggcgatggcattcaagaacctggcggcagcgcaaaagatg

SEQ ID NO: 2078 - DNA, 103 bp, Artificial Sequence
  Synthetic Polynucleotide
taatacgactcactatagggagaagaggcgcgatgttcttgaatgcatccaacagaggagaggatgcatgcaagaacataacctggcggcagcgcaaaagatg

SEQ ID NO: 2079 - DNA, 103 bp, Artificial Sequence
  Synthetic Polynucleotide
taatacgactcactatagggccatgagaagaggcgcgatgttcttgaatgaacagaggagacattcaatgacatcgcgcaacctggcggcagcgcaaaagatg

SEQ ID NO: 2080 - DNA, 103 bp, Artificial Sequence
  Synthetic Polynucleotide
taatacgactcactatagggctggtccatgagaagaggcgcgatgttcttaacagaggagaaagaacatggcgcctcttaacctggcggcagcgcaaaagatg

SEQ ID NO: 2081 - DNA, 103 bp, Artificial Sequence
  Synthetic Polynucleotide
taatacgactcactataggggtgtcctggtccatgagaagaggcgcgatgaacagaggagacatcgcatgtcttctcataacctggcggcagcgcaaaagatg

SEQ ID NO: 2082 - DNA, 103 bp, Artificial Sequence
  Synthetic Polynucleotide
taatacgactcactatagggcttcagtgtcctggtccatgagaagaggcgaacagaggagacgcctcatgtcatggaccaacctggcggcagcgcaaaagatg

SEQ ID NO: 2083 - DNA, 103 bp, Artificial Sequence
  Synthetic Polynucleotide
taatacgactcactatagggcatttcttcagtgtcctggtccatgagaagaacagaggagacttctcatggaccaggacaacctggcggcagcgcaaaagatg

SEQ ID NO: 2084 - DNA, 103 bp, Artificial Sequence
  Synthetic Polynucleotide
taatacgactcactatagggttggtcatttcttcagtgtcctggtccatgaacagaggagacatggaatgggacactgaaacctggcggcagcgcaaaagatg

SEQ ID NO: 2085 - DNA, 103 bp, Artificial Sequence
  Synthetic Polynucleotide
taatacgactcactatagggaaaggttggtcatttcttcagtgtcctggtaacagaggagaaccaggatgctgaagaaaaacctggcggcagcgcaaaagatg

SEQ ID NO: 2086 - DNA, 103 bp, Artificial Sequence
  Synthetic Polynucleotide
taatacgactcactatagggatcagaaaggttggtcatttcttcagtgtcaacagaggagagacactatggaaatgaccaacctggcggcagcgcaaaagatg

SEQ ID NO: 2087 - DNA, 103 bp, Artificial Sequence
  Synthetic Polynucleotide
taatacgactcactatagggatcatttctaacttatatgtttctcttagcaacagaggagagctaagatgaacatataaaacctggcggcagcgcaaaagatg

SEQ ID NO: 2088 - DNA, 103 bp, Artificial Sequence
  Synthetic Polynucleotide
taatacgactcactatagggactctatcagaaaggttggtcatttcttcaaacagaggagatgaagaatggaccaacctaacctggcggcagcgcaaaagatg

SEQ ID NO: 2089 - DNA, 103 bp, Artificial Sequence
  Synthetic Polynucleotide
taatacgactcactatagggaagacactctatcagaaaggttggtcatttaacagaggagaaaatgaatgacctttctgaacctggcggcagcgcaaaagatg

SEQ ID NO: 2090 - DNA, 103 bp, Artificial Sequence
  Synthetic Polynucleotide
taatacgactcactataggggtccgaagacactctatcagaaaggttggtaacagaggagaaccaacatgtctgatagaaacctggcggcagcgcaaaagatg

SEQ ID NO: 2091 - DNA, 103 bp, Artificial Sequence
  Synthetic Polynucleotide
taatacgactcactataggggcggtgtccgaagacactctatcagaaaggaacagaggagacctttcatgtagagtgtcaacctggcggcagcgcaaaagatg

SEQ ID NO: 2092 - DNA, 103 bp, Artificial Sequence
  Synthetic Polynucleotide
taatacgactcactatagggtgcctgcggtgtccgaagacactctatcagaacagaggagactgataatgtgtcttcggaacctggcggcagcgcaaaagatg

SEQ ID NO: 2093 - DNA, 103 bp, Artificial Sequence
  Synthetic Polynucleotide
taatacgactcactatagggcgtgttgcctgcggtgtccgaagacactctaacagaggagaagagtgatgtcggacaccaacctggcggcagcgcaaaagatg

SEQ ID NO: 2094 - DNA, 103 bp, Artificial Sequence
  Synthetic Polynucleotide
taatacgactcactataggggtggccgtgttgcctgcggtgtccgaagacaacagaggagagtcttcatgcaccgcaggaacctggcggcagcgcaaaagatg

SEQ ID NO: 2095 - DNA, 103 bp, Artificial Sequence
  Synthetic Polynucleotide
taatacgactcactatagggtgtttgtggccgtgttgcctgcggtgtccgaacagaggagacggacaatgcaggcaacaaacctggcggcagcgcaaaagatg

SEQ ID NO: 2096 - DNA, 103 bp, Artificial Sequence
  Synthetic Polynucleotide
taatacgactcactatagggttgagtgtttgtggccgtgttgcctgcggtaacagaggagaaccgcaatgaacacggccaacctggcggcagcgcaaaagatg

SEQ ID NO: 2097 - DNA, 103 bp, Artificial Sequence
  Synthetic Polynucleotide
taatacgactcactataggggtagattgagtgtttgtggccgtgttgcctaacagaggagaaggcaaatgggccacaaaaacctggcggcagcgcaaaagatg

SEQ ID NO: 2098 - DNA, 103 bp, Artificial Sequence
  Synthetic Polynucleotide
taatacgactcactatagggttagaatcatttctaacttatatgtttctcaacagaggagagagaaaatgataagttagaacctggcggcagcgcaaaagatg

SEQ ID NO: 2099 - DNA, 103 bp, Artificial Sequence
  Synthetic Polynucleotide
taatacgactcactatagggctactgtagattgagtgtttgtggccgtgtaacagaggagaacacggatgcaaacactcaacctggcggcagcgcaaaagatg

SEQ ID NO: 2100 - DNA, 103 bp, Artificial Sequence
  Synthetic Polynucleotide
taatacgactcactatagggacggcctactgtagattgagtgtttgtggcaacagaggagagccacaatgactcaatctaacctggcggcagcgcaaaagatg

SEQ ID NO: 2101 - DNA, 103 bp, Artificial Sequence
  Synthetic Polynucleotide
taatacgactcactatagggaacaaacggcctactgtagattgagtgtttaacagaggagaaaacacatgatctacagtaacctggcggcagcgcaaaagatg

SEQ ID NO: 2102 - DNA, 103 bp, Artificial Sequence
  Synthetic Polynucleotide
taatacgactcactatagggatgcaaacaaacggcctactgtagattgagaacagaggagactcaatatgcagtaggccaacctggcggcagcgcaaaagatg

SEQ ID NO: 2103 - DNA, 103 bp, Artificial Sequence
  Synthetic Polynucleotide
taatacgactcactatagggaccaaatgcaaacaaacggcctactgtagaaacagaggagatctacaatgggccgtttgaacctggcggcagcgcaaaagatg

SEQ ID NO: 2104 - DNA, 103 bp, Artificial Sequence
  Synthetic Polynucleotide
taatacgactcactatagggcttgtaccaaatgcaaacaaacggcctactaacagaggagaagtaggatgtttgtttgcaacctggcggcagcgcaaaagatg

SEQ ID NO: 2105 - DNA, 103 bp, Artificial Sequence
  Synthetic Polynucleotide
taatacgactcactatagggtgtgtcttgtaccaaatgcaaacaaacggcaacagaggagagccgttatgttgcatttgaacctggcggcagcgcaaaagatg

SEQ ID NO: 2106 - DNA, 103 bp, Artificial Sequence
  Synthetic Polynucleotide
taatacgactcactatagggacccttgtgtcttgtaccaaatgcaaacaaaacagaggagattgtttatgtttggtacaaacctggcggcagcgcaaaagatg

SEQ ID NO: 2107 - DNA, 103 bp, Artificial Sequence
  Synthetic Polynucleotide
taatacgactcactatagggtgtttacccttgtgtcttgtaccaaatgcaaacagaggagatgcattatgtacaagacaaacctggcggcagcgcaaaagatg

SEQ ID NO: 2108 - DNA, 103 bp, Artificial Sequence
  Synthetic Polynucleotide
taatacgactcactatagggctggatgtttacccttgtgtcttgtaccaaaacagaggagattggtaatggacacaaggaacctggcggcagcgcaaaagatg

SEQ ID NO: 2109 - DNA, 103 bp, Artificial Sequence
  Synthetic Polynucleotide
taatacgactcactatagggataatagtgggaagagatgtgggttggcacaacagaggagagtgccaatgcacatctctaacctggcggcagcgcaaaagatg

SEQ ID NO: 2110 - DNA, 103 bp, Artificial Sequence
  Synthetic Polynucleotide
taatacgactcactatagggagggattagaatcatttctaacttatatgtaacagaggagaacatatatgttagaaatgaacctggcggcagcgcaaaagatg

SEQ ID NO: 2111 - DNA, 103 bp, Artificial Sequence
  Synthetic Polynucleotide
taatacgactcactatagggggaagctggatgtttacccttgtgtcttgtaacagaggagaacaagaatgaagggtaaaaacctggcggcagcgcaaaagatg

SEQ ID NO: 2112 - DNA, 103 bp, Artificial Sequence
  Synthetic Polynucleotide
taatacgactcactataggggcacaggaagctggatgtttacccttgtgtaacagaggagaacacaaatgtaaacatccaacctggcggcagcgcaaaagatg

SEQ ID NO: 2113 - DNA, 103 bp, Artificial Sequence
  Synthetic Polynucleotide
taatacgactcactatagggtgtcagcacaggaagctggatgtttaccctaacagaggagaagggtaatgatccagcttaacctggcggcagcgcaaaagatg

SEQ ID NO: 2114 - DNA, 103 bp, Artificial Sequence
  Synthetic Polynucleotide
taatacgactcactatagggggctgtgtcagcacaggaagctggatgtttaacagaggagaaaacatatggcttcctgtaacctggcggcagcgcaaaagatg

SEQ ID NO: 2115 - DNA, 103 bp, Artificial Sequence
  Synthetic Polynucleotide
taatacgactcactatagggtcagtggctgtgtcagcacaggaagctggaaacagaggagatccagcatgctgtgctgaaacctggcggcagcgcaaaagatg

SEQ ID NO: 2116 - DNA, 103 bp, Artificial Sequence
  Synthetic Polynucleotide
taatacgactcactatagggctttgtcagtggctgtgtcagcacaggaagaacagaggagacttcctatgctgacacagaacctggcggcagcgcaaaagatg

SEQ ID NO: 2117 - DNA, 103 bp, Artificial Sequence
  Synthetic Polynucleotide
taatacgactcactataggggagtactttgtcagtggctgtgtcagcacaaacagaggagatgtgctatgacagccactaacctggcggcagcgcaaaagatg

SEQ ID NO: 2118 - DNA, 103 bp, Artificial Sequence
  Synthetic Polynucleotide
taatacgactcactataggggcagcgagtactttgtcagtggctgtgtcaaacagaggagatgacacatgcactgacaaaacctggcggcagcgcaaaagatg

SEQ ID NO: 2119 - DNA, 103 bp, Artificial Sequence
  Synthetic Polynucleotide
taatacgactcactatagggtctcggcagcgagtactttgtcagtggctgaacagaggagacagccaatgacaaagtacaacctggcggcagcgcaaaagatg

SEQ ID NO: 2120 - DNA, 103 bp, Artificial Sequence
  Synthetic Polynucleotide
taatacgactcactataggggtacctctcggcagcgagtactttgtcagtaacagaggagaactgacatggtactcgctaacctggcggcagcgcaaaagatg

SEQ ID NO: 2121 - DNA, 103 bp, Artificial Sequence
  Synthetic Polynucleotide
taatacgactcactatagggcgtcaagggattagaatcatttctaacttaaacagaggagataagttatgaatgattctaacctggcggcagcgcaaaagatg

SEQ ID NO: 2122 - DNA, 103 bp, Artificial Sequence
  Synthetic Polynucleotide
taatacgactcactataggggtgtagtacctctcggcagcgagtactttgaacagaggagacaaagtatgcgctgccgaaacctggcggcagcgcaaaagatg

SEQ ID NO: 2123 - DNA, 103 bp, Artificial Sequence
  Synthetic Polynucleotide
taatacgactcactatagggtaaaggtgtagtacctctcggcagcgagtaaacagaggagatactcgatgccgagaggtaacctggcggcagcgcaaaagatg

SEQ ID NO: 2124 - DNA, 103 bp, Artificial Sequence
  Synthetic Polynucleotide
taatacgactcactatagggtattttaaaggtgtagtacctctcggcagcaacagaggagagctgccatgaggtactacaacctggcggcagcgcaaaagatg

SEQ ID NO: 2125 - DNA, 103 bp, Artificial Sequence
  Synthetic Polynucleotide
taatacgactcactataggggtggctattttaaaggtgtagtacctctcgaacagaggagacgagagatgctacaccttaacctggcggcagcgcaaaagatg

SEQ ID NO: 2126 - DNA, 103 bp, Artificial Sequence
  Synthetic Polynucleotide
taatacgactcactatagggaccaagtggctattttaaaggtgtagtaccaacagaggagaggtactatgcctttaaaaaacctggcggcagcgcaaaagatg

SEQ ID NO: 2127 - DNA, 103 bp, Artificial Sequence
  Synthetic Polynucleotide
taatacgactcactatagggggtggaccaagtggctattttaaaggtgtaaacagaggagatacaccatgaaaatagccaacctggcggcagcgcaaaagatg

SEQ ID NO: 2128 - DNA, 103 bp, Artificial Sequence
  Synthetic Polynucleotide
taatacgactcactatagggttttgggtggaccaagtggctattttaaagaacagaggagactttaaatgagccacttgaacctggcggcagcgcaaaagatg

SEQ ID NO: 2129 - DNA, 103 bp, Artificial Sequence
  Synthetic Polynucleotide
taatacgactcactatagggatgctttttgggtggaccaagtggctatttaacagaggagaaaatagatgcttggtccaaacctggcggcagcgcaaaagatg

SEQ ID NO: 2130 - DNA, 103 bp, Artificial Sequence
  Synthetic Polynucleotide
taatacgactcactatagggatcaaatgctttttgggtggaccaagtggcaacagaggagagccactatgtccacccaaaacctggcggcagcgcaaaagatg

SEQ ID NO: 2131 - DNA, 103 bp, Artificial Sequence
  Synthetic Polynucleotide
taatacgactcactatagggacatgatcaaatgctttttgggtggaccaaaacagaggagattggtcatgccaaaaagcaacctggcggcagcgcaaaagatg

SEQ ID NO: 2132 - DNA, 103 bp, Artificial Sequence
  Synthetic Polynucleotide
taatacgactcactataggggaattcgtcaagggattagaatcatttctaaacagaggagatagaaaatgttctaatccaacctggcggcagcgcaaaagatg

SEQ ID NO: 2133 - DNA, 103 bp, Artificial Sequence
  Synthetic Polynucleotide
taatacgactcactatagggtccttacatgatcaaatgctttttgggtggaacagaggagaccacccatgaagcatttgaacctggcggcagcgcaaaagatg

SEQ ID NO: 2134 - DNA, 103 bp, Artificial Sequence
  Synthetic Polynucleotide
taatacgactcactatagggaggaatccttacatgatcaaatgctttttgaacagaggagacaaaaaatgtttgatcataacctggcggcagcgcaaaagatg

SEQ ID NO: 2135 - DNA, 103 bp, Artificial Sequence
  Synthetic Polynucleotide
taatacgactcactatagggggaaaaggaatccttacatgatcaaatgctaacagaggagaagcattatgtcatgtaagaacctggcggcagcgcaaaagatg

SEQ ID NO: 2136 - DNA, 103 bp, Artificial Sequence
  Synthetic Polynucleotide
taatacgactcactatagggcgtggggaaaaggaatccttacatgatcaaaacagaggagattgatcatgtaaggattcaacctggcggcagcgcaaaagatg

SEQ ID NO: 2137 - DNA, 103 bp, Artificial Sequence
  Synthetic Polynucleotide
taatacgactcactatagggtaggacgtggggaaaaggaatccttacatgaacagaggagacatgtaatgattccttttaacctggcggcagcgcaaaagatg

SEQ ID NO: 2138 - DNA, 103 bp, Artificial Sequence
  Synthetic Polynucleotide
taatacgactcactatagggcctgataggacgtggggaaaaggaatccttaacagaggagaaaggatatgttttccccaaacctggcggcagcgcaaaagatg

SEQ ID NO: 2139 - DNA, 103 bp, Artificial Sequence
  Synthetic Polynucleotide
taatacgactcactatagggtgcttcctgataggacgtggggaaaaggaaaacagaggagattccttatgcccacgtccaacctggcggcagcgcaaaagatg

SEQ ID NO: 2140 - DNA, 103 bp, Artificial Sequence
  Synthetic Polynucleotide
taatacgactcactatagggtcctttgcttcctgataggacgtggggaaaaacagaggagatttcccatggtcctatcaaacctggcggcagcgcaaaagatg

SEQ ID NO: 2141 - DNA, 103 bp, Artificial Sequence
  Synthetic Polynucleotide
taatacgactcactatagggacgcctcctttgcttcctgataggacgtggaacagaggagaccacgtatgatcaggaagaacctggcggcagcgcaaaagatg

SEQ ID NO: 2142 - DNA, 103 bp, Artificial Sequence
  Synthetic Polynucleotide
taatacgactcactatagggcaaaaacgcctcctttgcttcctgataggaaacagaggagatcctatatggaagcaaagaacctggcggcagcgcaaaagatg

SEQ ID NO: 2143 - DNA, 103 bp, Artificial Sequence
  Synthetic Polynucleotide
taatacgactcactataggggttccgaattcgtcaagggattagaatcataacagaggagaatgattatgatcccttgaaacctggcggcagcgcaaaagatg

SEQ ID NO: 2144 - DNA, 103 bp, Artificial Sequence
  Synthetic Polynucleotide
taatacgactcactatagggagaaccaaaaacgcctcctttgcttcctgaaacagaggagatcaggaatgaaaggaggcaacctggcggcagcgcaaaagatg

SEQ ID NO: 2145 - DNA, 103 bp, Artificial Sequence
  Synthetic Polynucleotide
taatacgactcactatagggagagtagaaccaaaaacgcctcctttgcttaacagaggagaaagcaaatgaggcgttttaacctggcggcagcgcaaaagatg

SEQ ID NO: 2146 - DNA, 103 bp, Artificial Sequence
  Synthetic Polynucleotide
taatacgactcactataggggtcttagagtagaaccaaaaacgcctccttaacagaggagaaaggagatgtttttggttaacctggcggcagcgcaaaagatg

SEQ ID NO: 2147 - DNA, 103 bp, Artificial Sequence
  Synthetic Polynucleotide
taatacgactcactataggggtggcgtcttagagtagaaccaaaaacgccaacagaggagaggcgttatgggttctactaacctggcggcagcgcaaaagatg

SEQ ID NO: 2148 - DNA, 103 bp, Artificial Sequence
  Synthetic Polynucleotide
taatacgactcactatagggaagtagtggcgtcttagagtagaaccaaaaaacagaggagattttggatgtactctaagaacctggcggcagcgcaaaagatg

SEQ ID NO: 2149 - DNA, 103 bp, Artificial Sequence
  Synthetic Polynucleotide
taatacgactcactatagggtacacaagtagtggcgtcttagagtagaacaacagaggagagttctaatgtaagacgccaacctggcggcagcgcaaaagatg

SEQ ID NO: 2150 - DNA, 103 bp, Artificial Sequence
  Synthetic Polynucleotide
taatacgactcactatagggacacttacacaagtagtggcgtcttagagtaacagaggagaactctaatgcgccactacaacctggcggcagcgcaaaagatg

SEQ ID NO: 2151 - DNA, 103 bp, Artificial Sequence
  Synthetic Polynucleotide
taatacgactcactatagggcaaccacacttacacaagtagtggcgtcttaacagaggagaaagacgatgctacttgtgaacctggcggcagcgcaaaagatg

SEQ ID NO: 2152 - DNA, 103 bp, Artificial Sequence
  Synthetic Polynucleotide
taatacgactcactatagggttctccaaccacacttacacaagtagtggcaacagaggagagccactatgtgtgtaagtaacctggcggcagcgcaaaagatg

SEQ ID NO: 2153 - DNA, 103 bp, Artificial Sequence
  Synthetic Polynucleotide
taatacgactcactatagggctgtattctccaaccacacttacacaagtaaacagaggagatacttgatgaagtgtggtaacctggcggcagcgcaaaagatg

SEQ ID NO: 2154 - DNA, 103 bp, Artificial Sequence
  Synthetic Polynucleotide
taatacgactcactatagggttctcgttccgaattcgtcaagggattagaaacagaggagatctaatatgttgacgaataacctggcggcagcgcaaaagatg

SEQ ID NO: 2155 - DNA, 103 bp, Artificial Sequence
  Synthetic Polynucleotide
taatacgactcactatagggtgtacctgtattctccaaccacacttacacaacagaggagagtgtaaatgtggttggagaacctggcggcagcgcaaaagatg

SEQ ID NO: 2156 - DNA, 103 bp, Artificial Sequence
  Synthetic Polynucleotide
taatacgactcactatagggtacactgtacctgtattctccaaccacactaacagaggagaagtgtgatgggagaatacaacctggcggcagcgcaaaagatg

SEQ ID NO: 2157 - DNA, 103 bp, Artificial Sequence
  Synthetic Polynucleotide
taatacgactcactatagggagcattacactgtacctgtattctccaaccaacagaggagaggttggatgatacaggtaaacctggcggcagcgcaaaagatg

SEQ ID NO: 2158 - DNA, 103 bp, Artificial Sequence
  Synthetic Polynucleotide
taatacgactcactatagggtgtgaagcattacactgtacctgtattctcaacagaggagagagaatatgggtacagtgaacctggcggcagcgcaaaagatg

SEQ ID NO: 2159 - DNA, 103 bp, Artificial Sequence
  Synthetic Polynucleotide
taatacgactcactataggggaaattgtgaagcattacactgtacctgtaaacagaggagatacaggatgagtgtaatgaacctggcggcagcgcaaaagatg

SEQ ID NO: 2160 - DNA, 103 bp, Artificial Sequence
  Synthetic Polynucleotide
taatacgactcactatagggtgcgtgaaattgtgaagcattacactgtacaacagaggagagtacagatgaatgcttcaaacctggcggcagcgcaaaagatg

SEQ ID NO: 2161 - DNA, 103 bp, Artificial Sequence
  Synthetic Polynucleotide
taatacgactcactataggggatcctgcgtgaaattgtgaagcattacacaacagaggagagtgtaaatgttcacaattaacctggcggcagcgcaaaagatg

SEQ ID NO: 2162 - DNA, 103 bp, Artificial Sequence
  Synthetic Polynucleotide
taatacgactcactataggggtaaggatcctgcgtgaaattgtgaagcataacagaggagaatgcttatgaatttcacgaacctggcggcagcgcaaaagatg

SEQ ID NO: 2163 - DNA, 103 bp, Artificial Sequence
  Synthetic Polynucleotide
taatacgactcactatagggtaccagtaaggatcctgcgtgaaattgtgaaacagaggagatcacaaatgcacgcaggaaacctggcggcagcgcaaaagatg

SEQ ID NO: 2164 - DNA, 103 bp, Artificial Sequence
  Synthetic Polynucleotide
taatacgactcactatagggatgaataccagtaaggatcctgcgtgaaataacagaggagaatttcaatgaggatccttaacctggcggcagcgcaaaagatg

SEQ ID NO: 2165 - DNA, 103 bp, Artificial Sequence
  Synthetic Polynucleotide
taatacgactcactatagggagaacttctcgttccgaattcgtcaagggaaacagaggagatcccttatggaattcggaaacctggcggcagcgcaaaagatg

SEQ ID NO: 2166 - DNA, 103 bp, Artificial Sequence
  Synthetic Polynucleotide
taatacgactcactataggggagccatgaataccagtaaggatcctgcgtaacagaggagaacgcagatgccttactggaacctggcggcagcgcaaaagatg

SEQ ID NO: 2167 - DNA, 103 bp, Artificial Sequence
  Synthetic Polynucleotide
taatacgactcactatagggttcgggagccatgaataccagtaaggatccaacagaggagaggatccatgctggtattcaacctggcggcagcgcaaaagatg

SEQ ID NO: 2168 - DNA, 103 bp, Artificial Sequence
  Synthetic Polynucleotide
taatacgactcactatagggtcaaattcgggagccatgaataccagtaagaacagaggagacttactatgattcatggcaacctggcggcagcgcaaaagatg

SEQ ID NO: 2169 - DNA, 103 bp, Artificial Sequence
  Synthetic Polynucleotide
taatacgactcactatagggaggtgtcaaattcgggagccatgaataccaaacagaggagatggtatatgtggctcccgaacctggcggcagcgcaaaagatg

SEQ ID NO: 2170 - DNA, 103 bp, Artificial Sequence
  Synthetic Polynucleotide
taatacgactcactatagggaggcgaggtgtcaaattcgggagccatgaaaacagaggagattcatgatgcccgaatttaacctggcggcagcgcaaaagatg

SEQ ID NO: 2171 - DNA, 103 bp, Artificial Sequence
  Synthetic Polynucleotide
taatacgactcactatagggttgtaaggcgaggtgtcaaattcgggagccaacagaggagaggctccatgatttgacacaacctggcggcagcgcaaaagatg

SEQ ID NO: 2172 - DNA, 103 bp, Artificial Sequence
  Synthetic Polynucleotide
taatacgactcactatagggttgcattgtaaggcgaggtgtcaaattcggaacagaggagaccgaatatgacacctcgcaacctggcggcagcgcaaaagatg

SEQ ID NO: 2173 - DNA, 103 bp, Artificial Sequence
  Synthetic Polynucleotide
taatacgactcactatagggcgttgttgcattgtaaggcgaggtgtcaaaaacagaggagatttgacatgtcgccttacaacctggcggcagcgcaaaagatg

SEQ ID NO: 2174 - DNA, 103 bp, Artificial Sequence
  Synthetic Polynucleotide
taatacgactcactatagggggctccgttgttgcattgtaaggcgaggtgaacagaggagacacctcatgttacaatgcaacctggcggcagcgcaaaagatg

SEQ ID NO: 2175 - DNA, 103 bp, Artificial Sequence
  Synthetic Polynucleotide
taatacgactcactatagggtggttggctccgttgttgcattgtaaggcgaacagaggagacgccttatgatgcaacaaaacctggcggcagcgcaaaagatg

SEQ ID NO: 2176 - DNA, 103 bp, Artificial Sequence
  Synthetic Polynucleotide
taatacgactcactataggggagggagaacttctcgttccgaattcgtcaaacagaggagatgacgaatgcggaacgagaacctggcggcagcgcaaaagatg

SEQ ID NO: 2177 - DNA, 103 bp, Artificial Sequence
  Synthetic Polynucleotide
taatacgactcactatagggtgctttggttggctccgttgttgcattgtaaacagaggagatacaatatgacaacggagaacctggcggcagcgcaaaagatg

SEQ ID NO: 2178 - DNA, 103 bp, Artificial Sequence
  Synthetic Polynucleotide
taatacgactcactataggggggactgctttggttggctccgttgttgcaaacagaggagatgcaacatgggagccaacaacctggcggcagcgcaaaagatg

SEQ ID NO: 2179 - DNA, 103 bp, Artificial Sequence
  Synthetic Polynucleotide
taatacgactcactatagggggaaagggactgctttggttggctccgttgaacagaggagacaacggatgcaaccaaagaacctggcggcagcgcaaaagatg

SEQ ID NO: 2180 - DNA, 103 bp, Artificial Sequence
  Synthetic Polynucleotide
taatacgactcactatagggcatctggaaagggactgctttggttggctcaacagaggagagagccaatgaaagcagtcaacctggcggcagcgcaaaagatg

SEQ ID NO: 2181 - DNA, 103 bp, Artificial Sequence
  Synthetic Polynucleotide
taatacgactcactataggggtgtccatctggaaagggactgctttggttaacagaggagaaaccaaatgagtccctttaacctggcggcagcgcaaaagatg

SEQ ID NO: 2182 - DNA, 103 bp, Artificial Sequence
  Synthetic Polynucleotide
taatacgactcactatagggattgcgtgtccatctggaaagggactgcttaacagaggagaaagcagatgctttccagaaacctggcggcagcgcaaaagatg

SEQ ID NO: 2183 - DNA, 103 bp, Artificial Sequence
  Synthetic Polynucleotide
taatacgactcactatagggctgccattgcgtgtccatctggaaagggacaacagaggagagtccctatgcagatggacaacctggcggcagcgcaaaagatg

SEQ ID NO: 2184 - DNA, 103 bp, Artificial Sequence
  Synthetic Polynucleotide
taatacgactcactatagggccagactgccattgcgtgtccatctggaaaaacagaggagatttccaatgggacacgcaaacctggcggcagcgcaaaagatg

SEQ ID NO: 2185 - DNA, 103 bp, Artificial Sequence
  Synthetic Polynucleotide
taatacgactcactataggggtttgccagactgccattgcgtgtccatctaacagaggagaagatggatgcgcaatggcaacctggcggcagcgcaaaagatg

SEQ ID NO: 2186 - DNA, 103 bp, Artificial Sequence
  Synthetic Polynucleotide
taatacgactcactataggggagcagtttgccagactgccattgcgtgtcaacagaggagagacacgatgtggcagtctaacctggcggcagcgcaaaagatg

SEQ ID NO: 2187 - DNA, 103 bp, Artificial Sequence
  Synthetic Polynucleotide
taatacgactcactatagggcaagggagggagaacttctcgttccgaattaacagaggagaaattcgatgcgagaagttaacctggcggcagcgcaaaagatg

SEQ ID NO: 2188 - DNA, 103 bp, Artificial Sequence
  Synthetic Polynucleotide
taatacgactcactatagggtgtccgagcagtttgccagactgccattgcaacagaggagagcaatgatggtctggcaaaacctggcggcagcgcaaaagatg

SEQ ID NO: 2189 - DNA, 103 bp, Artificial Sequence
  Synthetic Polynucleotide
taatacgactcactatagggaagaatgtccgagcagtttgccagactgccaacagaggagaggcagtatggcaaactgcaacctggcggcagcgcaaaagatg

SEQ ID NO: 2190 - DNA, 103 bp, Artificial Sequence
  Synthetic Polynucleotide
taatacgactcactatagggttcgtaagaatgtccgagcagtttgccagaaacagaggagatctggcatgctgctcggaaacctggcggcagcgcaaaagatg

SEQ ID NO: 2191 - DNA, 103 bp, Artificial Sequence
  Synthetic Polynucleotide
taatacgactcactataggggtgctttcgtaagaatgtccgagcagtttgaacagaggagacaaactatgcggacattcaacctggcggcagcgcaaaagatg

SEQ ID NO: 2192 - DNA, 103 bp, Artificial Sequence
  Synthetic Polynucleotide
taatacgactcactatagggaagtggtgctttcgtaagaatgtccgagcaaacagaggagatgctcgatgattcttacgaacctggcggcagcgcaaaagatg

SEQ ID NO: 2193 - DNA, 103 bp, Artificial Sequence
  Synthetic Polynucleotide
taatacgactcactatagggttgtaaagtggtgctttcgtaagaatgtccaacagaggagaggacatatgtacgaaagcaacctggcggcagcgcaaaagatg

SEQ ID NO: 2194 - DNA, 103 bp, Artificial Sequence
  Synthetic Polynucleotide
taatacgactcactatagggagaccttgtaaagtggtgctttcgtaagaaaacagaggagattcttaatgaagcaccacaacctggcggcagcgcaaaagatg

SEQ ID NO: 2195 - DNA, 103 bp, Artificial Sequence
  Synthetic Polynucleotide
taatacgactcactataggggtctaagaccttgtaaagtggtgctttcgtaacagaggagaacgaaaatgccactttacaacctggcggcagcgcaaaagatg

SEQ ID NO: 2196 - DNA, 103 bp, Artificial Sequence
  Synthetic Polynucleotide
taatacgactcactatagggaagaggtctaagaccttgtaaagtggtgctaacagaggagaagcaccatgttacaaggtaacctggcggcagcgcaaaagatg

SEQ ID NO: 2197 - DNA, 103 bp, Artificial Sequence
  Synthetic Polynucleotide
taatacgactcactatagggaaggcaagaggtctaagaccttgtaaagtgaacagaggagacactttatgaggtcttagaacctggcggcagcgcaaaagatg

SEQ ID NO: 2198 - DNA, 103 bp, Artificial Sequence
  Synthetic Polynucleotide
taatacgactcactatagggagcggcaagggagggagaacttctcgttccaacagaggagaggaacgatgagttctcccaacctggcggcagcgcaaaagatg

SEQ ID NO: 2199 - DNA, 103 bp, Artificial Sequence
  Synthetic Polynucleotide
taatacgactcactataggggattcaaggcaagaggtctaagaccttgtaaacagaggagatacaagatgttagacctcaacctggcggcagcgcaaaagatg

SEQ ID NO: 2200 - DNA, 103 bp, Artificial Sequence
  Synthetic Polynucleotide
taatacgactcactatagggctgatgattcaaggcaagaggtctaagaccaacagaggagaggtcttatgcctcttgccaacctggcggcagcgcaaaagatg

SEQ ID NO: 2201 - DNA, 103 bp, Artificial Sequence
  Synthetic Polynucleotide
taatacgactcactatagggtgattctgatgattcaaggcaagaggtctaaacagaggagatagaccatgtgccttgaaaacctggcggcagcgcaaaagatg

SEQ ID NO: 2202 - DNA, 103 bp, Artificial Sequence
  Synthetic Polynucleotide
taatacgactcactataggggccaatgattctgatgattcaaggcaagagaacagaggagactcttgatgtgaatcatcaacctggcggcagcgcaaaagatg

SEQ ID NO: 2203 - DNA, 103 bp, Artificial Sequence
  Synthetic Polynucleotide
taatacgactcactatagggccactgccaatgattctgatgattcaaggcaacagaggagagccttgatgcatcagaataacctggcggcagcgcaaaagatg

SEQ ID NO: 2204 - DNA, 103 bp, Artificial Sequence
  Synthetic Polynucleotide
taatacgactcactatagggacagtccactgccaatgattctgatgattcaacagaggagagaatcaatggaatcattgaacctggcggcagcgcaaaagatg

SEQ ID NO: 2205 - DNA, 103 bp, Artificial Sequence
  Synthetic Polynucleotide
taatacgactcactataggggatagacagtccactgccaatgattctgataacagaggagaatcagaatgattggcagtaacctggcggcagcgcaaaagatg

SEQ ID NO: 2206 - DNA, 103 bp, Artificial Sequence
  Synthetic Polynucleotide
taatacgactcactatagggatgtggatagacagtccactgccaatgattaacagaggagaaatcatatgcagtggactaacctggcggcagcgcaaaagatg

SEQ ID NO: 2207 - DNA, 103 bp, Artificial Sequence
  Synthetic Polynucleotide
taatacgactcactatagggatttgatgtggatagacagtccactgccaaaacagaggagattggcaatggactgtctaaacctggcggcagcgcaaaagatg

SEQ ID NO: 2208 - DNA, 103 bp, Artificial Sequence
  Synthetic Polynucleotide
taatacgactcactatagggtaagaatttgatgtggatagacagtccactaacagaggagaagtggaatgtctatccacaacctggcggcagcgcaaaagatg

SEQ ID NO: 2209 - DNA, 103 bp, Artificial Sequence
  Synthetic Polynucleotide
taatacgactcactataggggaacaagcggcaagggagggagaacttctcaacagaggagagagaagatgtccctccctaacctggcggcagcgcaaaagatg

SEQ ID NO: 2210 - DNA, 103 bp, Artificial Sequence
  Synthetic Polynucleotide
taatacgactcactataggggaggttaagaatttgatgtggatagacagtaacagaggagaactgtcatgccacatcaaaacctggcggcagcgcaaaagatg

SEQ ID NO: 2211 - DNA, 103 bp, Artificial Sequence
  Synthetic Polynucleotide
taatacgactcactataggggtcctgaggttaagaatttgatgtggatagaacagaggagactatccatgtcaaattctaacctggcggcagcgcaaaagatg

SEQ ID NO: 2212 - DNA, 103 bp, Artificial Sequence
  Synthetic Polynucleotide
taatacgactcactatagggtgttagtcctgaggttaagaatttgatgtgaacagaggagacacatcatgttcttaaccaacctggcggcagcgcaaaagatg

SEQ ID NO: 2213 - DNA, 103 bp, Artificial Sequence
  Synthetic Polynucleotide
taatacgactcactatagggcgtagtgttagtcctgaggttaagaatttgaacagaggagacaaattatgaacctcaggaacctggcggcagcgcaaaagatg

SEQ ID NO: 2214 - DNA, 103 bp, Artificial Sequence
  Synthetic Polynucleotide
taatacgactcactatagggtcacacgtagtgttagtcctgaggttaagaaacagaggagatcttaaatgcaggactaaaacctggcggcagcgcaaaagatg

SEQ ID NO: 2215 - DNA, 103 bp, Artificial Sequence
  Synthetic Polynucleotide
taatacgactcactatagggctaagtcacacgtagtgttagtcctgaggtaacagaggagaacctcaatgctaacactaaacctggcggcagcgcaaaagatg

SEQ ID NO: 2216 - DNA, 103 bp, Artificial Sequence
  Synthetic Polynucleotide
taatacgactcactatagggcacttctaagtcacacgtagtgttagtcctaacagaggagaaggactatgactacgtgtaacctggcggcagcgcaaaagatg

SEQ ID NO: 2217 - DNA, 103 bp, Artificial Sequence
  Synthetic Polynucleotide
taatacgactcactatagggtaaggcacttctaagtcacacgtagtgttaaacagaggagataacacatggtgtgacttaacctggcggcagcgcaaaagatg

SEQ ID NO: 2218 - DNA, 103 bp, Artificial Sequence
  Synthetic Polynucleotide
taatacgactcactatagggtaacataaggcacttctaagtcacacgtagaacagaggagactacgtatgacttagaagaacctggcggcagcgcaaaagatg

SEQ ID NO: 2219 - DNA, 103 bp, Artificial Sequence
  Synthetic Polynucleotide
taatacgactcactatagggaatgttaacataaggcacttctaagtcacaaacagaggagatgtgacatggaagtgcctaacctggcggcagcgcaaaagatg

SEQ ID NO: 2220 - DNA, 103 bp, Artificial Sequence
  Synthetic Polynucleotide
taatacgactcactataggggaataataatagtgggaagagatgtgggttaacagaggagaaacccaatgctcttcccaaacctggcggcagcgcaaaagatg

SEQ ID NO: 2221 - DNA, 103 bp, Artificial Sequence
  Synthetic Polynucleotide
taatacgactcactatagggggtgtgaacaagcggcaagggagggagaacaacagaggagagttctcatgcccttgccgaacctggcggcagcgcaaaagatg

SEQ ID NO: 2222 - DNA, 103 bp, Artificial Sequence
  Synthetic Polynucleotide
taatacgactcactatagggggacaaatgttaacataaggcacttctaagaacagaggagacttagaatggccttatgtaacctggcggcagcgcaaaagatg

SEQ ID NO: 2223 - DNA, 103 bp, Artificial Sequence
  Synthetic Polynucleotide
taatacgactcactatagggacgtgggacaaatgttaacataaggcacttaacagaggagaaagtgcatgatgttaacaaacctggcggcagcgcaaaagatg

SEQ ID NO: 2224 - DNA, 103 bp, Artificial Sequence
  Synthetic Polynucleotide
taatacgactcactatagggcgaggacgtgggacaaatgttaacataaggaacagaggagaccttatatgaacatttgtaacctggcggcagcgcaaaagatg

SEQ ID NO: 2225 - DNA, 103 bp, Artificial Sequence
  Synthetic Polynucleotide
taatacgactcactataggggtccacgaggacgtgggacaaatgttaacaaacagaggagatgttaaatgttgtcccacaacctggcggcagcgcaaaagatg

SEQ ID NO: 2226 - DNA, 103 bp, Artificial Sequence
  Synthetic Polynucleotide
taatacgactcactataggggctgggtccacgaggacgtgggacaaatgtaacagaggagaacatttatgccacgtcctaacctggcggcagcgcaaaagatg

SEQ ID NO: 2227 - DNA, 103 bp, Artificial Sequence
  Synthetic Polynucleotide
taatacgactcactatagggagcgtgctgggtccacgaggacgtgggacaaacagaggagatgtcccatgtcctcgtggaacctggcggcagcgcaaaagatg

SEQ ID NO: 2228 - DNA, 103 bp, Artificial Sequence
  Synthetic Polynucleotide
taatacgactcactatagggcagttagcgtgctgggtccacgaggacgtgaacagaggagacacgtcatggtggacccaaacctggcggcagcgcaaaagatg

SEQ ID NO: 2229 - DNA, 103 bp, Artificial Sequence
  Synthetic Polynucleotide
taatacgactcactatagggaaacccagttagcgtgctgggtccacgaggaacagaggagacctcgtatgcccagcacgaacctggcggcagcgcaaaagatg

SEQ ID NO: 2230 - DNA, 103 bp, Artificial Sequence
  Synthetic Polynucleotide
taatacgactcactatagggtaccaaaacccagttagcgtgctgggtccaaacagaggagatggaccatgcacgctaacaacctggcggcagcgcaaaagatg

SEQ ID NO: 2231 - DNA, 103 bp, Artificial Sequence
  Synthetic Polynucleotide
taatacgactcactataggggccactaccaaaacccagttagcgtgctggaacagaggagaccagcaatgtaactgggtaacctggcggcagcgcaaaagatg

SEQ ID NO: 2232 - DNA, 103 bp, Artificial Sequence
  Synthetic Polynucleotide
taatacgactcactatagggtgatgggtgtgaacaagcggcaagggagggaacagaggagaccctccatggccgcttgtaacctggcggcagcgcaaaagatg

SEQ ID NO: 2233 - DNA, 103 bp, Artificial Sequence
  Synthetic Polynucleotide
taatacgactcactatagggaaacagccactaccaaaacccagttagcgtaacagaggagaacgctaatggggttttggaacctggcggcagcgcaaaagatg

SEQ ID NO: 2234 - DNA, 103 bp, Artificial Sequence
  Synthetic Polynucleotide
taatacgactcactatagggagacaaaacagccactaccaaaacccagttaacagaggagaaactggatgttggtagtgaacctggcggcagcgcaaaagatg

SEQ ID NO: 2235 - DNA, 103 bp, Artificial Sequence
  Synthetic Polynucleotide
taatacgactcactatagggagaggagacaaaacagccactaccaaaaccaacagaggagaggttttatgagtggctgtaacctggcggcagcgcaaaagatg

SEQ ID NO: 2236 - DNA, 103 bp, Artificial Sequence
  Synthetic Polynucleotide
taatacgactcactatagggattgaagaggagacaaaacagccactaccaaacagaggagatggtagatgctgttttgtaacctggcggcagcgcaaaagatg

SEQ ID NO: 2237 - DNA, 103 bp, Artificial Sequence
  Synthetic Polynucleotide
taatacgactcactatagggagaatattgaagaggagacaaaacagccacaacagaggagagtggctatgttgtctcctaacctggcggcagcgcaaaagatg

SEQ ID NO: 2238 - DNA, 103 bp, Artificial Sequence
  Synthetic Polynucleotide
taatacgactcactatagggcctgaagaatattgaagaggagacaaaacaaacagaggagatgttttatgtcctcttcaaacctggcggcagcgcaaaagatg

SEQ ID NO: 2239 - DNA, 103 bp, Artificial Sequence
  Synthetic Polynucleotide
taatacgactcactatagggaagaacctgaagaatattgaagaggagacaaacagaggagatgtctcatgttcaatattaacctggcggcagcgcaaaagatg

SEQ ID NO: 2240 - DNA, 103 bp, Artificial Sequence
  Synthetic Polynucleotide
taatacgactcactataggggggggaagaacctgaagaatattgaagaggaacagaggagacctcttatgtattcttcaaacctggcggcagcgcaaaagatg

SEQ ID NO: 2241 - DNA, 103 bp, Artificial Sequence
  Synthetic Polynucleotide
taatacgactcactatagggacattgggggaagaacctgaagaatattgaaacagaggagatcaataatgttcaggttcaacctggcggcagcgcaaaagatg

SEQ ID NO: 2242 - DNA, 103 bp, Artificial Sequence
  Synthetic Polynucleotide
taatacgactcactatagggtgtctacattgggggaagaacctgaagaataacagaggagaattcttatggttcttcccaacctggcggcagcgcaaaagatg

SEQ ID NO: 2243 - DNA, 103 bp, Artificial Sequence
  Synthetic Polynucleotide
taatacgactcactatagggttaaatgatgggtgtgaacaagcggcaaggaacagaggagaccttgcatgttgttcacaaacctggcggcagcgcaaaagatg

SEQ ID NO: 2244 - DNA, 103 bp, Artificial Sequence
  Synthetic Polynucleotide
taatacgactcactatagggagtaatgtctacattgggggaagaacctgaaacagaggagatcaggtatgtcccccaataacctggcggcagcgcaaaagatg

SEQ ID NO: 2245 - DNA, 103 bp, Artificial Sequence
  Synthetic Polynucleotide
taatacgactcactataggggacacagtaatgtctacattgggggaagaaaacagaggagattcttcatgcaatgtagaaacctggcggcagcgcaaaagatg

SEQ ID NO: 2246 - DNA, 103 bp, Artificial Sequence
  Synthetic Polynucleotide
taatacgactcactataggggaacagacacagtaatgtctacattgggggaacagaggagacccccaatgtagacattaaacctggcggcagcgcaaaagatg

SEQ ID NO: 2247 - DNA, 103 bp, Artificial Sequence
  Synthetic Polynucleotide
taatacgactcactataggggggttgaacagacacagtaatgtctacattaacagaggagaaatgtaatgattactgtgaacctggcggcagcgcaaaagatg

SEQ ID NO: 2248 - DNA, 103 bp, Artificial Sequence
  Synthetic Polynucleotide
taatacgactcactatagggtttacgggttgaacagacacagtaatgtctaacagaggagaagacatatgtgtgtctgtaacctggcggcagcgcaaaagatg

SEQ ID NO: 2249 - DNA, 103 bp, Artificial Sequence
  Synthetic Polynucleotide
taatacgactcactatagggcaggctttacgggttgaacagacacagtaaaacagaggagattactgatgctgttcaacaacctggcggcagcgcaaaagatg

SEQ ID NO: 2250 - DNA, 103 bp, Artificial Sequence
  Synthetic Polynucleotide
taatacgactcactatagggaaagacaggctttacgggttgaacagacacaacagaggagagtgtctatgcaacccgtaaacctggcggcagcgcaaaagatg

SEQ ID NO: 2251 - DNA, 103 bp, Artificial Sequence
  Synthetic Polynucleotide
taatacgactcactatagggccgttaaagacaggctttacgggttgaacaaacagaggagatgttcaatgcgtaaagccaacctggcggcagcgcaaaagatg

SEQ ID NO: 2252 - DNA, 103 bp, Artificial Sequence
  Synthetic Polynucleotide
taatacgactcactatagggtgagaccgttaaagacaggctttacgggttaacagaggagaaacccgatgagcctgtctaacctggcggcagcgcaaaagatg

SEQ ID NO: 2253 - DNA, 103 bp, Artificial Sequence
  Synthetic Polynucleotide
taatacgactcactatagggatgtctgagaccgttaaagacaggctttacaacagaggagagtaaagatggtctttaacaacctggcggcagcgcaaaagatg

SEQ ID NO: 2254 - DNA, 103 bp, Artificial Sequence
  Synthetic Polynucleotide
taatacgactcactatagggccgaattaaatgatgggtgtgaacaagcggaacagaggagaccgcttatgcacacccataacctggcggcagcgcaaaagatg

SEQ ID NO: 2255 - DNA, 103 bp, Artificial Sequence
  Synthetic Polynucleotide
taatacgactcactatagggactgtatgtctgagaccgttaaagacaggcaacagaggagagcctgtatgtaacggtctaacctggcggcagcgcaaaagatg

SEQ ID NO: 2256 - DNA, 103 bp, Artificial Sequence
  Synthetic Polynucleotide
taatacgactcactatagggccaaaactgtatgtctgagaccgttaaagaaacagaggagatctttaatggtctcagacaacctggcggcagcgcaaaagatg

SEQ ID NO: 2257 - DNA, 103 bp, Artificial Sequence
  Synthetic Polynucleotide
taatacgactcactataggggtcctccaaaactgtatgtctgagaccgttaacagaggagaaacggtatgagacatacaaacctggcggcagcgcaaaagatg

SEQ ID NO: 2258 - DNA, 103 bp, Artificial Sequence
  Synthetic Polynucleotide
taatacgactcactatagggctctggtcctccaaaactgtatgtctgagaaacagaggagatctcagatgtacagttttaacctggcggcagcgcaaaagatg

SEQ ID NO: 2259 - DNA, 103 bp, Artificial Sequence
  Synthetic Polynucleotide
taatacgactcactatagggtggggctctggtcctccaaaactgtatgtcaacagaggagagacataatgttttggaggaacctggcggcagcgcaaaagatg

SEQ ID NO: 2260 - DNA, 103 bp, Artificial Sequence
  Synthetic Polynucleotide
taatacgactcactatagggtggtatggggctctggtcctccaaaactgtaacagaggagaacagttatggaggaccagaacctggcggcagcgcaaaagatg

SEQ ID NO: 2261 - DNA, 103 bp, Artificial Sequence
  Synthetic Polynucleotide
taatacgactcactataggggtgactggtatggggctctggtcctccaaaaacagaggagatttggaatgccagagcccaacctggcggcagcgcaaaagatg

SEQ ID NO: 2262 - DNA, 103 bp, Artificial Sequence
  Synthetic Polynucleotide
taatacgactcactatagggtaattgtgactggtatggggctctggtcctaacagaggagaaggaccatggccccatacaacctggcggcagcgcaaaagatg

SEQ ID NO: 2263 - DNA, 103 bp, Artificial Sequence
  Synthetic Polynucleotide
taatacgactcactatagggctctctaattgtgactggtatggggctctgaacagaggagacagagcatgataccagtcaacctggcggcagcgcaaaagatg

SEQ ID NO: 2264 - DNA, 103 bp, Artificial Sequence
  Synthetic Polynucleotide
taatacgactcactataggggcatgctctctaattgtgactggtatggggaacagaggagaccccatatgagtcacaataacctggcggcagcgcaaaagatg

SEQ ID NO: 2265 - DNA, 103 bp, Artificial Sequence
  Synthetic Polynucleotide
taatacgactcactatagggaagggccgaattaaatgatgggtgtgaacaaacagaggagatgttcaatgccatcatttaacctggcggcagcgcaaaagatg

SEQ ID NO: 2266 - DNA, 103 bp, Artificial Sequence
  Synthetic Polynucleotide
taatacgactcactatagggttccagcatgctctctaattgtgactggtaaacagaggagataccagatgcaattagagaacctggcggcagcgcaaaagatg

SEQ ID NO: 2267 - DNA, 103 bp, Artificial Sequence
  Synthetic Polynucleotide
taatacgactcactataggggaatgttccagcatgctctctaattgtgacaacagaggagagtcacaatgagagagcataacctggcggcagcgcaaaagatg

SEQ ID NO: 2268 - DNA, 103 bp, Artificial Sequence
  Synthetic Polynucleotide
taatacgactcactataggggaatagaatgttccagcatgctctctaattaacagaggagaaattagatggcatgctggaacctggcggcagcgcaaaagatg

SEQ ID NO: 2269 - DNA, 103 bp, Artificial Sequence
  Synthetic Polynucleotide
taatacgactcactatagggtggtggaatagaatgttccagcatgctctcaacagaggagagagagcatgctggaacataacctggcggcagcgcaaaagatg

SEQ ID NO: 2270 - DNA, 103 bp, Artificial Sequence
  Synthetic Polynucleotide
taatacgactcactatagggcggagtggtggaatagaatgttccagcatgaacagaggagacatgctatgacattctataacctggcggcagcgcaaaagatg

SEQ ID NO: 2271 - DNA, 103 bp, Artificial Sequence
  Synthetic Polynucleotide
taatacgactcactataggggtgtccggagtggtggaatagaatgttccaaacagaggagatggaacatgctattccacaacctggcggcagcgcaaaagatg

SEQ ID NO: 2272 - DNA, 103 bp, Artificial Sequence
  Synthetic Polynucleotide
taatacgactcactatagggcggtagtgtccggagtggtggaatagaatgaacagaggagacattctatgccaccactcaacctggcggcagcgcaaaagatg

SEQ ID NO: 2273 - DNA, 103 bp, Artificial Sequence
  Synthetic Polynucleotide
taatacgactcactataggggggaacggtagtgtccggagtggtggaataaacagaggagatattccatgactccggacaacctggcggcagcgcaaaagatg

SEQ ID NO: 2274 - DNA, 103 bp, Artificial Sequence
  Synthetic Polynucleotide
taatacgactcactatagggtatatgggaacggtagtgtccggagtggtgaacagaggagacaccacatgggacactacaacctggcggcagcgcaaaagatg

SEQ ID NO: 2275 - DNA, 103 bp, Artificial Sequence
  Synthetic Polynucleotide
taatacgactcactatagggtcccgtatatgggaacggtagtgtccggagaacagaggagactccggatgctaccgttcaacctggcggcagcgcaaaagatg

SEQ ID NO: 2276 - DNA, 103 bp, Artificial Sequence
  Synthetic Polynucleotide
taatacgactcactatagggtcacaaagggccgaattaaatgatgggtgtaacagaggagaacacccatgatttaattcaacctggcggcagcgcaaaagatg

SEQ ID NO: 2277 - DNA, 103 bp, Artificial Sequence
  Synthetic Polynucleotide
taatacgactcactatagggggtcttcccgtatatgggaacggtagtgtcaacagaggagagacactatggttcccataaacctggcggcagcgcaaaagatg

SEQ ID NO: 2278 - DNA, 103 bp, Artificial Sequence
  Synthetic Polynucleotide
taatacgactcactataggggcaatggtcttcccgtatatgggaacggtaaacagaggagataccgtatgcatatacggaacctggcggcagcgcaaaagatg

SEQ ID NO: 2279 - DNA, 103 bp, Artificial Sequence
  Synthetic Polynucleotide
taatacgactcactataggggtgttgcaatggtcttcccgtatatgggaaaacagaggagattcccaatgacgggaagaaacctggcggcagcgcaaaagatg

SEQ ID NO: 2280 - DNA, 103 bp, Artificial Sequence
  Synthetic Polynucleotide
taatacgactcactatagggggaaggtgttgcaatggtcttcccgtatataacagaggagaatatacatgaagaccattaacctggcggcagcgcaaaagatg

SEQ ID NO: 2281 - DNA, 103 bp, Artificial Sequence
  Synthetic Polynucleotide
taatacgactcactatagggtaatcggaaggtgttgcaatggtcttcccgaacagaggagacgggaaatgcattgcaacaacctggcggcagcgcaaaagatg

SEQ ID NO: 2282 - DNA, 103 bp, Artificial Sequence
  Synthetic Polynucleotide
taatacgactcactatagggacatgtaatcggaaggtgttgcaatggtctaacagaggagaagaccaatgcaacaccttaacctggcggcagcgcaaaagatg

SEQ ID NO: 2283 - DNA, 103 bp, Artificial Sequence
  Synthetic Polynucleotide
taatacgactcactatagggaccacacatgtaatcggaaggtgttgcaataacagaggagaattgcaatgccttccgataacctggcggcagcgcaaaagatg

SEQ ID NO: 2284 - DNA, 103 bp, Artificial Sequence
  Synthetic Polynucleotide
taatacgactcactatagggaactcaccacacatgtaatcggaaggtgttaacagaggagaaacaccatgcgattacataacctggcggcagcgcaaaagatg

SEQ ID NO: 2285 - DNA, 103 bp, Artificial Sequence
  Synthetic Polynucleotide
taatacgactcactatagggcatcaaactcaccacacatgtaatcggaagaacagaggagacttccgatgacatgtgtgaacctggcggcagcgcaaaagatg

SEQ ID NO: 2286 - DNA, 103 bp, Artificial Sequence
  Synthetic Polynucleotide
taatacgactcactatagggcaggtcatcaaactcaccacacatgtaatcaacagaggagagattacatgtgtggtgagaacctggcggcagcgcaaaagatg

SEQ ID NO: 2287 - DNA, 103 bp, Artificial Sequence
  Synthetic Polynucleotide
taatacgactcactataggggcttgtcacaaagggccgaattaaatgatgaacagaggagacatcatatgattcggcccaacctggcggcagcgcaaaagatg

SEQ ID NO: 2288 - DNA, 103 bp, Artificial Sequence
  Synthetic Polynucleotide
taatacgactcactataggggaaagcaggtcatcaaactcaccacacatgaacagaggagacatgtgatgtgagtttgaaacctggcggcagcgcaaaagatg

SEQ ID NO: 2289 - DNA, 103 bp, Artificial Sequence
  Synthetic Polynucleotide
taatacgactcactatagggataaagaaagcaggtcatcaaactcaccacaacagaggagagtggtgatgttgatgaccaacctggcggcagcgcaaaagatg

SEQ ID NO: 2290 - DNA, 103 bp, Artificial Sequence
  Synthetic Polynucleotide
taatacgactcactatagggcttacataaagaaagcaggtcatcaaactcaacagaggagagagtttatggacctgcttaacctggcggcagcgcaaaagatg

SEQ ID NO: 2291 - DNA, 103 bp, Artificial Sequence
  Synthetic Polynucleotide
taatacgactcactatagggggaatcttacataaagaaagcaggtcatcaaacagaggagatgatgaatggctttctttaacctggcggcagcgcaaaagatg

SEQ ID NO: 2292 - DNA, 103 bp, Artificial Sequence
  Synthetic Polynucleotide
taatacgactcactatagggaggtaggaatcttacataaagaaagcaggtaacagaggagaacctgcatgctttatgtaaacctggcggcagcgcaaaagatg

SEQ ID NO: 2293 - DNA, 103 bp, Artificial Sequence
  Synthetic Polynucleotide
taatacgactcactatagggtaggaaggtaggaatcttacataaagaaagaacagaggagactttctatgtgtaagattaacctggcggcagcgcaaaagatg

SEQ ID NO: 2294 - DNA, 103 bp, Artificial Sequence
  Synthetic Polynucleotide
taatacgactcactatagggttacctaggaaggtaggaatcttacataaaaacagaggagatttatgatggattcctacaacctggcggcagcgcaaaagatg

SEQ ID NO: 2295 - DNA, 103 bp, Artificial Sequence
  Synthetic Polynucleotide
taatacgactcactatagggttgggttacctaggaaggtaggaatcttacaacagaggagagtaagaatgctaccttccaacctggcggcagcgcaaaagatg

SEQ ID NO: 2296 - DNA, 103 bp, Artificial Sequence
  Synthetic Polynucleotide
taatacgactcactatagggtgttgttgggttacctaggaaggtaggaataacagaggagaattcctatgttcctaggtaacctggcggcagcgcaaaagatg

SEQ ID NO: 2297 - DNA, 103 bp, Artificial Sequence
  Synthetic Polynucleotide
taatacgactcactatagggtgatctgttgttgggttacctaggaaggtaaacagaggagataccttatgaggtaacccaacctggcggcagcgcaaaagatg

SEQ ID NO: 2298 - DNA, 103 bp, Artificial Sequence
  Synthetic Polynucleotide
taatacgactcactataggggaggggcttgtcacaaagggccgaattaaaaacagaggagatttaatatggccctttgtaacctggcggcagcgcaaaagatg

SEQ ID NO: 2299 - DNA, 103 bp, Artificial Sequence
  Synthetic Polynucleotide
taatacgactcactataggggcctctgatctgttgttgggttacctaggaaacagaggagatcctagatgacccaacaaaacctggcggcagcgcaaaagatg

SEQ ID NO: 2300 - DNA, 103 bp, Artificial Sequence
  Synthetic Polynucleotide
taatacgactcactataggggggcagcctctgatctgttgttgggttaccaacagaggagaggtaacatgacaacagataacctggcggcagcgcaaaagatg

SEQ ID NO: 2301 - DNA, 103 bp, Artificial Sequence
  Synthetic Polynucleotide
taatacgactcactatagggatgtagggcagcctctgatctgttgttgggaacagaggagacccaacatgagatcagagaacctggcggcagcgcaaaagatg

SEQ ID NO: 2302 - DNA, 103 bp, Artificial Sequence
  Synthetic Polynucleotide
taatacgactcactatagggcagaaatgtagggcagcctctgatctgttgaacagaggagacaacagatgagaggctgcaacctggcggcagcgcaaaagatg

SEQ ID NO: 2303 - DNA, 103 bp, Artificial Sequence
  Synthetic Polynucleotide
taatacgactcactataggggttagcagaaatgtagggcagcctctgatcaacagaggagagatcagatgctgccctacaacctggcggcagcgcaaaagatg

SEQ ID NO: 2304 - DNA, 103 bp, Artificial Sequence
  Synthetic Polynucleotide
taatacgactcactataggggtgttgttagcagaaatgtagggcagcctcaacagaggagagaggctatgctacatttcaacctggcggcagcgcaaaagatg

SEQ ID NO: 2305 - DNA, 103 bp, Artificial Sequence
  Synthetic Polynucleotide
taatacgactcactatagggcaaccgtgttgttagcagaaatgtagggcaaacagaggagatgccctatgtttctgctaaacctggcggcagcgcaaaagatg

SEQ ID NO: 2306 - DNA, 103 bp, Artificial Sequence
  Synthetic Polynucleotide
taatacgactcactatagggatctccaaccgtgttgttagcagaaatgtaaacagaggagatacattatggctaacaacaacctggcggcagcgcaaaagatg

SEQ ID NO: 2307 - DNA, 103 bp, Artificial Sequence
  Synthetic Polynucleotide
taatacgactcactatagggggctgatctccaaccgtgttgttagcagaaaacagaggagattctgcatgcaacacggtaacctggcggcagcgcaaaagatg

SEQ ID NO: 2308 - DNA, 103 bp, Artificial Sequence
  Synthetic Polynucleotide
taatacgactcactatagggcaagaggctgatctccaaccgtgttgttagaacagaggagactaacaatgcggttggagaacctggcggcagcgcaaaagatg

SEQ ID NO: 2309 - DNA, 103 bp, Artificial Sequence
  Synthetic Polynucleotide
taatacgactcactatagggtcaccgaggggcttgtcacaaagggccgaaaacagaggagattcggcatgttgtgacaaaacctggcggcagcgcaaaagatg

SEQ ID NO: 2310 - DNA, 103 bp, Artificial Sequence
  Synthetic Polynucleotide
taatacgactcactatagggcgtggcaagaggctgatctccaaccgtgttaacagaggagaaacacgatgggagatcagaacctggcggcagcgcaaaagatg

SEQ ID NO: 2311 - DNA, 103 bp, Artificial Sequence
  Synthetic Polynucleotide
taatacgactcactatagggtggtacgtggcaagaggctgatctccaaccaacagaggagaggttggatgtcagcctctaacctggcggcagcgcaaaagatg

SEQ ID NO: 2312 - DNA, 103 bp, Artificial Sequence
  Synthetic Polynucleotide
taatacgactcactatagggtgacctggtacgtggcaagaggctgatctcaacagaggagagagatcatgctcttgccaaacctggcggcagcgcaaaagatg

SEQ ID NO: 2313 - DNA, 103 bp, Artificial Sequence
  Synthetic Polynucleotide
taatacgactcactatagggcagtgtgacctggtacgtggcaagaggctgaacagaggagacagcctatggccacgtacaacctggcggcagcgcaaaagatg

SEQ ID NO: 2314 - DNA, 103 bp, Artificial Sequence
  Synthetic Polynucleotide
taatacgactcactatagggcatgacagtgtgacctggtacgtggcaagaaacagaggagatcttgcatggtaccaggtaacctggcggcagcgcaaaagatg

SEQ ID NO: 2315 - DNA, 103 bp, Artificial Sequence
  Synthetic Polynucleotide
taatacgactcactatagggaagaacatgacagtgtgacctggtacgtggaacagaggagaccacgtatgaggtcacacaacctggcggcagcgcaaaagatg

SEQ ID NO: 2316 - DNA, 103 bp, Artificial Sequence
  Synthetic Polynucleotide
taatacgactcactatagggcatacaagaacatgacagtgtgacctggtaaacagaggagataccagatgacactgtcaaacctggcggcagcgcaaaagatg

SEQ ID NO: 2317 - DNA, 103 bp, Artificial Sequence
  Synthetic Polynucleotide
taatacgactcactatagggtttgccatacaagaacatgacagtgtgaccaacagaggagaggtcacatggtcatgttcaacctggcggcagcgcaaaagatg

SEQ ID NO: 2318 - DNA, 103 bp, Artificial Sequence
  Synthetic Polynucleotide
taatacgactcactatagggttgaatttgccatacaagaacatgacagtgaacagaggagacactgtatggttcttgtaaacctggcggcagcgcaaaagatg

SEQ ID NO: 2319 - DNA, 103 bp, Artificial Sequence
  Synthetic Polynucleotide
taatacgactcactatagggcagcattgaatttgccatacaagaacatgaaacagaggagatcatgtatgtgtatggcaaacctggcggcagcgcaaaagatg

SEQ ID NO: 2320 - DNA, 103 bp, Artificial Sequence
  Synthetic Polynucleotide
taatacgactcactatagggtcctttcaccgaggggcttgtcacaaagggaacagaggagaccctttatgacaagccccaacctggcggcagcgcaaaagatg

SEQ ID NO: 2321 - DNA, 103 bp, Artificial Sequence
  Synthetic Polynucleotide
taatacgactcactataggggcagccagcattgaatttgccatacaagaaaacagaggagattcttgatgggcaaattcaacctggcggcagcgcaaaagatg

SEQ ID NO: 2322 - DNA, 103 bp, Artificial Sequence
  Synthetic Polynucleotide
taatacgactcactatagggaaacagcagccagcattgaatttgccatacaacagaggagagtatggatgattcaatgcaacctggcggcagcgcaaaagatg

SEQ ID NO: 2323 - DNA, 103 bp, Artificial Sequence
  Synthetic Polynucleotide
taatacgactcactatagggccttgaaacagcagccagcattgaatttgcaacagaggagagcaaatatgatgctggctaacctggcggcagcgcaaaagatg

SEQ ID NO: 2324 - DNA, 103 bp, Artificial Sequence
  Synthetic Polynucleotide
taatacgactcactatagggaagttccttgaaacagcagccagcattgaaaacagaggagattcaatatgggctgctgtaacctggcggcagcgcaaaagatg

SEQ ID NO: 2325 - DNA, 103 bp, Artificial Sequence
  Synthetic Polynucleotide
taatacgactcactatagggggttgaagttccttgaaacagcagccagcaaacagaggagatgctggatgctgtttcaaaacctggcggcagcgcaaaagatg

SEQ ID NO: 2326 - DNA, 103 bp, Artificial Sequence
  Synthetic Polynucleotide
taatacgactcactatagggatactggttgaagttccttgaaacagcagcaacagaggagagctgctatgtcaaggaacaacctggcggcagcgcaaaagatg

SEQ ID NO: 2327 - DNA, 103 bp, Artificial Sequence
  Synthetic Polynucleotide
taatacgactcactatagggcctcgatactggttgaagttccttgaaacaaacagaggagatgtttcatggaacttcaaaacctggcggcagcgcaaaagatg

SEQ ID NO: 2328 - DNA, 103 bp, Artificial Sequence
  Synthetic Polynucleotide
taatacgactcactataggggagaccctcgatactggttgaagttccttgaacagaggagacaaggaatgtcaaccagtaacctggcggcagcgcaaaagatg

SEQ ID NO: 2329 - DNA, 103 bp, Artificial Sequence
  Synthetic Polynucleotide
taatacgactcactatagggattaagagaccctcgatactggttgaagttaacagaggagaaacttcatgcagtatcgaaacctggcggcagcgcaaaagatg

SEQ ID NO: 2330 - DNA, 103 bp, Artificial Sequence
  Synthetic Polynucleotide
taatacgactcactatagggaagtaattaagagaccctcgatactggttgaacagaggagacaaccaatgtcgagggtcaacctggcggcagcgcaaaagatg

SEQ ID NO: 2331 - DNA, 103 bp, Artificial Sequence
  Synthetic Polynucleotide
taatacgactcactatagggaaccggaataataatagtgggaagagatgtaacagaggagaacatctatgcccactattaacctggcggcagcgcaaaagatg

SEQ ID NO: 2332 - DNA, 103 bp, Artificial Sequence
  Synthetic Polynucleotide
taatacgactcactatagggagaggtcctttcaccgaggggcttgtcacaaacagaggagatgtgacatgcccctcggtaacctggcggcagcgcaaaagatg

SEQ ID NO: 2333 - DNA, 103 bp, Artificial Sequence
  Synthetic Polynucleotide
taatacgactcactatagggcaaacaagtaattaagagaccctcgatactaacagaggagaagtatcatgggtctcttaaacctggcggcagcgcaaaagatg

SEQ ID NO: 2334 - DNA, 103 bp, Artificial Sequence
  Synthetic Polynucleotide
taatacgactcactatagggaaaaacaaacaagtaattaagagaccctcgaacagaggagacgagggatgcttaattacaacctggcggcagcgcaaaagatg

SEQ ID NO: 2335 - DNA, 103 bp, Artificial Sequence
  Synthetic Polynucleotide
taatacgactcactatagggcctgtaaaaacaaacaagtaattaagagacaacagaggagagtctctatgttacttgttaacctggcggcagcgcaaaagatg

SEQ ID NO: 2336 - DNA, 103 bp, Artificial Sequence
  Synthetic Polynucleotide
taatacgactcactatagggcactacctgtaaaaacaaacaagtaattaaaacagaggagattaattatgtgtttgtttaacctggcggcagcgcaaaagatg

SEQ ID NO: 2337 - DNA, 103 bp, Artificial Sequence
  Synthetic Polynucleotide
taatacgactcactatagggcatagcactacctgtaaaaacaaacaagtaaacagaggagatacttgatggtttttacaaacctggcggcagcgcaaaagatg

SEQ ID NO: 2338 - DNA, 103 bp, Artificial Sequence
  Synthetic Polynucleotide
taatacgactcactatagggtttgccatagcactacctgtaaaaacaaacaacagaggagagtttgtatgtacaggtagaacctggcggcagcgcaaaagatg

SEQ ID NO: 2339 - DNA, 103 bp, Artificial Sequence
  Synthetic Polynucleotide
taatacgactcactatagggttccttttgccatagcactacctgtaaaaaaacagaggagatttttaatggtagtgctaaacctggcggcagcgcaaaagatg

SEQ ID NO: 2340 - DNA, 103 bp, Artificial Sequence
  Synthetic Polynucleotide
taatacgactcactatagggaaattttccttttgccatagcactacctgtaacagaggagaacaggtatggctatggcaaacctggcggcagcgcaaaagatg

SEQ ID NO: 2341 - DNA, 103 bp, Artificial Sequence
  Synthetic Polynucleotide
taatacgactcactatagggattaaaaattttccttttgccatagcactaaacagaggagatagtgcatgggcaaaaggaacctggcggcagcgcaaaagatg

SEQ ID NO: 2342 - DNA, 103 bp, Artificial Sequence
  Synthetic Polynucleotide
taatacgactcactatagggatgagattaaaaattttccttttgccatagaacagaggagactatggatgaaggaaaataacctggcggcagcgcaaaagatg

SEQ ID NO: 2343 - DNA, 103 bp, Artificial Sequence
  Synthetic Polynucleotide
taatacgactcactatagggaagagagaggtcctttcaccgaggggcttgaacagaggagacaagccatgcggtgaaagaacctggcggcagcgcaaaagatg

SEQ ID NO: 2344 - DNA, 103 bp, Artificial Sequence
  Synthetic Polynucleotide
taatacgactcactatagggagtgtatgagattaaaaattttccttttgcaacagaggagagcaaaaatgaaatttttaaacctggcggcagcgcaaaagatg

SEQ ID NO: 2345 - DNA, 103 bp, Artificial Sequence
  Synthetic Polynucleotide
taatacgactcactataggggggggagtgtatgagattaaaaattttcctaacagaggagaaggaaaatgtttaatctcaacctggcggcagcgcaaaagatg

SEQ ID NO: 2346 - DNA, 103 bp, Artificial Sequence
  Synthetic Polynucleotide
taatacgactcactatagggctcctgggggagtgtatgagattaaaaattaacagaggagaaattttatgtctcatacaaacctggcggcagcgcaaaagatg

SEQ ID NO: 2347 - DNA, 103 bp, Artificial Sequence
  Synthetic Polynucleotide
taatacgactcactatagggacctgctcctgggggagtgtatgagattaaaacagaggagattaatcatgtacactcccaacctggcggcagcgcaaaagatg

SEQ ID NO: 2348 - DNA, 103 bp, Artificial Sequence
  Synthetic Polynucleotide
taatacgactcactatagggggtttacctgctcctgggggagtgtatgagaacagaggagactcataatgtcccccaggaacctggcggcagcgcaaaagatg

SEQ ID NO: 2349 - DNA, 103 bp, Artificial Sequence
  Synthetic Polynucleotide
taatacgactcactatagggcttttggtttacctgctcctgggggagtgtaacagaggagaacactcatgcaggagcagaacctggcggcagcgcaaaagatg

SEQ ID NO: 2350 - DNA, 103 bp, Artificial Sequence
  Synthetic Polynucleotide
taatacgactcactatagggtctgtcttttggtttacctgctcctgggggaacagaggagacccccaatggcaggtaaaaacctggcggcagcgcaaaagatg

SEQ ID NO: 2351 - DNA, 103 bp, Artificial Sequence
  Synthetic Polynucleotide
taatacgactcactatagggtgctctctgtcttttggtttacctgctcctaacagaggagaaggagcatgtaaaccaaaaacctggcggcagcgcaaaagatg

SEQ ID NO: 2352 - DNA, 103 bp, Artificial Sequence
  Synthetic Polynucleotide
taatacgactcactatagggtagcttgctctctgtcttttggtttacctgaacagaggagacaggtaatgcaaaagacaaacctggcggcagcgcaaaagatg

SEQ ID NO: 2353 - DNA, 103 bp, Artificial Sequence
  Synthetic Polynucleotide
taatacgactcactatagggttgcatagcttgctctctgtcttttggtttaacagaggagaaaaccaatggacagagagaacctggcggcagcgcaaaagatg

SEQ ID NO: 2354 - DNA, 103 bp, Artificial Sequence
  Synthetic Polynucleotide
taatacgactcactatagggtcggaaagagagaggtcctttcaccgagggaacagaggagaccctcgatgaaaggacctaacctggcggcagcgcaaaagatg

SEQ ID NO: 2355 - DNA, 103 bp, Artificial Sequence
  Synthetic Polynucleotide
taatacgactcactataggggtggcttgcatagcttgctctctgtcttttaacagaggagaaaaagaatgagagcaagcaacctggcggcagcgcaaaagatg

SEQ ID NO: 2356 - DNA, 103 bp, Artificial Sequence
  Synthetic Polynucleotide
taatacgactcactatagggcatatgtggcttgcatagcttgctctctgtaacagaggagaacagagatgaagctatgcaacctggcggcagcgcaaaagatg

SEQ ID NO: 2357 - DNA, 103 bp, Artificial Sequence
  Synthetic Polynucleotide
taatacgactcactatagggaatcgcatatgtggcttgcatagcttgctcaacagaggagagagcaaatgatgcaagccaacctggcggcagcgcaaaagatg

SEQ ID NO: 2358 - DNA, 103 bp, Artificial Sequence
  Synthetic Polynucleotide
taatacgactcactatagggtcccaaatcgcatatgtggcttgcatagctaacagaggagaagctatatgagccacataaacctggcggcagcgcaaaagatg

SEQ ID NO: 2359 - DNA, 103 bp, Artificial Sequence
  Synthetic Polynucleotide
taatacgactcactatagggccaagtcccaaatcgcatatgtggcttgcaaacagaggagatgcaagatgcatatgcgaaacctggcggcagcgcaaaagatg

SEQ ID NO: 2360 - DNA, 103 bp, Artificial Sequence
  Synthetic Polynucleotide
taatacgactcactataggggaggcccaagtcccaaatcgcatatgtggcaacagaggagagccacaatggcgatttggaacctggcggcagcgcaaaagatg

SEQ ID NO: 2361 - DNA, 103 bp, Artificial Sequence
  Synthetic Polynucleotide
taatacgactcactataggggagttgaggcccaagtcccaaatcgcatataacagaggagaatatgcatgttgggacttaacctggcggcagcgcaaaagatg

SEQ ID NO: 2362 - DNA, 103 bp, Artificial Sequence
  Synthetic Polynucleotide
taatacgactcactatagggagctagagttgaggcccaagtcccaaatcgaacagaggagacgatttatgacttgggccaacctggcggcagcgcaaaagatg

SEQ ID NO: 2363 - DNA, 103 bp, Artificial Sequence
  Synthetic Polynucleotide
taatacgactcactatagggattgtagctagagttgaggcccaagtcccaaacagaggagatgggacatgggcctcaacaacctggcggcagcgcaaaagatg

SEQ ID NO: 2364 - DNA, 103 bp, Artificial Sequence
  Synthetic Polynucleotide
taatacgactcactataggggtgaaattgtagctagagttgaggcccaagaacagaggagacttgggatgcaactctagaacctggcggcagcgcaaaagatg

SEQ ID NO: 2365 - DNA, 103 bp, Artificial Sequence
  Synthetic Polynucleotide
taatacgactcactatagggccacgtcggaaagagagaggtcctttcaccaacagaggagaggtgaaatgacctctctcaacctggcggcagcgcaaaagatg

SEQ ID NO: 2366 - DNA, 103 bp, Artificial Sequence
  Synthetic Polynucleotide
taatacgactcactatagggggacggtgaaattgtagctagagttgaggcaacagaggagagcctcaatgctagctacaaacctggcggcagcgcaaaagatg

SEQ ID NO: 2367 - DNA, 103 bp, Artificial Sequence
  Synthetic Polynucleotide
taatacgactcactataggggaatgggacggtgaaattgtagctagagttaacagaggagaaactctatgtacaatttcaacctggcggcagcgcaaaagatg

SEQ ID NO: 2368 - DNA, 103 bp, Artificial Sequence
  Synthetic Polynucleotide
taatacgactcactataggggagatgaatgggacggtgaaattgtagctaaacagaggagatagctaatgtttcaccgtaacctggcggcagcgcaaaagatg

SEQ ID NO: 2369 - DNA, 103 bp, Artificial Sequence
  Synthetic Polynucleotide
taatacgactcactatagggtcggggagatgaatgggacggtgaaattgtaacagaggagaacaattatgccgtcccataacctggcggcagcgcaaaagatg

SEQ ID NO: 2370 - DNA, 103 bp, Artificial Sequence
  Synthetic Polynucleotide
taatacgactcactataggggtgtgtcggggagatgaatgggacggtgaaaacagaggagattcaccatgccattcatcaacctggcggcagcgcaaaagatg

SEQ ID NO: 2371 - DNA, 103 bp, Artificial Sequence
  Synthetic Polynucleotide
taatacgactcactatagggcggtagtgtgtcggggagatgaatgggacgaacagaggagacgtcccatgcatctccccaacctggcggcagcgcaaaagatg

SEQ ID NO: 2372 - DNA, 103 bp, Artificial Sequence
  Synthetic Polynucleotide
taatacgactcactatagggtttggcggtagtgtgtcggggagatgaatgaacagaggagacattcaatgccccgacacaacctggcggcagcgcaaaagatg

SEQ ID NO: 2373 - DNA, 103 bp, Artificial Sequence
  Synthetic Polynucleotide
taatacgactcactatagggagaggtttggcggtagtgtgtcggggagataacagaggagaatctccatgacacactacaacctggcggcagcgcaaaagatg

SEQ ID NO: 2374 - DNA, 103 bp, Artificial Sequence
  Synthetic Polynucleotide
taatacgactcactataggggtataagaggtttggcggtagtgtgtcgggaacagaggagacccgacatgctaccgccaaacctggcggcagcgcaaaagatg

SEQ ID NO: 2375 - DNA, 103 bp, Artificial Sequence
  Synthetic Polynucleotide
taatacgactcactataggggagttgtataagaggtttggcggtagtgtgaacagaggagacacactatggccaaacctaacctggcggcagcgcaaaagatg

SEQ ID NO: 2376 - DNA, 103 bp, Artificial Sequence
  Synthetic Polynucleotide
taatacgactcactatagggtccaaccacgtcggaaagagagaggtccttaacagaggagaaaggacatgtctctttccaacctggcggcagcgcaaaagatg

SEQ ID NO: 2377 - DNA, 103 bp, Artificial Sequence
  Synthetic Polynucleotide
taatacgactcactatagggtgagggagttgtataagaggtttggcggtaaacagaggagataccgcatgacctcttataacctggcggcagcgcaaaagatg

SEQ ID NO: 2378 - DNA, 103 bp, Artificial Sequence
  Synthetic Polynucleotide
taatacgactcactataggggtgattgagggagttgtataagaggtttggaacagaggagaccaaacatgttatacaacaacctggcggcagcgcaaaagatg

SEQ ID NO: 2379 - DNA, 103 bp, Artificial Sequence
  Synthetic Polynucleotide
taatacgactcactatagggcggaagtgattgagggagttgtataagaggaacagaggagacctcttatgcaactccctaacctggcggcagcgcaaaagatg

SEQ ID NO: 2380 - DNA, 103 bp, Artificial Sequence
  Synthetic Polynucleotide
taatacgactcactataggggtcaacggaagtgattgagggagttgtataaacagaggagatatacaatgccctcaatcaacctggcggcagcgcaaaagatg

SEQ ID NO: 2381 - DNA, 103 bp, Artificial Sequence
  Synthetic Polynucleotide
taatacgactcactatagggcaaccgtcaacggaagtgattgagggagttaacagaggagaaactccatgaatcacttcaacctggcggcagcgcaaaagatg

SEQ ID NO: 2382 - DNA, 103 bp, Artificial Sequence
  Synthetic Polynucleotide
taatacgactcactatagggagagccaaccgtcaacggaagtgattgaggaacagaggagacctcaaatgcttccgttgaacctggcggcagcgcaaaagatg

SEQ ID NO: 2383 - DNA, 103 bp, Artificial Sequence
  Synthetic Polynucleotide
taatacgactcactatagggaattgagagccaaccgtcaacggaagtgataacagaggagaatcactatggttgacggtaacctggcggcagcgcaaaagatg

SEQ ID NO: 2384 - DNA, 103 bp, Artificial Sequence
  Synthetic Polynucleotide
taatacgactcactatagggtgccaaattgagagccaaccgtcaacggaaaacagaggagattccgtatgcggttggctaacctggcggcagcgcaaaagatg

SEQ ID NO: 2385 - DNA, 103 bp, Artificial Sequence
  Synthetic Polynucleotide
taatacgactcactatagggttagttgccaaattgagagccaaccgtcaaaacagaggagattgacgatgggctctcaaaacctggcggcagcgcaaaagatg

SEQ ID NO: 2386 - DNA, 103 bp, Artificial Sequence
  Synthetic Polynucleotide
taatacgactcactatagggtggggttagttgccaaattgagagccaaccaacagaggagaggttggatgtcaatttggaacctggcggcagcgcaaaagatg

SEQ ID NO: 2387 - DNA, 103 bp, Artificial Sequence
  Synthetic Polynucleotide
taatacgactcactatagggttaattccaaccacgtcggaaagagagaggaacagaggagacctctcatgttccgacgtaacctggcggcagcgcaaaagatg

SEQ ID NO: 2388 - DNA, 103 bp, Artificial Sequence
  Synthetic Polynucleotide
taatacgactcactataggggtgagtggggttagttgccaaattgagagcaacagaggagagctctcatgttggcaactaacctggcggcagcgcaaaagatg

SEQ ID NO: 2389 - DNA, 103 bp, Artificial Sequence
  Synthetic Polynucleotide
taatacgactcactatagggggtaagtgagtggggttagttgccaaattgaacagaggagacaatttatgaactaacccaacctggcggcagcgcaaaagatg

SEQ ID NO: 2390 - DNA, 103 bp, Artificial Sequence
  Synthetic Polynucleotide
taatacgactcactatagggagctgggtaagtgagtggggttagttgccaaacagaggagatggcaaatgaccccactcaacctggcggcagcgcaaaagatg

SEQ ID NO: 2391 - DNA, 103 bp, Artificial Sequence
  Synthetic Polynucleotide
taatacgactcactataggggtgttagctgggtaagtgagtggggttagtaacagaggagaactaacatgactcacttaaacctggcggcagcgcaaaagatg

SEQ ID NO: 2392 - DNA, 103 bp, Artificial Sequence
  Synthetic Polynucleotide
taatacgactcactataggggtggggtgttagctgggtaagtgagtggggaacagaggagaccccacatgcttacccagaacctggcggcagcgcaaaagatg

SEQ ID NO: 2393 - DNA, 103 bp, Artificial Sequence
  Synthetic Polynucleotide
taatacgactcactatagggactctgtggggtgttagctgggtaagtgagaacagaggagactcactatgccagctaacaacctggcggcagcgcaaaagatg

SEQ ID NO: 2394 - DNA, 103 bp, Artificial Sequence
  Synthetic Polynucleotide
taatacgactcactatagggtcggcactctgtggggtgttagctgggtaaaacagaggagattacccatgtaacaccccaacctggcggcagcgcaaaagatg

SEQ ID NO: 2395 - DNA, 103 bp, Artificial Sequence
  Synthetic Polynucleotide
taatacgactcactataggggtatatcggcactctgtggggtgttagctgaacagaggagacagctaatgccccacagaaacctggcggcagcgcaaaagatg

SEQ ID NO: 2396 - DNA, 103 bp, Artificial Sequence
  Synthetic Polynucleotide
taatacgactcactatagggagttagtatatcggcactctgtggggtgttaacagaggagaaacaccatgcagagtgccaacctggcggcagcgcaaaagatg

SEQ ID NO: 2397 - DNA, 103 bp, Artificial Sequence
  Synthetic Polynucleotide
taatacgactcactatagggaccaaagttagtatatcggcactctgtgggaacagaggagacccacaatgtgccgatataacctggcggcagcgcaaaagatg

SEQ ID NO: 2398 - DNA, 103 bp, Artificial Sequence
  Synthetic Polynucleotide
taatacgactcactatagggagatgttaattccaaccacgtcggaaagagaacagaggagactctttatgacgtggttgaacctggcggcagcgcaaaagatg

SEQ ID NO: 2399 - DNA, 103 bp, Artificial Sequence
  Synthetic Polynucleotide
taatacgactcactatagggctgaaaccaaagttagtatatcggcactctaacagaggagaagagtgatgatatactaaaacctggcggcagcgcaaaagatg

SEQ ID NO: 2400 - DNA, 103 bp, Artificial Sequence
  Synthetic Polynucleotide
taatacgactcactatagggcccacctgaaaccaaagttagtatatcggcaacagaggagagccgatatgctaactttgaacctggcggcagcgcaaaagatg

SEQ ID NO: 2401 - DNA, 103 bp, Artificial Sequence
  Synthetic Polynucleotide
taatacgactcactatagggtcatccccacctgaaaccaaagttagtataaacagaggagatatactatgtttggtttcaacctggcggcagcgcaaaagatg

SEQ ID NO: 2402 - DNA, 103 bp, Artificial Sequence
  Synthetic Polynucleotide
taatacgactcactatagggtgaagtcatccccacctgaaaccaaagttaaacagaggagataacttatgtttcaggtgaacctggcggcagcgcaaaagatg

SEQ ID NO: 2403 - DNA, 103 bp, Artificial Sequence
  Synthetic Polynucleotide
taatacgactcactataggggagagtgaagtcatccccacctgaaaccaaaacagaggagattggttatgggtggggataacctggcggcagcgcaaaagatg

SEQ ID NO: 2404 - DNA, 103 bp, Artificial Sequence
  Synthetic Polynucleotide
taatacgactcactatagggattctgagagtgaagtcatccccacctgaaaacagaggagattcaggatgggatgacttaacctggcggcagcgcaaaagatg

SEQ ID NO: 2405 - DNA, 103 bp, Artificial Sequence
  Synthetic Polynucleotide
taatacgactcactatagggccggcattctgagagtgaagtcatccccacaacagaggagagtggggatgacttcactcaacctggcggcagcgcaaaagatg

SEQ ID NO: 2406 - DNA, 103 bp, Artificial Sequence
  Synthetic Polynucleotide
taatacgactcactatagggagtcaccggcattctgagagtgaagtcatcaacagaggagagatgacatgactctcagaaacctggcggcagcgcaaaagatg

SEQ ID NO: 2407 - DNA, 103 bp, Artificial Sequence
  Synthetic Polynucleotide
taatacgactcactatagggctaggagtcaccggcattctgagagtgaagaacagaggagacttcacatgcagaatgccaacctggcggcagcgcaaaagatg

SEQ ID NO: 2408 - DNA, 103 bp, Artificial Sequence
  Synthetic Polynucleotide
taatacgactcactatagggacttactaggagtcaccggcattctgagagaacagaggagactctcaatgtgccggtgaaacctggcggcagcgcaaaagatg

SEQ ID NO: 2409 - DNA, 103 bp, Artificial Sequence
  Synthetic Polynucleotide
taatacgactcactatagggggaaaagatgttaattccaaccacgtcggaaacagaggagatccgacatggttggaattaacctggcggcagcgcaaaagatg

SEQ ID NO: 2410 - DNA, 103 bp, Artificial Sequence
  Synthetic Polynucleotide
taatacgactcactatagggcgtgtacttactaggagtcaccggcattctaacagaggagaagaatgatggtgactcctaacctggcggcagcgcaaaagatg

SEQ ID NO: 2411 - DNA, 103 bp, Artificial Sequence
  Synthetic Polynucleotide
taatacgactcactatagggtggggcgtgtacttactaggagtcaccggcaacagaggagagccggtatgtcctagtaaaacctggcggcagcgcaaaagatg

SEQ ID NO: 2412 - DNA, 103 bp, Artificial Sequence
  Synthetic Polynucleotide
taatacgactcactatagggctccatggggcgtgtacttactaggagtcaaacagaggagatgactcatggtaagtacaaacctggcggcagcgcaaaagatg

SEQ ID NO: 2413 - DNA, 103 bp, Artificial Sequence
  Synthetic Polynucleotide
taatacgactcactatagggatccactccatggggcgtgtacttactaggaacagaggagacctagtatgtacacgcccaacctggcggcagcgcaaaagatg

SEQ ID NO: 2414 - DNA, 103 bp, Artificial Sequence
  Synthetic Polynucleotide
taatacgactcactataggggcgttatccactccatggggcgtgtacttaaacagaggagataagtaatggccccatggaacctggcggcagcgcaaaagatg

SEQ ID NO: 2415 - DNA, 103 bp, Artificial Sequence
  Synthetic Polynucleotide
taatacgactcactatagggtttctgcgttatccactccatggggcgtgtaacagaggagaacacgcatgatggagtggaacctggcggcagcgcaaaagatg

SEQ ID NO: 2416 - DNA, 103 bp, Artificial Sequence
  Synthetic Polynucleotide
taatacgactcactataggggcctttttctgcgttatccactccatggggaacagaggagaccccatatggtggataacaacctggcggcagcgcaaaagatg

SEQ ID NO: 2417 - DNA, 103 bp, Artificial Sequence
  Synthetic Polynucleotide
taatacgactcactatagggaccttgcctttttctgcgttatccactccaaacagaggagatggagtatgtaacgcagaaacctggcggcagcgcaaaagatg

SEQ ID NO: 2418 - DNA, 103 bp, Artificial Sequence
  Synthetic Polynucleotide
taatacgactcactatagggttgcaaccttgcctttttctgcgttatccaaacagaggagatggataatgcagaaaaagaacctggcggcagcgcaaaagatg

SEQ ID NO: 2419 - DNA, 103 bp, Artificial Sequence
  Synthetic Polynucleotide
taatacgactcactataggggtcatttgcaaccttgcctttttctgcgttaacagaggagaaacgcaatgaaaggcaagaacctggcggcagcgcaaaagatg

SEQ ID NO: 2420 - DNA, 103 bp, Artificial Sequence
  Synthetic Polynucleotide
taatacgactcactatagggtcgtcggaaaagatgttaattccaaccacgaacagaggagacgtggtatgaattaacataacctggcggcagcgcaaaagatg

SEQ ID NO: 2421 - DNA, 103 bp, Artificial Sequence
  Synthetic Polynucleotide
taatacgactcactataggggcgttgtcatttgcaaccttgcctttttctaacagaggagaagaaaaatgcaaggttgcaacctggcggcagcgcaaaagatg

SEQ ID NO: 2422 - DNA, 103 bp, Artificial Sequence
  Synthetic Polynucleotide
taatacgactcactatagggctgaagcgttgtcatttgcaaccttgccttaacagaggagaaaggcaatgttgcaaatgaacctggcggcagcgcaaaagatg

SEQ ID NO: 2423 - DNA, 103 bp, Artificial Sequence
  Synthetic Polynucleotide
taatacgactcactataggggtctgctgaagcgttgtcatttgcaaccttaacagaggagaaaggttatgaatgacaacaacctggcggcagcgcaaaagatg

SEQ ID NO: 2424 - DNA, 103 bp, Artificial Sequence
  Synthetic Polynucleotide
taatacgactcactatagggacaaagtctgctgaagcgttgtcatttgcaaacagaggagatgcaaaatgcaacgcttcaacctggcggcagcgcaaaagatg

SEQ ID NO: 2425 - DNA, 103 bp, Artificial Sequence
  Synthetic Polynucleotide
taatacgactcactatagggctgctacaaagtctgctgaagcgttgtcataacagaggagaatgacaatgcttcagcagaacctggcggcagcgcaaaagatg

SEQ ID NO: 2426 - DNA, 103 bp, Artificial Sequence
  Synthetic Polynucleotide
taatacgactcactatagggagggactgctacaaagtctgctgaagcgttaacagaggagaaacgctatggcagactttaacctggcggcagcgcaaaagatg

SEQ ID NO: 2427 - DNA, 103 bp, Artificial Sequence
  Synthetic Polynucleotide
taatacgactcactataggggctatagggactgctacaaagtctgctgaaaacagaggagattcagcatgctttgtagcaacctggcggcagcgcaaaagatg

SEQ ID NO: 2428 - DNA, 103 bp, Artificial Sequence
  Synthetic Polynucleotide
taatacgactcactataggggaagagctatagggactgctacaaagtctgaacagaggagacagactatgtagcagtccaacctggcggcagcgcaaaagatg

SEQ ID NO: 2429 - DNA, 103 bp, Artificial Sequence
  Synthetic Polynucleotide
taatacgactcactatagggttcaggaagagctatagggactgctacaaaaacagaggagatttgtaatggtccctataaacctggcggcagcgcaaaagatg

SEQ ID NO: 2430 - DNA, 103 bp, Artificial Sequence
  Synthetic Polynucleotide
taatacgactcactatagggtggttttcaggaagagctatagggactgctaacagaggagaagcagtatgtatagctctaacctggcggcagcgcaaaagatg

SEQ ID NO: 2431 - DNA, 103 bp, Artificial Sequence
  Synthetic Polynucleotide
taatacgactcactatagggcactttcgtcggaaaagatgttaattccaaaacagaggagattggaaatgacatcttttaacctggcggcagcgcaaaagatg

SEQ ID NO: 2432 - DNA, 103 bp, Artificial Sequence
  Synthetic Polynucleotide
taatacgactcactatagggttgtctggttttcaggaagagctatagggaaacagaggagatccctaatgctcttcctgaacctggcggcagcgcaaaagatg

SEQ ID NO: 2433 - DNA, 103 bp, Artificial Sequence
  Synthetic Polynucleotide
taatacgactcactatagggcacttttgtctggttttcaggaagagctataacagaggagaatagctatgcctgaaaacaacctggcggcagcgcaaaagatg

SEQ ID NO: 2434 - DNA, 103 bp, Artificial Sequence
  Synthetic Polynucleotide
taatacgactcactatagggaaggccacttttgtctggttttcaggaagaaacagaggagatcttccatgaaaccagacaacctggcggcagcgcaaaagatg

SEQ ID NO: 2435 - DNA, 103 bp, Artificial Sequence
  Synthetic Polynucleotide
taatacgactcactatagggaaaagaaggccacttttgtctggttttcagaacagaggagactgaaaatgagacaaaagaacctggcggcagcgcaaaagatg

SEQ ID NO: 2436 - DNA, 103 bp, Artificial Sequence
  Synthetic Polynucleotide
taatacgactcactataggggtcgtaaaagaaggccacttttgtctggttaacagaggagaaaccagatgaaagtggccaacctggcggcagcgcaaaagatg

SEQ ID NO: 2437 - DNA, 103 bp, Artificial Sequence
  Synthetic Polynucleotide
taatacgactcactataggggccctgtcgtaaaagaaggccacttttgtcaacagaggagagacaaaatgggccttcttaacctggcggcagcgcaaaagatg

SEQ ID NO: 2438 - DNA, 103 bp, Artificial Sequence
  Synthetic Polynucleotide
taatacgactcactatagggggaccgccctgtcgtaaaagaaggccacttaacagaggagaaagtggatgtcttttacgaacctggcggcagcgcaaaagatg

SEQ ID NO: 2439 - DNA, 103 bp, Artificial Sequence
  Synthetic Polynucleotide
taatacgactcactatagggcgctaggaccgccctgtcgtaaaagaaggcaacagaggagagccttcatgtacgacaggaacctggcggcagcgcaaaagatg

SEQ ID NO: 2440 - DNA, 103 bp, Artificial Sequence
  Synthetic Polynucleotide
taatacgactcactataggggcggacgctaggaccgccctgtcgtaaaagaacagaggagacttttaatgcagggcggtaacctggcggcagcgcaaaagatg

SEQ ID NO: 2441 - DNA, 103 bp, Artificial Sequence
  Synthetic Polynucleotide
taatacgactcactatagggcaagggcggacgctaggaccgccctgtcgtaacagaggagaacgacaatgcggtcctagaacctggcggcagcgcaaaagatg

SEQ ID NO: 2442 - DNA, 103 bp, Artificial Sequence
  Synthetic Polynucleotide
taatacgactcactataggggcgggaaccggaataataatagtgggaagaaacagaggagatcttccatgtattattataacctggcggcagcgcaaaagatg

SEQ ID NO: 2443 - DNA, 103 bp, Artificial Sequence
  Synthetic Polynucleotide
taatacgactcactatagggaatagcactttcgtcggaaaagatgttaataacagaggagaattaacatgttttccgacaacctggcggcagcgcaaaagatg

SEQ ID NO: 2444 - DNA, 103 bp, Artificial Sequence
  Synthetic Polynucleotide
taatacgactcactatagggattgacaagggcggacgctaggaccgccctaacagaggagaagggcgatgctagcgtccaacctggcggcagcgcaaaagatg

SEQ ID NO: 2445 - DNA, 103 bp, Artificial Sequence
  Synthetic Polynucleotide
taatacgactcactatagggtgagcattgacaagggcggacgctaggaccaacagaggagaggtcctatggtccgccctaacctggcggcagcgcaaaagatg

SEQ ID NO: 2446 - DNA, 103 bp, Artificial Sequence
  Synthetic Polynucleotide
taatacgactcactatagggggtcctgagcattgacaagggcggacgctaaacagaggagatagcgtatgcccttgtcaaacctggcggcagcgcaaaagatg

SEQ ID NO: 2447 - DNA, 103 bp, Artificial Sequence
  Synthetic Polynucleotide
taatacgactcactataggggttcaggtcctgagcattgacaagggcggaaacagaggagatccgccatggtcaatgctaacctggcggcagcgcaaaagatg

SEQ ID NO: 2448 - DNA, 103 bp, Artificial Sequence
  Synthetic Polynucleotide
taatacgactcactatagggtttgagttcaggtcctgagcattgacaaggaacagaggagaccttgtatgtgctcaggaaacctggcggcagcgcaaaagatg

SEQ ID NO: 2449 - DNA, 103 bp, Artificial Sequence
  Synthetic Polynucleotide
taatacgactcactatagggaaaagtttgagttcaggtcctgagcattgaaacagaggagatcaatgatgaggacctgaaacctggcggcagcgcaaaagatg

SEQ ID NO: 2450 - DNA, 103 bp, Artificial Sequence
  Synthetic Polynucleotide
taatacgactcactatagggaagagaaaagtttgagttcaggtcctgagcaacagaggagagctcagatgctgaactcaaacctggcggcagcgcaaaagatg

SEQ ID NO: 2451 - DNA, 103 bp, Artificial Sequence
  Synthetic Polynucleotide
taatacgactcactatagggtcttgaagagaaaagtttgagttcaggtccaacagaggagaggacctatgctcaaacttaacctggcggcagcgcaaaagatg

SEQ ID NO: 2452 - DNA, 103 bp, Artificial Sequence
  Synthetic Polynucleotide
taatacgactcactatagggctgcgtcttgaagagaaaagtttgagttcaaacagaggagatgaactatgacttttctcaacctggcggcagcgcaaaagatg

SEQ ID NO: 2453 - DNA, 103 bp, Artificial Sequence
  Synthetic Polynucleotide
taatacgactcactatagggatttgctgcgtcttgaagagaaaagtttgaaacagaggagatcaaacatgtctcttcaaaacctggcggcagcgcaaaagatg

SEQ ID NO: 2454 - DNA, 103 bp, Artificial Sequence
  Synthetic Polynucleotide
taatacgactcactatagggggcataatagcactttcgtcggaaaagatgaacagaggagacatcttatgcgacgaaagaacctggcggcagcgcaaaagatg

SEQ ID NO: 2455 - DNA, 103 bp, Artificial Sequence
  Synthetic Polynucleotide
taatacgactcactatagggatcacatttgctgcgtcttgaagagaaaagaacagaggagacttttcatgtcaagacgcaacctggcggcagcgcaaaagatg

SEQ ID NO: 2456 - DNA, 103 bp, Artificial Sequence
  Synthetic Polynucleotide
taatacgactcactatagggtgttcatcacatttgctgcgtcttgaagagaacagaggagactcttcatgacgcagcaaaacctggcggcagcgcaaaagatg

SEQ ID NO: 2457 - DNA, 103 bp, Artificial Sequence
  Synthetic Polynucleotide
taatacgactcactatagggtgcattgttcatcacatttgctgcgtcttgaacagaggagacaagacatggcaaatgtgaacctggcggcagcgcaaaagatg

SEQ ID NO: 2458 - DNA, 103 bp, Artificial Sequence
  Synthetic Polynucleotide
taatacgactcactatagggaaaagtgcattgttcatcacatttgctgcgaacagaggagacgcagcatgtgtgatgaaaacctggcggcagcgcaaaagatg

SEQ ID NO: 2459 - DNA, 103 bp, Artificial Sequence
  Synthetic Polynucleotide
taatacgactcactataggggtgtcaaaagtgcattgttcatcacatttgaacagaggagacaaatgatgtgaacaatgaacctggcggcagcgcaaaagatg

SEQ ID NO: 2460 - DNA, 103 bp, Artificial Sequence
  Synthetic Polynucleotide
taatacgactcactataggggagtggtgtcaaaagtgcattgttcatcacaacagaggagagtgatgatgaatgcacttaacctggcggcagcgcaaaagatg

SEQ ID NO: 2461 - DNA, 103 bp, Artificial Sequence
  Synthetic Polynucleotide
taatacgactcactatagggcttgggagtggtgtcaaaagtgcattgttcaacagaggagagaacaaatgacttttgacaacctggcggcagcgcaaaagatg

SEQ ID NO: 2462 - DNA, 103 bp, Artificial Sequence
  Synthetic Polynucleotide
taatacgactcactatagggggttgcttgggagtggtgtcaaaagtgcataacagaggagaatgcacatgtgacaccacaacctggcggcagcgcaaaagatg

SEQ ID NO: 2463 - DNA, 103 bp, Artificial Sequence
  Synthetic Polynucleotide
taatacgactcactatagggaagacggttgcttgggagtggtgtcaaaagaacagaggagacttttgatgccactcccaaacctggcggcagcgcaaaagatg

SEQ ID NO: 2464 - DNA, 103 bp, Artificial Sequence
  Synthetic Polynucleotide
taatacgactcactatagggtcatcaagacggttgcttgggagtggtgtcaacagaggagagacaccatgcccaagcaaaacctggcggcagcgcaaaagatg

SEQ ID NO: 2465 - DNA, 103 bp, Artificial Sequence
  Synthetic Polynucleotide
taatacgactcactatagggggggaggcataatagcactttcgtcggaaaaacagaggagatttccgatgaaagtgctaaacctggcggcagcgcaaaagatg

SEQ ID NO: 2466 - DNA, 103 bp, Artificial Sequence
  Synthetic Polynucleotide
taatacgactcactatagggttgagtcatcaagacggttgcttgggagtgaacagaggagacactccatggcaaccgtcaacctggcggcagcgcaaaagatg

SEQ ID NO: 2467 - DNA, 103 bp, Artificial Sequence
  Synthetic Polynucleotide
taatacgactcactatagggatatgttgagtcatcaagacggttgcttggaacagaggagaccaagcatgcgtcttgataacctggcggcagcgcaaaagatg

SEQ ID NO: 2468 - DNA, 103 bp, Artificial Sequence
  Synthetic Polynucleotide
taatacgactcactatagggagaccatatgttgagtcatcaagacggttgaacagaggagacaaccgatgtgatgactcaacctggcggcagcgcaaaagatg

SEQ ID NO: 2469 - DNA, 103 bp, Artificial Sequence
  Synthetic Polynucleotide
taatacgactcactatagggctgcaagaccatatgttgagtcatcaagacaacagaggagagtcttgatgactcaacataacctggcggcagcgcaaaagatg

SEQ ID NO: 2470 - DNA, 103 bp, Artificial Sequence
  Synthetic Polynucleotide
taatacgactcactatagggttgttctgcaagaccatatgttgagtcatcaacagaggagagatgacatgacatatggtaacctggcggcagcgcaaaagatg

SEQ ID NO: 2471 - DNA, 103 bp, Artificial Sequence
  Synthetic Polynucleotide
taatacgactcactatagggctgtgttgttctgcaagaccatatgttgagaacagaggagactcaacatgtggtcttgcaacctggcggcagcgcaaaagatg

SEQ ID NO: 2472 - DNA, 103 bp, Artificial Sequence
  Synthetic Polynucleotide
taatacgactcactataggggccatctgtgttgttctgcaagaccatatgaacagaggagacatatgatgttgcagaacaacctggcggcagcgcaaaagatg

SEQ ID NO: 2473 - DNA, 103 bp, Artificial Sequence
  Synthetic Polynucleotide
taatacgactcactatagggagaaagccatctgtgttgttctgcaagaccaacagaggagaggtcttatggaacaacacaacctggcggcagcgcaaaagatg

SEQ ID NO: 2474 - DNA, 103 bp, Artificial Sequence
  Synthetic Polynucleotide
taatacgactcactataggggggaaagaaagccatctgtgttgttctgcaaacagaggagatgcagaatgacacagatgaacctggcggcagcgcaaaagatg

SEQ ID NO: 2475 - DNA, 103 bp, Artificial Sequence
  Synthetic Polynucleotide
taatacgactcactatagggcagtagggaaagaaagccatctgtgttgttaacagaggagaaacaacatggatggctttaacctggcggcagcgcaaaagatg

SEQ ID NO: 2476 - DNA, 103 bp, Artificial Sequence
  Synthetic Polynucleotide
taatacgactcactatagggcaatcggggaggcataatagcactttcgtcaacagaggagagacgaaatggctattatgaacctggcggcagcgcaaaagatg

SEQ ID NO: 2477 - DNA, 103 bp, Artificial Sequence
  Synthetic Polynucleotide
taatacgactcactatagggtgtatcagtagggaaagaaagccatctgtgaacagaggagacacagaatgctttctttcaacctggcggcagcgcaaaagatg

SEQ ID NO: 2478 - DNA, 103 bp, Artificial Sequence
  Synthetic Polynucleotide
taatacgactcactatagggtgctttgtatcagtagggaaagaaagccataacagaggagaatggctatgtttccctacaacctggcggcagcgcaaaagatg

SEQ ID NO: 2479 - DNA, 103 bp, Artificial Sequence
  Synthetic Polynucleotide
taatacgactcactataggggtgtctgctttgtatcagtagggaaagaaaaacagaggagatttcttatgctactgataaacctggcggcagcgcaaaagatg

SEQ ID NO: 2480 - DNA, 103 bp, Artificial Sequence
  Synthetic Polynucleotide
taatacgactcactatagggggggggtgtctgctttgtatcagtagggaaaacagaggagattccctatggatacaaagaacctggcggcagcgcaaaagatg

SEQ ID NO: 2481 - DNA, 103 bp, Artificial Sequence
  Synthetic Polynucleotide
taatacgactcactatagggttgtaggggggtgtctgctttgtatcagtaaacagaggagatactgaatgaaagcagacaacctggcggcagcgcaaaagatg

SEQ ID NO: 2482 - DNA, 103 bp, Artificial Sequence
  Synthetic Polynucleotide
taatacgactcactatagggtggttttgtaggggggtgtctgctttgtataacagaggagaatacaaatgagacaccccaacctggcggcagcgcaaaagatg

SEQ ID NO: 2483 - DNA, 103 bp, Artificial Sequence
  Synthetic Polynucleotide
taatacgactcactatagggctgtttggttttgtaggggggtgtctgcttaacagaggagaaagcagatgcccccctacaacctggcggcagcgcaaaagatg

SEQ ID NO: 2484 - DNA, 103 bp, Artificial Sequence
  Synthetic Polynucleotide
taatacgactcactatagggcaatcctgtttggttttgtaggggggtgtcaacagaggagagacaccatgctacaaaacaacctggcggcagcgcaaaagatg

SEQ ID NO: 2485 - DNA, 103 bp, Artificial Sequence
  Synthetic Polynucleotide
taatacgactcactatagggaattccaatcctgtttggttttgtagggggaacagaggagaccccctatgaaaccaaacaacctggcggcagcgcaaaagatg

SEQ ID NO: 2486 - DNA, 103 bp, Artificial Sequence
  Synthetic Polynucleotide
taatacgactcactatagggaaggaaattccaatcctgtttggttttgtaaacagaggagatacaaaatgaaacaggataacctggcggcagcgcaaaagatg

SEQ ID NO: 2487 - DNA, 103 bp, Artificial Sequence
  Synthetic Polynucleotide
taatacgactcactatagggtcacacaatcggggaggcataatagcacttaacagaggagaaagtgcatgtatgcctccaacctggcggcagcgcaaaagatg

SEQ ID NO: 2488 - DNA, 103 bp, Artificial Sequence
  Synthetic Polynucleotide
taatacgactcactatagggaacataaggaaattccaatcctgtttggttaacagaggagaaaccaaatgggattggaaaacctggcggcagcgcaaaagatg

SEQ ID NO: 2489 - DNA, 103 bp, Artificial Sequence
  Synthetic Polynucleotide
taatacgactcactataggggagaaaacataaggaaattccaatcctgttaacagaggagaaacaggatgggaatttccaacctggcggcagcgcaaaagatg

SEQ ID NO: 2490 - DNA, 103 bp, Artificial Sequence
  Synthetic Polynucleotide
taatacgactcactatagggaaaaggagaaaacataaggaaattccaatcaacagaggagagattggatgttccttatgaacctggcggcagcgcaaaagatg

SEQ ID NO: 2491 - DNA, 103 bp, Artificial Sequence
  Synthetic Polynucleotide
taatacgactcactatagggtaagtaaaaggagaaaacataaggaaattcaacagaggagagaatttatgtatgttttcaacctggcggcagcgcaaaagatg

SEQ ID NO: 2492 - DNA, 103 bp, Artificial Sequence
  Synthetic Polynucleotide
taatacgactcactatagggtgtaataagtaaaaggagaaaacataaggaaacagaggagatccttaatgtttctccttaacctggcggcagcgcaaaagatg

SEQ ID NO: 2493 - DNA, 103 bp, Artificial Sequence
  Synthetic Polynucleotide
taatacgactcactatagggacacttgtaataagtaaaaggagaaaacataacagaggagaatgtttatgccttttactaacctggcggcagcgcaaaagatg

SEQ ID NO: 2494 - DNA, 103 bp, Artificial Sequence
  Synthetic Polynucleotide
taatacgactcactatagggagatcacacttgtaataagtaaaaggagaaaacagaggagattctccatgtacttattaaacctggcggcagcgcaaaagatg

SEQ ID NO: 2495 - DNA, 103 bp, Artificial Sequence
  Synthetic Polynucleotide
taatacgactcactatagggcctctagatcacacttgtaataagtaaaagaacagaggagacttttaatgattacaagtaacctggcggcagcgcaaaagatg

SEQ ID NO: 2496 - DNA, 103 bp, Artificial Sequence
  Synthetic Polynucleotide
taatacgactcactatagggagtaacctctagatcacacttgtaataagtaacagaggagaacttatatgaagtgtgataacctggcggcagcgcaaaagatg

SEQ ID NO: 2497 - DNA, 103 bp, Artificial Sequence
  Synthetic Polynucleotide
taatacgactcactataggggacagagtaacctctagatcacacttgtaaaacagaggagattacaaatgtgatctagaaacctggcggcagcgcaaaagatg

SEQ ID NO: 2498 - DNA, 103 bp, Artificial Sequence
  Synthetic Polynucleotide
taatacgactcactatagggaagcatcacacaatcggggaggcataatagaacagaggagactattaatgctccccgataacctggcggcagcgcaaaagatg

SEQ ID NO: 2499 - DNA, 103 bp, Artificial Sequence
  Synthetic Polynucleotide
taatacgactcactatagggtcaaagacagagtaacctctagatcacactaacagaggagaagtgtgatgtagaggttaaacctggcggcagcgcaaaagatg

SEQ ID NO: 2500 - DNA, 103 bp, Artificial Sequence
  Synthetic Polynucleotide
taatacgactcactatagggtgagttcaaagacagagtaacctctagatcaacagaggagagatctaatggttactctgaacctggcggcagcgcaaaagatg

SEQ ID NO: 2501 - DNA, 103 bp, Artificial Sequence
  Synthetic Polynucleotide
taatacgactcactatagggtcacttgagttcaaagacagagtaacctctaacagaggagaagaggtatgtctgtctttaacctggcggcagcgcaaaagatg

SEQ ID NO: 2502 - DNA, 103 bp, Artificial Sequence
  Synthetic Polynucleotide
taatacgactcactatagggtagcatcacttgagttcaaagacagagtaaaacagaggagattactcatgctttgaactaacctggcggcagcgcaaaagatg

SEQ ID NO: 2503 - DNA, 103 bp, Artificial Sequence
  Synthetic Polynucleotide
taatacgactcactatagggacctatagcatcacttgagttcaaagacagaacagaggagactgtctatgaactcaagtaacctggcggcagcgcaaaagatg

SEQ ID NO: 2504 - DNA, 103 bp, Artificial Sequence
  Synthetic Polynucleotide
taatacgactcactatagggactgaacctatagcatcacttgagttcaaaaacagaggagatttgaaatgaagtgatgcaacctggcggcagcgcaaaagatg

SEQ ID NO: 2505 - DNA, 103 bp, Artificial Sequence
  Synthetic Polynucleotide
taatacgactcactataggggcactactgaacctatagcatcacttgagtaacagaggagaactcaaatgatgctatagaacctggcggcagcgcaaaagatg

SEQ ID NO: 2506 - DNA, 103 bp, Artificial Sequence
  Synthetic Polynucleotide
taatacgactcactataggggtagcgcactactgaacctatagcatcactaacagaggagaagtgatatgataggttcaaacctggcggcagcgcaaaagatg

SEQ ID NO: 2507 - DNA, 103 bp, Artificial Sequence
  Synthetic Polynucleotide
taatacgactcactatagggggggtgtagcgcactactgaacctatagcaaacagaggagatgctatatgttcagtagtaacctggcggcagcgcaaaagatg

SEQ ID NO: 2508 - DNA, 103 bp, Artificial Sequence
  Synthetic Polynucleotide
taatacgactcactatagggcacatggggtgtagcgcactactgaacctaaacagaggagataggttatgtagtgcgctaacctggcggcagcgcaaaagatg

SEQ ID NO: 2509 - DNA, 103 bp, Artificial Sequence
  Synthetic Polynucleotide
taatacgactcactataggggcagaaagcatcacacaatcggggaggcataacagaggagaatgcctatgcgattgtgtaacctggcggcagcgcaaaagatg

SEQ ID NO: 2510 - DNA, 103 bp, Artificial Sequence
  Synthetic Polynucleotide
taatacgactcactatagggcgcgccacatggggtgtagcgcactactgaaacagaggagatcagtaatgcgctacaccaacctggcggcagcgcaaaagatg

SEQ ID NO: 2511 - DNA, 103 bp, Artificial Sequence
  Synthetic Polynucleotide
taatacgactcactatagggactggcgcgccacatggggtgtagcgcactaacagaggagaagtgcgatgcaccccatgaacctggcggcagcgcaaaagatg

SEQ ID NO: 2512 - DNA, 103 bp, Artificial Sequence
  Synthetic Polynucleotide
taatacgactcactataggggatccactggcgcgccacatggggtgtagcaacagaggagagctacaatgcatgtggcgaacctggcggcagcgcaaaagatg

SEQ ID NO: 2513 - DNA, 103 bp, Artificial Sequence
  Synthetic Polynucleotide
taatacgactcactatagggagacagatccactggcgcgccacatggggtaacagaggagaaccccaatgggcgcgccaaacctggcggcagcgcaaaagatg

SEQ ID NO: 2514 - DNA, 103 bp, Artificial Sequence
  Synthetic Polynucleotide
taatacgactcactatagggtgttcagacagatccactggcgcgccacataacagaggagaatgtggatggccagtggaaacctggcggcagcgcaaaagatg

SEQ ID NO: 2515 - DNA, 103 bp, Artificial Sequence
  Synthetic Polynucleotide
taatacgactcactatagggtagtttgttcagacagatccactggcgcgcaacagaggagagcgcgcatgtggatctgtaacctggcggcagcgcaaaagatg

SEQ ID NO: 2516 - DNA, 103 bp, Artificial Sequence
  Synthetic Polynucleotide
taatacgactcactatagggggggatagtttgttcagacagatccactggaacagaggagaccagtgatgctgtctgaaaacctggcggcagcgcaaaagatg

SEQ ID NO: 2517 - DNA, 103 bp, Artificial Sequence
  Synthetic Polynucleotide
taatacgactcactataggggtgtaggggatagtttgttcagacagatccaacagaggagaggatctatgtgaacaaacaacctggcggcagcgcaaaagatg

SEQ ID NO: 2518 - DNA, 103 bp, Artificial Sequence
  Synthetic Polynucleotide
taatacgactcactatagggatggagtgtaggggatagtttgttcagacaaacagaggagatgtctgatgaaactatccaacctggcggcagcgcaaaagatg

SEQ ID NO: 2519 - DNA, 103 bp, Artificial Sequence
  Synthetic Polynucleotide
taatacgactcactatagggcaatgatggagtgtaggggatagtttgttcaacagaggagagaacaaatgatcccctacaacctggcggcagcgcaaaagatg

SEQ ID NO: 2520 - DNA, 103 bp, Artificial Sequence
  Synthetic Polynucleotide
taatacgactcactataggggcagggcagaaagcatcacacaatcggggaaacagaggagatccccgatggtgtgatgcaacctggcggcagcgcaaaagatg

SEQ ID NO: 2521 - DNA, 103 bp, Artificial Sequence
  Synthetic Polynucleotide
taatacgactcactatagggtctgacaatgatggagtgtaggggatagttaacagaggagaaactatatgctacactccaacctggcggcagcgcaaaagatg

SEQ ID NO: 2522 - DNA, 103 bp, Artificial Sequence
  Synthetic Polynucleotide
taatacgactcactataggggggtatctgacaatgatggagtgtaggggaaacagaggagatcccctatgctccatcataacctggcggcagcgcaaaagatg

SEQ ID NO: 2523 - DNA, 103 bp, Artificial Sequence
  Synthetic Polynucleotide
taatacgactcactatagggatcacgggtatctgacaatgatggagtgtaaacagaggagatacactatgtcattgtcaaacctggcggcagcgcaaaagatg

SEQ ID NO: 2524 - DNA, 103 bp, Artificial Sequence
  Synthetic Polynucleotide
taatacgactcactatagggtgtggatcacgggtatctgacaatgatggaaacagaggagatccatcatggtcagatacaacctggcggcagcgcaaaagatg

SEQ ID NO: 2525 - DNA, 103 bp, Artificial Sequence
  Synthetic Polynucleotide
taatacgactcactatagggacatatgtggatcacgggtatctgacaatgaacagaggagacattgtatgatacccgtgaacctggcggcagcgcaaaagatg

SEQ ID NO: 2526 - DNA, 103 bp, Artificial Sequence
  Synthetic Polynucleotide
taatacgactcactatagggaacccacatatgtggatcacgggtatctgaaacagaggagatcagatatgcgtgatccaaacctggcggcagcgcaaaagatg

SEQ ID NO: 2527 - DNA, 103 bp, Artificial Sequence
  Synthetic Polynucleotide
taatacgactcactatagggccaacaacccacatatgtggatcacgggtaaacagaggagatacccgatgtccacatataacctggcggcagcgcaaaagatg

SEQ ID NO: 2528 - DNA, 103 bp, Artificial Sequence
  Synthetic Polynucleotide
taatacgactcactatagggcgggtccaacaacccacatatgtggatcacaacagaggagagtgatcatgatatgtgggaacctggcggcagcgcaaaagatg

SEQ ID NO: 2529 - DNA, 103 bp, Artificial Sequence
  Synthetic Polynucleotide
taatacgactcactatagggagcaccgggtccaacaacccacatatgtggaacagaggagaccacatatgtgggttgttaacctggcggcagcgcaaaagatg

SEQ ID NO: 2530 - DNA, 103 bp, Artificial Sequence
  Synthetic Polynucleotide
taatacgactcactatagggttagtagcaccgggtccaacaacccacataaacagaggagatatgtgatgtgttggaccaacctggcggcagcgcaaaagatg

SEQ ID NO: 2531 - DNA, 103 bp, Artificial Sequence
  Synthetic Polynucleotide
taatacgactcactataggggcccagcagggcagaaagcatcacacaatcaacagaggagagattgtatgatgctttctaacctggcggcagcgcaaaagatg

SEQ ID NO: 2532 - DNA, 103 bp, Artificial Sequence
  Synthetic Polynucleotide
taatacgactcactatagggtttgattagtagcaccgggtccaacaacccaacagaggagagggttgatggacccggtgaacctggcggcagcgcaaaagatg

SEQ ID NO: 2533 - DNA, 103 bp, Artificial Sequence
  Synthetic Polynucleotide
taatacgactcactatagggagaaatttgattagtagcaccgggtccaacaacagaggagagttggaatgggtgctactaacctggcggcagcgcaaaagatg

SEQ ID NO: 2534 - DNA, 103 bp, Artificial Sequence
  Synthetic Polynucleotide
taatacgactcactatagggacaaaagaaatttgattagtagcaccgggtaacagaggagaacccggatgtactaatcaaacctggcggcagcgcaaaagatg

SEQ ID NO: 2535 - DNA, 103 bp, Artificial Sequence
  Synthetic Polynucleotide
taatacgactcactataggggaatgacaaaagaaatttgattagtagcacaacagaggagagtgctaatgatcaaatttaacctggcggcagcgcaaaagatg

SEQ ID NO: 2536 - DNA, 103 bp, Artificial Sequence
  Synthetic Polynucleotide
taatacgactcactataggggtaaggaatgacaaaagaaatttgattagtaacagaggagaactaatatgatttcttttaacctggcggcagcgcaaaagatg

SEQ ID NO: 2537 - DNA, 103 bp, Artificial Sequence
  Synthetic Polynucleotide
taatacgactcactataggggaagtgtaaggaatgacaaaagaaatttgaaacagaggagatcaaatatgttttgtcataacctggcggcagcgcaaaagatg

SEQ ID NO: 2538 - DNA, 103 bp, Artificial Sequence
  Synthetic Polynucleotide
taatacgactcactatagggaaggagaagtgtaaggaatgacaaaagaaaaacagaggagatttcttatgtcattccttaacctggcggcagcgcaaaagatg

SEQ ID NO: 2539 - DNA, 103 bp, Artificial Sequence
  Synthetic Polynucleotide
taatacgactcactatagggggacaaaggagaagtgtaaggaatgacaaaaacagaggagatttgtcatgccttacactaacctggcggcagcgcaaaagatg

SEQ ID NO: 2540 - DNA, 103 bp, Artificial Sequence
  Synthetic Polynucleotide
taatacgactcactatagggaatacggacaaaggagaagtgtaaggaatgaacagaggagacattccatgcacttctccaacctggcggcagcgcaaaagatg

SEQ ID NO: 2541 - DNA, 103 bp, Artificial Sequence
  Synthetic Polynucleotide
taatacgactcactatagggctggtaatacggacaaaggagaagtgtaagaacagaggagacttacaatgctcctttgtaacctggcggcagcgcaaaagatg

SEQ ID NO: 2542 - DNA, 103 bp, Artificial Sequence
  Synthetic Polynucleotide
taatacgactcactataggggctccgcccagcagggcagaaagcatcacaaacagaggagatgtgatatgttctgccctaacctggcggcagcgcaaaagatg

SEQ ID NO: 2543 - DNA, 103 bp, Artificial Sequence
  Synthetic Polynucleotide
taatacgactcactatagggaacagctggtaatacggacaaaggagaagtaacagaggagaacttctatgttgtccgtaaacctggcggcagcgcaaaagatg

SEQ ID NO: 2544 - DNA, 103 bp, Artificial Sequence
  Synthetic Polynucleotide
taatacgactcactatagggaaccaaacagctggtaatacggacaaaggaaacagaggagatcctttatgcgtattaccaacctggcggcagcgcaaaagatg

SEQ ID NO: 2545 - DNA, 103 bp, Artificial Sequence
  Synthetic Polynucleotide
taatacgactcactatagggcattaaaccaaacagctggtaatacggacaaacagaggagatgtccgatgtaccagctgaacctggcggcagcgcaaaagatg

SEQ ID NO: 2546 - DNA, 103 bp, Artificial Sequence
  Synthetic Polynucleotide
taatacgactcactatagggaaacccattaaaccaaacagctggtaatacaacagaggagagtattaatggctgtttggaacctggcggcagcgcaaaagatg

SEQ ID NO: 2547 - DNA, 103 bp, Artificial Sequence
  Synthetic Polynucleotide
taatacgactcactatagggtcagaaaacccattaaaccaaacagctggtaacagaggagaaccagcatgttggtttaaaacctggcggcagcgcaaaagatg

SEQ ID NO: 2548 - DNA, 103 bp, Artificial Sequence
  Synthetic Polynucleotide
taatacgactcactatagggcaaaatcagaaaacccattaaaccaaacagaacagaggagactgtttatgttaatgggtaacctggcggcagcgcaaaagatg

SEQ ID NO: 2549 - DNA, 103 bp, Artificial Sequence
  Synthetic Polynucleotide
taatacgactcactataggggttgtcaaaatcagaaaacccattaaaccaaacagaggagatggtttatggggttttctaacctggcggcagcgcaaaagatg

SEQ ID NO: 2550 - DNA, 103 bp, Artificial Sequence
  Synthetic Polynucleotide
taatacgactcactataggggttttgttgtcaaaatcagaaaacccattaaacagaggagataatggatgttctgatttaacctggcggcagcgcaaaagatg

SEQ ID NO: 2551 - DNA, 103 bp, Artificial Sequence
  Synthetic Polynucleotide
taatacgactcactatagggaccgtgttttgttgtcaaaatcagaaaaccaacagaggagaggttttatgattttgacaaacctggcggcagcgcaaaagatg

SEQ ID NO: 2552 - DNA, 103 bp, Artificial Sequence
  Synthetic Polynucleotide
taatacgactcactatagggaccaaaccgtgttttgttgtcaaaatcagaaacagaggagatctgatatggacaacaaaaacctggcggcagcgcaaaagatg

SEQ ID NO: 2553 - DNA, 103 bp, Artificial Sequence
  Synthetic Polynucleotide
taatacgactcactatagggctaaggcgggaaccggaataataatagtggaacagaggagaccactaatgttattccggaacctggcggcagcgcaaaagatg

SEQ ID NO: 2554 - DNA, 103 bp, Artificial Sequence
  Synthetic Polynucleotide
taatacgactcactatagggaggacgctccgcccagcagggcagaaagcaaacagaggagatgctttatgccctgctggaacctggcggcagcgcaaaagatg

SEQ ID NO: 2555 - DNA, 103 bp, Artificial Sequence
  Synthetic Polynucleotide
taatacgactcactataggggcaacaccaaaccgtgttttgttgtcaaaaaacagaggagattttgaatgcaaaacacgaacctggcggcagcgcaaaagatg

SEQ ID NO: 2556 - DNA, 103 bp, Artificial Sequence
  Synthetic Polynucleotide
taatacgactcactatagggttggtgcaacaccaaaccgtgttttgttgtaacagaggagaacaacaatgcacggtttgaacctggcggcagcgcaaaagatg

SEQ ID NO: 2557 - DNA, 103 bp, Artificial Sequence
  Synthetic Polynucleotide
taatacgactcactatagggagcgtttggtgcaacaccaaaccgtgttttaacagaggagaaaaacaatgtttggtgttaacctggcggcagcgcaaaagatg

SEQ ID NO: 2558 - DNA, 103 bp, Artificial Sequence
  Synthetic Polynucleotide
taatacgactcactatagggaagtcagcgtttggtgcaacaccaaaccgtaacagaggagaacggttatgtgttgcaccaacctggcggcagcgcaaaagatg

SEQ ID NO: 2559 - DNA, 103 bp, Artificial Sequence
  Synthetic Polynucleotide
taatacgactcactataggggaccaaagtcagcgtttggtgcaacaccaaaacagaggagattggtgatgcaccaaacgaacctggcggcagcgcaaaagatg

SEQ ID NO: 2560 - DNA, 103 bp, Artificial Sequence
  Synthetic Polynucleotide
taatacgactcactatagggcaatcgaccaaagtcagcgtttggtgcaacaacagaggagagttgcaatgaacgctgacaacctggcggcagcgcaaaagatg

SEQ ID NO: 2561 - DNA, 103 bp, Artificial Sequence
  Synthetic Polynucleotide
taatacgactcactatagggacgaacaatcgaccaaagtcagcgtttggtaacagaggagaaccaaaatgtgactttggaacctggcggcagcgcaaaagatg

SEQ ID NO: 2562 - DNA, 103 bp, Artificial Sequence
  Synthetic Polynucleotide
taatacgactcactatagggcctgaacgaacaatcgaccaaagtcagcgtaacagaggagaacgctgatgttggtcgataacctggcggcagcgcaaaagatg

SEQ ID NO: 2563 - DNA, 103 bp, Artificial Sequence
  Synthetic Polynucleotide
taatacgactcactatagggtgcaccctgaacgaacaatcgaccaaagtcaacagaggagagactttatgcgattgttcaacctggcggcagcgcaaaagatg

SEQ ID NO: 2564 - DNA, 103 bp, Artificial Sequence
  Synthetic Polynucleotide
taatacgactcactatagggctgtctgcaccctgaacgaacaatcgaccaaacagaggagatggtcgatggttcgttcaaacctggcggcagcgcaaaagatg

SEQ ID NO: 2565 - DNA, 103 bp, Artificial Sequence
  Synthetic Polynucleotide
taatacgactcactatagggacccgaggacgctccgcccagcagggcagaaacagaggagatctgccatgctgggcggaaacctggcggcagcgcaaaagatg

SEQ ID NO: 2566 - DNA, 103 bp, Artificial Sequence
  Synthetic Polynucleotide
taatacgactcactatagggagaacctgtctgcaccctgaacgaacaatcaacagaggagagattgtatgttcagggtgaacctggcggcagcgcaaaagatg

SEQ ID NO: 2567 - DNA, 103 bp, Artificial Sequence
  Synthetic Polynucleotide
taatacgactcactataggggaccgagaacctgtctgcaccctgaacgaaaacagaggagattcgttatgggtgcagacaacctggcggcagcgcaaaagatg

SEQ ID NO: 2568 - DNA, 103 bp, Artificial Sequence
  Synthetic Polynucleotide
taatacgactcactatagggtagtggaccgagaacctgtctgcaccctgaaacagaggagatcagggatgagacaggttaacctggcggcagcgcaaaagatg

SEQ ID NO: 2569 - DNA, 103 bp, Artificial Sequence
  Synthetic Polynucleotide
taatacgactcactatagggaccggtagtggaccgagaacctgtctgcacaacagaggagagtgcagatgggttctcggaacctggcggcagcgcaaaagatg

SEQ ID NO: 2570 - DNA, 103 bp, Artificial Sequence
  Synthetic Polynucleotide
taatacgactcactatagggtttgtaccggtagtggaccgagaacctgtcaacagaggagagacaggatgtcggtccacaacctggcggcagcgcaaaagatg

SEQ ID NO: 2571 - DNA, 103 bp, Artificial Sequence
  Synthetic Polynucleotide
taatacgactcactatagggatctttttgtaccggtagtggaccgagaacaacagaggagagttctcatgccactaccgaacctggcggcagcgcaaaagatg

SEQ ID NO: 2572 - DNA, 103 bp, Artificial Sequence
  Synthetic Polynucleotide
taatacgactcactatagggctctcatctttttgtaccggtagtggaccgaacagaggagacggtccatgaccggtacaaacctggcggcagcgcaaaagatg

SEQ ID NO: 2573 - DNA, 103 bp, Artificial Sequence
  Synthetic Polynucleotide
taatacgactcactatagggaaacactctcatctttttgtaccggtagtgaacagaggagacactacatgtacaaaaagaacctggcggcagcgcaaaagatg

SEQ ID NO: 2574 - DNA, 103 bp, Artificial Sequence
  Synthetic Polynucleotide
taatacgactcactatagggggacaaaacactctcatctttttgtaccggaacagaggagaccggtaatgaaagatgagaacctggcggcagcgcaaaagatg

SEQ ID NO: 2575 - DNA, 103 bp, Artificial Sequence
  Synthetic Polynucleotide
taatacgactcactataggggtcttggacaaaacactctcatctttttgtaacagaggagaacaaaaatgtgagagtgtaacctggcggcagcgcaaaagatg

SEQ ID NO: 2576 - DNA, 103 bp, Artificial Sequence
  Synthetic Polynucleotide
taatacgactcactatagggtctcaacccgaggacgctccgcccagcaggaacagaggagacctgctatgcggagcgtcaacctggcggcagcgcaaaagatg

SEQ ID NO: 2577 - DNA, 103 bp, Artificial Sequence
  Synthetic Polynucleotide
taatacgactcactatagggagttggtcttggacaaaacactctcatcttaacagaggagaaagatgatggtgttttgtaacctggcggcagcgcaaaagatg

SEQ ID NO: 2578 - DNA, 103 bp, Artificial Sequence
  Synthetic Polynucleotide
taatacgactcactatagggaacacagttggtcttggacaaaacactctcaacagaggagagagagtatgttgtccaagaacctggcggcagcgcaaaagatg

SEQ ID NO: 2579 - DNA, 103 bp, Artificial Sequence
  Synthetic Polynucleotide
taatacgactcactatagggggaaaaacacagttggtcttggacaaaacaaacagaggagatgttttatgcaagaccaaaacctggcggcagcgcaaaagatg

SEQ ID NO: 2580 - DNA, 103 bp, Artificial Sequence
  Synthetic Polynucleotide
taatacgactcactatagggccacgggaaaaacacagttggtcttggacaaacagaggagatgtccaatgccaactgtgaacctggcggcagcgcaaaagatg

SEQ ID NO: 2581 - DNA, 103 bp, Artificial Sequence
  Synthetic Polynucleotide
taatacgactcactataggggcgggccacgggaaaaacacagttggtcttaacagaggagaaagaccatgtgtgtttttaacctggcggcagcgcaaaagatg

SEQ ID NO: 2582 - DNA, 103 bp, Artificial Sequence
  Synthetic Polynucleotide
taatacgactcactatagggagttggcgggccacgggaaaaacacagttgaacagaggagacaactgatgttttcccgtaacctggcggcagcgcaaaagatg

SEQ ID NO: 2583 - DNA, 103 bp, Artificial Sequence
  Synthetic Polynucleotide
taatacgactcactatagggcactgagttggcgggccacgggaaaaacacaacagaggagagtgtttatgccgtggcccaacctggcggcagcgcaaaagatg

SEQ ID NO: 2584 - DNA, 103 bp, Artificial Sequence
  Synthetic Polynucleotide
taatacgactcactatagggtttgacactgagttggcgggccacgggaaaaacagaggagatttcccatggcccgccaaaacctggcggcagcgcaaaagatg

SEQ ID NO: 2585 - DNA, 103 bp, Artificial Sequence
  Synthetic Polynucleotide
taatacgactcactatagggtgatctttgacactgagttggcgggccacgaacagaggagacgtggcatgccaactcagaacctggcggcagcgcaaaagatg

SEQ ID NO: 2586 - DNA, 103 bp, Artificial Sequence
  Synthetic Polynucleotide
taatacgactcactatagggagacttgatctttgacactgagttggcgggaacagaggagacccgccatgtcagtgtcaaacctggcggcagcgcaaaagatg

SEQ ID NO: 2587 - DNA, 103 bp, Artificial Sequence
  Synthetic Polynucleotide
taatacgactcactatagggaggtttctcaacccgaggacgctccgcccaaacagaggagatgggcgatgcgtcctcggaacctggcggcagcgcaaaagatg

SEQ ID NO: 2588 - DNA, 103 bp, Artificial Sequence
  Synthetic Polynucleotide
taatacgactcactatagggcgaacagacttgatctttgacactgagttgaacagaggagacaactcatggtcaaagataacctggcggcagcgcaaaagatg

SEQ ID NO: 2589 - DNA, 103 bp, Artificial Sequence
  Synthetic Polynucleotide
taatacgactcactatagggtcgggcgaacagacttgatctttgacactgaacagaggagacagtgtatgagatcaagtaacctggcggcagcgcaaaagatg

SEQ ID NO: 2590 - DNA, 103 bp, Artificial Sequence
  Synthetic Polynucleotide
taatacgactcactatagggaggggtcgggcgaacagacttgatctttgaaacagaggagatcaaagatgaagtctgttaacctggcggcagcgcaaaagatg

SEQ ID NO: 2591 - DNA, 103 bp, Artificial Sequence
  Synthetic Polynucleotide
taatacgactcactatagggaaaacaggggtcgggcgaacagacttgatcaacagaggagagatcaaatgtgttcgcccaacctggcggcagcgcaaaagatg

SEQ ID NO: 2592 - DNA, 103 bp, Artificial Sequence
  Synthetic Polynucleotide
taatacgactcactataggggctccaaaacaggggtcgggcgaacagactaacagaggagaagtctgatggcccgacccaacctggcggcagcgcaaaagatg

SEQ ID NO: 2593 - DNA, 103 bp, Artificial Sequence
  Synthetic Polynucleotide
taatacgactcactatagggttgaagctccaaaacaggggtcgggcgaacaacagaggagagttcgcatgacccctgttaacctggcggcagcgcaaaagatg

SEQ ID NO: 2594 - DNA, 103 bp, Artificial Sequence
  Synthetic Polynucleotide
taatacgactcactataggggggttttgaagctccaaaacaggggtcgggaacagaggagacccgacatgtgttttggaaacctggcggcagcgcaaaagatg

SEQ ID NO: 2595 - DNA, 103 bp, Artificial Sequence
  Synthetic Polynucleotide
taatacgactcactatagggaaatggggttttgaagctccaaaacaggggaacagaggagacccctgatgtggagcttcaacctggcggcagcgcaaaagatg

SEQ ID NO: 2596 - DNA, 103 bp, Artificial Sequence
  Synthetic Polynucleotide
taatacgactcactatagggcattgaaatggggttttgaagctccaaaacaacagaggagagttttgatgcttcaaaacaacctggcggcagcgcaaaagatg

SEQ ID NO: 2597 - DNA, 103 bp, Artificial Sequence
  Synthetic Polynucleotide
taatacgactcactatagggctatacattgaaatggggttttgaagctccaacagaggagaggagctatgaaaccccataacctggcggcagcgcaaaagatg

SEQ ID NO: 2598 - DNA, 103 bp, Artificial Sequence
  Synthetic Polynucleotide
taatacgactcactatagggattcaaggtttctcaacccgaggacgctccaacagaggagaggagcgatgtcgggttgaaacctggcggcagcgcaaaagatg

SEQ ID NO: 2599 - DNA, 103 bp, Artificial Sequence
  Synthetic Polynucleotide
taatacgactcactatagggcaactctatacattgaaatggggttttgaaaacagaggagattcaaaatgccatttcaaaacctggcggcagcgcaaaagatg

SEQ ID NO: 2600 - DNA, 103 bp, Artificial Sequence
  Synthetic Polynucleotide
taatacgactcactatagggaagatcaactctatacattgaaatggggttaacagaggagaaaccccatgtcaatgtataacctggcggcagcgcaaaagatg

SEQ ID NO: 2601 - DNA, 103 bp, Artificial Sequence
  Synthetic Polynucleotide
taatacgactcactatagggatgaaaagatcaactctatacattgaaatgaacagaggagacatttcatggtatagagtaacctggcggcagcgcaaaagatg

SEQ ID NO: 2602 - DNA, 103 bp, Artificial Sequence
  Synthetic Polynucleotide
taatacgactcactatagggaatttatgaaaagatcaactctatacattgaacagaggagacaatgtatggagttgatcaacctggcggcagcgcaaaagatg

SEQ ID NO: 2603 - DNA, 103 bp, Artificial Sequence
  Synthetic Polynucleotide
taatacgactcactatagggtgaaaaatttatgaaaagatcaactctataaacagaggagatatagaatggatcttttcaacctggcggcagcgcaaaagatg

SEQ ID NO: 2604 - DNA, 103 bp, Artificial Sequence
  Synthetic Polynucleotide
taatacgactcactatagggtcatctgaaaaatttatgaaaagatcaactaacagaggagaagttgaatgtttcataaaaacctggcggcagcgcaaaagatg

SEQ ID NO: 2605 - DNA, 103 bp, Artificial Sequence
  Synthetic Polynucleotide
taatacgactcactatagggtgatttcatctgaaaaatttatgaaaagataacagaggagaatctttatgtaaatttttaacctggcggcagcgcaaaagatg

SEQ ID NO: 2606 - DNA, 103 bp, Artificial Sequence
  Synthetic Polynucleotide
taatacgactcactatagggttggatgatttcatctgaaaaatttatgaaaacagaggagattcataatgttttcagataacctggcggcagcgcaaaagatg

SEQ ID NO: 2607 - DNA, 103 bp, Artificial Sequence
  Synthetic Polynucleotide
taatacgactcactataggggtaaattggatgatttcatctgaaaaatttaacagaggagaaaatttatgagatgaaataacctggcggcagcgcaaaagatg

SEQ ID NO: 2608 - DNA, 103 bp, Artificial Sequence
  Synthetic Polynucleotide
taatacgactcactatagggtgtaagtaaattggatgatttcatctgaaaaacagaggagatttcagatgaaatcatccaacctggcggcagcgcaaaagatg

SEQ ID NO: 2609 - DNA, 103 bp, Artificial Sequence
  Synthetic Polynucleotide
taatacgactcactatagggaaaagattcaaggtttctcaacccgaggacaacagaggagagtcctcatgttgagaaacaacctggcggcagcgcaaaagatg

SEQ ID NO: 2610 - DNA, 103 bp, Artificial Sequence
  Synthetic Polynucleotide
taatacgactcactatagggcactttgtaagtaaattggatgatttcatcaacagaggagagatgaaatgatccaatttaacctggcggcagcgcaaaagatg

SEQ ID NO: 2611 - DNA, 103 bp, Artificial Sequence
  Synthetic Polynucleotide
taatacgactcactatagggccatgcactttgtaagtaaattggatgattaacagaggagaaatcatatgatttacttaaacctggcggcagcgcaaaagatg

SEQ ID NO: 2612 - DNA, 103 bp, Artificial Sequence
  Synthetic Polynucleotide
taatacgactcactatagggttctgccatgcactttgtaagtaaattggaaacagaggagatccaatatgcttacaaagaacctggcggcagcgcaaaagatg

SEQ ID NO: 2613 - DNA, 103 bp, Artificial Sequence
  Synthetic Polynucleotide
taatacgactcactatagggaactgttctgccatgcactttgtaagtaaaaacagaggagatttactatgaaagtgcataacctggcggcagcgcaaaagatg

SEQ ID NO: 2614 - DNA, 103 bp, Artificial Sequence
  Synthetic Polynucleotide
taatacgactcactatagggtggcaaactgttctgccatgcactttgtaaaacagaggagattacaaatggcatggcagaacctggcggcagcgcaaaagatg

SEQ ID NO: 2615 - DNA, 103 bp, Artificial Sequence
  Synthetic Polynucleotide
taatacgactcactatagggcatattggcaaactgttctgccatgcacttaacagaggagaaagtgcatggcagaacagaacctggcggcagcgcaaaagatg

SEQ ID NO: 2616 - DNA, 103 bp, Artificial Sequence
  Synthetic Polynucleotide
taatacgactcactataggggatttcatattggcaaactgttctgccatgaacagaggagacatggcatgacagtttgcaacctggcggcagcgcaaaagatg

SEQ ID NO: 2617 - DNA, 103 bp, Artificial Sequence
  Synthetic Polynucleotide
taatacgactcactatagggccagggatttcatattggcaaactgttctgaacagaggagacagaacatgttgccaataaacctggcggcagcgcaaaagatg

SEQ ID NO: 2618 - DNA, 103 bp, Artificial Sequence
  Synthetic Polynucleotide
taatacgactcactatagggcaaaaccagggatttcatattggcaaactgaacagaggagacagtttatgaatatgaaaaacctggcggcagcgcaaaagatg

SEQ ID NO: 2619 - DNA, 103 bp, Artificial Sequence
  Synthetic Polynucleotide
taatacgactcactatagggtaaaccaaaaccagggatttcatattggcaaacagaggagatgccaaatggaaatccctaacctggcggcagcgcaaaagatg

SEQ ID NO: 2620 - DNA, 103 bp, Artificial Sequence
  Synthetic Polynucleotide
taatacgactcactatagggaaaggaaaagattcaaggtttctcaacccgaacagaggagacgggttatgaaaccttgaaacctggcggcagcgcaaaagatg

SEQ ID NO: 2621 - DNA, 103 bp, Artificial Sequence
  Synthetic Polynucleotide
taatacgactcactatagggcgggataaaccaaaaccagggatttcatataacagaggagaatatgaatgccctggtttaacctggcggcagcgcaaaagatg

SEQ ID NO: 2622 - DNA, 103 bp, Artificial Sequence
  Synthetic Polynucleotide
taatacgactcactatagggcagaacgggataaaccaaaaccagggatttaacagaggagaaaatccatggttttggttaacctggcggcagcgcaaaagatg

SEQ ID NO: 2623 - DNA, 103 bp, Artificial Sequence
  Synthetic Polynucleotide
taatacgactcactataggggcgtccagaacgggataaaccaaaaccaggaacagaggagacctggtatgggtttatccaacctggcggcagcgcaaaagatg

SEQ ID NO: 2624 - DNA, 103 bp, Artificial Sequence
  Synthetic Polynucleotide
taatacgactcactatagggagaaggcgtccagaacgggataaaccaaaaaacagaggagattttggatgatcccgttcaacctggcggcagcgcaaaagatg

SEQ ID NO: 2625 - DNA, 103 bp, Artificial Sequence
  Synthetic Polynucleotide
taatacgactcactatagggagacgagaaggcgtccagaacgggataaacaacagaggagagtttatatggttctggacaacctggcggcagcgcaaaagatg

SEQ ID NO: 2626 - DNA, 103 bp, Artificial Sequence
  Synthetic Polynucleotide
taatacgactcactatagggcatacagacgagaaggcgtccagaacgggaaacagaggagatcccgtatgggacgccttaacctggcggcagcgcaaaagatg

SEQ ID NO: 2627 - DNA, 103 bp, Artificial Sequence
  Synthetic Polynucleotide
taatacgactcactatagggtcgcccatacagacgagaaggcgtccagaaaacagaggagattctggatgccttctcgtaacctggcggcagcgcaaaagatg

SEQ ID NO: 2628 - DNA, 103 bp, Artificial Sequence
  Synthetic Polynucleotide
taatacgactcactataggggcttctcgcccatacagacgagaaggcgtcaacagaggagagacgccatgtcgtctgtaaacctggcggcagcgcaaaagatg

SEQ ID NO: 2629 - DNA, 103 bp, Artificial Sequence
  Synthetic Polynucleotide
taatacgactcactatagggacagggcttctcgcccatacagacgagaagaacagaggagacttctcatgtgtatgggcaacctggcggcagcgcaaaagatg

SEQ ID NO: 2630 - DNA, 103 bp, Artificial Sequence
  Synthetic Polynucleotide
taatacgactcactatagggagctgacagggcttctcgcccatacagacgaacagaggagacgtctgatggggcgagaaaacctggcggcagcgcaaaagatg

SEQ ID NO: 2631 - DNA, 103 bp, Artificial Sequence
  Synthetic Polynucleotide
taatacgactcactataggggctccaaaggaaaagattcaaggtttctcaaacagaggagatgagaaatgttgaatcttaacctggcggcagcgcaaaagatg

SEQ ID NO: 2632 - DNA, 103 bp, Artificial Sequence
  Synthetic Polynucleotide
taatacgactcactatagggcgggaagctgacagggcttctcgcccatacaacagaggagagtatggatgagaagccctaacctggcggcagcgcaaaagatg

SEQ ID NO: 2633 - DNA, 103 bp, Artificial Sequence
  Synthetic Polynucleotide
taatacgactcactatagggagagacgggaagctgacagggcttctcgccaacagaggagaggcgagatgccctgtcagaacctggcggcagcgcaaaagatg

SEQ ID NO: 2634 - DNA, 103 bp, Artificial Sequence
  Synthetic Polynucleotide
taatacgactcactatagggggagtagagacgggaagctgacagggcttcaacagaggagagaagccatgtcagcttccaacctggcggcagcgcaaaagatg

SEQ ID NO: 2635 - DNA, 103 bp, Artificial Sequence
  Synthetic Polynucleotide
taatacgactcactatagggacttgggagtagagacgggaagctgacaggaacagaggagacctgtcatgttcccgtctaacctggcggcagcgcaaaagatg

SEQ ID NO: 2636 - DNA, 103 bp, Artificial Sequence
  Synthetic Polynucleotide
taatacgactcactataggggaaacacttgggagtagagacgggaagctgaacagaggagacagcttatggtctctactaacctggcggcagcgcaaaagatg

SEQ ID NO: 2637 - DNA, 103 bp, Artificial Sequence
  Synthetic Polynucleotide
taatacgactcactatagggtggtagaaacacttgggagtagagacgggaaacagaggagatcccgtatgtactcccaaaacctggcggcagcgcaaaagatg

SEQ ID NO: 2638 - DNA, 103 bp, Artificial Sequence
  Synthetic Polynucleotide
taatacgactcactatagggcgatgtggtagaaacacttgggagtagagaaacagaggagatctctaatgccaagtgttaacctggcggcagcgcaaaagatg

SEQ ID NO: 2639 - DNA, 103 bp, Artificial Sequence
  Synthetic Polynucleotide
taatacgactcactatagggaaaaacgatgtggtagaaacacttgggagtaacagaggagaactcccatgtgtttctacaacctggcggcagcgcaaaagatg

SEQ ID NO: 2640 - DNA, 103 bp, Artificial Sequence
  Synthetic Polynucleotide
taatacgactcactatagggccagtaaaaacgatgtggtagaaacacttgaacagaggagacaagtgatgctaccacataacctggcggcagcgcaaaagatg

SEQ ID NO: 2641 - DNA, 103 bp, Artificial Sequence
  Synthetic Polynucleotide
taatacgactcactatagggtggagccagtaaaaacgatgtggtagaaacaacagaggagagtttctatgacatcgtttaacctggcggcagcgcaaaagatg

SEQ ID NO: 2642 - DNA, 103 bp, Artificial Sequence
  Synthetic Polynucleotide
taatacgactcactatagggccaaggctccaaaggaaaagattcaaggttaacagaggagaaaccttatgtcttttcctaacctggcggcagcgcaaaagatg

SEQ ID NO: 2643 - DNA, 103 bp, Artificial Sequence
  Synthetic Polynucleotide
taatacgactcactatagggatttctggagccagtaaaaacgatgtggtaaacagaggagataccacatggtttttactaacctggcggcagcgcaaaagatg

SEQ ID NO: 2644 - DNA, 103 bp, Artificial Sequence
  Synthetic Polynucleotide
taatacgactcactatagggaaggaatttctggagccagtaaaaacgatgaacagaggagacatcgtatgtactggctcaacctggcggcagcgcaaaagatg

SEQ ID NO: 2645 - DNA, 103 bp, Artificial Sequence
  Synthetic Polynucleotide
taatacgactcactatagggcaccaaaggaatttctggagccagtaaaaaaacagaggagatttttaatggctccagaaaacctggcggcagcgcaaaagatg

SEQ ID NO: 2646 - DNA, 103 bp, Artificial Sequence
  Synthetic Polynucleotide
taatacgactcactatagggggacacaccaaaggaatttctggagccagtaacagaggagaactggcatgagaaattccaacctggcggcagcgcaaaagatg

SEQ ID NO: 2647 - DNA, 103 bp, Artificial Sequence
  Synthetic Polynucleotide
taatacgactcactatagggtagatggacacaccaaaggaatttctggagaacagaggagactccagatgttcctttggaacctggcggcagcgcaaaagatg

SEQ ID NO: 2648 - DNA, 103 bp, Artificial Sequence
  Synthetic Polynucleotide
taatacgactcactatagggctttgtagatggacacaccaaaggaatttcaacagaggagagaaattatgttggtgtgtaacctggcggcagcgcaaaagatg

SEQ ID NO: 2649 - DNA, 103 bp, Artificial Sequence
  Synthetic Polynucleotide
taatacgactcactatagggtctagctttgtagatggacacaccaaaggaaacagaggagatcctttatggtgtccatcaacctggcggcagcgcaaaagatg

SEQ ID NO: 2650 - DNA, 103 bp, Artificial Sequence
  Synthetic Polynucleotide
taatacgactcactatagggctgtatctagctttgtagatggacacaccaaacagaggagatggtgtatgcatctacaaaacctggcggcagcgcaaaagatg

SEQ ID NO: 2651 - DNA, 103 bp, Artificial Sequence
  Synthetic Polynucleotide
taatacgactcactatagggagggtctgtatctagctttgtagatggacaaacagaggagatgtccaatgacaaagctaaacctggcggcagcgcaaaagatg

SEQ ID NO: 2652 - DNA, 103 bp, Artificial Sequence
  Synthetic Polynucleotide
taatacgactcactatagggcttccagggtctgtatctagctttgtagataacagaggagaatctacatggctagatacaacctggcggcagcgcaaaagatg

SEQ ID NO: 2653 - DNA, 103 bp, Artificial Sequence
  Synthetic Polynucleotide
taatacgactcactataggggggagccaaggctccaaaggaaaagattcaaacagaggagatgaatcatgtcctttggaaacctggcggcagcgcaaaagatg

SEQ ID NO: 2654 - DNA, 103 bp, Artificial Sequence
  Synthetic Polynucleotide
taatacgactcactatagggggctgcttccagggtctgtatctagctttgaacagaggagacaaagcatgatacagaccaacctggcggcagcgcaaaagatg

SEQ ID NO: 2655 - DNA, 103 bp, Artificial Sequence
  Synthetic Polynucleotide
taatacgactcactataggggaaggggctgcttccagggtctgtatctagaacagaggagactagatatggaccctggaaacctggcggcagcgcaaaagatg

SEQ ID NO: 2656 - DNA, 103 bp, Artificial Sequence
  Synthetic Polynucleotide
taatacgactcactatagggatcgtgaaggggctgcttccagggtctgtaaacagaggagatacagaatgtggaagcagaacctggcggcagcgcaaaagatg

SEQ ID NO: 2657 - DNA, 103 bp, Artificial Sequence
  Synthetic Polynucleotide
taatacgactcactatagggaactcatcgtgaaggggctgcttccagggtaacagaggagaaccctgatggcagcccctaacctggcggcagcgcaaaagatg

SEQ ID NO: 2658 - DNA, 103 bp, Artificial Sequence
  Synthetic Polynucleotide
taatacgactcactatagggcgtacaactcatcgtgaaggggctgcttccaacagaggagaggaagcatgcccttcacgaacctggcggcagcgcaaaagatg

SEQ ID NO: 2659 - DNA, 103 bp, Artificial Sequence
  Synthetic Polynucleotide
taatacgactcactatagggatagtcgtacaactcatcgtgaaggggctgaacagaggagacagcccatgcacgatgagaacctggcggcagcgcaaaagatg

SEQ ID NO: 2660 - DNA, 103 bp, Artificial Sequence
  Synthetic Polynucleotide
taatacgactcactatagggaagccatagtcgtacaactcatcgtgaaggaacagaggagaccttcaatgtgagttgtaaacctggcggcagcgcaaaagatg

SEQ ID NO: 2661 - DNA, 103 bp, Artificial Sequence
  Synthetic Polynucleotide
taatacgactcactatagggtagaaaagccatagtcgtacaactcatcgtaacagaggagaacgatgatgtgtacgactaacctggcggcagcgcaaaagatg

SEQ ID NO: 2662 - DNA, 103 bp, Artificial Sequence
  Synthetic Polynucleotide
taatacgactcactataggggaaagtagaaaagccatagtcgtacaactcaacagaggagagagttgatggactatggcaacctggcggcagcgcaaaagatg

SEQ ID NO: 2663 - DNA, 103 bp, Artificial Sequence
  Synthetic Polynucleotide
taatacgactcactatagggtcagtgaaagtagaaaagccatagtcgtacaacagaggagagtacgaatgtggcttttcaacctggcggcagcgcaaaagatg

SEQ ID NO: 2664 - DNA, 103 bp, Artificial Sequence
  Synthetic Polynucleotide
taatacgactcactatagggtggacctaaggcgggaaccggaataataataacagaggagaattattatgccggttcccaacctggcggcagcgcaaaagatg

SEQ ID NO: 2665 - DNA, 103 bp, Artificial Sequence
  Synthetic Polynucleotide
taatacgactcactatagggaccgggggagccaaggctccaaaggaaaagaacagaggagacttttcatgtggagccttaacctggcggcagcgcaaaagatg

SEQ ID NO: 2666 - DNA, 103 bp, Artificial Sequence
  Synthetic Polynucleotide
taatacgactcactatagggagaagtcagtgaaagtagaaaagccatagtaacagaggagaactatgatgtttctacttaacctggcggcagcgcaaaagatg

SEQ ID NO: 2667 - DNA, 103 bp, Artificial Sequence
  Synthetic Polynucleotide
taatacgactcactatagggtttaaagaagtcagtgaaagtagaaaagccaacagaggagaggctttatgactttcactaacctggcggcagcgcaaaagatg

SEQ ID NO: 2668 - DNA, 103 bp, Artificial Sequence
  Synthetic Polynucleotide
taatacgactcactatagggacagctttaaagaagtcagtgaaagtagaaaacagaggagattctacatgcactgacttaacctggcggcagcgcaaaagatg

SEQ ID NO: 2669 - DNA, 103 bp, Artificial Sequence
  Synthetic Polynucleotide
taatacgactcactatagggccctaacagctttaaagaagtcagtgaaagaacagaggagactttcaatgacttctttaaacctggcggcagcgcaaaagatg

SEQ ID NO: 2670 - DNA, 103 bp, Artificial Sequence
  Synthetic Polynucleotide
taatacgactcactatagggataatccctaacagctttaaagaagtcagtaacagaggagaactgacatgtttaaagctaacctggcggcagcgcaaaagatg

SEQ ID NO: 2671 - DNA, 103 bp, Artificial Sequence
  Synthetic Polynucleotide
taatacgactcactataggggcatgataatccctaacagctttaaagaagaacagaggagacttcttatgagctgttagaacctggcggcagcgcaaaagatg

SEQ ID NO: 2672 - DNA, 103 bp, Artificial Sequence
  Synthetic Polynucleotide
taatacgactcactatagggaggaggcatgataatccctaacagctttaaaacagaggagattaaagatgttagggattaacctggcggcagcgcaaaagatg

SEQ ID NO: 2673 - DNA, 103 bp, Artificial Sequence
  Synthetic Polynucleotide
taatacgactcactataggggtaataggaggcatgataatccctaacagcaacagaggagagctgttatggattatcataacctggcggcagcgcaaaagatg

SEQ ID NO: 2674 - DNA, 103 bp, Artificial Sequence
  Synthetic Polynucleotide
taatacgactcactatagggtgtttgtaataggaggcatgataatccctaaacagaggagatagggaatgtcatgcctcaacctggcggcagcgcaaaagatg

SEQ ID NO: 2675 - DNA, 103 bp, Artificial Sequence
  Synthetic Polynucleotide
taatacgactcactataggggcctttgtttgtaataggaggcatgataataacagaggagaattatcatgcctcctattaacctggcggcagcgcaaaagatg

SEQ ID NO: 2676 - DNA, 103 bp, Artificial Sequence
  Synthetic Polynucleotide
taatacgactcactatagggcttagaccgggggagccaaggctccaaaggaacagaggagacctttgatgccttggctcaacctggcggcagcgcaaaagatg

SEQ ID NO: 2677 - DNA, 103 bp, Artificial Sequence
  Synthetic Polynucleotide
taatacgactcactatagggttgaagcctttgtttgtaataggaggcatgaacagaggagacatgccatgtattacaaaaacctggcggcagcgcaaaagatg

SEQ ID NO: 2678 - DNA, 103 bp, Artificial Sequence
  Synthetic Polynucleotide
taatacgactcactatagggtcatgttgaagcctttgtttgtaataggagaacagaggagactcctaatgcaaacaaagaacctggcggcagcgcaaaagatg

SEQ ID NO: 2679 - DNA, 103 bp, Artificial Sequence
  Synthetic Polynucleotide
taatacgactcactatagggcaatgtcatgttgaagcctttgtttgtaataacagaggagaattacaatgaaaggcttcaacctggcggcagcgcaaaagatg

SEQ ID NO: 2680 - DNA, 103 bp, Artificial Sequence
  Synthetic Polynucleotide
taatacgactcactatagggtgtttcaatgtcatgttgaagcctttgtttaacagaggagaaaacaaatgcttcaacataacctggcggcagcgcaaaagatg

SEQ ID NO: 2681 - DNA, 103 bp, Artificial Sequence
  Synthetic Polynucleotide
taatacgactcactatagggggatttgtttcaatgtcatgttgaagccttaacagaggagaaaggctatgacatgacataacctggcggcagcgcaaaagatg

SEQ ID NO: 2682 - DNA, 103 bp, Artificial Sequence
  Synthetic Polynucleotide
taatacgactcactatagggggccaggatttgtttcaatgtcatgttgaaaacagaggagattcaacatgacattgaaaaacctggcggcagcgcaaaagatg

SEQ ID NO: 2683 - DNA, 103 bp, Artificial Sequence
  Synthetic Polynucleotide
taatacgactcactataggggacagggccaggatttgtttcaatgtcatgaacagaggagacatgacatggaaacaaataacctggcggcagcgcaaaagatg

SEQ ID NO: 2684 - DNA, 103 bp, Artificial Sequence
  Synthetic Polynucleotide
taatacgactcactataggggactggacagggccaggatttgtttcaatgaacagaggagacattgaatgaaatcctggaacctggcggcagcgcaaaagatg

SEQ ID NO: 2685 - DNA, 103 bp, Artificial Sequence
  Synthetic Polynucleotide
taatacgactcactatagggaaaccgactggacagggccaggatttgtttaacagaggagaaaacaaatgctggccctgaacctggcggcagcgcaaaagatg

SEQ ID NO: 2686 - DNA, 103 bp, Artificial Sequence
  Synthetic Polynucleotide
taatacgactcactatagggctgaaaaaccgactggacagggccaggattaacagaggagaaatcctatgcctgtccagaacctggcggcagcgcaaaagatg

SEQ ID NO: 2687 - DNA, 103 bp, Artificial Sequence
  Synthetic Polynucleotide
taatacgactcactatagggagcggcttagaccgggggagccaaggctccaacagaggagaggagccatggctcccccgaacctggcggcagcgcaaaagatg

SEQ ID NO: 2688 - DNA, 103 bp, Artificial Sequence
  Synthetic Polynucleotide
taatacgactcactatagggtgcaactgaaaaaccgactggacagggccaaacagaggagatggcccatgccagtcggtaacctggcggcagcgcaaaagatg

SEQ ID NO: 2689 - DNA, 103 bp, Artificial Sequence
  Synthetic Polynucleotide
taatacgactcactatagggcaccttgcaactgaaaaaccgactggacagaacagaggagactgtccatgcggtttttcaacctggcggcagcgcaaaagatg

SEQ ID NO: 2690 - DNA, 103 bp, Artificial Sequence
  Synthetic Polynucleotide
taatacgactcactatagggcaccccaccttgcaactgaaaaaccgactgaacagaggagacagtcgatgtttcagttgaacctggcggcagcgcaaaagatg

SEQ ID NO: 2691 - DNA, 103 bp, Artificial Sequence
  Synthetic Polynucleotide
taatacgactcactataggggttagcaccccaccttgcaactgaaaaaccaacagaggagaggttttatggttgcaaggaacctggcggcagcgcaaaagatg

SEQ ID NO: 2692 - DNA, 103 bp, Artificial Sequence
  Synthetic Polynucleotide
taatacgactcactatagggatttagttagcaccccaccttgcaactgaaaacagaggagattcagtatgaaggtggggaacctggcggcagcgcaaaagatg

SEQ ID NO: 2693 - DNA, 103 bp, Artificial Sequence
  Synthetic Polynucleotide
taatacgactcactatagggttgggatttagttagcaccccaccttgcaaaacagaggagattgcaaatgggggtgctaaacctggcggcagcgcaaaagatg

SEQ ID NO: 2694 - DNA, 103 bp, Artificial Sequence
  Synthetic Polynucleotide
taatacgactcactatagggggtgcttgggatttagttagcaccccacctaacagaggagaaggtggatggctaactaaaacctggcggcagcgcaaaagatg

SEQ ID NO: 2695 - DNA, 103 bp, Artificial Sequence
  Synthetic Polynucleotide
taatacgactcactatagggacatgggtgcttgggatttagttagcacccaacagaggagagggtgcatgctaaatcccaacctggcggcagcgcaaaagatg

SEQ ID NO: 2696 - DNA, 103 bp, Artificial Sequence
  Synthetic Polynucleotide
taatacgactcactatagggaccagacatgggtgcttgggatttagttagaacagaggagactaactatgtcccaagcaaacctggcggcagcgcaaaagatg

SEQ ID NO: 2697 - DNA, 103 bp, Artificial Sequence
  Synthetic Polynucleotide
taatacgactcactatagggtgtaaaccagacatgggtgcttgggatttaaacagaggagataaatcatgagcacccataacctggcggcagcgcaaaagatg

SEQ ID NO: 2698 - DNA, 103 bp, Artificial Sequence
  Synthetic Polynucleotide
taatacgactcactatagggttccaagcggcttagaccgggggagccaagaacagaggagacttggcatgcccggtctaaacctggcggcagcgcaaaagatg

SEQ ID NO: 2699 - DNA, 103 bp, Artificial Sequence
  Synthetic Polynucleotide
taatacgactcactatagggtactctgtaaaccagacatgggtgcttgggaacagaggagacccaagatgccatgtctgaacctggcggcagcgcaaaagatg

SEQ ID NO: 2700 - DNA, 103 bp, Artificial Sequence
  Synthetic Polynucleotide
taatacgactcactatagggtaacatactctgtaaaccagacatgggtgcaacagaggagagcacccatgtctggtttaaacctggcggcagcgcaaaagatg

SEQ ID NO: 2701 - DNA, 103 bp, Artificial Sequence
  Synthetic Polynucleotide
taatacgactcactatagggctcagtaacatactctgtaaaccagacatgaacagaggagacatgtcatgtttacagagaacctggcggcagcgcaaaagatg

SEQ ID NO: 2702 - DNA, 103 bp, Artificial Sequence
  Synthetic Polynucleotide
taatacgactcactatagggttgctctcagtaacatactctgtaaaccagaacagaggagactggttatgagagtatgtaacctggcggcagcgcaaaagatg

SEQ ID NO: 2703 - DNA, 103 bp, Artificial Sequence
  Synthetic Polynucleotide
taatacgactcactatagggtccaattgctctcagtaacatactctgtaaaacagaggagattacagatgatgttactgaacctggcggcagcgcaaaagatg

SEQ ID NO: 2704 - DNA, 103 bp, Artificial Sequence
  Synthetic Polynucleotide
taatacgactcactatagggtcgattccaattgctctcagtaacatactcaacagaggagagagtatatgactgagagcaacctggcggcagcgcaaaagatg

SEQ ID NO: 2705 - DNA, 103 bp, Artificial Sequence
  Synthetic Polynucleotide
taatacgactcactatagggccgcttcgattccaattgctctcagtaacaaacagaggagatgttacatggagcaattgaacctggcggcagcgcaaaagatg

SEQ ID NO: 2706 - DNA, 103 bp, Artificial Sequence
  Synthetic Polynucleotide
taatacgactcactataggggcagtccgcttcgattccaattgctctcagaacagaggagactgagaatgattggaatcaacctggcggcagcgcaaaagatg

SEQ ID NO: 2707 - DNA, 103 bp, Artificial Sequence
  Synthetic Polynucleotide
taatacgactcactatagggtcagtgcagtccgcttcgattccaattgctaacagaggagaagcaatatgaatcgaagcaacctggcggcagcgcaaaagatg

SEQ ID NO: 2708 - DNA, 103 bp, Artificial Sequence
  Synthetic Polynucleotide
taatacgactcactatagggtgaattcagtgcagtccgcttcgattccaaaacagaggagattggaaatgaagcggactaacctggcggcagcgcaaaagatg

SEQ ID NO: 2709 - DNA, 103 bp, Artificial Sequence
  Synthetic Polynucleotide
taatacgactcactatagggtcatattccaagcggcttagaccgggggagaacagaggagactccccatgtctaagccgaacctggcggcagcgcaaaagatg

SEQ ID NO: 2710 - DNA, 103 bp, Artificial Sequence
  Synthetic Polynucleotide
taatacgactcactatagggtctggtgaattcagtgcagtccgcttcgataacagaggagaatcgaaatggactgcactaacctggcggcagcgcaaaagatg

SEQ ID NO: 2711 - DNA, 103 bp, Artificial Sequence
  Synthetic Polynucleotide
taatacgactcactatagggacagctctggtgaattcagtgcagtccgctaacagaggagaagcggaatgcactgaattaacctggcggcagcgcaaaagatg

SEQ ID NO: 2712 - DNA, 103 bp, Artificial Sequence
  Synthetic Polynucleotide
taatacgactcactatagggaatttacagctctggtgaattcagtgcagtaacagaggagaactgcaatgaattcaccaaacctggcggcagcgcaaaagatg

SEQ ID NO: 2713 - DNA, 103 bp, Artificial Sequence
  Synthetic Polynucleotide
taatacgactcactataggggatcaaatttacagctctggtgaattcagtaacagaggagaactgaaatgaccagagctaacctggcggcagcgcaaaagatg

SEQ ID NO: 2714 - DNA, 103 bp, Artificial Sequence
  Synthetic Polynucleotide
taatacgactcactatagggtcagtgatcaaatttacagctctggtgaataacagaggagaattcacatgagctgtaaaaacctggcggcagcgcaaaagatg

SEQ ID NO: 2715 - DNA, 103 bp, Artificial Sequence
  Synthetic Polynucleotide
taatacgactcactatagggaaaggtcagtgatcaaatttacagctctggaacagaggagaccagagatgtaaatttgaaacctggcggcagcgcaaaagatg

SEQ ID NO: 2716 - DNA, 103 bp, Artificial Sequence
  Synthetic Polynucleotide
taatacgactcactataggggttacaaaggtcagtgatcaaatttacagcaacagaggagagctgtaatgttgatcactaacctggcggcagcgcaaaagatg

SEQ ID NO: 2717 - DNA, 103 bp, Artificial Sequence
  Synthetic Polynucleotide
taatacgactcactatagggcaggtgttacaaaggtcagtgatcaaatttaacagaggagaaaatttatgcactgacctaacctggcggcagcgcaaaagatg

SEQ ID NO: 2718 - DNA, 103 bp, Artificial Sequence
  Synthetic Polynucleotide
taatacgactcactatagggtctcccaggtgttacaaaggtcagtgatcaaacagaggagatgatcaatgacctttgtaaacctggcggcagcgcaaaagatg

SEQ ID NO: 2719 - DNA, 103 bp, Artificial Sequence
  Synthetic Polynucleotide
taatacgactcactatagggggcgctctcccaggtgttacaaaggtcagtaacagaggagaactgacatgtgtaacaccaacctggcggcagcgcaaaagatg

SEQ ID NO: 2720 - DNA, 103 bp, Artificial Sequence
  Synthetic Polynucleotide
taatacgactcactatagggccctgtcatattccaagcggcttagaccggaacagaggagaccggtcatggccgcttggaacctggcggcagcgcaaaagatg

SEQ ID NO: 2721 - DNA, 103 bp, Artificial Sequence
  Synthetic Polynucleotide
taatacgactcactataggggttttggcgctctcccaggtgttacaaaggaacagaggagacctttgatgcacctgggaaacctggcggcagcgcaaaagatg

SEQ ID NO: 2722 - DNA, 103 bp, Artificial Sequence
  Synthetic Polynucleotide
taatacgactcactatagggacgttgttttggcgctctcccaggtgttacaacagaggagagtaacaatggggagagcgaacctggcggcagcgcaaaagatg

SEQ ID NO: 2723 - DNA, 103 bp, Artificial Sequence
  Synthetic Polynucleotide
taatacgactcactatagggggacaacgttgttttggcgctctcccaggtaacagaggagaacctggatgagcgccaaaaacctggcggcagcgcaaaagatg

SEQ ID NO: 2724 - DNA, 103 bp, Artificial Sequence
  Synthetic Polynucleotide
taatacgactcactatagggggggaggacaacgttgttttggcgctctccaacagaggagaggagagatgcaaaacaacaacctggcggcagcgcaaaagatg

SEQ ID NO: 2725 - DNA, 103 bp, Artificial Sequence
  Synthetic Polynucleotide
taatacgactcactatagggattcaggggaggacaacgttgttttggcgcaacagaggagagcgccaatgcaacgttgtaacctggcggcagcgcaaaagatg

SEQ ID NO: 2726 - DNA, 103 bp, Artificial Sequence
  Synthetic Polynucleotide
taatacgactcactatagggccaaaattcaggggaggacaacgttgttttaacagaggagaaaaacaatgttgtcctccaacctggcggcagcgcaaaagatg

SEQ ID NO: 2727 - DNA, 103 bp, Artificial Sequence
  Synthetic Polynucleotide
taatacgactcactatagggttggtccaaaattcaggggaggacaacgttaacagaggagaaacgttatgctcccctgaaacctggcggcagcgcaaaagatg

SEQ ID NO: 2728 - DNA, 103 bp, Artificial Sequence
  Synthetic Polynucleotide
taatacgactcactatagggccattttggtccaaaattcaggggaggacaaacagaggagatgtcctatgctgaattttaacctggcggcagcgcaaaagatg

SEQ ID NO: 2729 - DNA, 103 bp, Artificial Sequence
  Synthetic Polynucleotide
taatacgactcactatagggcattaccattttggtccaaaattcaggggaaacagaggagatcccctatgttttggaccaacctggcggcagcgcaaaagatg

SEQ ID NO: 2730 - DNA, 103 bp, Artificial Sequence
  Synthetic Polynucleotide
taatacgactcactatagggattctcattaccattttggtccaaaattcaaacagaggagatgaattatggaccaaaataacctggcggcagcgcaaaagatg

SEQ ID NO: 2731 - DNA, 103 bp, Artificial Sequence
  Synthetic Polynucleotide
taatacgactcactatagggaataaccctgtcatattccaagcggcttagaacagaggagactaagcatgttggaatataacctggcggcagcgcaaaagatg

SEQ ID NO: 2732 - DNA, 103 bp, Artificial Sequence
  Synthetic Polynucleotide
taatacgactcactatagggtcacaattctcattaccattttggtccaaaaacagaggagatttggaatgaaatggtaaaacctggcggcagcgcaaaagatg

SEQ ID NO: 2733 - DNA, 103 bp, Artificial Sequence
  Synthetic Polynucleotide
taatacgactcactatagggcattttcacaattctcattaccattttggtaacagaggagaaccaaaatggtaatgagaaacctggcggcagcgcaaaagatg

SEQ ID NO: 2734 - DNA, 103 bp, Artificial Sequence
  Synthetic Polynucleotide
taatacgactcactataggggcaaccattttcacaattctcattaccattaacagaggagaaatggtatggagaattgtaacctggcggcagcgcaaaagatg

SEQ ID NO: 2735 - DNA, 103 bp, Artificial Sequence
  Synthetic Polynucleotide
taatacgactcactatagggaagcagcaaccattttcacaattctcattaaacagaggagataatgaatgttgtgaaaaaacctggcggcagcgcaaaagatg

SEQ ID NO: 2736 - DNA, 103 bp, Artificial Sequence
  Synthetic Polynucleotide
taatacgactcactatagggaactgaagcagcaaccattttcacaattctaacagaggagaagaattatgaaaatggttaacctggcggcagcgcaaaagatg

SEQ ID NO: 2737 - DNA, 103 bp, Artificial Sequence
  Synthetic Polynucleotide
taatacgactcactatagggtaaagaactgaagcagcaaccattttcacaaacagaggagatgtgaaatgggttgctgcaacctggcggcagcgcaaaagatg

SEQ ID NO: 2738 - DNA, 103 bp, Artificial Sequence
  Synthetic Polynucleotide
taatacgactcactataggggtaggtaaagaactgaagcagcaaccatttaacagaggagaaaatggatgctgcttcagaacctggcggcagcgcaaaagatg

SEQ ID NO: 2739 - DNA, 103 bp, Artificial Sequence
  Synthetic Polynucleotide
taatacgactcactatagggattgtgtaggtaaagaactgaagcagcaacaacagaggagagttgctatgtcagttcttaacctggcggcagcgcaaaagatg

SEQ ID NO: 2740 - DNA, 103 bp, Artificial Sequence
  Synthetic Polynucleotide
taatacgactcactatagggtctggattgtgtaggtaaagaactgaagcaaacagaggagatgcttcatgtctttacctaacctggcggcagcgcaaaagatg

SEQ ID NO: 2741 - DNA, 103 bp, Artificial Sequence
  Synthetic Polynucleotide
taatacgactcactatagggtcaaatctggattgtgtaggtaaagaactgaacagaggagacagttcatgacctacacaaacctggcggcagcgcaaaagatg

SEQ ID NO: 2742 - DNA, 103 bp, Artificial Sequence
  Synthetic Polynucleotide
taatacgactcactatagggtggaaaataaccctgtcatattccaagcggaacagaggagaccgcttatgatatgacagaacctggcggcagcgcaaaagatg

SEQ ID NO: 2743 - DNA, 103 bp, Artificial Sequence
  Synthetic Polynucleotide
taatacgactcactatagggagtggtcaaatctggattgtgtaggtaaagaacagaggagactttacatgcacaatccaaacctggcggcagcgcaaaagatg

SEQ ID NO: 2744 - DNA, 103 bp, Artificial Sequence
  Synthetic Polynucleotide
taatacgactcactatagggacagtagtggtcaaatctggattgtgtaggaacagaggagacctacaatgtccagatttaacctggcggcagcgcaaaagatg

SEQ ID NO: 2745 - DNA, 103 bp, Artificial Sequence
  Synthetic Polynucleotide
taatacgactcactataggggacagacagtagtggtcaaatctggattgtaacagaggagaacaatcatgatttgaccaaacctggcggcagcgcaaaagatg

SEQ ID NO: 2746 - DNA, 103 bp, Artificial Sequence
  Synthetic Polynucleotide
taatacgactcactatagggagacagacagacagtagtggtcaaatctggaacagaggagaccagatatgaccactactaacctggcggcagcgcaaaagatg

SEQ ID NO: 2747 - DNA, 103 bp, Artificial Sequence
  Synthetic Polynucleotide
taatacgactcactatagggatcaaagacagacagacagtagtggtcaaaaacagaggagatttgacatgtactgtctgaacctggcggcagcgcaaaagatg

SEQ ID NO: 2748 - DNA, 103 bp, Artificial Sequence
  Synthetic Polynucleotide
taatacgactcactatagggcagccatcaaagacagacagacagtagtggaacagaggagaccactaatgtctgtctgtaacctggcggcagcgcaaaagatg

SEQ ID NO: 2749 - DNA, 103 bp, Artificial Sequence
  Synthetic Polynucleotide
taatacgactcactatagggtattccagccatcaaagacagacagacagtaacagaggagaactgtcatgctgtctttgaacctggcggcagcgcaaaagatg

SEQ ID NO: 2750 - DNA, 103 bp, Artificial Sequence
  Synthetic Polynucleotide
taatacgactcactatagggacatctattccagccatcaaagacagacagaacagaggagactgtctatgtttgatggcaacctggcggcagcgcaaaagatg

SEQ ID NO: 2751 - DNA, 103 bp, Artificial Sequence
  Synthetic Polynucleotide
taatacgactcactatagggtgagaacatctattccagccatcaaagacaaacagaggagatgtcttatgtggctggaaaacctggcggcagcgcaaaagatg

SEQ ID NO: 2752 - DNA, 103 bp, Artificial Sequence
  Synthetic Polynucleotide
taatacgactcactatagggattagtgagaacatctattccagccatcaaaacagaggagattgatgatgggaatagataacctggcggcagcgcaaaagatg

SEQ ID NO: 2753 - DNA, 103 bp, Artificial Sequence
  Synthetic Polynucleotide
taatacgactcactataggggagtttggaaaataaccctgtcatattccaaacagaggagatggaatatgacagggttaaacctggcggcagcgcaaaagatg

SEQ ID NO: 2754 - DNA, 103 bp, Artificial Sequence
  Synthetic Polynucleotide
taatacgactcactatagggctatcattagtgagaacatctattccagccaacagaggagaggctggatgagatgttctaacctggcggcagcgcaaaagatg

SEQ ID NO: 2755 - DNA, 103 bp, Artificial Sequence
  Synthetic Polynucleotide
taatacgactcactatagggaaacactatcattagtgagaacatctattcaacagaggagagaatagatgttctcactaaacctggcggcagcgcaaaagatg

SEQ ID NO: 2756 - DNA, 103 bp, Artificial Sequence
  Synthetic Polynucleotide
taatacgactcactataggggttaaaaacactatcattagtgagaacatcaacagaggagagatgttatgactaatgataacctggcggcagcgcaaaagatg

SEQ ID NO: 2757 - DNA, 103 bp, Artificial Sequence
  Synthetic Polynucleotide
taatacgactcactatagggagccagttaaaaacactatcattagtgagaaacagaggagatctcacatgtgatagtgtaacctggcggcagcgcaaaagatg

SEQ ID NO: 2758 - DNA, 103 bp, Artificial Sequence
  Synthetic Polynucleotide
taatacgactcactatagggtggacagccagttaaaaacactatcattagaacagaggagactaatgatggtgtttttaaacctggcggcagcgcaaaagatg

SEQ ID NO: 2759 - DNA, 103 bp, Artificial Sequence
  Synthetic Polynucleotide
taatacgactcactatagggtttagtggacagccagttaaaaacactatcaacagaggagagatagtatgtttaactggaacctggcggcagcgcaaaagatg

SEQ ID NO: 2760 - DNA, 103 bp, Artificial Sequence
  Synthetic Polynucleotide
taatacgactcactataggggatagtttagtggacagccagttaaaaacaaacagaggagatgttttatgctggctgtcaacctggcggcagcgcaaaagatg

SEQ ID NO: 2761 - DNA, 103 bp, Artificial Sequence
  Synthetic Polynucleotide
taatacgactcactatagggacttggatagtttagtggacagccagttaaaacagaggagattaactatgtgtccactaaacctggcggcagcgcaaaagatg

SEQ ID NO: 2762 - DNA, 103 bp, Artificial Sequence
  Synthetic Polynucleotide
taatacgactcactataggggaagaacttggatagtttagtggacagccaaacagaggagatggctgatgactaaactaaacctggcggcagcgcaaaagatg

SEQ ID NO: 2763 - DNA, 103 bp, Artificial Sequence
  Synthetic Polynucleotide
taatacgactcactataggggtgtggaagaacttggatagtttagtggacaacagaggagagtccacatgactatccaaaacctggcggcagcgcaaaagatg

SEQ ID NO: 2764 - DNA, 103 bp, Artificial Sequence
  Synthetic Polynucleotide
taatacgactcactatagggataaagagtttggaaaataaccctgtcataaacagaggagatatgacatggttattttcaacctggcggcagcgcaaaagatg

SEQ ID NO: 2765 - DNA, 103 bp, Artificial Sequence
  Synthetic Polynucleotide
taatacgactcactatagggcaggggtgtggaagaacttggatagtttagaacagaggagactaaacatgccaagttctaacctggcggcagcgcaaaagatg

SEQ ID NO: 2766 - DNA, 103 bp, Artificial Sequence
  Synthetic Polynucleotide
taatacgactcactatagggaggggcaggggtgtggaagaacttggatagaacagaggagactatccatgttcttccacaacctggcggcagcgcaaaagatg

SEQ ID NO: 2767 - DNA, 103 bp, Artificial Sequence
  Synthetic Polynucleotide
taatacgactcactatagggatgggaggggcaggggtgtggaagaacttgaacagaggagacaagttatgccacaccccaacctggcggcagcgcaaaagatg

SEQ ID NO: 2768 - DNA, 103 bp, Artificial Sequence
  Synthetic Polynucleotide
taatacgactcactataggggaacaatgggaggggcaggggtgtggaagaaacagaggagatcttccatgcccctgcccaacctggcggcagcgcaaaagatg

SEQ ID NO: 2769 - DNA, 103 bp, Artificial Sequence
  Synthetic Polynucleotide
taatacgactcactatagggaagaggaacaatgggaggggcaggggtgtgaacagaggagacacaccatggcccctcccaacctggcggcagcgcaaaagatg

SEQ ID NO: 2770 - DNA, 103 bp, Artificial Sequence
  Synthetic Polynucleotide
taatacgactcactatagggtgcaaaagaggaacaatgggaggggcagggaacagaggagaccctgcatgtcccattgtaacctggcggcagcgcaaaagatg

SEQ ID NO: 2771 - DNA, 103 bp, Artificial Sequence
  Synthetic Polynucleotide
taatacgactcactataggggttgttgcaaaagaggaacaatgggaggggaacagaggagacccctcatgttgttcctcaacctggcggcagcgcaaaagatg

SEQ ID NO: 2772 - DNA, 103 bp, Artificial Sequence
  Synthetic Polynucleotide
taatacgactcactatagggagactgttgttgcaaaagaggaacaatgggaacagaggagacccattatgcctcttttgaacctggcggcagcgcaaaagatg

SEQ ID NO: 2773 - DNA, 103 bp, Artificial Sequence
  Synthetic Polynucleotide
taatacgactcactatagggacaggagactgttgttgcaaaagaggaacaaacagaggagatgttccatgtttgcaacaaacctggcggcagcgcaaaagatg

SEQ ID NO: 2774 - DNA, 103 bp, Artificial Sequence
  Synthetic Polynucleotide
taatacgactcactatagggctctaacaggagactgttgttgcaaaagagaacagaggagactctttatgaacaacagtaacctggcggcagcgcaaaagatg

SEQ ID NO: 2775 - DNA, 103 bp, Artificial Sequence
  Synthetic Polynucleotide
taatacgactcactatagggttcaatggacctaaggcgggaaccggaataaacagaggagatattccatgtcccgccttaacctggcggcagcgcaaaagatg

SEQ ID NO: 2776 - DNA, 103 bp, Artificial Sequence
  Synthetic Polynucleotide
taatacgactcactatagggtagaaataaagagtttggaaaataaccctgaacagaggagacagggtatgtttccaaacaacctggcggcagcgcaaaagatg

SEQ ID NO: 2777 - DNA, 103 bp, Artificial Sequence
  Synthetic Polynucleotide
taatacgactcactatagggtgcttctctaacaggagactgttgttgcaaaacagaggagattgcaaatgcagtctcctaacctggcggcagcgcaaaagatg

SEQ ID NO: 2778 - DNA, 103 bp, Artificial Sequence
  Synthetic Polynucleotide
taatacgactcactatagggtcatttgcttctctaacaggagactgttgtaacagaggagaacaacaatgtcctgttagaacctggcggcagcgcaaaagatg

SEQ ID NO: 2779 - DNA, 103 bp, Artificial Sequence
  Synthetic Polynucleotide
taatacgactcactatagggagttatcatttgcttctctaacaggagactaacagaggagaagtctcatgttagagaagaacctggcggcagcgcaaaagatg

SEQ ID NO: 2780 - DNA, 103 bp, Artificial Sequence
  Synthetic Polynucleotide
taatacgactcactatagggattaaagttatcatttgcttctctaacaggaacagaggagacctgttatggaagcaaataacctggcggcagcgcaaaagatg

SEQ ID NO: 2781 - DNA, 103 bp, Artificial Sequence
  Synthetic Polynucleotide
taatacgactcactataggggccaaattaaagttatcatttgcttctctaaacagaggagatagagaatgaaatgataaaacctggcggcagcgcaaaagatg

SEQ ID NO: 2782 - DNA, 103 bp, Artificial Sequence
  Synthetic Polynucleotide
taatacgactcactatagggtctttgccaaattaaagttatcatttgcttaacagaggagaaagcaaatgataactttaaacctggcggcagcgcaaaagatg

SEQ ID NO: 2783 - DNA, 103 bp, Artificial Sequence
  Synthetic Polynucleotide
taatacgactcactatagggtatgttctttgccaaattaaagttatcattaacagaggagaaatgatatgtttaatttgaacctggcggcagcgcaaaagatg

SEQ ID NO: 2784 - DNA, 103 bp, Artificial Sequence
  Synthetic Polynucleotide
taatacgactcactatagggcattctatgttctttgccaaattaaagttaaacagaggagataacttatgtttggcaaaaacctggcggcagcgcaaaagatg

SEQ ID NO: 2785 - DNA, 103 bp, Artificial Sequence
  Synthetic Polynucleotide
taatacgactcactatagggttgcccattctatgttctttgccaaattaaaacagaggagattaattatgcaaagaacaaacctggcggcagcgcaaaagatg

SEQ ID NO: 2786 - DNA, 103 bp, Artificial Sequence
  Synthetic Polynucleotide
taatacgactcactatagggttttattgcccattctatgttctttgccaaaacagaggagattggcaatgaacatagaaaacctggcggcagcgcaaaagatg

SEQ ID NO: 2787 - DNA, 103 bp, Artificial Sequence
  Synthetic Polynucleotide
taatacgactcactataggggaaagtagaaataaagagtttggaaaataaaacagaggagattatttatgaaactctttaacctggcggcagcgcaaaagatg

SEQ ID NO: 2788 - DNA, 103 bp, Artificial Sequence
  Synthetic Polynucleotide
taatacgactcactatagggattgtttttattgcccattctatgttctttaacagaggagaaaagaaatgagaatgggcaacctggcggcagcgcaaaagatg

SEQ ID NO: 2789 - DNA, 103 bp, Artificial Sequence
  Synthetic Polynucleotide
taatacgactcactatagggttttaattgtttttattgcccattctatgtaacagaggagaacatagatggggcaataaaacctggcggcagcgcaaaagatg

SEQ ID NO: 2790 - DNA, 103 bp, Artificial Sequence
  Synthetic Polynucleotide
taatacgactcactatagggtattcttttaattgtttttattgcccattcaacagaggagagaatggatgataaaaacaaacctggcggcagcgcaaaagatg

SEQ ID NO: 2791 - DNA, 103 bp, Artificial Sequence
  Synthetic Polynucleotide
taatacgactcactatagggtctactattcttttaattgtttttattgccaacagaggagaggcaatatgaacaattaaaacctggcggcagcgcaaaagatg

SEQ ID NO: 2792 - DNA, 103 bp, Artificial Sequence
  Synthetic Polynucleotide
taatacgactcactatagggtccattctactattcttttaattgtttttaaacagaggagataaaaaatgttaaaagaaaacctggcggcagcgcaaaagatg

SEQ ID NO: 2793 - DNA, 103 bp, Artificial Sequence
  Synthetic Polynucleotide
taatacgactcactatagggagtaatccattctactattcttttaattgtaacagaggagaacaattatgagaatagtaaacctggcggcagcgcaaaagatg

SEQ ID NO: 2794 - DNA, 103 bp, Artificial Sequence
  Synthetic Polynucleotide
taatacgactcactatagggcatgaagtaatccattctactattcttttaaacagaggagataaaagatgagtagaatgaacctggcggcagcgcaaaagatg

SEQ ID NO: 2795 - DNA, 103 bp, Artificial Sequence
  Synthetic Polynucleotide
taatacgactcactatagggtgaaccatgaagtaatccattctactattcaacagaggagagaatagatgaatggattaaacctggcggcagcgcaaaagatg

SEQ ID NO: 2796 - DNA, 103 bp, Artificial Sequence
  Synthetic Polynucleotide
taatacgactcactatagggctgtttgaaccatgaagtaatccattctacaacagaggagagtagaaatgattacttcaaacctggcggcagcgcaaaagatg

SEQ ID NO: 2797 - DNA, 103 bp, Artificial Sequence
  Synthetic Polynucleotide
taatacgactcactatagggtcttcctgtttgaaccatgaagtaatccataacagaggagaatggatatgttcatggttaacctggcggcagcgcaaaagatg

SEQ ID NO: 2798 - DNA, 103 bp, Artificial Sequence
  Synthetic Polynucleotide
taatacgactcactatagggcccatgaaagtagaaataaagagtttggaaaacagaggagattccaaatgctttatttcaacctggcggcagcgcaaaagatg

SEQ ID NO: 2799 - DNA, 103 bp, Artificial Sequence
  Synthetic Polynucleotide
taatacgactcactatagggttgtttcttcctgtttgaaccatgaagtaaaacagaggagattacttatgggttcaaacaacctggcggcagcgcaaaagatg

SEQ ID NO: 2800 - DNA, 103 bp, Artificial Sequence
  Synthetic Polynucleotide
taatacgactcactatagggaggacttgtttcttcctgtttgaaccatgaaacagaggagatcatggatgaaacaggaaaacctggcggcagcgcaaaagatg

SEQ ID NO: 2801 - DNA, 103 bp, Artificial Sequence
  Synthetic Polynucleotide
taatacgactcactataggggcttgaggacttgtttcttcctgtttgaacaacagaggagagttcaaatgggaagaaacaacctggcggcagcgcaaaagatg

SEQ ID NO: 2802 - DNA, 103 bp, Artificial Sequence
  Synthetic Polynucleotide
taatacgactcactatagggacttagcttgaggacttgtttcttcctgttaacagaggagaaacaggatgaaacaagtcaacctggcggcagcgcaaaagatg

SEQ ID NO: 2803 - DNA, 103 bp, Artificial Sequence
  Synthetic Polynucleotide
taatacgactcactatagggatctaacttagcttgaggacttgtttcttcaacagaggagagaagaaatgagtcctcaaaacctggcggcagcgcaaaagatg

SEQ ID NO: 2804 - DNA, 103 bp, Artificial Sequence
  Synthetic Polynucleotide
taatacgactcactatagggattttatctaacttagcttgaggacttgttaacagaggagaaacaagatgtcaagctaaaacctggcggcagcgcaaaagatg

SEQ ID NO: 2805 - DNA, 103 bp, Artificial Sequence
  Synthetic Polynucleotide
taatacgactcactatagggctaacattttatctaacttagcttgaggacaacagaggagagtcctcatgctaagttagaacctggcggcagcgcaaaagatg

SEQ ID NO: 2806 - DNA, 103 bp, Artificial Sequence
  Synthetic Polynucleotide
taatacgactcactataggggtctgctaacattttatctaacttagcttgaacagaggagacaagctatgttagataaaaacctggcggcagcgcaaaagatg

SEQ ID NO: 2807 - DNA, 103 bp, Artificial Sequence
  Synthetic Polynucleotide
taatacgactcactatagggggaaagtctgctaacattttatctaacttaaacagaggagataagttatgtaaaatgttaacctggcggcagcgcaaaagatg

SEQ ID NO: 2808 - DNA, 103 bp, Artificial Sequence
  Synthetic Polynucleotide
taatacgactcactataggggttctggaaagtctgctaacattttatctaaacagaggagatagataatgtgttagcagaacctggcggcagcgcaaaagatg

SEQ ID NO: 2809 - DNA, 103 bp, Artificial Sequence
  Synthetic Polynucleotide
taatacgactcactatagggtagaacccatgaaagtagaaataaagagttaacagaggagaaactctatgtttctacttaacctggcggcagcgcaaaagatg

SEQ ID NO: 2810 - DNA, 103 bp, Artificial Sequence
  Synthetic Polynucleotide
taatacgactcactatagggacagtgttctggaaagtctgctaacattttaacagaggagaaaaatgatggcagactttaacctggcggcagcgcaaaagatg

SEQ ID NO: 2811 - DNA, 103 bp, Artificial Sequence
  Synthetic Polynucleotide
taatacgactcactataggggaagaacagtgttctggaaagtctgctaacaacagaggagagttagcatgctttccagaaacctggcggcagcgcaaaagatg

SEQ ID NO: 2812 - DNA, 103 bp, Artificial Sequence
  Synthetic Polynucleotide
taatacgactcactataggggaatggaagaacagtgttctggaaagtctgaacagaggagacagactatgcagaacactaacctggcggcagcgcaaaagatg

SEQ ID NO: 2813 - DNA, 103 bp, Artificial Sequence
  Synthetic Polynucleotide
taatacgactcactatagggagcaagaatggaagaacagtgttctggaaaaacagaggagatttccaatgcactgttctaacctggcggcagcgcaaaagatg

SEQ ID NO: 2814 - DNA, 103 bp, Artificial Sequence
  Synthetic Polynucleotide
taatacgactcactatagggctcatagcaagaatggaagaacagtgttctaacagaggagaagaacaatgttcttccataacctggcggcagcgcaaaagatg

SEQ ID NO: 2815 - DNA, 103 bp, Artificial Sequence
  Synthetic Polynucleotide
taatacgactcactatagggcatttctcatagcaagaatggaagaacagtaacagaggagaactgttatgccattcttgaacctggcggcagcgcaaaagatg

SEQ ID NO: 2816 - DNA, 103 bp, Artificial Sequence
  Synthetic Polynucleotide
taatacgactcactatagggtctaccatttctcatagcaagaatggaagaaacagaggagatcttccatgcttgctatgaacctggcggcagcgcaaaagatg

SEQ ID NO: 2817 - DNA, 103 bp, Artificial Sequence
  Synthetic Polynucleotide
taatacgactcactataggggcttttctaccatttctcatagcaagaatgaacagaggagacattctatgtatgagaaaaacctggcggcagcgcaaaagatg

SEQ ID NO: 2818 - DNA, 103 bp, Artificial Sequence
  Synthetic Polynucleotide
taatacgactcactatagggtatatgcttttctaccatttctcatagcaaaacagaggagattgctaatggaaatggtaaacctggcggcagcgcaaaagatg

SEQ ID NO: 2819 - DNA, 103 bp, Artificial Sequence
  Synthetic Polynucleotide
taatacgactcactatagggatccgtatatgcttttctaccatttctcataacagaggagaatgagaatgggtagaaaaaacctggcggcagcgcaaaagatg

SEQ ID NO: 2820 - DNA, 103 bp, Artificial Sequence
  Synthetic Polynucleotide
taatacgactcactatagggatggatagaacccatgaaagtagaaataaaaacagaggagatttattatgactttcatgaacctggcggcagcgcaaaagatg

SEQ ID NO: 2821 - DNA, 103 bp, Artificial Sequence
  Synthetic Polynucleotide
taatacgactcactataggggcacaatccgtatatgcttttctaccatttaacagaggagaaaatggatgaaaagcataaacctggcggcagcgcaaaagatg

SEQ ID NO: 2822 - DNA, 103 bp, Artificial Sequence
  Synthetic Polynucleotide
taatacgactcactatagggctccagcacaatccgtatatgcttttctacaacagaggagagtagaaatgcatatacggaacctggcggcagcgcaaaagatg

SEQ ID NO: 2823 - DNA, 103 bp, Artificial Sequence
  Synthetic Polynucleotide
taatacgactcactataggggaatgctccagcacaatccgtatatgctttaacagaggagaaaagcaatgacggattgtaacctggcggcagcgcaaaagatg

SEQ ID NO: 2824 - DNA, 103 bp, Artificial Sequence
  Synthetic Polynucleotide
taatacgactcactatagggtacttgaatgctccagcacaatccgtatataacagaggagaatatacatgttgtgctggaacctggcggcagcgcaaaagatg

SEQ ID NO: 2825 - DNA, 103 bp, Artificial Sequence
  Synthetic Polynucleotide
taatacgactcactatagggcaaaatacttgaatgctccagcacaatccgaacagaggagacggattatgctggagcataacctggcggcagcgcaaaagatg

SEQ ID NO: 2826 - DNA, 103 bp, Artificial Sequence
  Synthetic Polynucleotide
taatacgactcactatagggttgttcaaaatacttgaatgctccagcacaaacagaggagatgtgctatggcattcaagaacctggcggcagcgcaaaagatg

SEQ ID NO: 2827 - DNA, 103 bp, Artificial Sequence
  Synthetic Polynucleotide
taatacgactcactatagggtaaagttgttcaaaatacttgaatgctccaaacagaggagatggagcatgcaagtatttaacctggcggcagcgcaaaagatg

SEQ ID NO: 2828 - DNA, 103 bp, Artificial Sequence
  Synthetic Polynucleotide
taatacgactcactatagggaattgtaaagttgttcaaaatacttgaatgaacagaggagacattcaatgattttgaacaacctggcggcagcgcaaaagatg

SEQ ID NO: 2829 - DNA, 103 bp, Artificial Sequence
  Synthetic Polynucleotide
taatacgactcactatagggtgccaaattgtaaagttgttcaaaatacttaacagaggagaaagtatatggaacaacttaacctggcggcagcgcaaaagatg

SEQ ID NO: 2830 - DNA, 103 bp, Artificial Sequence
  Synthetic Polynucleotide
taatacgactcactatagggtgtactgccaaattgtaaagttgttcaaaaaacagaggagattttgaatgactttacaaaacctggcggcagcgcaaaagatg

SEQ ID NO: 2831 - DNA, 103 bp, Artificial Sequence
  Synthetic Polynucleotide
taatacgactcactatagggttttcatggatagaacccatgaaagtagaaaacagaggagattctacatgcatgggttcaacctggcggcagcgcaaaagatg

SEQ ID NO: 2832 - DNA, 103 bp, Artificial Sequence
  Synthetic Polynucleotide
taatacgactcactatagggtacattgtactgccaaattgtaaagttgttaacagaggagaaacaacatgacaatttggaacctggcggcagcgcaaaagatg

SEQ ID NO: 2833 - DNA, 103 bp, Artificial Sequence
  Synthetic Polynucleotide
taatacgactcactatagggtcttttacattgtactgccaaattgtaaagaacagaggagactttacatgttggcagtaaacctggcggcagcgcaaaagatg

SEQ ID NO: 2834 - DNA, 103 bp, Artificial Sequence
  Synthetic Polynucleotide
taatacgactcactatagggggtattcttttacattgtactgccaaattgaacagaggagacaatttatgagtacaatgaacctggcggcagcgcaaaagatg

SEQ ID NO: 2835 - DNA, 103 bp, Artificial Sequence
  Synthetic Polynucleotide
taatacgactcactatagggccaatggtattcttttacattgtactgccaaacagaggagatggcagatgaatgtaaaaaacctggcggcagcgcaaaagatg

SEQ ID NO: 2836 - DNA, 103 bp, Artificial Sequence
  Synthetic Polynucleotide
taatacgactcactatagggagttgccaatggtattcttttacattgtacaacagaggagagtacaaatgaaaagaataaacctggcggcagcgcaaaagatg

SEQ ID NO: 2837 - DNA, 103 bp, Artificial Sequence
  Synthetic Polynucleotide
taatacgactcactatagggcacaaagttgccaatggtattcttttacataacagaggagaatgtaaatgaataccattaacctggcggcagcgcaaaagatg

SEQ ID NO: 2838 - DNA, 103 bp, Artificial Sequence
  Synthetic Polynucleotide
taatacgactcactatagggtttcacacaaagttgccaatggtattctttaacagaggagaaaagaaatgcattggcaaaacctggcggcagcgcaaaagatg

SEQ ID NO: 2839 - DNA, 103 bp, Artificial Sequence
  Synthetic Polynucleotide
taatacgactcactataggggaatttttcacacaaagttgccaatggtataacagaggagaataccaatggcaactttgaacctggcggcagcgcaaaagatg

SEQ ID NO: 2840 - DNA, 103 bp, Artificial Sequence
  Synthetic Polynucleotide
taatacgactcactatagggtttttgaatttttcacacaaagttgccaataacagaggagaattggcatgtttgtgtgaaacctggcggcagcgcaaaagatg

SEQ ID NO: 2841 - DNA, 103 bp, Artificial Sequence
  Synthetic Polynucleotide
taatacgactcactataggggtttgtttttgaatttttcacacaaagttgaacagaggagacaacttatggtgaaaaataacctggcggcagcgcaaaagatg

SEQ ID NO: 2842 - DNA, 103 bp, Artificial Sequence
  Synthetic Polynucleotide
taatacgactcactatagggtacccttttcatggatagaacccatgaaagaacagaggagactttcaatggttctatccaacctggcggcagcgcaaaagatg

SEQ ID NO: 2843 - DNA, 103 bp, Artificial Sequence
  Synthetic Polynucleotide
taatacgactcactataggggtcgtgtttgtttttgaatttttcacacaaaacagaggagattgtgtatgaaattcaaaaacctggcggcagcgcaaaagatg

SEQ ID NO: 2844 - DNA, 103 bp, Artificial Sequence
  Synthetic Polynucleotide
taatacgactcactataggggcatggtcgtgtttgtttttgaatttttcaaacagaggagatgaaaaatgcaaaaacaaaacctggcggcagcgcaaaagatg

SEQ ID NO: 2845 - DNA, 103 bp, Artificial Sequence
  Synthetic Polynucleotide
taatacgactcactatagggccacagcatggtcgtgtttgtttttgaattaacagaggagaaattcaatgacaaacacgaacctggcggcagcgcaaaagatg

SEQ ID NO: 2846 - DNA, 103 bp, Artificial Sequence
  Synthetic Polynucleotide
taatacgactcactatagggcctagccacagcatggtcgtgtttgtttttaacagaggagaaaaaacatgcacgaccataacctggcggcagcgcaaaagatg

SEQ ID NO: 2847 - DNA, 103 bp, Artificial Sequence
  Synthetic Polynucleotide
taatacgactcactatagggtctggcctagccacagcatggtcgtgtttgaacagaggagacaaacaatgccatgctgtaacctggcggcagcgcaaaagatg

SEQ ID NO: 2848 - DNA, 103 bp, Artificial Sequence
  Synthetic Polynucleotide
taatacgactcactatagggcgggttctggcctagccacagcatggtcgtaacagaggagaacgaccatgctgtggctaaacctggcggcagcgcaaaagatg

SEQ ID NO: 2849 - DNA, 103 bp, Artificial Sequence
  Synthetic Polynucleotide
taatacgactcactatagggaaccacgggttctggcctagccacagcatgaacagaggagacatgctatggctaggccaaacctggcggcagcgcaaaagatg

SEQ ID NO: 2850 - DNA, 103 bp, Artificial Sequence
  Synthetic Polynucleotide
taatacgactcactatagggacaacaaccacgggttctggcctagccacaaacagaggagatgtggcatggccagaaccaacctggcggcagcgcaaaagatg

SEQ ID NO: 2851 - DNA, 103 bp, Artificial Sequence
  Synthetic Polynucleotide
taatacgactcactataggggcaacacaacaaccacgggttctggcctagaacagaggagactaggcatgaacccgtggaacctggcggcagcgcaaaagatg

SEQ ID NO: 2852 - DNA, 103 bp, Artificial Sequence
  Synthetic Polynucleotide
taatacgactcactatagggccctcgcaacacaacaaccacgggttctggaacagaggagaccagaaatggtggttgttaacctggcggcagcgcaaaagatg

SEQ ID NO: 2853 - DNA, 103 bp, Artificial Sequence
  Synthetic Polynucleotide
taatacgactcactatagggacacatacccttttcatggatagaacccataacagaggagaatgggtatgatccatgaaaacctggcggcagcgcaaaagatg

SEQ ID NO: 2854 - DNA, 103 bp, Artificial Sequence
  Synthetic Polynucleotide
taatacgactcactataggggcattccctcgcaacacaacaaccacgggtaacagaggagaacccgtatgtgttgtgttaacctggcggcagcgcaaaagatg

SEQ ID NO: 2855 - DNA, 103 bp, Artificial Sequence
  Synthetic Polynucleotide
taatacgactcactataggggtccagcattccctcgcaacacaacaaccaaacagaggagatggttgatgtgttgcgagaacctggcggcagcgcaaaagatg

SEQ ID NO: 2856 - DNA, 103 bp, Artificial Sequence
  Synthetic Polynucleotide
taatacgactcactatagggtccttgtccagcattccctcgcaacacaacaacagaggagagttgtgatgcgagggaataacctggcggcagcgcaaaagatg

SEQ ID NO: 2857 - DNA, 103 bp, Artificial Sequence
  Synthetic Polynucleotide
taatacgactcactataggggactttccttgtccagcattccctcgcaacaacagaggagagttgcgatggaatgctggaacctggcggcagcgcaaaagatg

SEQ ID NO: 2858 - DNA, 103 bp, Artificial Sequence
  Synthetic Polynucleotide
taatacgactcactatagggtcacggactttccttgtccagcattccctcaacagaggagagagggaatgctggacaagaacctggcggcagcgcaaaagatg

SEQ ID NO: 2859 - DNA, 103 bp, Artificial Sequence
  Synthetic Polynucleotide
taatacgactcactatagggactggtcacggactttccttgtccagcattaacagaggagaaatgctatgcaaggaaagaacctggcggcagcgcaaaagatg

SEQ ID NO: 2860 - DNA, 103 bp, Artificial Sequence
  Synthetic Polynucleotide
taatacgactcactatagggatttgactggtcacggactttccttgtccaaacagaggagatggacaatgaaagtccgtaacctggcggcagcgcaaaagatg

SEQ ID NO: 2861 - DNA, 103 bp, Artificial Sequence
  Synthetic Polynucleotide
taatacgactcactatagggcgatgatttgactggtcacggactttccttaacagaggagaaaggaaatgccgtgaccaaacctggcggcagcgcaaaagatg

SEQ ID NO: 2862 - DNA, 103 bp, Artificial Sequence
  Synthetic Polynucleotide
taatacgactcactatagggttgggcgatgatttgactggtcacggacttaacagaggagaaagtccatgaccagtcaaaacctggcggcagcgcaaaagatg

SEQ ID NO: 2863 - DNA, 103 bp, Artificial Sequence
  Synthetic Polynucleotide
taatacgactcactatagggactgcttgggcgatgatttgactggtcacgaacagaggagacgtgacatgtcaaatcataacctggcggcagcgcaaaagatg

SEQ ID NO: 2864 - DNA, 103 bp, Artificial Sequence
  Synthetic Polynucleotide
taatacgactcactataggggggcaacacatacccttttcatggatagaaaacagaggagattctatatgtgaaaagggaacctggcggcagcgcaaaagatg

SEQ ID NO: 2865 - DNA, 103 bp, Artificial Sequence
  Synthetic Polynucleotide
taatacgactcactatagggtggagactgcttgggcgatgatttgactggaacagaggagaccagtcatgtcatcgcccaacctggcggcagcgcaaaagatg

SEQ ID NO: 2866 - DNA, 103 bp, Artificial Sequence
  Synthetic Polynucleotide
taatacgactcactatagggaagtttggagactgcttgggcgatgatttgaacagaggagacaaatcatggcccaagcaaacctggcggcagcgcaaaagatg

SEQ ID NO: 2867 - DNA, 103 bp, Artificial Sequence
  Synthetic Polynucleotide
taatacgactcactatagggaacaaaagtttggagactgcttgggcgatgaacagaggagacatcgcatgagcagtctcaacctggcggcagcgcaaaagatg

SEQ ID NO: 2868 - DNA, 103 bp, Artificial Sequence
  Synthetic Polynucleotide
taatacgactcactataggggaccaaacaaaagtttggagactgcttgggaacagaggagacccaagatgtctccaaacaacctggcggcagcgcaaaagatg

SEQ ID NO: 2869 - DNA, 103 bp, Artificial Sequence
  Synthetic Polynucleotide
taatacgactcactatagggttgacgaccaaacaaaagtttggagactgcaacagaggagagcagtcatgaaacttttgaacctggcggcagcgcaaaagatg

SEQ ID NO: 2870 - DNA, 103 bp, Artificial Sequence
  Synthetic Polynucleotide
taatacgactcactatagggactgattgacgaccaaacaaaagtttggagaacagaggagactccaaatgtttgtttggaacctggcggcagcgcaaaagatg

SEQ ID NO: 2871 - DNA, 103 bp, Artificial Sequence
  Synthetic Polynucleotide
taatacgactcactatagggaataaactgattgacgaccaaacaaaagttaacagaggagaaactttatgttggtcgtcaacctggcggcagcgcaaaagatg

SEQ ID NO: 2872 - DNA, 103 bp, Artificial Sequence
  Synthetic Polynucleotide
taatacgactcactataggggagagaataaactgattgacgaccaaacaaaacagaggagattgtttatgcgtcaatcaaacctggcggcagcgcaaaagatg

SEQ ID NO: 2873 - DNA, 103 bp, Artificial Sequence
  Synthetic Polynucleotide
taatacgactcactatagggggtgggagagaataaactgattgacgaccaaacagaggagatggtcgatgatcagtttaaacctggcggcagcgcaaaagatg

SEQ ID NO: 2874 - DNA, 103 bp, Artificial Sequence
  Synthetic Polynucleotide
taatacgactcactatagggaatccggtgggagagaataaactgattgacaacagaggagagtcaatatgtttattctcaacctggcggcagcgcaaaagatg

SEQ ID NO: 2875 - DNA, 103 bp, Artificial Sequence
  Synthetic Polynucleotide
taatacgactcactatagggggaaggggcaacacatacccttttcatggaaacagaggagatccatgatgagggtatgtaacctggcggcagcgcaaaagatg

SEQ ID NO: 2876 - DNA, 103 bp, Artificial Sequence
  Synthetic Polynucleotide
taatacgactcactatagggatctgaatccggtgggagagaataaactgaaacagaggagatcagttatgtctctcccaaacctggcggcagcgcaaaagatg

SEQ ID NO: 2877 - DNA, 103 bp, Artificial Sequence
  Synthetic Polynucleotide
taatacgactcactatagggaagtaatctgaatccggtgggagagaataaaacagaggagattattcatgcccaccggaaacctggcggcagcgcaaaagatg

SEQ ID NO: 2878 - DNA, 103 bp, Artificial Sequence
  Synthetic Polynucleotide
taatacgactcactatagggcatctaagtaatctgaatccggtgggagagaacagaggagactctccatgcggattcagaacctggcggcagcgcaaaagatg

SEQ ID NO: 2879 - DNA, 103 bp, Artificial Sequence
  Synthetic Polynucleotide
taatacgactcactataggggtaaccatctaagtaatctgaatccggtggaacagaggagaccaccgatgtcagattacaacctggcggcagcgcaaaagatg

SEQ ID NO: 2880 - DNA, 103 bp, Artificial Sequence
  Synthetic Polynucleotide
taatacgactcactatagggttctcgtaaccatctaagtaatctgaatccaacagaggagaggattcatgttacttagaaacctggcggcagcgcaaaagatg

SEQ ID NO: 2881 - DNA, 103 bp, Artificial Sequence
  Synthetic Polynucleotide
taatacgactcactatagggattgattctcgtaaccatctaagtaatctgaacagaggagacagattatgtagatggttaacctggcggcagcgcaaaagatg

SEQ ID NO: 2882 - DNA, 103 bp, Artificial Sequence
  Synthetic Polynucleotide
taatacgactcactatagggtgaatattgattctcgtaaccatctaagtaaacagaggagatacttaatgggttacgagaacctggcggcagcgcaaaagatg

SEQ ID NO: 2883 - DNA, 103 bp, Artificial Sequence
  Synthetic Polynucleotide
taatacgactcactatagggattactgaatattgattctcgtaaccatctaacagaggagaagatggatgcgagaatcaaacctggcggcagcgcaaaagatg

SEQ ID NO: 2884 - DNA, 103 bp, Artificial Sequence
  Synthetic Polynucleotide
taatacgactcactatagggccatgattactgaatattgattctcgtaacaacagaggagagttacgatgatcaatattaacctggcggcagcgcaaaagatg

SEQ ID NO: 2885 - DNA, 103 bp, Artificial Sequence
  Synthetic Polynucleotide
taatacgactcactatagggatcatccatgattactgaatattgattctcaacagaggagagagaatatgtattcagtaaacctggcggcagcgcaaaagatg

SEQ ID NO: 2886 - DNA, 103 bp, Artificial Sequence
  Synthetic Polynucleotide
taatacgactcactatagggtggtaggctacgtgtgtctcacgcagccataacagaggagaatggctatgtgagacacaaacctggcggcagcgcaaaagatg

SEQ ID NO: 2887 - DNA, 103 bp, Artificial Sequence
  Synthetic Polynucleotide
taatacgactcactatagggatgggttcttaatctcttgctttgcagagtaacagaggagaactctgatgagcaagagaaacctggcggcagcgcaaaagatg

SEQ ID NO: 2888 - DNA, 103 bp, Artificial Sequence
  Synthetic Polynucleotide
taatacgactcactatagggtatatcgcgacgtctgctctctgtctacataacagaggagaatgtagatggagagcagaaacctggcggcagcgcaaaagatg

SEQ ID NO: 2889 - DNA, 103 bp, Artificial Sequence
  Synthetic Polynucleotide
taatacgactcactataggggatggcacgttgtggtcaaatagcattaccaacagaggagaggtaatatgatttgaccaaacctggcggcagcgcaaaagatg

SEQ ID NO: 2890 - DNA, 103 bp, Artificial Sequence
  Synthetic Polynucleotide
taatacgactcactatagggcgcgcgatggcacgttgtggtcaaatagcaaacagaggagatgctatatgaccacaacgaacctggcggcagcgcaaaagatg

SEQ ID NO: 2891 - DNA, 103 bp, Artificial Sequence
  Synthetic Polynucleotide
taatacgactcactatagggacttacgcgcgatggcacgttgtggtcaaaaacagaggagatttgacatgaacgtgccaaacctggcggcagcgcaaaagatg

SEQ ID NO: 2892 - DNA, 103 bp, Artificial Sequence
  Synthetic Polynucleotide
taatacgactcactatagggcttggacttacgcgcgatggcacgttgtggaacagaggagaccacaaatggccatcgcgaacctggcggcagcgcaaaagatg

SEQ ID NO: 2893 - DNA, 103 bp, Artificial Sequence
  Synthetic Polynucleotide
taatacgactcactatagggattcccttggacttacgcgcgatggcacgtaacagaggagaacgtgcatgcgcgcgtaaaacctggcggcagcgcaaaagatg

SEQ ID NO: 2894 - DNA, 103 bp, Artificial Sequence
  Synthetic Polynucleotide
taatacgactcactatagggtctgtattcccttggacttacgcgcgatggaacagaggagaccatcgatggtaagtccaaacctggcggcagcgcaaaagatg

SEQ ID NO: 2895 - DNA, 103 bp, Artificial Sequence
  Synthetic Polynucleotide
taatacgactcactataggggaaggtctgtattcccttggacttacgcgcaacagaggagagcgcgtatgtccaagggaaacctggcggcagcgcaaaagatg

SEQ ID NO: 2896 - DNA, 103 bp, Artificial Sequence
  Synthetic Polynucleotide
taatacgactcactatagggcctgggaaggtctgtattcccttggacttaaacagaggagataagtcatggggaatacaaacctggcggcagcgcaaaagatg

SEQ ID NO: 2897 - DNA, 103 bp, Artificial Sequence
  Synthetic Polynucleotide
taatacgactcactatagggagactcctgggaaggtctgtattcccttggaacagaggagaccaaggatgtacagacctaacctggcggcagcgcaaaagatg

SEQ ID NO: 2898 - DNA, 103 bp, Artificial Sequence
  Synthetic Polynucleotide
taatacgactcactatagggtgtacagactcctgggaaggtctgtattccaacagaggagaggaataatgaccttcccaaacctggcggcagcgcaaaagatg

SEQ ID NO: 2899 - DNA, 103 bp, Artificial Sequence
  Synthetic Polynucleotide
taatacgactcactatagggcttggtatatcgcgacgtctgctctctgtcaacagaggagagacagaatgcagacgtcgaacctggcggcagcgcaaaagatg

SEQ ID NO: 2900 - DNA, 103 bp, Artificial Sequence
  Synthetic Polynucleotide
taatacgactcactatagggcttcctgtacagactcctgggaaggtctgtaacagaggagaacagacatgcccaggagtaacctggcggcagcgcaaaagatg

SEQ ID NO: 2901 - DNA, 103 bp, Artificial Sequence
  Synthetic Polynucleotide
taatacgactcactatagggactcgcttcctgtacagactcctgggaaggaacagaggagaccttccatggagtctgtaaacctggcggcagcgcaaaagatg

SEQ ID NO: 2902 - DNA, 103 bp, Artificial Sequence
  Synthetic Polynucleotide
taatacgactcactataggggtcgtactcgcttcctgtacagactcctggaacagaggagaccaggaatgtgtacaggaaacctggcggcagcgcaaaagatg

SEQ ID NO: 2903 - DNA, 103 bp, Artificial Sequence
  Synthetic Polynucleotide
taatacgactcactatagggacgtggtcgtactcgcttcctgtacagactaacagaggagaagtctgatgaggaagcgaaacctggcggcagcgcaaaagatg

SEQ ID NO: 2904 - DNA, 103 bp, Artificial Sequence
  Synthetic Polynucleotide
taatacgactcactatagggcagtgacgtggtcgtactcgcttcctgtacaacagaggagagtacagatggcgagtacgaacctggcggcagcgcaaaagatg

SEQ ID NO: 2905 - DNA, 103 bp, Artificial Sequence
  Synthetic Polynucleotide
taatacgactcactatagggtgcgtcagtgacgtggtcgtactcgcttccaacagaggagaggaagcatgtacgaccacaacctggcggcagcgcaaaagatg

SEQ ID NO: 2906 - DNA, 103 bp, Artificial Sequence
  Synthetic Polynucleotide
taatacgactcactatagggggctatgcgtcagtgacgtggtcgtactcgaacagaggagacgagtaatgccacgtcacaacctggcggcagcgcaaaagatg

SEQ ID NO: 2907 - DNA, 103 bp, Artificial Sequence
  Synthetic Polynucleotide
taatacgactcactataggggaattggctatgcgtcagtgacgtggtcgtaacagaggagaacgaccatgtcactgacgaacctggcggcagcgcaaaagatg

SEQ ID NO: 2908 - DNA, 103 bp, Artificial Sequence
  Synthetic Polynucleotide
taatacgactcactatagggagatcgaattggctatgcgtcagtgacgtgaacagaggagacacgtcatggacgcatagaacctggcggcagcgcaaaagatg

SEQ ID NO: 2909 - DNA, 103 bp, Artificial Sequence
  Synthetic Polynucleotide
taatacgactcactatagggcgcttagatcgaattggctatgcgtcagtgaacagaggagacactgaatgatagccaataacctggcggcagcgcaaaagatg

SEQ ID NO: 2910 - DNA, 103 bp, Artificial Sequence
  Synthetic Polynucleotide
taatacgactcactataggggacgtcttggtatatcgcgacgtctgctctaacagaggagaagagcaatggtcgcgataaacctggcggcagcgcaaaagatg

SEQ ID NO: 2911 - DNA, 103 bp, Artificial Sequence
  Synthetic Polynucleotide
taatacgactcactataggggtcaacgcttagatcgaattggctatgcgtaacagaggagaacgcatatgcaattcgataacctggcggcagcgcaaaagatg

SEQ ID NO: 2912 - DNA, 103 bp, Artificial Sequence
  Synthetic Polynucleotide
taatacgactcactatagggttgccgtcaacgcttagatcgaattggctaaacagaggagatagccaatgcgatctaagaacctggcggcagcgcaaaagatg

SEQ ID NO: 2913 - DNA, 103 bp, Artificial Sequence
  Synthetic Polynucleotide
taatacgactcactataggggtatcttgccgtcaacgcttagatcgaattaacagaggagaaattcgatgtaagcgttgaacctggcggcagcgcaaaagatg

SEQ ID NO: 2914 - DNA, 103 bp, Artificial Sequence
  Synthetic Polynucleotide
taatacgactcactataggggggcagtatcttgccgtcaacgcttagatcaacagaggagagatctaatggttgacggcaacctggcggcagcgcaaaagatg

SEQ ID NO: 2915 - DNA, 103 bp, Artificial Sequence
  Synthetic Polynucleotide
taatacgactcactataggggggacgggcagtatcttgccgtcaacgcttaacagaggagaaagcgtatgcggcaagataacctggcggcagcgcaaaagatg

SEQ ID NO: 2916 - DNA, 103 bp, Artificial Sequence
  Synthetic Polynucleotide
taatacgactcactatagggctgacgggacgggcagtatcttgccgtcaaaacagaggagattgacgatgagatactgcaacctggcggcagcgcaaaagatg

SEQ ID NO: 2917 - DNA, 103 bp, Artificial Sequence
  Synthetic Polynucleotide
taatacgactcactatagggcaggtctgacgggacgggcagtatcttgccaacagaggagaggcaagatgctgcccgtcaacctggcggcagcgcaaaagatg

SEQ ID NO: 2918 - DNA, 103 bp, Artificial Sequence
  Synthetic Polynucleotide
taatacgactcactataggggcatccaggtctgacgggacgggcagtatcaacagaggagagatactatgcgtcccgtcaacctggcggcagcgcaaaagatg

SEQ ID NO: 2919 - DNA, 103 bp, Artificial Sequence
  Synthetic Polynucleotide
taatacgactcactatagggcgtcagcatccaggtctgacgggacgggcaaacagaggagatgcccgatgcgtcagaccaacctggcggcagcgcaaaagatg

SEQ ID NO: 2920 - DNA, 103 bp, Artificial Sequence
  Synthetic Polynucleotide
taatacgactcactatagggtggggcgtcagcatccaggtctgacgggacaacagaggagagtcccgatggacctggataacctggcggcagcgcaaaagatg

SEQ ID NO: 2921 - DNA, 103 bp, Artificial Sequence
  Synthetic Polynucleotide
taatacgactcactataggggcatagacgtcttggtatatcgcgacgtctaacagaggagaagacgtatggatataccaaacctggcggcagcgcaaaagatg

SEQ ID NO: 2922 - DNA, 103 bp, Artificial Sequence
  Synthetic Polynucleotide
taatacgactcactatagggagggctggggcgtcagcatccaggtctgacaacagaggagagtcagaatgggatgctgaaacctggcggcagcgcaaaagatg

SEQ ID NO: 2923 - DNA, 103 bp, Artificial Sequence
  Synthetic Polynucleotide
taatacgactcactataggggttctagggctggggcgtcagcatccaggtaacagaggagaacctggatgctgacgcccaacctggcggcagcgcaaaagatg

SEQ ID NO: 2924 - DNA, 103 bp, Artificial Sequence
  Synthetic Polynucleotide
taatacgactcactatagggggctggttctagggctggggcgtcagcatcaacagaggagagatgctatggccccagccaacctggcggcagcgcaaaagatg

SEQ ID NO: 2925 - DNA, 103 bp, Artificial Sequence
  Synthetic Polynucleotide
taatacgactcactatagggtcaagggctggttctagggctggggcgtcaaacagaggagatgacgcatgagccctagaaacctggcggcagcgcaaaagatg

SEQ ID NO: 2926 - DNA, 103 bp, Artificial Sequence
  Synthetic Polynucleotide
taatacgactcactatagggcgtcgtcaagggctggttctagggctggggaacagaggagaccccagatgtagaaccagaacctggcggcagcgcaaaagatg

SEQ ID NO: 2927 - DNA, 103 bp, Artificial Sequence
  Synthetic Polynucleotide
taatacgactcactatagggcgccccgtcgtcaagggctggttctagggcaacagaggagagccctaatgccagcccttaacctggcggcagcgcaaaagatg

SEQ ID NO: 2928 - DNA, 103 bp, Artificial Sequence
  Synthetic Polynucleotide
taatacgactcactatagggtgtatcgccccgtcgtcaagggctggttctaacagaggagaagaaccatgccttgacgaaacctggcggcagcgcaaaagatg

SEQ ID NO: 2929 - DNA, 103 bp, Artificial Sequence
  Synthetic Polynucleotide
taatacgactcactatagggacgtgtgtatcgccccgtcgtcaagggctgaacagaggagacagcccatgacgacggggaacctggcggcagcgcaaaagatg

SEQ ID NO: 2930 - DNA, 103 bp, Artificial Sequence
  Synthetic Polynucleotide
taatacgactcactatagggtggcaacgtgtgtatcgccccgtcgtcaagaacagaggagacttgacatgggggcgataaacctggcggcagcgcaaaagatg

SEQ ID NO: 2931 - DNA, 103 bp, Artificial Sequence
  Synthetic Polynucleotide
taatacgactcactataggggcagatggcaacgtgtgtatcgccccgtcgaacagaggagacgacggatggatacacacaacctggcggcagcgcaaaagatg

SEQ ID NO: 2932 - DNA, 103 bp, Artificial Sequence
  Synthetic Polynucleotide
taatacgactcactataggggtacagcatagacgtcttggtatatcgcgaaacagaggagatcgcgaatgaccaagacgaacctggcggcagcgcaaaagatg

SEQ ID NO: 2933 - DNA, 103 bp, Artificial Sequence
  Synthetic Polynucleotide
taatacgactcactatagggcggttgcagatggcaacgtgtgtatcgcccaacagaggagagggcgaatgacacgttgcaacctggcggcagcgcaaaagatg

SEQ ID NO: 2934 - DNA, 103 bp, Artificial Sequence
  Synthetic Polynucleotide
taatacgactcactataggggtttccggttgcagatggcaacgtgtgtataacagaggagaatacacatgttgccatctaacctggcggcagcgcaaaagatg

SEQ ID NO: 2935 - DNA, 103 bp, Artificial Sequence
  Synthetic Polynucleotide
taatacgactcactataggggcaaggtttccggttgcagatggcaacgtgaacagaggagacacgttatgatctgcaacaacctggcggcagcgcaaaagatg

SEQ ID NO: 2936 - DNA, 103 bp, Artificial Sequence
  Synthetic Polynucleotide
taatacgactcactatagggcggccgcaaggtttccggttgcagatggcaaacagaggagatgccatatgcaaccggaaaacctggcggcagcgcaaaagatg

SEQ ID NO: 2937 - DNA, 103 bp, Artificial Sequence
  Synthetic Polynucleotide
taatacgactcactatagggagacacggccgcaaggtttccggttgcagaaacagaggagatctgcaatgggaaaccttaacctggcggcagcgcaaaagatg

SEQ ID NO: 2938 - DNA, 103 bp, Artificial Sequence
  Synthetic Polynucleotide
taatacgactcactatagggcagtcagacacggccgcaaggtttccggttaacagaggagaaaccggatgccttgcggcaacctggcggcagcgcaaaagatg

SEQ ID NO: 2939 - DNA, 103 bp, Artificial Sequence
  Synthetic Polynucleotide
taatacgactcactatagggttacccagtcagacacggccgcaaggtttcaacagaggagagaaaccatgcggccgtgtaacctggcggcagcgcaaaagatg

SEQ ID NO: 2940 - DNA, 103 bp, Artificial Sequence
  Synthetic Polynucleotide
taatacgactcactataggggctcattacccagtcagacacggccgcaagaacagaggagacttgcgatggtgtctgacaacctggcggcagcgcaaaagatg

SEQ ID NO: 2941 - DNA, 103 bp, Artificial Sequence
  Synthetic Polynucleotide
taatacgactcactatagggacggtgctcattacccagtcagacacggccaacagaggagaggccgtatgtgactgggtaacctggcggcagcgcaaaagatg

SEQ ID NO: 2942 - DNA, 103 bp, Artificial Sequence
  Synthetic Polynucleotide
taatacgactcactatagggcaggtacggtgctcattacccagtcagacaaacagaggagatgtctgatggggtaatgaaacctggcggcagcgcaaaagatg

SEQ ID NO: 2943 - DNA, 103 bp, Artificial Sequence
  Synthetic Polynucleotide
taatacgactcactatagggtgcgtgtacagcatagacgtcttggtatataacagaggagaatatacatggacgtctataacctggcggcagcgcaaaagatg

SEQ ID NO: 2944 - DNA, 103 bp, Artificial Sequence
  Synthetic Polynucleotide
taatacgactcactatagggcgcgacaggtacggtgctcattacccagtcaacagaggagagactggatgatgagcaccaacctggcggcagcgcaaaagatg

SEQ ID NO: 2945 - DNA, 103 bp, Artificial Sequence
  Synthetic Polynucleotide
taatacgactcactatagggggcggcgcgacaggtacggtgctcattaccaacagaggagaggtaatatgcaccgtaccaacctggcggcagcgcaaaagatg

SEQ ID NO: 2946 - DNA, 103 bp, Artificial Sequence
  Synthetic Polynucleotide
taatacgactcactatagggttctgggcggcgcgacaggtacggtgctcaaacagaggagatgagcaatgtacctgtcgaacctggcggcagcgcaaaagatg

SEQ ID NO: 2947 - DNA, 103 bp, Artificial Sequence
  Synthetic Polynucleotide
taatacgactcactatagggccttcttctgggcggcgcgacaggtacggtaacagaggagaaccgtaatggtcgcgccgaacctggcggcagcgcaaaagatg

SEQ ID NO: 2948 - DNA, 103 bp, Artificial Sequence
  Synthetic Polynucleotide
taatacgactcactatagggcctcgccttcttctgggcggcgcgacaggtaacagaggagaacctgtatggccgcccagaacctggcggcagcgcaaaagatg

SEQ ID NO: 2949 - DNA, 103 bp, Artificial Sequence
  Synthetic Polynucleotide
taatacgactcactatagggttctccctcgccttcttctgggcggcgcgaaacagaggagatcgcgcatgccagaagaaaacctggcggcagcgcaaaagatg

SEQ ID NO: 2950 - DNA, 103 bp, Artificial Sequence
  Synthetic Polynucleotide
taatacgactcactatagggcaggtttctccctcgccttcttctgggcggaacagaggagaccgcccatgagaaggcgaaacctggcggcagcgcaaaagatg

SEQ ID NO: 2951 - DNA, 103 bp, Artificial Sequence
  Synthetic Polynucleotide
taatacgactcactatagggacagtcaggtttctccctcgccttcttctgaacagaggagacagaagatggcgagggagaacctggcggcagcgcaaaagatg

SEQ ID NO: 2952 - DNA, 103 bp, Artificial Sequence
  Synthetic Polynucleotide
taatacgactcactatagggatgtcacagtcaggtttctccctcgccttcaacagaggagagaaggcatgggagaaaccaacctggcggcagcgcaaaagatg

SEQ ID NO: 2953 - DNA, 103 bp, Artificial Sequence
  Synthetic Polynucleotide
taatacgactcactataggggtcgcatgtcacagtcaggtttctccctcgaacagaggagacgagggatgaacctgactaacctggcggcagcgcaaaagatg

SEQ ID NO: 2954 - DNA, 103 bp, Artificial Sequence
  Synthetic Polynucleotide
taatacgactcactataggggtgggtgcgtgtacagcatagacgtcttggaacagaggagaccaagaatgctatgctgtaacctggcggcagcgcaaaagatg

SEQ ID NO: 2955 - DNA, 103 bp, Artificial Sequence
  Synthetic Polynucleotide
taatacgactcactatagggctctcgtcgcatgtcacagtcaggtttctcaacagaggagagagaaaatggactgtgacaacctggcggcagcgcaaaagatg

SEQ ID NO: 2956 - DNA, 103 bp, Artificial Sequence
  Synthetic Polynucleotide
taatacgactcactatagggcttctctctcgtcgcatgtcacagtcaggtaacagaggagaacctgaatgtgacatgcgaacctggcggcagcgcaaaagatg

SEQ ID NO: 2957 - DNA, 103 bp, Artificial Sequence
  Synthetic Polynucleotide
taatacgactcactatagggattcccttctctctcgtcgcatgtcacagtaacagaggagaactgtgatgtgcgacgagaacctggcggcagcgcaaaagatg

SEQ ID NO: 2958 - DNA, 103 bp, Artificial Sequence
  Synthetic Polynucleotide
taatacgactcactataggggttatattcccttctctctcgtcgcatgtcaacagaggagagacatgatgcgagagagaaacctggcggcagcgcaaaagatg

SEQ ID NO: 2959 - DNA, 103 bp, Artificial Sequence
  Synthetic Polynucleotide
taatacgactcactatagggtgggtgttatattcccttctctctcgtcgcaacagaggagagcgacgatggagaagggaaacctggcggcagcgcaaaagatg

SEQ ID NO: 2960 - DNA, 103 bp, Artificial Sequence
  Synthetic Polynucleotide
taatacgactcactatagggagccatgggtgttatattcccttctctctcaacagaggagagagagaatggggaatataaacctggcggcagcgcaaaagatg

SEQ ID NO: 2961 - DNA, 103 bp, Artificial Sequence
  Synthetic Polynucleotide
taatacgactcactatagggacgctagccatgggtgttatattcccttctaacagaggagaagaaggatgtataacaccaacctggcggcagcgcaaaagatg

SEQ ID NO: 2962 - DNA, 103 bp, Artificial Sequence
  Synthetic Polynucleotide
taatacgactcactatagggatcggacgctagccatgggtgttatattccaacagaggagaggaataatgcacccatggaacctggcggcagcgcaaaagatg

SEQ ID NO: 2963 - DNA, 103 bp, Artificial Sequence
  Synthetic Polynucleotide
taatacgactcactatagggaaagaatcggacgctagccatgggtgttataacagaggagaataacaatgatggctagcaacctggcggcagcgcaaaagatg

SEQ ID NO: 2964 - DNA, 103 bp, Artificial Sequence
  Synthetic Polynucleotide
taatacgactcactataggggccctaaagaatcggacgctagccatgggtaacagaggagaacccatatgtagcgtccgaacctggcggcagcgcaaaagatg

SEQ ID NO: 2965 - DNA, 103 bp, Artificial Sequence
  Synthetic Polynucleotide
taatacgactcactataggggcgacgtgggtgcgtgtacagcatagacgtaacagaggagaacgtctatgctgtacacgaacctggcggcagcgcaaaagatg

SEQ ID NO: 2966 - DNA, 103 bp, Artificial Sequence
  Synthetic Polynucleotide
taatacgactcactataggggctctgccctaaagaatcggacgctagccaaacagaggagatggctaatgtccgattctaacctggcggcagcgcaaaagatg

SEQ ID NO: 2967 - DNA, 103 bp, Artificial Sequence
  Synthetic Polynucleotide
taatacgactcactatagggacacagctctgccctaaagaatcggacgctaacagaggagaagcgtcatgttctttaggaacctggcggcagcgcaaaagatg

SEQ ID NO: 2968 - DNA, 103 bp, Artificial Sequence
  Synthetic Polynucleotide
taatacgactcactatagggactggacacagctctgccctaaagaatcggaacagaggagaccgattatgtagggcagaaacctggcggcagcgcaaaagatg

SEQ ID NO: 2969 - DNA, 103 bp, Artificial Sequence
  Synthetic Polynucleotide
taatacgactcactataggggtacgactggacacagctctgccctaaagaaacagaggagatctttaatgcagagctgtaacctggcggcagcgcaaaagatg

SEQ ID NO: 2970 - DNA, 103 bp, Artificial Sequence
  Synthetic Polynucleotide
taatacgactcactatagggttcttgtacgactggacacagctctgccctaacagaggagaagggcaatgctgtgtccaaacctggcggcagcgcaaaagatg

SEQ ID NO: 2971 - DNA, 103 bp, Artificial Sequence
  Synthetic Polynucleotide
taatacgactcactataggggctgtttcttgtacgactggacacagctctaacagaggagaagagctatgtccagtcgtaacctggcggcagcgcaaaagatg

SEQ ID NO: 2972 - DNA, 103 bp, Artificial Sequence
  Synthetic Polynucleotide
taatacgactcactatagggtctccgctgtttcttgtacgactggacacaaacagaggagatgtgtcatgtcgtacaagaacctggcggcagcgcaaaagatg

SEQ ID NO: 2973 - DNA, 103 bp, Artificial Sequence
  Synthetic Polynucleotide
taatacgactcactatagggacgcgtctccgctgtttcttgtacgactggaacagaggagaccagtcatgcaagaaacaaacctggcggcagcgcaaaagatg

SEQ ID NO: 2974 - DNA, 103 bp, Artificial Sequence
  Synthetic Polynucleotide
taatacgactcactataggggtgtcacgcgtctccgctgtttcttgtacgaacagaggagacgtacaatgaacagcggaaacctggcggcagcgcaaaagatg

SEQ ID NO: 2975 - DNA, 103 bp, Artificial Sequence
  Synthetic Polynucleotide
taatacgactcactatagggtagctgtgtcacgcgtctccgctgtttcttaacagaggagaaagaaaatgcggagacgcaacctggcggcagcgcaaaagatg

SEQ ID NO: 2976 - DNA, 103 bp, Artificial Sequence
  Synthetic Polynucleotide
taatacgactcactataggggtatagcgacgtgggtgcgtgtacagcataaacagaggagatatgctatgcacgcacccaacctggcggcagcgcaaaagatg

SEQ ID NO: 2977 - DNA, 103 bp, Artificial Sequence
  Synthetic Polynucleotide
taatacgactcactatagggagacatagctgtgtcacgcgtctccgctgtaacagaggagaacagcgatgacgcgtgacaacctggcggcagcgcaaaagatg

SEQ ID NO: 2978 - DNA, 103 bp, Artificial Sequence
  Synthetic Polynucleotide
taatacgactcactatagggtgaagagacatagctgtgtcacgcgtctccaacagaggagaggagacatgtgacacagcaacctggcggcagcgcaaaagatg

SEQ ID NO: 2979 - DNA, 103 bp, Artificial Sequence
  Synthetic Polynucleotide
taatacgactcactataggggtgcctgaagagacatagctgtgtcacgcgaacagaggagacgcgtgatgcagctatgtaacctggcggcagcgcaaaagatg

SEQ ID NO: 2980 - DNA, 103 bp, Artificial Sequence
  Synthetic Polynucleotide
taatacgactcactatagggcggcggtgcctgaagagacatagctgtgtcaacagaggagagacacaatgatgtctcttaacctggcggcagcgcaaaagatg

SEQ ID NO: 2981 - DNA, 103 bp, Artificial Sequence
  Synthetic Polynucleotide
taatacgactcactataggggtactcggcggtgcctgaagagacatagctaacagaggagaagctatatgtcttcaggcaacctggcggcagcgcaaaagatg

SEQ ID NO: 2982 - DNA, 103 bp, Artificial Sequence
  Synthetic Polynucleotide
taatacgactcactatagggtggcggtactcggcggtgcctgaagagacaaacagaggagatgtctcatgaggcaccgcaacctggcggcagcgcaaaagatg

SEQ ID NO: 2983 - DNA, 103 bp, Artificial Sequence
  Synthetic Polynucleotide
taatacgactcactatagggttccgtggcggtactcggcggtgcctgaagaacagaggagacttcagatgccgccgagtaacctggcggcagcgcaaaagatg

SEQ ID NO: 2984 - DNA, 103 bp, Artificial Sequence
  Synthetic Polynucleotide
taatacgactcactatagggctcagttccgtggcggtactcggcggtgccaacagaggagaggcaccatggagtaccgcaacctggcggcagcgcaaaagatg

SEQ ID NO: 2985 - DNA, 103 bp, Artificial Sequence
  Synthetic Polynucleotide
taatacgactcactatagggggtgactcagttccgtggcggtactcggcgaacagaggagacgccgaatgccgccacggaacctggcggcagcgcaaaagatg

SEQ ID NO: 2986 - DNA, 103 bp, Artificial Sequence
  Synthetic Polynucleotide
taatacgactcactatagggcggcgggtgactcagttccgtggcggtactaacagaggagaagtaccatgacggaactgaacctggcggcagcgcaaaagatg

SEQ ID NO: 2987 - DNA, 103 bp, Artificial Sequence
  Synthetic Polynucleotide
taatacgactcactatagggtggtggtatagcgacgtgggtgcgtgtacaaacagaggagatgtacaatgacccacgtcaacctggcggcagcgcaaaagatg

SEQ ID NO: 2988 - DNA, 103 bp, Artificial Sequence
  Synthetic Polynucleotide
taatacgactcactataggggagatcggcgggtgactcagttccgtggcgaacagaggagacgccacatgactgagtcaaacctggcggcagcgcaaaagatg

SEQ ID NO: 2989 - DNA, 103 bp, Artificial Sequence
  Synthetic Polynucleotide
taatacgactcactatagggcgaaggagatcggcgggtgactcagttccgaacagaggagacggaacatggtcacccgcaacctggcggcagcgcaaaagatg

SEQ ID NO: 2990 - DNA, 103 bp, Artificial Sequence
  Synthetic Polynucleotide
taatacgactcactatagggtgcaccgaaggagatcggcgggtgactcagaacagaggagactgagtatgccgccgatcaacctggcggcagcgcaaaagatg

SEQ ID NO: 2991 - DNA, 103 bp, Artificial Sequence
  Synthetic Polynucleotide
taatacgactcactatagggcttggtgcaccgaaggagatcggcgggtgaaacagaggagatcacccatggatctccttaacctggcggcagcgcaaaagatg

SEQ ID NO: 2992 - DNA, 103 bp, Artificial Sequence
  Synthetic Polynucleotide
taatacgactcactatagggtctcgcttggtgcaccgaaggagatcggcgaacagaggagacgccgaatgccttcggtgaacctggcggcagcgcaaaagatg

SEQ ID NO: 2993 - DNA, 103 bp, Artificial Sequence
  Synthetic Polynucleotide
taatacgactcactataggggaacgtctcgcttggtgcaccgaaggagataacagaggagaatctccatgggtgcaccaaacctggcggcagcgcaaaagatg

SEQ ID NO: 2994 - DNA, 103 bp, Artificial Sequence
  Synthetic Polynucleotide
taatacgactcactatagggatggggaacgtctcgcttggtgcaccgaagaacagaggagacttcggatgaccaagcgaaacctggcggcagcgcaaaagatg

SEQ ID NO: 2995 - DNA, 103 bp, Artificial Sequence
  Synthetic Polynucleotide
taatacgactcactatagggatgtgatggggaacgtctcgcttggtgcacaacagaggagagtgcacatggcgagacgtaacctggcggcagcgcaaaagatg

SEQ ID NO: 2996 - DNA, 103 bp, Artificial Sequence
  Synthetic Polynucleotide
taatacgactcactatagggcccaaatgtgatggggaacgtctcgcttggaacagaggagaccaagcatgacgttccccaacctggcggcagcgcaaaagatg

SEQ ID NO: 2997 - DNA, 103 bp, Artificial Sequence
  Synthetic Polynucleotide
taatacgactcactatagggaagtccccaaatgtgatggggaacgtctcgaacagaggagacgagacatgccccatcacaacctggcggcagcgcaaaagatg

SEQ ID NO: 2998 - DNA, 103 bp, Artificial Sequence
  Synthetic Polynucleotide
taatacgactcactatagggccatgatgggttcttaatctcttgctttgcaacagaggagagcaaagatggagattaagaacctggcggcagcgcaaaagatg

SEQ ID NO: 2999 - DNA, 103 bp, Artificial Sequence
  Synthetic Polynucleotide
taatacgactcactatagggtcgcctggtggtatagcgacgtgggtgcgtaacagaggagaacgcacatgcgtcgctataacctggcggcagcgcaaaagatg

SEQ ID NO: 3000 - DNA, 103 bp, Artificial Sequence
  Synthetic Polynucleotide
taatacgactcactatagggcgttgaagtccccaaatgtgatggggaacgaacagaggagacgttccatgtcacatttgaacctggcggcagcgcaaaagatg

SEQ ID NO: 3001 - DNA, 103 bp, Artificial Sequence
  Synthetic Polynucleotide
taatacgactcactatagggtccttcgttgaagtccccaaatgtgatgggaacagaggagacccatcatgtttggggacaacctggcggcagcgcaaaagatg

SEQ ID NO: 3002 - DNA, 103 bp, Artificial Sequence
  Synthetic Polynucleotide
taatacgactcactatagggatttctccttcgttgaagtccccaaatgtgaacagaggagacacattatgggacttcaaaacctggcggcagcgcaaaagatg

SEQ ID NO: 3003 - DNA, 103 bp, Artificial Sequence
  Synthetic Polynucleotide
taatacgactcactatagggtttcgatttctccttcgttgaagtccccaaaacagaggagattggggatgtcaacgaagaacctggcggcagcgcaaaagatg

SEQ ID NO: 3004 - DNA, 103 bp, Artificial Sequence
  Synthetic Polynucleotide
taatacgactcactatagggcaagctttcgatttctccttcgttgaagtcaacagaggagagacttcatggaaggagaaaacctggcggcagcgcaaaagatg

SEQ ID NO: 3005 - DNA, 103 bp, Artificial Sequence
  Synthetic Polynucleotide
taatacgactcactataggggaagacaagctttcgatttctccttcgttgaacagaggagacaacgaatgagaaatcgaaacctggcggcagcgcaaaagatg

SEQ ID NO: 3006 - DNA, 103 bp, Artificial Sequence
  Synthetic Polynucleotide
taatacgactcactataggggctcagaagacaagctttcgatttctccttaacagaggagaaaggagatgtcgaaagctaacctggcggcagcgcaaaagatg

SEQ ID NO: 3007 - DNA, 103 bp, Artificial Sequence
  Synthetic Polynucleotide
taatacgactcactatagggtagtagctcagaagacaagctttcgatttcaacagaggagagaaatcatgagcttgtctaacctggcggcagcgcaaaagatg

SEQ ID NO: 3008 - DNA, 103 bp, Artificial Sequence
  Synthetic Polynucleotide
taatacgactcactatagggaaagttagtagctcagaagacaagctttcgaacagaggagacgaaagatggtcttctgaaacctggcggcagcgcaaaagatg

SEQ ID NO: 3009 - DNA, 103 bp, Artificial Sequence
  Synthetic Polynucleotide
taatacgactcactatagggctccgaaagttagtagctcagaagacaagcaacagaggagagcttgtatgctgagctacaacctggcggcagcgcaaaagatg

SEQ ID NO: 3010 - DNA, 103 bp, Artificial Sequence
  Synthetic Polynucleotide
taatacgactcactatagggtttaatcgcctggtggtatagcgacgtgggaacagaggagacccacgatgctataccacaacctggcggcagcgcaaaagatg

SEQ ID NO: 3011 - DNA, 103 bp, Artificial Sequence
  Synthetic Polynucleotide
taatacgactcactataggggaagtctccgaaagttagtagctcagaagaaacagaggagatcttctatgctactaactaacctggcggcagcgcaaaagatg

SEQ ID NO: 3012 - DNA, 103 bp, Artificial Sequence
  Synthetic Polynucleotide
taatacgactcactatagggggtaggaagtctccgaaagttagtagctcaaacagaggagatgagctatgaactttcggaacctggcggcagcgcaaaagatg

SEQ ID NO: 3013 - DNA, 103 bp, Artificial Sequence
  Synthetic Polynucleotide
taatacgactcactatagggctccgggtaggaagtctccgaaagttagtaaacagaggagatactaaatgtcggagactaacctggcggcagcgcaaaagatg

SEQ ID NO: 3014 - DNA, 103 bp, Artificial Sequence
  Synthetic Polynucleotide
taatacgactcactatagggcacttctccgggtaggaagtctccgaaagtaacagaggagaactttcatggacttcctaaacctggcggcagcgcaaaagatg

SEQ ID NO: 3015 - DNA, 103 bp, Artificial Sequence
  Synthetic Polynucleotide
taatacgactcactatagggtcatccacttctccgggtaggaagtctccgaacagaggagacggagaatgcctacccggaacctggcggcagcgcaaaagatg

SEQ ID NO: 3016 - DNA, 103 bp, Artificial Sequence
  Synthetic Polynucleotide
taatacgactcactatagggtcaaatcatccacttctccgggtaggaagtaacagaggagaacttccatgccggagaagaacctggcggcagcgcaaaagatg

SEQ ID NO: 3017 - DNA, 103 bp, Artificial Sequence
  Synthetic Polynucleotide
taatacgactcactatagggatctgtcaaatcatccacttctccgggtagaacagaggagactacccatggaagtggataacctggcggcagcgcaaaagatg

SEQ ID NO: 3018 - DNA, 103 bp, Artificial Sequence
  Synthetic Polynucleotide
taatacgactcactatagggtcgctatctgtcaaatcatccacttctccgaacagaggagacggagaatgggatgatttaacctggcggcagcgcaaaagatg

SEQ ID NO: 3019 - DNA, 103 bp, Artificial Sequence
  Synthetic Polynucleotide
taatacgactcactatagggaccagtcgctatctgtcaaatcatccacttaacagaggagaaagtggatgatttgacagaacctggcggcagcgcaaaagatg

SEQ ID NO: 3020 - DNA, 103 bp, Artificial Sequence
  Synthetic Polynucleotide
taatacgactcactatagggcgtggaccagtcgctatctgtcaaatcatcaacagaggagagatgatatgacagatagcaacctggcggcagcgcaaaagatg

SEQ ID NO: 3021 - DNA, 103 bp, Artificial Sequence
  Synthetic Polynucleotide
taatacgactcactatagggacccctttaatcgcctggtggtatagcgacaacagaggagagtcgctatgccaccaggcaacctggcggcagcgcaaaagatg

SEQ ID NO: 3022 - DNA, 103 bp, Artificial Sequence
  Synthetic Polynucleotide
taatacgactcactataggggagcacgtggaccagtcgctatctgtcaaaaacagaggagatttgacatgtagcgactgaacctggcggcagcgcaaaagatg

SEQ ID NO: 3023 - DNA, 103 bp, Artificial Sequence
  Synthetic Polynucleotide
taatacgactcactatagggtgtctgagcacgtggaccagtcgctatctgaacagaggagacagataatgactggtccaaacctggcggcagcgcaaaagatg

SEQ ID NO: 3024 - DNA, 103 bp, Artificial Sequence
  Synthetic Polynucleotide
taatacgactcactataggggtccgtgtctgagcacgtggaccagtcgctaacagaggagaagcgacatgtccacgtgcaacctggcggcagcgcaaaagatg

SEQ ID NO: 3025 - DNA, 103 bp, Artificial Sequence
  Synthetic Polynucleotide
taatacgactcactatagggtcgtcgtccgtgtctgagcacgtggaccagaacagaggagactggtcatggtgctcagaaacctggcggcagcgcaaaagatg

SEQ ID NO: 3026 - DNA, 103 bp, Artificial Sequence
  Synthetic Polynucleotide
taatacgactcactataggggtaactcgtcgtccgtgtctgagcacgtggaacagaggagaccacgtatgcagacacggaacctggcggcagcgcaaaagatg

SEQ ID NO: 3027 - DNA, 103 bp, Artificial Sequence
  Synthetic Polynucleotide
taatacgactcactatagggtagtcgtaactcgtcgtccgtgtctgagcaaacagaggagatgctcaatgacggacgacaacctggcggcagcgcaaaagatg

SEQ ID NO: 3028 - DNA, 103 bp, Artificial Sequence
  Synthetic Polynucleotide
taatacgactcactatagggctgtctagtcgtaactcgtcgtccgtgtctaacagaggagaagacacatgcgacgagttaacctggcggcagcgcaaaagatg

SEQ ID NO: 3029 - DNA, 103 bp, Artificial Sequence
  Synthetic Polynucleotide
taatacgactcactatagggctgccctgtctagtcgtaactcgtcgtccgaacagaggagacggacgatgagttacgacaacctggcggcagcgcaaaagatg

SEQ ID NO: 3030 - DNA, 103 bp, Artificial Sequence
  Synthetic Polynucleotide
taatacgactcactatagggcccacctgccctgtctagtcgtaactcgtcaacagaggagagacgagatgcgactagacaacctggcggcagcgcaaaagatg

SEQ ID NO: 3031 - DNA, 103 bp, Artificial Sequence
  Synthetic Polynucleotide
taatacgactcactatagggatatacccacctgccctgtctagtcgtaacaacagaggagagttacgatgagacagggcaacctggcggcagcgcaaaagatg

SEQ ID NO: 3032 - DNA, 103 bp, Artificial Sequence
  Synthetic Polynucleotide
taatacgactcactatagggatcggacccctttaatcgcctggtggtataaacagaggagatataccatgaggcgattaaacctggcggcagcgcaaaagatg

SEQ ID NO: 3033 - DNA, 103 bp, Artificial Sequence
  Synthetic Polynucleotide
taatacgactcactatagggagaatatatacccacctgccctgtctagtcaacagaggagagactagatggggcaggtgaacctggcggcagcgcaaaagatg

SEQ ID NO: 3034 - DNA, 103 bp, Artificial Sequence
  Synthetic Polynucleotide
taatacgactcactatagggcgacgagaatatatacccacctgccctgtcaacagaggagagacaggatgggtgggtataacctggcggcagcgcaaaagatg

SEQ ID NO: 3035 - DNA, 103 bp, Artificial Sequence
  Synthetic Polynucleotide
taatacgactcactataggggtgtccgacgagaatatatacccacctgccaacagaggagaggcaggatggtatatattaacctggcggcagcgcaaaagatg

SEQ ID NO: 3036 - DNA, 103 bp, Artificial Sequence
  Synthetic Polynucleotide
taatacgactcactataggggaccagtgtccgacgagaatatatacccacaacagaggagagtgggtatgtattctcgtaacctggcggcagcgcaaaagatg

SEQ ID NO: 3037 - DNA, 103 bp, Artificial Sequence
  Synthetic Polynucleotide
taatacgactcactatagggacctggaccagtgtccgacgagaatatataaacagaggagatatataatgtcgtcggacaacctggcggcagcgcaaaagatg

SEQ ID NO: 3038 - DNA, 103 bp, Artificial Sequence
  Synthetic Polynucleotide
taatacgactcactatagggaaatgacctggaccagtgtccgacgagaataacagaggagaattctcatgggacactggaacctggcggcagcgcaaaagatg

SEQ ID NO: 3039 - DNA, 103 bp, Artificial Sequence
  Synthetic Polynucleotide
taatacgactcactataggggttgtaaatgacctggaccagtgtccgacgaacagaggagacgtcggatgctggtccagaacctggcggcagcgcaaaagatg

SEQ ID NO: 3040 - DNA, 103 bp, Artificial Sequence
  Synthetic Polynucleotide
taatacgactcactatagggcttctgttgtaaatgacctggaccagtgtcaacagaggagagacactatgccaggtcataacctggcggcagcgcaaaagatg

SEQ ID NO: 3041 - DNA, 103 bp, Artificial Sequence
  Synthetic Polynucleotide
taatacgactcactatagggactgacttctgttgtaaatgacctggaccaaacagaggagatggtccatgtcatttacaaacctggcggcagcgcaaaagatg

SEQ ID NO: 3042 - DNA, 103 bp, Artificial Sequence
  Synthetic Polynucleotide
taatacgactcactatagggggcgtactgacttctgttgtaaatgacctgaacagaggagacaggtcatgtacaacagaaacctggcggcagcgcaaaagatg

SEQ ID NO: 3043 - DNA, 103 bp, Artificial Sequence
  Synthetic Polynucleotide
taatacgactcactatagggcgccaatcggacccctttaatcgcctggtgaacagaggagacaccagatgattaaagggaacctggcggcagcgcaaaagatg

SEQ ID NO: 3044 - DNA, 103 bp, Artificial Sequence
  Synthetic Polynucleotide
taatacgactcactatagggtgactggcgtactgacttctgttgtaaatgaacagaggagacatttaatgcagaagtcaaacctggcggcagcgcaaaagatg

SEQ ID NO: 3045 - DNA, 103 bp, Artificial Sequence
  Synthetic Polynucleotide
taatacgactcactatagggagcactgactggcgtactgacttctgttgtaacagaggagaacaacaatggtcagtacgaacctggcggcagcgcaaaagatg

SEQ ID NO: 3046 - DNA, 103 bp, Artificial Sequence
  Synthetic Polynucleotide
taatacgactcactatagggccggcagcactgactggcgtactgacttctaacagaggagaagaagtatgtacgccagtaacctggcggcagcgcaaaagatg

SEQ ID NO: 3047 - DNA, 103 bp, Artificial Sequence
  Synthetic Polynucleotide
taatacgactcactataggggttcaccggcagcactgactggcgtactgaaacagaggagatcagtaatgcagtcagtgaacctggcggcagcgcaaaagatg

SEQ ID NO: 3048 - DNA, 103 bp, Artificial Sequence
  Synthetic Polynucleotide
taatacgactcactatagggagggtgttcaccggcagcactgactggcgtaacagaggagaacgccaatgagtgctgccaacctggcggcagcgcaaaagatg

SEQ ID NO: 3049 - DNA, 103 bp, Artificial Sequence
  Synthetic Polynucleotide
taatacgactcactatagggcctccagggtgttcaccggcagcactgactaacagaggagaagtcagatgtgccggtgaaacctggcggcagcgcaaaagatg

SEQ ID NO: 3050 - DNA, 103 bp, Artificial Sequence
  Synthetic Polynucleotide
taatacgactcactataggggacttcctccagggtgttcaccggcagcacaacagaggagagtgctgatggtgaacaccaacctggcggcagcgcaaaagatg

SEQ ID NO: 3051 - DNA, 103 bp, Artificial Sequence
  Synthetic Polynucleotide
taatacgactcactatagggtcgtggacttcctccagggtgttcaccggcaacagaggagagccggtatgcaccctggaaacctggcggcagcgcaaaagatg

SEQ ID NO: 3052 - DNA, 103 bp, Artificial Sequence
  Synthetic Polynucleotide
taatacgactcactatagggtctcctcgtggacttcctccagggtgttcaaacagaggagatgaacaatgtggaggaagaacctggcggcagcgcaaaagatg

SEQ ID NO: 3053 - DNA, 103 bp, Artificial Sequence
  Synthetic Polynucleotide
taatacgactcactatagggacacttctcctcgtggacttcctccagggtaacagaggagaaccctgatggaagtccacaacctggcggcagcgcaaaagatg

SEQ ID NO: 3054 - DNA, 103 bp, Artificial Sequence
  Synthetic Polynucleotide
taatacgactcactatagggcagtacgccaatcggacccctttaatcgccaacagaggagaggcgatatgaggggtccgaacctggcggcagcgcaaaagatg

SEQ ID NO: 3055 - DNA, 103 bp, Artificial Sequence
  Synthetic Polynucleotide
taatacgactcactataggggggtaacacttctcctcgtggacttcctccaacagaggagaggaggaatgccacgaggaaacctggcggcagcgcaaaagatg

SEQ ID NO: 3056 - DNA, 103 bp, Artificial Sequence
  Synthetic Polynucleotide
taatacgactcactatagggtaggtgggtaacacttctcctcgtggacttaacagaggagaaagtccatgaggagaagtaacctggcggcagcgcaaaagatg

SEQ ID NO: 3057 - DNA, 103 bp, Artificial Sequence
  Synthetic Polynucleotide
taatacgactcactatagggcagcttaggtgggtaacacttctcctcgtgaacagaggagacacgagatgaagtgttacaacctggcggcagcgcaaaagatg

SEQ ID NO: 3058 - DNA, 103 bp, Artificial Sequence
  Synthetic Polynucleotide
taatacgactcactatagggtcatccagcttaggtgggtaacacttctccaacagaggagaggagaaatgttacccaccaacctggcggcagcgcaaaagatg

SEQ ID NO: 3059 - DNA, 103 bp, Artificial Sequence
  Synthetic Polynucleotide
taatacgactcactatagggttgcttcatccagcttaggtgggtaacactaacagaggagaagtgttatgcacctaagcaacctggcggcagcgcaaaagatg

SEQ ID NO: 3060 - DNA, 103 bp, Artificial Sequence
  Synthetic Polynucleotide
taatacgactcactatagggctcctttgcttcatccagcttaggtgggtaaacagaggagatacccaatgaagctggataacctggcggcagcgcaaaagatg

SEQ ID NO: 3061 - DNA, 103 bp, Artificial Sequence
  Synthetic Polynucleotide
taatacgactcactatagggagttgctcctttgcttcatccagcttaggtaacagaggagaacctaaatgggatgaagcaacctggcggcagcgcaaaagatg

SEQ ID NO: 3062 - DNA, 103 bp, Artificial Sequence
  Synthetic Polynucleotide
taatacgactcactataggggtagtagttgctcctttgcttcatccagctaacagaggagaagctggatgaagcaaaggaacctggcggcagcgcaaaagatg

SEQ ID NO: 3063 - DNA, 103 bp, Artificial Sequence
  Synthetic Polynucleotide
taatacgactcactatagggcttaagtagtagttgctcctttgcttcatcaacagaggagagatgaaatgaaggagcaaaacctggcggcagcgcaaaagatg

SEQ ID NO: 3064 - DNA, 103 bp, Artificial Sequence
  Synthetic Polynucleotide
taatacgactcactatagggagtttcttaagtagtagttgctcctttgctaacagaggagaagcaaaatggcaactactaacctggcggcagcgcaaaagatg

SEQ ID NO: 3065 - DNA, 103 bp, Artificial Sequence
  Synthetic Polynucleotide
taatacgactcactatagggctacccagtacgccaatcggacccctttaaaacagaggagattaaagatgtccgattggaacctggcggcagcgcaaaagatg

SEQ ID NO: 3066 - DNA, 103 bp, Artificial Sequence
  Synthetic Polynucleotide
taatacgactcactatagggcctggagtttcttaagtagtagttgctcctaacagaggagaaggagcatgtactacttaaacctggcggcagcgcaaaagatg

SEQ ID NO: 3067 - DNA, 103 bp, Artificial Sequence
  Synthetic Polynucleotide
taatacgactcactatagggactctcctggagtttcttaagtagtagttgaacagaggagacaactaatgcttaagaaaaacctggcggcagcgcaaaagatg

SEQ ID NO: 3068 - DNA, 103 bp, Artificial Sequence
  Synthetic Polynucleotide
taatacgactcactataggggatgcactctcctggagtttcttaagtagtaacagaggagaactactatggaaactccaaacctggcggcagcgcaaaagatg

SEQ ID NO: 3069 - DNA, 103 bp, Artificial Sequence
  Synthetic Polynucleotide
taatacgactcactatagggccatggatgcactctcctggagtttcttaaaacagaggagattaagaatgtccaggagaaacctggcggcagcgcaaaagatg

SEQ ID NO: 3070 - DNA, 103 bp, Artificial Sequence
  Synthetic Polynucleotide
taatacgactcactataggggttggccatggatgcactctcctggagtttaacagaggagaaaactcatggagagtgcaaacctggcggcagcgcaaaagatg

SEQ ID NO: 3071 - DNA, 103 bp, Artificial Sequence
  Synthetic Polynucleotide
taatacgactcactatagggcttctgttggccatggatgcactctcctggaacagaggagaccaggaatgtgcatccataacctggcggcagcgcaaaagatg

SEQ ID NO: 3072 - DNA, 103 bp, Artificial Sequence
  Synthetic Polynucleotide
taatacgactcactatagggacctgcttctgttggccatggatgcactctaacagaggagaagagtgatgccatggccaaacctggcggcagcgcaaaagatg

SEQ ID NO: 3073 - DNA, 103 bp, Artificial Sequence
  Synthetic Polynucleotide
taatacgactcactatagggctgatacctgcttctgttggccatggatgcaacagaggagagcatccatggccaacagaaacctggcggcagcgcaaaagatg

SEQ ID NO: 3074 - DNA, 103 bp, Artificial Sequence
  Synthetic Polynucleotide
taatacgactcactatagggcgcgactgatacctgcttctgttggccatgaacagaggagacatggcatgcagaagcagaacctggcggcagcgcaaaagatg

SEQ ID NO: 3075 - DNA, 103 bp, Artificial Sequence
  Synthetic Polynucleotide
taatacgactcactatagggctttgcgcgactgatacctgcttctgttggaacagaggagaccaacaatggcaggtatcaacctggcggcagcgcaaaagatg

SEQ ID NO: 3076 - DNA, 103 bp, Artificial Sequence
  Synthetic Polynucleotide
taatacgactcactatagggaaaccctacccagtacgccaatcggaccccaacagaggagaggggtcatgttggcgtacaacctggcggcagcgcaaaagatg

SEQ ID NO: 3077 - DNA, 103 bp, Artificial Sequence
  Synthetic Polynucleotide
taatacgactcactatagggttctactttgcgcgactgatacctgcttctaacagaggagaagaagcatgtatcagtcgaacctggcggcagcgcaaaagatg

SEQ ID NO: 3078 - DNA, 103 bp, Artificial Sequence
  Synthetic Polynucleotide
taatacgactcactatagggatgttttctactttgcgcgactgatacctgaacagaggagacaggtaatggtcgcgcaaaacctggcggcagcgcaaaagatg

SEQ ID NO: 3079 - DNA, 103 bp, Artificial Sequence
  Synthetic Polynucleotide
taatacgactcactatagggctttcatgttttctactttgcgcgactgataacagaggagaatcagtatggcaaagtagaacctggcggcagcgcaaaagatg

SEQ ID NO: 3080 - DNA, 103 bp, Artificial Sequence
  Synthetic Polynucleotide
taatacgactcactatagggtgttgctttcatgttttctactttgcgcgaaacagaggagatcgcgcatggtagaaaacaacctggcggcagcgcaaaagatg

SEQ ID NO: 3081 - DNA, 103 bp, Artificial Sequence
  Synthetic Polynucleotide
taatacgactcactatagggatgattgttgctttcatgttttctactttgaacagaggagacaaagtatgaaacatgaaaacctggcggcagcgcaaaagatg

SEQ ID NO: 3082 - DNA, 103 bp, Artificial Sequence
  Synthetic Polynucleotide
taatacgactcactatagggtctggatgattgttgctttcatgttttctaaacagaggagatagaaaatgtgaaagcaaaacctggcggcagcgcaaaagatg

SEQ ID NO: 3083 - DNA, 103 bp, Artificial Sequence
  Synthetic Polynucleotide
taatacgactcactatagggtagtctctggatgattgttgctttcatgttaacagaggagaaacatgatggcaacaatcaacctggcggcagcgcaaaagatg

SEQ ID NO: 3084 - DNA, 103 bp, Artificial Sequence
  Synthetic Polynucleotide
taatacgactcactatagggctctttagtctctggatgattgttgctttcaacagaggagagaaagcatgaatcatccaaacctggcggcagcgcaaaagatg

SEQ ID NO: 3085 - DNA, 103 bp, Artificial Sequence
  Synthetic Polynucleotide
taatacgactcactatagggagcctctctttagtctctggatgattgttgaacagaggagacaacaaatgtccagagacaacctggcggcagcgcaaaagatg

SEQ ID NO: 3086 - DNA, 103 bp, Artificial Sequence
  Synthetic Polynucleotide
taatacgactcactatagggtctacagcctctctttagtctctggatgataacagaggagaatcatcatgagactaaagaacctggcggcagcgcaaaagatg

SEQ ID NO: 3087 - DNA, 103 bp, Artificial Sequence
  Synthetic Polynucleotide
taatacgactcactataggggtgtcaaaccctacccagtacgccaatcggaacagaggagaccgattatggtactgggtaacctggcggcagcgcaaaagatg

SEQ ID NO: 3088 - DNA, 103 bp, Artificial Sequence
  Synthetic Polynucleotide
taatacgactcactatagggtataatctacagcctctctttagtctctggaacagaggagaccagagatgaaagagaggaacctggcggcagcgcaaaagatg

SEQ ID NO: 3089 - DNA, 103 bp, Artificial Sequence
  Synthetic Polynucleotide
taatacgactcactatagggttaagtataatctacagcctctctttagtcaacagaggagagactaaatggaggctgtaaacctggcggcagcgcaaaagatg

SEQ ID NO: 3090 - DNA, 103 bp, Artificial Sequence
  Synthetic Polynucleotide
taatacgactcactatagggtgacattaagtataatctacagcctctcttaacagaggagaaagagaatgtgtagattaaacctggcggcagcgcaaaagatg

SEQ ID NO: 3091 - DNA, 103 bp, Artificial Sequence
  Synthetic Polynucleotide
taatacgactcactataggggtctctgacattaagtataatctacagcctaacagaggagaaggctgatgattatacttaacctggcggcagcgcaaaagatg

SEQ ID NO: 3092 - DNA, 103 bp, Artificial Sequence
  Synthetic Polynucleotide
taatacgactcactatagggttggggtctctgacattaagtataatctacaacagaggagagtagatatgacttaatgtaacctggcggcagcgcaaaagatg

SEQ ID NO: 3093 - DNA, 103 bp, Artificial Sequence
  Synthetic Polynucleotide
taatacgactcactataggggacttttggggtctctgacattaagtataaaacagaggagattatacatgatgtcagagaacctggcggcagcgcaaaagatg

SEQ ID NO: 3094 - DNA, 103 bp, Artificial Sequence
  Synthetic Polynucleotide
taatacgactcactataggggtagggacttttggggtctctgacattaagaacagaggagacttaatatgagagaccccaacctggcggcagcgcaaaagatg

SEQ ID NO: 3095 - DNA, 103 bp, Artificial Sequence
  Synthetic Polynucleotide
taatacgactcactatagggggtaggtagggacttttggggtctctgacaaacagaggagatgtcagatgccccaaaagaacctggcggcagcgcaaaagatg

SEQ ID NO: 3096 - DNA, 103 bp, Artificial Sequence
  Synthetic Polynucleotide
taatacgactcactatagggggtccggtaggtagggacttttggggtctcaacagaggagagagaccatgaaagtccctaacctggcggcagcgcaaaagatg

SEQ ID NO: 3097 - DNA, 103 bp, Artificial Sequence
  Synthetic Polynucleotide
taatacgactcactatagggtatgtggtccggtaggtagggacttttgggaacagaggagacccaaaatgccctacctaaacctggcggcagcgcaaaagatg

SEQ ID NO: 3098 - DNA, 103 bp, Artificial Sequence
  Synthetic Polynucleotide
taatacgactcactataggggggttgtgtcaaaccctacccagtacgccaaacagaggagatggcgtatggggtagggtaacctggcggcagcgcaaaagatg

SEQ ID NO: 3099 - DNA, 103 bp, Artificial Sequence
  Synthetic Polynucleotide
taatacgactcactatagggccggatatgtggtccggtaggtagggacttaacagaggagaaagtccatgcctaccggaaacctggcggcagcgcaaaagatg

SEQ ID NO: 3100 - DNA, 103 bp, Artificial Sequence
  Synthetic Polynucleotide
taatacgactcactatagggaggcgccggatatgtggtccggtaggtaggaacagaggagacctaccatgcggaccacaaacctggcggcagcgcaaaagatg

SEQ ID NO: 3101 - DNA, 103 bp, Artificial Sequence
  Synthetic Polynucleotide
taatacgactcactatagggtacacaggcgccggatatgtggtccggtagaacagaggagactaccgatgcacatatccaacctggcggcagcgcaaaagatg

SEQ ID NO: 3102 - DNA, 103 bp, Artificial Sequence
  Synthetic Polynucleotide
taatacgactcactataggggcgagtacacaggcgccggatatgtggtccaacagaggagaggaccaatgatccggcgcaacctggcggcagcgcaaaagatg

SEQ ID NO: 3103 - DNA, 103 bp, Artificial Sequence
  Synthetic Polynucleotide
taatacgactcactatagggcggaggcgagtacacaggcgccggatatgtaacagaggagaacatatatggcgcctgtgaacctggcggcagcgcaaaagatg

SEQ ID NO: 3104 - DNA, 103 bp, Artificial Sequence
  Synthetic Polynucleotide
taatacgactcactatagggttaatcggaggcgagtacacaggcgccggaaacagaggagatccggcatgtgtgtactcaacctggcggcagcgcaaaagatg

SEQ ID NO: 3105 - DNA, 103 bp, Artificial Sequence
  Synthetic Polynucleotide
taatacgactcactatagggggacgttaatcggaggcgagtacacaggcgaacagaggagacgcctgatgactcgcctcaacctggcggcagcgcaaaagatg

SEQ ID NO: 3106 - DNA, 103 bp, Artificial Sequence
  Synthetic Polynucleotide
taatacgactcactatagggcagtcggacgttaatcggaggcgagtacacaacagaggagagtgtacatgcctccgattaacctggcggcagcgcaaaagatg

SEQ ID NO: 3107 - DNA, 103 bp, Artificial Sequence
  Synthetic Polynucleotide
taatacgactcactatagggttggacagtcggacgttaatcggaggcgagaacagaggagactcgccatggattaacgtaacctggcggcagcgcaaaagatg

SEQ ID NO: 3108 - DNA, 103 bp, Artificial Sequence
  Synthetic Polynucleotide
taatacgactcactatagggcggggttggacagtcggacgttaatcggagaacagaggagactccgaatgacgtccgacaacctggcggcagcgcaaaagatg

SEQ ID NO: 3109 - DNA, 103 bp, Artificial Sequence
  Synthetic Polynucleotide
taatacgactcactatagggaggatccatgatgggttcttaatctcttgcaacagaggagagcaagaatgtaagaacccaacctggcggcagcgcaaaagatg

SEQ ID NO: 3110 - DNA, 103 bp, Artificial Sequence
  Synthetic Polynucleotide
taatacgactcactataggggaacggggttgtgtcaaaccctacccagtaaacagaggagatactggatggggtttgacaacctggcggcagcgcaaaagatg

SEQ ID NO: 3111 - DNA, 103 bp, Artificial Sequence
  Synthetic Polynucleotide
taatacgactcactatagggggactcggggttggacagtcggacgttaataacagaggagaattaacatgcgactgtccaacctggcggcagcgcaaaagatg

SEQ ID NO: 3112 - DNA, 103 bp, Artificial Sequence
  Synthetic Polynucleotide
taatacgactcactatagggactgcggactcggggttggacagtcggacgaacagaggagacgtccgatggtccaacccaacctggcggcagcgcaaaagatg

SEQ ID NO: 3113 - DNA, 103 bp, Artificial Sequence
  Synthetic Polynucleotide
taatacgactcactatagggctgccactgcggactcggggttggacagtcaacagaggagagactgtatgaccccgagtaacctggcggcagcgcaaaagatg

SEQ ID NO: 3114 - DNA, 103 bp, Artificial Sequence
  Synthetic Polynucleotide
taatacgactcactataggggcatgctgccactgcggactcggggttggaaacagaggagatccaacatggagtccgcaaacctggcggcagcgcaaaagatg

SEQ ID NO: 3115 - DNA, 103 bp, Artificial Sequence
  Synthetic Polynucleotide
taatacgactcactatagggtcattgcatgctgccactgcggactcggggaacagaggagaccccgaatgcgcagtggcaacctggcggcagcgcaaaagatg

SEQ ID NO: 3116 - DNA, 103 bp, Artificial Sequence
  Synthetic Polynucleotide
taatacgactcactatagggagaactcattgcatgctgccactgcggactaacagaggagaagtccgatgtggcagcataacctggcggcagcgcaaaagatg

SEQ ID NO: 3117 - DNA, 103 bp, Artificial Sequence
  Synthetic Polynucleotide
taatacgactcactatagggagccaagaactcattgcatgctgccactgcaacagaggagagcagtgatggcatgcaataacctggcggcagcgcaaaagatg

SEQ ID NO: 3118 - DNA, 103 bp, Artificial Sequence
  Synthetic Polynucleotide
taatacgactcactatagggtttctagccaagaactcattgcatgctgccaacagaggagaggcagcatgcaatgagttaacctggcggcagcgcaaaagatg

SEQ ID NO: 3119 - DNA, 103 bp, Artificial Sequence
  Synthetic Polynucleotide
taatacgactcactataggggatagtttctagccaagaactcattgcatgaacagaggagacatgcaatgagttcttggaacctggcggcagcgcaaaagatg

SEQ ID NO: 3120 - DNA, 103 bp, Artificial Sequence
  Synthetic Polynucleotide
taatacgactcactatagggagttggatagtttctagccaagaactcattaacagaggagaaatgagatgttggctagaaacctggcggcagcgcaaaagatg

SEQ ID NO: 3121 - DNA, 103 bp, Artificial Sequence
  Synthetic Polynucleotide
taatacgactcactatagggtacatgaacggggttgtgtcaaaccctaccaacagaggagaggtaggatgtgacacaacaacctggcggcagcgcaaaagatg

SEQ ID NO: 3122 - DNA, 103 bp, Artificial Sequence
  Synthetic Polynucleotide
taatacgactcactataggggaaacagttggatagtttctagccaagaacaacagaggagagttcttatgtagaaactaaacctggcggcagcgcaaaagatg

SEQ ID NO: 3123 - DNA, 103 bp, Artificial Sequence
  Synthetic Polynucleotide
taatacgactcactatagggatgatgaaacagttggatagtttctagccaaacagaggagatggctaatgactatccaaaacctggcggcagcgcaaaagatg

SEQ ID NO: 3124 - DNA, 103 bp, Artificial Sequence
  Synthetic Polynucleotide
taatacgactcactatagggttggtatgatgaaacagttggatagtttctaacagaggagaagaaacatgccaactgttaacctggcggcagcgcaaaagatg

SEQ ID NO: 3125 - DNA, 103 bp, Artificial Sequence
  Synthetic Polynucleotide
taatacgactcactataggggtgatttggtatgatgaaacagttggatagaacagaggagactatccatgtgtttcatcaacctggcggcagcgcaaaagatg

SEQ ID NO: 3126 - DNA, 103 bp, Artificial Sequence
  Synthetic Polynucleotide
taatacgactcactatagggcgtcggtgatttggtatgatgaaacagttgaacagaggagacaactgatgcatcataccaacctggcggcagcgcaaaagatg

SEQ ID NO: 3127 - DNA, 103 bp, Artificial Sequence
  Synthetic Polynucleotide
taatacgactcactatagggatactcgtcggtgatttggtatgatgaaacaacagaggagagtttcaatgtaccaaatcaacctggcggcagcgcaaaagatg

SEQ ID NO: 3128 - DNA, 103 bp, Artificial Sequence
  Synthetic Polynucleotide
taatacgactcactataggggcatcatactcgtcggtgatttggtatgataacagaggagaatcataatgaatcaccgaaacctggcggcagcgcaaaagatg

SEQ ID NO: 3129 - DNA, 103 bp, Artificial Sequence
  Synthetic Polynucleotide
taatacgactcactataggggatatgcatcatactcgtcggtgatttggtaacagaggagaaccaaaatgccgacgagtaacctggcggcagcgcaaaagatg

SEQ ID NO: 3130 - DNA, 103 bp, Artificial Sequence
  Synthetic Polynucleotide
taatacgactcactataggggtctagatatgcatcatactcgtcggtgataacagaggagaatcaccatggagtatgataacctggcggcagcgcaaaagatg

SEQ ID NO: 3131 - DNA, 103 bp, Artificial Sequence
  Synthetic Polynucleotide
taatacgactcactatagggaccatgtctagatatgcatcatactcgtcgaacagaggagacgacgaatgtgatgcataaacctggcggcagcgcaaaagatg

SEQ ID NO: 3132 - DNA, 103 bp, Artificial Sequence
  Synthetic Polynucleotide
taatacgactcactatagggcattgtacatgaacggggttgtgtcaaaccaacagaggagaggtttgatgcaaccccgtaacctggcggcagcgcaaaagatg

SEQ ID NO: 3133 - DNA, 103 bp, Artificial Sequence
  Synthetic Polynucleotide
taatacgactcactatagggcgtccaccatgtctagatatgcatcatactaacagaggagaagtatgatgcatatctagaacctggcggcagcgcaaaagatg

SEQ ID NO: 3134 - DNA, 103 bp, Artificial Sequence
  Synthetic Polynucleotide
taatacgactcactatagggcgacccgtccaccatgtctagatatgcatcaacagaggagagatgcaatgctagacatgaacctggcggcagcgcaaaagatg

SEQ ID NO: 3135 - DNA, 103 bp, Artificial Sequence
  Synthetic Polynucleotide
taatacgactcactatagggctctccgacccgtccaccatgtctagatataacagaggagaatatctatgcatggtggaaacctggcggcagcgcaaaagatg

SEQ ID NO: 3136 - DNA, 103 bp, Artificial Sequence
  Synthetic Polynucleotide
taatacgactcactataggggacaactctccgacccgtccaccatgtctaaacagaggagatagacaatgtggacgggtaacctggcggcagcgcaaaagatg

SEQ ID NO: 3137 - DNA, 103 bp, Artificial Sequence
  Synthetic Polynucleotide
taatacgactcactataggggtccagacaactctccgacccgtccaccataacagaggagaatggtgatggggtcggagaacctggcggcagcgcaaaagatg

SEQ ID NO: 3138 - DNA, 103 bp, Artificial Sequence
  Synthetic Polynucleotide
taatacgactcactataggggctcggtccagacaactctccgacccgtccaacagaggagaggacggatgggagagttgaacctggcggcagcgcaaaagatg

SEQ ID NO: 3139 - DNA, 103 bp, Artificial Sequence
  Synthetic Polynucleotide
taatacgactcactatagggatgtcgctcggtccagacaactctccgaccaacagaggagaggtcggatggttgtctggaacctggcggcagcgcaaaagatg

SEQ ID NO: 3140 - DNA, 103 bp, Artificial Sequence
  Synthetic Polynucleotide
taatacgactcactatagggattgaatgtcgctcggtccagacaactctcaacagaggagagagagtatgctggaccgaaacctggcggcagcgcaaaagatg

SEQ ID NO: 3141 - DNA, 103 bp, Artificial Sequence
  Synthetic Polynucleotide
taatacgactcactataggggacggattgaatgtcgctcggtccagacaaaacagaggagattgtctatgccgagcgacaacctggcggcagcgcaaaagatg

SEQ ID NO: 3142 - DNA, 103 bp, Artificial Sequence
  Synthetic Polynucleotide
taatacgactcactataggggttttgacggattgaatgtcgctcggtccaaacagaggagatggaccatgcgacattcaaacctggcggcagcgcaaaagatg

SEQ ID NO: 3143 - DNA, 103 bp, Artificial Sequence
  Synthetic Polynucleotide
taatacgactcactatagggcatggcattgtacatgaacggggttgtgtcaacagaggagagacacaatgccgttcatgaacctggcggcagcgcaaaagatg

SEQ ID NO: 3144 - DNA, 103 bp, Artificial Sequence
  Synthetic Polynucleotide
taatacgactcactatagggcctaagttttgacggattgaatgtcgctcgaacagaggagacgagcgatgttcaatccgaacctggcggcagcgcaaaagatg

SEQ ID NO: 3145 - DNA, 103 bp, Artificial Sequence
  Synthetic Polynucleotide
taatacgactcactatagggtagctcctaagttttgacggattgaatgtcaacagaggagagacattatgtccgtcaaaaacctggcggcagcgcaaaagatg

SEQ ID NO: 3146 - DNA, 103 bp, Artificial Sequence
  Synthetic Polynucleotide
taatacgactcactatagggttgggtagctcctaagttttgacggattgaaacagaggagatcaatcatgcaaaacttaaacctggcggcagcgcaaaagatg

SEQ ID NO: 3147 - DNA, 103 bp, Artificial Sequence
  Synthetic Polynucleotide
taatacgactcactatagggctgttttgggtagctcctaagttttgacggaacagaggagaccgtcaatgcttaggagcaacctggcggcagcgcaaaagatg

SEQ ID NO: 3148 - DNA, 103 bp, Artificial Sequence
  Synthetic Polynucleotide
taatacgactcactataggggcgtgctgttttgggtagctcctaagttttaacagaggagaaaaactatggagctacccaacctggcggcagcgcaaaagatg

SEQ ID NO: 3149 - DNA, 103 bp, Artificial Sequence
  Synthetic Polynucleotide
taatacgactcactatagggggtaagcgtgctgttttgggtagctcctaaaacagaggagattaggaatgacccaaaacaacctggcggcagcgcaaaagatg

SEQ ID NO: 3150 - DNA, 103 bp, Artificial Sequence
  Synthetic Polynucleotide
taatacgactcactatagggcgcgtggtaagcgtgctgttttgggtagctaacagaggagaagctacatgaaacagcacaacctggcggcagcgcaaaagatg

SEQ ID NO: 3151 - DNA, 103 bp, Artificial Sequence
  Synthetic Polynucleotide
taatacgactcactataggggagggcgcgtggtaagcgtgctgttttgggaacagaggagacccaaaatggcacgcttaaacctggcggcagcgcaaaagatg

SEQ ID NO: 3152 - DNA, 103 bp, Artificial Sequence
  Synthetic Polynucleotide
taatacgactcactatagggtgatggagggcgcgtggtaagcgtgctgttaacagaggagaaacagcatgcttaccacgaacctggcggcagcgcaaaagatg

SEQ ID NO: 3153 - DNA, 103 bp, Artificial Sequence
  Synthetic Polynucleotide
taatacgactcactataggggcttctgatggagggcgcgtggtaagcgtgaacagaggagacacgctatgcacgcgcccaacctggcggcagcgcaaaagatg

SEQ ID NO: 3154 - DNA, 103 bp, Artificial Sequence
  Synthetic Polynucleotide
taatacgactcactatagggcccgccatggcattgtacatgaacggggttaacagaggagaaaccccatgcatgtacaaaacctggcggcagcgcaaaagatg

SEQ ID NO: 3155 - DNA, 103 bp, Artificial Sequence
  Synthetic Polynucleotide
taatacgactcactatagggacagcgcttctgatggagggcgcgtggtaaaacagaggagattaccaatggccctccataacctggcggcagcgcaaaagatg

SEQ ID NO: 3156 - DNA, 103 bp, Artificial Sequence
  Synthetic Polynucleotide
taatacgactcactatagggacggtacagcgcttctgatggagggcgcgtaacagaggagaacgcgcatgccatcagaaaacctggcggcagcgcaaaagatg

SEQ ID NO: 3157 - DNA, 103 bp, Artificial Sequence
  Synthetic Polynucleotide
taatacgactcactatagggtggggacggtacagcgcttctgatggagggaacagaggagaccctccatgagaagcgctaacctggcggcagcgcaaaagatg

SEQ ID NO: 3158 - DNA, 103 bp, Artificial Sequence
  Synthetic Polynucleotide
taatacgactcactatagggtggaatggggacggtacagcgcttctgatgaacagaggagacatcagatgcgctgtaccaacctggcggcagcgcaaaagatg

SEQ ID NO: 3159 - DNA, 103 bp, Artificial Sequence
  Synthetic Polynucleotide
taatacgactcactatagggtgttctggaatggggacggtacagcgcttcaacagaggagagaagcgatgtaccgtcccaacctggcggcagcgcaaaagatg

SEQ ID NO: 3160 - DNA, 103 bp, Artificial Sequence
  Synthetic Polynucleotide
taatacgactcactatagggtagtgtgttctggaatggggacggtacagcaacagaggagagctgtaatgtccccattcaacctggcggcagcgcaaaagatg

SEQ ID NO: 3161 - DNA, 103 bp, Artificial Sequence
  Synthetic Polynucleotide
taatacgactcactatagggttctgtagtgtgttctggaatggggacggtaacagaggagaaccgtcatgattccagaaaacctggcggcagcgcaaaagatg

SEQ ID NO: 3162 - DNA, 103 bp, Artificial Sequence
  Synthetic Polynucleotide
taatacgactcactataggggtacattctgtagtgtgttctggaatggggaacagaggagaccccatatgagaacacacaacctggcggcagcgcaaaagatg

SEQ ID NO: 3163 - DNA, 103 bp, Artificial Sequence
  Synthetic Polynucleotide
taatacgactcactatagggtgccagtacattctgtagtgtgttctggaaaacagaggagattccagatgacactacagaacctggcggcagcgcaaaagatg

SEQ ID NO: 3164 - DNA, 103 bp, Artificial Sequence
  Synthetic Polynucleotide
taatacgactcactataggggctgctgccagtacattctgtagtgtgttcaacagaggagagaacacatgacagaatgtaacctggcggcagcgcaaaagatg

SEQ ID NO: 3165 - DNA, 103 bp, Artificial Sequence
  Synthetic Polynucleotide
taatacgactcactatagggaggcacccgccatggcattgtacatgaacgaacagaggagacgttcaatgacaatgccaaacctggcggcagcgcaaaagatg

SEQ ID NO: 3166 - DNA, 103 bp, Artificial Sequence
  Synthetic Polynucleotide
taatacgactcactatagggtcgtggctgctgccagtacattctgtagtgaacagaggagacactacatgatgtactggaacctggcggcagcgcaaaagatg

SEQ ID NO: 3167 - DNA, 103 bp, Artificial Sequence
  Synthetic Polynucleotide
taatacgactcactatagggtcttttcgtggctgctgccagtacattctgaacagaggagacagaatatgctggcagcaaacctggcggcagcgcaaaagatg

SEQ ID NO: 3168 - DNA, 103 bp, Artificial Sequence
  Synthetic Polynucleotide
taatacgactcactatagggcagtttcttttcgtggctgctgccagtacaaacagaggagatgtactatgagcagccacaacctggcggcagcgcaaaagatg

SEQ ID NO: 3169 - DNA, 103 bp, Artificial Sequence
  Synthetic Polynucleotide
taatacgactcactatagggcgttgcagtttcttttcgtggctgctgccaaacagaggagatggcagatgccacgaaaaaacctggcggcagcgcaaaagatg

SEQ ID NO: 3170 - DNA, 103 bp, Artificial Sequence
  Synthetic Polynucleotide
taatacgactcactatagggtgtgacgttgcagtttcttttcgtggctgcaacagaggagagcagccatgaaaagaaacaacctggcggcagcgcaaaagatg

SEQ ID NO: 3171 - DNA, 103 bp, Artificial Sequence
  Synthetic Polynucleotide
taatacgactcactatagggatctgtgtgacgttgcagtttcttttcgtgaacagaggagacacgaaatgaaactgcaaaacctggcggcagcgcaaaagatg

SEQ ID NO: 3172 - DNA, 103 bp, Artificial Sequence
  Synthetic Polynucleotide
taatacgactcactatagggccctcatctgtgtgacgttgcagtttctttaacagaggagaaaagaaatggcaacgtcaaacctggcggcagcgcaaaagatg

SEQ ID NO: 3173 - DNA, 103 bp, Artificial Sequence
  Synthetic Polynucleotide
taatacgactcactatagggtaattccctcatctgtgtgacgttgcagttaacagaggagaaactgcatggtcacacagaacctggcggcagcgcaaaagatg

SEQ ID NO: 3174 - DNA, 103 bp, Artificial Sequence
  Synthetic Polynucleotide
taatacgactcactataggggtgggtaattccctcatctgtgtgacgttgaacagaggagacaacgtatgacagatgagaacctggcggcagcgcaaaagatg

SEQ ID NO: 3175 - DNA, 103 bp, Artificial Sequence
  Synthetic Polynucleotide
taatacgactcactatagggccaaagtgggtaattccctcatctgtgtgaaacagaggagatcacacatgtgagggaataacctggcggcagcgcaaaagatg

SEQ ID NO: 3176 - DNA, 103 bp, Artificial Sequence
  Synthetic Polynucleotide
taatacgactcactatagggggggtaggcacccgccatggcattgtacataacagaggagaatgtacatggccatggcgaacctggcggcagcgcaaaagatg

SEQ ID NO: 3177 - DNA, 103 bp, Artificial Sequence
  Synthetic Polynucleotide
taatacgactcactatagggtgagtccaaagtgggtaattccctcatctgaacagaggagacagatgatggaattacccaacctggcggcagcgcaaaagatg

SEQ ID NO: 3178 - DNA, 103 bp, Artificial Sequence
  Synthetic Polynucleotide
taatacgactcactatagggactgctgagtccaaagtgggtaattccctcaacagaggagagagggaatgacccactttaacctggcggcagcgcaaaagatg

SEQ ID NO: 3179 - DNA, 103 bp, Artificial Sequence
  Synthetic Polynucleotide
taatacgactcactatagggtgaatactgctgagtccaaagtgggtaattaacagaggagaaattacatgctttggactaacctggcggcagcgcaaaagatg

SEQ ID NO: 3180 - DNA, 103 bp, Artificial Sequence
  Synthetic Polynucleotide
taatacgactcactatagggcacgttgaatactgctgagtccaaagtgggaacagaggagacccactatggactcagcaaacctggcggcagcgcaaaagatg

SEQ ID NO: 3181 - DNA, 103 bp, Artificial Sequence
  Synthetic Polynucleotide
taatacgactcactatagggcactccacgttgaatactgctgagtccaaaaacagaggagatttggaatgagcagtattaacctggcggcagcgcaaaagatg

SEQ ID NO: 3182 - DNA, 103 bp, Artificial Sequence
  Synthetic Polynucleotide
taatacgactcactatagggtgaaacactccacgttgaatactgctgagtaacagaggagaactcagatgtattcaacgaacctggcggcagcgcaaaagatg

SEQ ID NO: 3183 - DNA, 103 bp, Artificial Sequence
  Synthetic Polynucleotide
taatacgactcactatagggttttttgaaacactccacgttgaatactgcaacagaggagagcagtaatgaacgtggagaacctggcggcagcgcaaaagatg

SEQ ID NO: 3184 - DNA, 103 bp, Artificial Sequence
  Synthetic Polynucleotide
taatacgactcactataggggcgaattttttgaaacactccacgttgaataacagaggagaattcaaatgggagtgtttaacctggcggcagcgcaaaagatg

SEQ ID NO: 3185 - DNA, 103 bp, Artificial Sequence
  Synthetic Polynucleotide
taatacgactcactatagggtgcatgcgaattttttgaaacactccacgtaacagaggagaacgtggatggtttcaaaaaacctggcggcagcgcaaaagatg

SEQ ID NO: 3186 - DNA, 103 bp, Artificial Sequence
  Synthetic Polynucleotide
taatacgactcactatagggttggttgcatgcgaattttttgaaacactcaacagaggagagagtgtatgaaaaaattcaacctggcggcagcgcaaaagatg

SEQ ID NO: 3187 - DNA, 103 bp, Artificial Sequence
  Synthetic Polynucleotide
taatacgactcactatagggtatgaggggtaggcacccgccatggcattgaacagaggagacaatgcatgggcgggtgcaacctggcggcagcgcaaaagatg

SEQ ID NO: 3188 - DNA, 103 bp, Artificial Sequence
  Synthetic Polynucleotide
taatacgactcactatagggtattcttggttgcatgcgaattttttgaaaaacagaggagatttcaaatgattcgcatgaacctggcggcagcgcaaaagatg

SEQ ID NO: 3189 - DNA, 103 bp, Artificial Sequence
  Synthetic Polynucleotide
taatacgactcactatagggcccagtattcttggttgcatgcgaatttttaacagaggagaaaaaatatgcatgcaaccaacctggcggcagcgcaaaagatg

SEQ ID NO: 3190 - DNA, 103 bp, Artificial Sequence
  Synthetic Polynucleotide
taatacgactcactatagggttcttcccagtattcttggttgcatgcgaaaacagaggagattcgcaatgaaccaagaaaacctggcggcagcgcaaaagatg

SEQ ID NO: 3191 - DNA, 103 bp, Artificial Sequence
  Synthetic Polynucleotide
taatacgactcactataggggcaaattcttcccagtattcttggttgcataacagaggagaatgcaaatgagaatactgaacctggcggcagcgcaaaagatg

SEQ ID NO: 3192 - DNA, 103 bp, Artificial Sequence
  Synthetic Polynucleotide
taatacgactcactatagggtggcagcaaattcttcccagtattcttggtaacagaggagaaccaagatgactgggaagaacctggcggcagcgcaaaagatg

SEQ ID NO: 3193 - DNA, 103 bp, Artificial Sequence
  Synthetic Polynucleotide
taatacgactcactatagggagggctggcagcaaattcttcccagtattcaacagaggagagaatacatggaagaatttaacctggcggcagcgcaaaagatg

SEQ ID NO: 3194 - DNA, 103 bp, Artificial Sequence
  Synthetic Polynucleotide
taatacgactcactatagggctgatagggctggcagcaaattcttcccagaacagaggagactgggaatgatttgctgcaacctggcggcagcgcaaaagatg

SEQ ID NO: 3195 - DNA, 103 bp, Artificial Sequence
  Synthetic Polynucleotide
taatacgactcactatagggttatcctgatagggctggcagcaaattcttaacagaggagaaagaatatgctgccagccaacctggcggcagcgcaaaagatg

SEQ ID NO: 3196 - DNA, 103 bp, Artificial Sequence
  Synthetic Polynucleotide
taatacgactcactatagggagttgttatcctgatagggctggcagcaaaaacagaggagatttgctatgagccctatcaacctggcggcagcgcaaaagatg

SEQ ID NO: 3197 - DNA, 103 bp, Artificial Sequence
  Synthetic Polynucleotide
taatacgactcactatagggttctcagttgttatcctgatagggctggcaaacagaggagatgccagatgtatcaggataacctggcggcagcgcaaaagatg

SEQ ID NO: 3198 - DNA, 103 bp, Artificial Sequence
  Synthetic Polynucleotide
taatacgactcactatagggtcgagtatgaggggtaggcacccgccatggaacagaggagaccatggatggtgcctaccaacctggcggcagcgcaaaagatg

SEQ ID NO: 3199 - DNA, 103 bp, Artificial Sequence
  Synthetic Polynucleotide
taatacgactcactatagggttaaattctcagttgttatcctgatagggcaacagaggagagccctaatgggataacaaaacctggcggcagcgcaaaagatg

SEQ ID NO: 3200 - DNA, 103 bp, Artificial Sequence
  Synthetic Polynucleotide
taatacgactcactatagggggttgttaaattctcagttgttatcctgataacagaggagaatcaggatgacaactgagaacctggcggcagcgcaaaagatg

SEQ ID NO: 3201 - DNA, 103 bp, Artificial Sequence
  Synthetic Polynucleotide
taatacgactcactatagggacataggttgttaaattctcagttgttatcaacagaggagagataacatgtgagaatttaacctggcggcagcgcaaaagatg

SEQ ID NO: 3202 - DNA, 103 bp, Artificial Sequence
  Synthetic Polynucleotide
taatacgactcactatagggtagtaacataggttgttaaattctcagttgaacagaggagacaactgatgatttaacaaaacctggcggcagcgcaaaagatg

SEQ ID NO: 3203 - DNA, 103 bp, Artificial Sequence
  Synthetic Polynucleotide
taatacgactcactatagggtagtttagtaacataggttgttaaattctcaacagaggagagagaatatgacaacctataacctggcggcagcgcaaaagatg

SEQ ID NO: 3204 - DNA, 103 bp, Artificial Sequence
  Synthetic Polynucleotide
taatacgactcactatagggccctttagtttagtaacataggttgttaaaaacagaggagatttaacatgctatgttacaacctggcggcagcgcaaaagatg

SEQ ID NO: 3205 - DNA, 103 bp, Artificial Sequence
  Synthetic Polynucleotide
taatacgactcactatagggttggcccctttagtttagtaacataggttgaacagaggagacaacctatgttactaaacaacctggcggcagcgcaaaagatg

SEQ ID NO: 3206 - DNA, 103 bp, Artificial Sequence
  Synthetic Polynucleotide
taatacgactcactatagggtgcttttggcccctttagtttagtaacataaacagaggagatatgttatgaaactaaagaacctggcggcagcgcaaaagatg

SEQ ID NO: 3207 - DNA, 103 bp, Artificial Sequence
  Synthetic Polynucleotide
taatacgactcactataggggctgctgcttttggcccctttagtttagtaaacagaggagatactaaatgaaaggggccaacctggcggcagcgcaaaagatg

SEQ ID NO: 3208 - DNA, 103 bp, Artificial Sequence
  Synthetic Polynucleotide
taatacgactcactatagggatagcgctgctgcttttggcccctttagttaacagaggagaaactaaatgggccaaaagaacctggcggcagcgcaaaagatg

SEQ ID NO: 3209 - DNA, 103 bp, Artificial Sequence
  Synthetic Polynucleotide
taatacgactcactatagggatttgtcgagtatgaggggtaggcacccgcaacagaggagagcgggtatgtacccctcaaacctggcggcagcgcaaaagatg

SEQ ID NO: 3210 - DNA, 103 bp, Artificial Sequence
  Synthetic Polynucleotide
taatacgactcactatagggtgcaaatagcgctgctgcttttggccccttaacagaggagaaaggggatgaaagcagcaaacctggcggcagcgcaaaagatg

SEQ ID NO: 3211 - DNA, 103 bp, Artificial Sequence
  Synthetic Polynucleotide
taatacgactcactataggggtttttgcaaatagcgctgctgcttttggcaacagaggagagccaaaatgagcagcgctaacctggcggcagcgcaaaagatg

SEQ ID NO: 3212 - DNA, 103 bp, Artificial Sequence
  Synthetic Polynucleotide
taatacgactcactatagggtatgggtttttgcaaatagcgctgctgcttaacagaggagaaagcagatgcgctatttgaacctggcggcagcgcaaaagatg

SEQ ID NO: 3213 - DNA, 103 bp, Artificial Sequence
  Synthetic Polynucleotide
taatacgactcactatagggcagattatgggtttttgcaaatagcgctgcaacagaggagagcagcgatgtttgcaaaaaacctggcggcagcgcaaaagatg

SEQ ID NO: 3214 - DNA, 103 bp, Artificial Sequence
  Synthetic Polynucleotide
taatacgactcactatagggggcagcagattatgggtttttgcaaatagcaacagaggagagctattatgaaaaacccaaacctggcggcagcgcaaaagatg

SEQ ID NO: 3215 - DNA, 103 bp, Artificial Sequence
  Synthetic Polynucleotide
taatacgactcactataggggcagtggcagcagattatgggtttttgcaaaacagaggagattgcaaatgcccataatcaacctggcggcagcgcaaaagatg

SEQ ID NO: 3216 - DNA, 103 bp, Artificial Sequence
  Synthetic Polynucleotide
taatacgactcactatagggttcctgcagtggcagcagattatgggttttaacagaggagaaaaaccatgaatctgctgaacctggcggcagcgcaaaagatg

SEQ ID NO: 3217 - DNA, 103 bp, Artificial Sequence
  Synthetic Polynucleotide
taatacgactcactatagggggcacttcctgcagtggcagcagattatggaacagaggagaccataaatggctgccactaacctggcggcagcgcaaaagatg

SEQ ID NO: 3218 - DNA, 103 bp, Artificial Sequence
  Synthetic Polynucleotide
taatacgactcactatagggccattggcacttcctgcagtggcagcagataacagaggagaatctgcatgcactgcaggaacctggcggcagcgcaaaagatg

SEQ ID NO: 3219 - DNA, 103 bp, Artificial Sequence
  Synthetic Polynucleotide
taatacgactcactatagggcctatccattggcacttcctgcagtggcagaacagaggagactgccaatgcaggaagtgaacctggcggcagcgcaaaagatg

SEQ ID NO: 3220 - DNA, 103 bp, Artificial Sequence
  Synthetic Polynucleotide
taatacgactcactatagggtacacaggatccatgatgggttcttaatctaacagaggagaagattaatgacccatcataacctggcggcagcgcaaaagatg

SEQ ID NO: 3221 - DNA, 103 bp, Artificial Sequence
  Synthetic Polynucleotide
taatacgactcactataggggcccaatttgtcgagtatgaggggtaggcaaacagaggagatgcctaatgctcatactcaacctggcggcagcgcaaaagatg

SEQ ID NO: 3222 - DNA, 103 bp, Artificial Sequence
  Synthetic Polynucleotide
taatacgactcactataggggtgaacctatccattggcacttcctgcagtaacagaggagaactgcaatgagtgccaataacctggcggcagcgcaaaagatg

SEQ ID NO: 3223 - DNA, 103 bp, Artificial Sequence
  Synthetic Polynucleotide
taatacgactcactatagggctactgtgaacctatccattggcacttcctaacagaggagaaggaagatgcaatggataaacctggcggcagcgcaaaagatg

SEQ ID NO: 3224 - DNA, 103 bp, Artificial Sequence
  Synthetic Polynucleotide
taatacgactcactatagggcatgtctactgtgaacctatccattggcacaacagaggagagtgccaatggataggttcaacctggcggcagcgcaaaagatg

SEQ ID NO: 3225 - DNA, 103 bp, Artificial Sequence
  Synthetic Polynucleotide
taatacgactcactatagggcttttcatgtctactgtgaacctatccattaacagaggagaaatggaatggttcacagtaacctggcggcagcgcaaaagatg

SEQ ID NO: 3226 - DNA, 103 bp, Artificial Sequence
  Synthetic Polynucleotide
taatacgactcactatagggcatcccttttcatgtctactgtgaacctataacagaggagaataggtatgcagtagacaaacctggcggcagcgcaaaagatg

SEQ ID NO: 3227 - DNA, 103 bp, Artificial Sequence
  Synthetic Polynucleotide
taatacgactcactatagggcttcacatcccttttcatgtctactgtgaaaacagaggagattcacaatggacatgaaaaacctggcggcagcgcaaaagatg

SEQ ID NO: 3228 - DNA, 103 bp, Artificial Sequence
  Synthetic Polynucleotide
taatacgactcactataggggtcaccttcacatcccttttcatgtctactaacagaggagaagtagaatggaaaagggaaacctggcggcagcgcaaaagatg

SEQ ID NO: 3229 - DNA, 103 bp, Artificial Sequence
  Synthetic Polynucleotide
taatacgactcactatagggcaggagtcaccttcacatcccttttcatgtaacagaggagaacatgaatggggatgtgaaacctggcggcagcgcaaaagatg

SEQ ID NO: 3230 - DNA, 103 bp, Artificial Sequence
  Synthetic Polynucleotide
taatacgactcactatagggtgtaccaggagtcaccttcacatcccttttaacagaggagaaaaaggatggtgaaggtgaacctggcggcagcgcaaaagatg

SEQ ID NO: 3231 - DNA, 103 bp, Artificial Sequence
  Synthetic Polynucleotide
taatacgactcactatagggtgctttgtaccaggagtcaccttcacatccaacagaggagaggatgtatgggtgactccaacctggcggcagcgcaaaagatg

SEQ ID NO: 3232 - DNA, 103 bp, Artificial Sequence
  Synthetic Polynucleotide
taatacgactcactatagggcatctgcccaatttgtcgagtatgaggggtaacagaggagaacccctatgactcgacaaaacctggcggcagcgcaaaagatg

SEQ ID NO: 3233 - DNA, 103 bp, Artificial Sequence
  Synthetic Polynucleotide
taatacgactcactatagggctgtgtgctttgtaccaggagtcaccttcaaacagaggagatgaaggatgctcctggtaaacctggcggcagcgcaaaagatg

SEQ ID NO: 3234 - DNA, 103 bp, Artificial Sequence
  Synthetic Polynucleotide
taatacgactcactatagggttcctctgtgtgctttgtaccaggagtcacaacagaggagagtgactatgggtacaaagaacctggcggcagcgcaaaagatg

SEQ ID NO: 3235 - DNA, 103 bp, Artificial Sequence
  Synthetic Polynucleotide
taatacgactcactatagggggtctttcctctgtgtgctttgtaccaggaaacagaggagatcctggatgaaagcacacaacctggcggcagcgcaaaagatg

SEQ ID NO: 3236 - DNA, 103 bp, Artificial Sequence
  Synthetic Polynucleotide
taatacgactcactatagggccttaggtctttcctctgtgtgctttgtacaacagaggagagtacaaatgacacagaggaacctggcggcagcgcaaaagatg

SEQ ID NO: 3237 - DNA, 103 bp, Artificial Sequence
  Synthetic Polynucleotide
taatacgactcactatagggctgtaccttaggtctttcctctgtgtgcttaacagaggagaaagcacatggaggaaagaaacctggcggcagcgcaaaagatg

SEQ ID NO: 3238 - DNA, 103 bp, Artificial Sequence
  Synthetic Polynucleotide
taatacgactcactatagggataacctgtaccttaggtctttcctctgtgaacagaggagacacagaatgaagacctaaaacctggcggcagcgcaaaagatg

SEQ ID NO: 3239 - DNA, 103 bp, Artificial Sequence
  Synthetic Polynucleotide
taatacgactcactatagggcctgtataacctgtaccttaggtctttcctaacagaggagaaggaaaatgctaaggtacaacctggcggcagcgcaaaagatg

SEQ ID NO: 3240 - DNA, 103 bp, Artificial Sequence
  Synthetic Polynucleotide
taatacgactcactatagggagccgcctgtataacctgtaccttaggtctaacagaggagaagacctatggtacaggttaacctggcggcagcgcaaaagatg

SEQ ID NO: 3241 - DNA, 103 bp, Artificial Sequence
  Synthetic Polynucleotide
taatacgactcactatagggggttcagccgcctgtataacctgtaccttaaacagaggagataaggtatgggttatacaaacctggcggcagcgcaaaagatg

SEQ ID NO: 3242 - DNA, 103 bp, Artificial Sequence
  Synthetic Polynucleotide
taatacgactcactatagggccaagggttcagccgcctgtataacctgtaaacagaggagatacaggatgtacaggcggaacctggcggcagcgcaaaagatg

SEQ ID NO: 3243 - DNA, 103 bp, Artificial Sequence
  Synthetic Polynucleotide
taatacgactcactatagggctgctcatctgcccaatttgtcgagtatgaaacagaggagatcatacatgacaaattggaacctggcggcagcgcaaaagatg

SEQ ID NO: 3244 - DNA, 103 bp, Artificial Sequence
  Synthetic Polynucleotide
taatacgactcactatagggtgttgccaagggttcagccgcctgtataacaacagaggagagttataatggcggctgaaaacctggcggcagcgcaaaagatg

SEQ ID NO: 3245 - DNA, 103 bp, Artificial Sequence
  Synthetic Polynucleotide
taatacgactcactatagggtatgctgttgccaagggttcagccgcctgtaacagaggagaacaggcatgtgaacccttaacctggcggcagcgcaaaagatg

SEQ ID NO: 3246 - DNA, 103 bp, Artificial Sequence
  Synthetic Polynucleotide
taatacgactcactatagggataggtatgctgttgccaagggttcagccgaacagaggagacggctgatgccttggcaaaacctggcggcagcgcaaaagatg

SEQ ID NO: 3247 - DNA, 103 bp, Artificial Sequence
  Synthetic Polynucleotide
taatacgactcactatagggcccacataggtatgctgttgccaagggttcaacagaggagagaacccatggcaacagcaaacctggcggcagcgcaaaagatg

SEQ ID NO: 3248 - DNA, 103 bp, Artificial Sequence
  Synthetic Polynucleotide
taatacgactcactatagggtgaatcccacataggtatgctgttgccaagaacagaggagacttggcatgagcatacctaacctggcggcagcgcaaaagatg

SEQ ID NO: 3249 - DNA, 103 bp, Artificial Sequence
  Synthetic Polynucleotide
taatacgactcactatagggctctgtgaatcccacataggtatgctgttgaacagaggagacaacagatgacctatgtgaacctggcggcagcgcaaaagatg

SEQ ID NO: 3250 - DNA, 103 bp, Artificial Sequence
  Synthetic Polynucleotide
taatacgactcactatagggcagctctctgtgaatcccacataggtatgcaacagaggagagcatacatgtgtgggattaacctggcggcagcgcaaaagatg

SEQ ID NO: 3251 - DNA, 103 bp, Artificial Sequence
  Synthetic Polynucleotide
taatacgactcactatagggctaaccagctctctgtgaatcccacataggaacagaggagacctatgatggattcacagaacctggcggcagcgcaaaagatg

SEQ ID NO: 3252 - DNA, 103 bp, Artificial Sequence
  Synthetic Polynucleotide
taatacgactcactataggggcctcctaaccagctctctgtgaatcccacaacagaggagagtgggaatgacagagagcaacctggcggcagcgcaaaagatg

SEQ ID NO: 3253 - DNA, 103 bp, Artificial Sequence
  Synthetic Polynucleotide
taatacgactcactataggggttcagcctcctaaccagctctctgtgaataacagaggagaattcacatggagctggttaacctggcggcagcgcaaaagatg

SEQ ID NO: 3254 - DNA, 103 bp, Artificial Sequence
  Synthetic Polynucleotide
taatacgactcactatagggagtacctgctcatctgcccaatttgtcgagaacagaggagactcgacatgttgggcagaaacctggcggcagcgcaaaagatg

SEQ ID NO: 3255 - DNA, 103 bp, Artificial Sequence
  Synthetic Polynucleotide
taatacgactcactatagggacggcgttcagcctcctaaccagctctctgaacagaggagacagagaatgggttaggagaacctggcggcagcgcaaaagatg

SEQ ID NO: 3256 - DNA, 103 bp, Artificial Sequence
  Synthetic Polynucleotide
taatacgactcactatagggggaggacggcgttcagcctcctaaccagctaacagaggagaagctggatgggaggctgaaacctggcggcagcgcaaaagatg

SEQ ID NO: 3257 - DNA, 103 bp, Artificial Sequence
  Synthetic Polynucleotide
taatacgactcactataggggggtaggaggacggcgttcagcctcctaacaacagaggagagttaggatgctgaacgccaacctggcggcagcgcaaaagatg

SEQ ID NO: 3258 - DNA, 103 bp, Artificial Sequence
  Synthetic Polynucleotide
taatacgactcactatagggacattgggtaggaggacggcgttcagcctcaacagaggagagaggctatgcgccgtcctaacctggcggcagcgcaaaagatg

SEQ ID NO: 3259 - DNA, 103 bp, Artificial Sequence
  Synthetic Polynucleotide
taatacgactcactatagggtatgtacattgggtaggaggacggcgttcaaacagaggagatgaacgatgtcctcctacaacctggcggcagcgcaaaagatg

SEQ ID NO: 3260 - DNA, 103 bp, Artificial Sequence
  Synthetic Polynucleotide
taatacgactcactatagggtagtgtatgtacattgggtaggaggacggcaacagaggagagccgtcatgctacccaataacctggcggcagcgcaaaagatg

SEQ ID NO: 3261 - DNA, 103 bp, Artificial Sequence
  Synthetic Polynucleotide
taatacgactcactatagggtcaaatagtgtatgtacattgggtaggaggaacagaggagacctcctatgcaatgtacaaacctggcggcagcgcaaaagatg

SEQ ID NO: 3262 - DNA, 103 bp, Artificial Sequence
  Synthetic Polynucleotide
taatacgactcactatagggacatgtcaaatagtgtatgtacattgggtaaacagaggagatacccaatgtacatacacaacctggcggcagcgcaaaagatg

SEQ ID NO: 3263 - DNA, 103 bp, Artificial Sequence
  Synthetic Polynucleotide
taatacgactcactatagggggcagacatgtcaaatagtgtatgtacattaacagaggagaaatgtaatgacactatttaacctggcggcagcgcaaaagatg

SEQ ID NO: 3264 - DNA, 103 bp, Artificial Sequence
  Synthetic Polynucleotide
taatacgactcactatagggtcctcggcagacatgtcaaatagtgtatgtaacagaggagaacatacatgatttgacataacctggcggcagcgcaaaagatg

SEQ ID NO: 3265 - DNA, 103 bp, Artificial Sequence
  Synthetic Polynucleotide
taatacgactcactatagggccttcagtacctgctcatctgcccaatttgaacagaggagacaaattatgcagatgagcaacctggcggcagcgcaaaagatg

SEQ ID NO: 3266 - DNA, 103 bp, Artificial Sequence
  Synthetic Polynucleotide
taatacgactcactatagggcgaaatcctcggcagacatgtcaaatagtgaacagaggagacactatatgacatgtctgaacctggcggcagcgcaaaagatg

SEQ ID NO: 3267 - DNA, 103 bp, Artificial Sequence
  Synthetic Polynucleotide
taatacgactcactatagggggcatcgaaatcctcggcagacatgtcaaaaacagaggagatttgacatgtctgccgagaacctggcggcagcgcaaaagatg

SEQ ID NO: 3268 - DNA, 103 bp, Artificial Sequence
  Synthetic Polynucleotide
taatacgactcactatagggatgatggcatcgaaatcctcggcagacatgaacagaggagacatgtcatgcgaggatttaacctggcggcagcgcaaaagatg

SEQ ID NO: 3269 - DNA, 103 bp, Artificial Sequence
  Synthetic Polynucleotide
taatacgactcactatagggcggctatgatggcatcgaaatcctcggcagaacagaggagactgccgatgatttcgatgaacctggcggcagcgcaaaagatg

SEQ ID NO: 3270 - DNA, 103 bp, Artificial Sequence
  Synthetic Polynucleotide
taatacgactcactataggggtgtgcggctatgatggcatcgaaatcctcaacagaggagagaggatatggatgccatcaacctggcggcagcgcaaaagatg

SEQ ID NO: 3271 - DNA, 103 bp, Artificial Sequence
  Synthetic Polynucleotide
taatacgactcactatagggttaaagtgtgcggctatgatggcatcgaaaaacagaggagatttcgaatgcatcatagcaacctggcggcagcgcaaaagatg

SEQ ID NO: 3272 - DNA, 103 bp, Artificial Sequence
  Synthetic Polynucleotide
taatacgactcactatagggctggcttaaagtgtgcggctatgatggcataacagaggagaatgccaatgtagccgcacaacctggcggcagcgcaaaagatg

SEQ ID NO: 3273 - DNA, 103 bp, Artificial Sequence
  Synthetic Polynucleotide
taatacgactcactataggggtctcctggcttaaagtgtgcggctatgataacagaggagaatcataatggcacactttaacctggcggcagcgcaaaagatg

SEQ ID NO: 3274 - DNA, 103 bp, Artificial Sequence
  Synthetic Polynucleotide
taatacgactcactatagggacagtgtctcctggcttaaagtgtgcggctaacagaggagaagccgcatgctttaagccaacctggcggcagcgcaaaagatg

SEQ ID NO: 3275 - DNA, 103 bp, Artificial Sequence
  Synthetic Polynucleotide
taatacgactcactatagggctaaaacagtgtctcctggcttaaagtgtgaacagaggagacacactatgagccaggagaacctggcggcagcgcaaaagatg

SEQ ID NO: 3276 - DNA, 103 bp, Artificial Sequence
  Synthetic Polynucleotide
taatacgactcactatagggcttagccttcagtacctgctcatctgcccaaacagaggagatgggcaatggagcaggtaaacctggcggcagcgcaaaagatg

SEQ ID NO: 3277 - DNA, 103 bp, Artificial Sequence
  Synthetic Polynucleotide
taatacgactcactatagggcgtttctaaaacagtgtctcctggcttaaaaacagaggagatttaagatgggagacactaacctggcggcagcgcaaaagatg

SEQ ID NO: 3278 - DNA, 103 bp, Artificial Sequence
  Synthetic Polynucleotide
taatacgactcactatagggatgtccgtttctaaaacagtgtctcctggcaacagaggagagccaggatgcactgttttaacctggcggcagcgcaaaagatg

SEQ ID NO: 3279 - DNA, 103 bp, Artificial Sequence
  Synthetic Polynucleotide
taatacgactcactatagggaggctatgtccgtttctaaaacagtgtctcaacagaggagagagacaatgttttagaaaaacctggcggcagcgcaaaagatg

SEQ ID NO: 3280 - DNA, 103 bp, Artificial Sequence
  Synthetic Polynucleotide
taatacgactcactatagggaaaggaggctatgtccgtttctaaaacagtaacagaggagaactgttatggaaacggacaacctggcggcagcgcaaaagatg

SEQ ID NO: 3281 - DNA, 103 bp, Artificial Sequence
  Synthetic Polynucleotide
taatacgactcactatagggttatcaaaggaggctatgtccgtttctaaaaacagaggagatttagaatgggacatagcaacctggcggcagcgcaaaagatg

SEQ ID NO: 3282 - DNA, 103 bp, Artificial Sequence
  Synthetic Polynucleotide
taatacgactcactatagggggctcttatcaaaggaggctatgtccgtttaacagaggagaaaacggatgtagcctcctaacctggcggcagcgcaaaagatg

SEQ ID NO: 3283 - DNA, 103 bp, Artificial Sequence
  Synthetic Polynucleotide
taatacgactcactatagggatcttggctcttatcaaaggaggctatgtcaacagaggagagacataatgtcctttgataacctggcggcagcgcaaaagatg

SEQ ID NO: 3284 - DNA, 103 bp, Artificial Sequence
  Synthetic Polynucleotide
taatacgactcactataggggaatcatcttggctcttatcaaaggaggctaacagaggagaagcctcatgtgataagagaacctggcggcagcgcaaaagatg

SEQ ID NO: 3285 - DNA, 103 bp, Artificial Sequence
  Synthetic Polynucleotide
taatacgactcactatagggcaagtgaatcatcttggctcttatcaaaggaacagaggagacctttgatgagagccaagaacctggcggcagcgcaaaagatg

SEQ ID NO: 3286 - DNA, 103 bp, Artificial Sequence
  Synthetic Polynucleotide
taatacgactcactatagggaagcgcaagtgaatcatcttggctcttatcaacagaggagagataagatgcaagatgataacctggcggcagcgcaaaagatg

SEQ ID NO: 3287 - DNA, 103 bp, Artificial Sequence
  Synthetic Polynucleotide
taatacgactcactatagggatgttcttagccttcagtacctgctcatctaacagaggagaagatgaatgggtactgaaaacctggcggcagcgcaaaagatg

SEQ ID NO: 3288 - DNA, 103 bp, Artificial Sequence
  Synthetic Polynucleotide
taatacgactcactataggggcagtaagcgcaagtgaatcatcttggctcaacagaggagagagccaatgtgattcactaacctggcggcagcgcaaaagatg

SEQ ID NO: 3289 - DNA, 103 bp, Artificial Sequence
  Synthetic Polynucleotide
taatacgactcactatagggttaaagcagtaagcgcaagtgaatcatcttaacagaggagaaagatgatgcacttgcgcaacctggcggcagcgcaaaagatg

SEQ ID NO: 3290 - DNA, 103 bp, Artificial Sequence
  Synthetic Polynucleotide
taatacgactcactatagggcagcattaaagcagtaagcgcaagtgaatcaacagaggagagattcaatggcgcttactaacctggcggcagcgcaaaagatg

SEQ ID NO: 3291 - DNA, 103 bp, Artificial Sequence
  Synthetic Polynucleotide
taatacgactcactatagggtctaacagcattaaagcagtaagcgcaagtaacagaggagaacttgcatgtactgctttaacctggcggcagcgcaaaagatg

SEQ ID NO: 3292 - DNA, 103 bp, Artificial Sequence
  Synthetic Polynucleotide
taatacgactcactatagggaatcctctaacagcattaaagcagtaagcgaacagaggagacgcttaatgctttaatgcaacctggcggcagcgcaaaagatg

SEQ ID NO: 3293 - DNA, 103 bp, Artificial Sequence
  Synthetic Polynucleotide
taatacgactcactatagggccctaaatcctctaacagcattaaagcagtaacagaggagaactgctatgatgctgttaaacctggcggcagcgcaaaagatg

SEQ ID NO: 3294 - DNA, 103 bp, Artificial Sequence
  Synthetic Polynucleotide
taatacgactcactatagggtccacccctaaatcctctaacagcattaaaaacagaggagatttaatatggttagaggaaacctggcggcagcgcaaaagatg

SEQ ID NO: 3295 - DNA, 103 bp, Artificial Sequence
  Synthetic Polynucleotide
taatacgactcactatagggagtgatccacccctaaatcctctaacagcaaacagaggagatgctgtatgaggatttagaacctggcggcagcgcaaaagatg

SEQ ID NO: 3296 - DNA, 103 bp, Artificial Sequence
  Synthetic Polynucleotide
taatacgactcactatagggcagggagtgatccacccctaaatcctctaaaacagaggagattagagatgttaggggtgaacctggcggcagcgcaaaagatg

SEQ ID NO: 3297 - DNA, 103 bp, Artificial Sequence
  Synthetic Polynucleotide
taatacgactcactatagggtccaacagggagtgatccacccctaaatccaacagaggagaggatttatgggtggatcaaacctggcggcagcgcaaaagatg

SEQ ID NO: 3298 - DNA, 103 bp, Artificial Sequence
  Synthetic Polynucleotide
taatacgactcactatagggatcctatgttcttagccttcagtacctgctaacagaggagaagcaggatgtgaaggctaaacctggcggcagcgcaaaagatg

SEQ ID NO: 3299 - DNA, 103 bp, Artificial Sequence
  Synthetic Polynucleotide
taatacgactcactatagggtcaagtccaacagggagtgatccacccctaaacagaggagataggggatgatcactcccaacctggcggcagcgcaaaagatg

SEQ ID NO: 3300 - DNA, 103 bp, Artificial Sequence
  Synthetic Polynucleotide
taatacgactcactatagggctctatcaagtccaacagggagtgatccacaacagaggagagtggatatgtccctgttgaacctggcggcagcgcaaaagatg

SEQ ID NO: 3301 - DNA, 103 bp, Artificial Sequence
  Synthetic Polynucleotide
taatacgactcactataggggcagcctctatcaagtccaacagggagtgaaacagaggagatcactcatggttggacttaacctggcggcagcgcaaaagatg

SEQ ID NO: 3302 - DNA, 103 bp, Artificial Sequence
  Synthetic Polynucleotide
taatacgactcactatagggcgaaagcagcctctatcaagtccaacagggaacagaggagaccctgtatgacttgatagaacctggcggcagcgcaaaagatg

SEQ ID NO: 3303 - DNA, 103 bp, Artificial Sequence
  Synthetic Polynucleotide
taatacgactcactatagggctctccgaaagcagcctctatcaagtccaaaacagaggagattggacatgatagaggctaacctggcggcagcgcaaaagatg

SEQ ID NO: 3304 - DNA, 103 bp, Artificial Sequence
  Synthetic Polynucleotide
taatacgactcactataggggaaatctctccgaaagcagcctctatcaagaacagaggagacttgatatgggctgctttaacctggcggcagcgcaaaagatg

SEQ ID NO: 3305 - DNA, 103 bp, Artificial Sequence
  Synthetic Polynucleotide
taatacgactcactatagggagctggaaatctctccgaaagcagcctctaaacagaggagatagaggatgctttcggagaacctggcggcagcgcaaaagatg

SEQ ID NO: 3306 - DNA, 103 bp, Artificial Sequence
  Synthetic Polynucleotide
taatacgactcactatagggatgacagctggaaatctctccgaaagcagcaacagaggagagctgctatgggagagattaacctggcggcagcgcaaaagatg

SEQ ID NO: 3307 - DNA, 103 bp, Artificial Sequence
  Synthetic Polynucleotide
taatacgactcactatagggggtagatgacagctggaaatctctccgaaaaacagaggagatttcggatggatttccagaacctggcggcagcgcaaaagatg

SEQ ID NO: 3308 - DNA, 103 bp, Artificial Sequence
  Synthetic Polynucleotide
taatacgactcactatagggctgtcggtagatgacagctggaaatctctcaacagaggagagagagaatgccagctgtcaacctggcggcagcgcaaaagatg

SEQ ID NO: 3309 - DNA, 103 bp, Artificial Sequence
  Synthetic Polynucleotide
taatacgactcactatagggacataatcctatgttcttagccttcagtacaacagaggagagtactgatggctaagaacaacctggcggcagcgcaaaagatg

SEQ ID NO: 3310 - DNA, 103 bp, Artificial Sequence
  Synthetic Polynucleotide
taatacgactcactatagggcgtacctgtcggtagatgacagctggaaataacagaggagaatttccatgtgtcatctaaacctggcggcagcgcaaaagatg

SEQ ID NO: 3311 - DNA, 103 bp, Artificial Sequence
  Synthetic Polynucleotide
taatacgactcactatagggaagcgcgtacctgtcggtagatgacagctgaacagaggagacagctgatgtctaccgacaacctggcggcagcgcaaaagatg

SEQ ID NO: 3312 - DNA, 103 bp, Artificial Sequence
  Synthetic Polynucleotide
taatacgactcactatagggacttgaagcgcgtacctgtcggtagatgacaacagaggagagtcatcatgcgacaggtaaacctggcggcagcgcaaaagatg

SEQ ID NO: 3313 - DNA, 103 bp, Artificial Sequence
  Synthetic Polynucleotide
taatacgactcactataggggccgaacttgaagcgcgtacctgtcggtagaacagaggagactaccgatgggtacgcgcaacctggcggcagcgcaaaagatg

SEQ ID NO: 3314 - DNA, 103 bp, Artificial Sequence
  Synthetic Polynucleotide
taatacgactcactatagggatggcgccgaacttgaagcgcgtacctgtcaacagaggagagacaggatggcgcttcaaaacctggcggcagcgcaaaagatg

SEQ ID NO: 3315 - DNA, 103 bp, Artificial Sequence
  Synthetic Polynucleotide
taatacgactcactatagggtcatcatggcgccgaacttgaagcgcgtacaacagaggagagtacgcatgtcaagttcgaacctggcggcagcgcaaaagatg

SEQ ID NO: 3316 - DNA, 103 bp, Artificial Sequence
  Synthetic Polynucleotide
taatacgactcactatagggagatttcatcatggcgccgaacttgaagcgaacagaggagacgcttcatgttcggcgccaacctggcggcagcgcaaaagatg

SEQ ID NO: 3317 - DNA, 103 bp, Artificial Sequence
  Synthetic Polynucleotide
taatacgactcactatagggataccagatttcatcatggcgccgaacttgaacagaggagacaagttatgcgccatgataacctggcggcagcgcaaaagatg

SEQ ID NO: 3318 - DNA, 103 bp, Artificial Sequence
  Synthetic Polynucleotide
taatacgactcactatagggggaacataccagatttcatcatggcgccgaaacagaggagatcggcgatgtgatgaaataacctggcggcagcgcaaaagatg

SEQ ID NO: 3319 - DNA, 103 bp, Artificial Sequence
  Synthetic Polynucleotide
taatacgactcactatagggagttaggaacataccagatttcatcatggcaacagaggagagccatgatgaaatctggtaacctggcggcagcgcaaaagatg

SEQ ID NO: 3320 - DNA, 103 bp, Artificial Sequence
  Synthetic Polynucleotide
taatacgactcactataggggttgaacataatcctatgttcttagccttcaacagaggagagaaggcatggaacataggaacctggcggcagcgcaaaagatg

SEQ ID NO: 3321 - DNA, 103 bp, Artificial Sequence
  Synthetic Polynucleotide
taatacgactcactatagggaacagagttaggaacataccagatttcatcaacagaggagagatgaaatgtggtatgttaacctggcggcagcgcaaaagatg

SEQ ID NO: 3322 - DNA, 103 bp, Artificial Sequence
  Synthetic Polynucleotide
taatacgactcactatagggtgacgaacagagttaggaacataccagattaacagaggagaaatctgatgtgttcctaaaacctggcggcagcgcaaaagatg

SEQ ID NO: 3323 - DNA, 103 bp, Artificial Sequence
  Synthetic Polynucleotide
taatacgactcactatagggtgtgttgacgaacagagttaggaacataccaacagaggagaggtatgatgctaactctgaacctggcggcagcgcaaaagatg

SEQ ID NO: 3324 - DNA, 103 bp, Artificial Sequence
  Synthetic Polynucleotide
taatacgactcactatagggagcagtgtgttgacgaacagagttaggaacaacagaggagagttcctatgtctgttcgtaacctggcggcagcgcaaaagatg

SEQ ID NO: 3325 - DNA, 103 bp, Artificial Sequence
  Synthetic Polynucleotide
taatacgactcactatagggtatttagcagtgtgttgacgaacagagttaaacagaggagataactcatgtcgtcaacaaacctggcggcagcgcaaaagatg

SEQ ID NO: 3326 - DNA, 103 bp, Artificial Sequence
  Synthetic Polynucleotide
taatacgactcactatagggggtgatatttagcagtgtgttgacgaacagaacagaggagactgttcatgaacacactgaacctggcggcagcgcaaaagatg

SEQ ID NO: 3327 - DNA, 103 bp, Artificial Sequence
  Synthetic Polynucleotide
taatacgactcactataggggcgatggtgatatttagcagtgtgttgacgaacagaggagacgtcaaatgactgctaaaaacctggcggcagcgcaaaagatg

SEQ ID NO: 3328 - DNA, 103 bp, Artificial Sequence
  Synthetic Polynucleotide
taatacgactcactatagggggctggcgatggtgatatttagcagtgtgtaacagaggagaacacacatgtaaatatcaaacctggcggcagcgcaaaagatg

SEQ ID NO: 3329 - DNA, 103 bp, Artificial Sequence
  Synthetic Polynucleotide
taatacgactcactatagggcactcggctggcgatggtgatatttagcagaacagaggagactgctaatgatcaccatcaacctggcggcagcgcaaaagatg

SEQ ID NO: 3330 - DNA, 103 bp, Artificial Sequence
  Synthetic Polynucleotide
taatacgactcactatagggtccagcactcggctggcgatggtgatatttaacagaggagaaaatatatgcatcgccagaacctggcggcagcgcaaaagatg

SEQ ID NO: 3331 - DNA, 103 bp, Artificial Sequence
  Synthetic Polynucleotide
taatacgactcactatagggccacgtacacaggatccatgatgggttcttaacagaggagaaagaacatgtcatggatcaacctggcggcagcgcaaaagatg

SEQ ID NO: 3332 - DNA, 103 bp, Artificial Sequence
  Synthetic Polynucleotide
taatacgactcactatagggggtctgttgaacataatcctatgttcttagaacagaggagactaagaatgtaggattataacctggcggcagcgcaaaagatg

SEQ ID NO: 3333 - DNA, 103 bp, Artificial Sequence
  Synthetic Polynucleotide
taatacgactcactataggggatcttccagcactcggctggcgatggtgaaacagaggagatcaccaatgccagccgagaacctggcggcagcgcaaaagatg

SEQ ID NO: 3334 - DNA, 103 bp, Artificial Sequence
  Synthetic Polynucleotide
taatacgactcactatagggcagacgatcttccagcactcggctggcgataacagaggagaatcgccatgcgagtgctgaacctggcggcagcgcaaaagatg

SEQ ID NO: 3335 - DNA, 103 bp, Artificial Sequence
  Synthetic Polynucleotide
taatacgactcactatagggtttgtcagacgatcttccagcactcggctgaacagaggagacagccgatggctggaagaaacctggcggcagcgcaaaagatg

SEQ ID NO: 3336 - DNA, 103 bp, Artificial Sequence
  Synthetic Polynucleotide
taatacgactcactatagggcggattttgtcagacgatcttccagcactcaacagaggagagagtgcatgaagatcgtcaacctggcggcagcgcaaaagatg

SEQ ID NO: 3337 - DNA, 103 bp, Artificial Sequence
  Synthetic Polynucleotide
taatacgactcactataggggcacgcggattttgtcagacgatcttccagaacagaggagactggaaatgcgtctgacaaacctggcggcagcgcaaaagatg

SEQ ID NO: 3338 - DNA, 103 bp, Artificial Sequence
  Synthetic Polynucleotide
taatacgactcactataggggctgcgcacgcggattttgtcagacgatctaacagaggagaagatcgatggacaaaatcaacctggcggcagcgcaaaagatg

SEQ ID NO: 3339 - DNA, 103 bp, Artificial Sequence
  Synthetic Polynucleotide
taatacgactcactatagggtgaaggctgcgcacgcggattttgtcagacaacagaggagagtctgaatgaatccgcgtaacctggcggcagcgcaaaagatg

SEQ ID NO: 3340 - DNA, 103 bp, Artificial Sequence
  Synthetic Polynucleotide
taatacgactcactataggggccgatgaaggctgcgcacgcggattttgtaacagaggagaacaaaaatggcgtgcgcaaacctggcggcagcgcaaaagatg

SEQ ID NO: 3341 - DNA, 103 bp, Artificial Sequence
  Synthetic Polynucleotide
taatacgactcactatagggtcgtcgccgatgaaggctgcgcacgcggataacagaggagaatccgcatgcgcagccttaacctggcggcagcgcaaaagatg

SEQ ID NO: 3342 - DNA, 103 bp, Artificial Sequence
  Synthetic Polynucleotide
taatacgactcactatagggtgttgtcgtcgccgatgaaggctgcgcacgaacagaggagacgtgcgatgccttcatcgaacctggcggcagcgcaaaagatg

SEQ ID NO: 3343 - DNA, 103 bp, Artificial Sequence
  Synthetic Polynucleotide
taatacgactcactatagggcgtcaggtctgttgaacataatcctatgttaacagaggagaaacataatgttatgttcaaacctggcggcagcgcaaaagatg

SEQ ID NO: 3344 - DNA, 103 bp, Artificial Sequence
  Synthetic Polynucleotide
taatacgactcactatagggtattatgttgtcgtcgccgatgaaggctgcaacagaggagagcagccatgatcggcgacaacctggcggcagcgcaaaagatg

SEQ ID NO: 3345 - DNA, 103 bp, Artificial Sequence
  Synthetic Polynucleotide
taatacgactcactatagggccatgtattatgttgtcgtcgccgatgaagaacagaggagacttcatatgcgacgacaaaacctggcggcagcgcaaaagatg

SEQ ID NO: 3346 - DNA, 103 bp, Artificial Sequence
  Synthetic Polynucleotide
taatacgactcactatagggcgactccatgtattatgttgtcgtcgccgaaacagaggagatcggcgatgacaacataaaacctggcggcagcgcaaaagatg

SEQ ID NO: 3347 - DNA, 103 bp, Artificial Sequence
  Synthetic Polynucleotide
taatacgactcactatagggggagacgactccatgtattatgttgtcgtcaacagaggagagacgacatgataatacataacctggcggcagcgcaaaagatg

SEQ ID NO: 3348 - DNA, 103 bp, Artificial Sequence
  Synthetic Polynucleotide
taatacgactcactatagggtcatcggagacgactccatgtattatgttgaacagaggagacaacatatgacatggagtaacctggcggcagcgcaaaagatg

SEQ ID NO: 3349 - DNA, 103 bp, Artificial Sequence
  Synthetic Polynucleotide
taatacgactcactatagggtcaattcatcggagacgactccatgtattaaacagaggagataatacatggagtcgtctaacctggcggcagcgcaaaagatg

SEQ ID NO: 3350 - DNA, 103 bp, Artificial Sequence
  Synthetic Polynucleotide
taatacgactcactatagggtgccatcaattcatcggagacgactccatgaacagaggagacatggaatggtctccgataacctggcggcagcgcaaaagatg

SEQ ID NO: 3351 - DNA, 103 bp, Artificial Sequence
  Synthetic Polynucleotide
taatacgactcactatagggctggctgccatcaattcatcggagacgactaacagaggagaagtcgtatgcgatgaattaacctggcggcagcgcaaaagatg

SEQ ID NO: 3352 - DNA, 103 bp, Artificial Sequence
  Synthetic Polynucleotide
taatacgactcactatagggcgcatctggctgccatcaattcatcggagaaacagaggagatctccgatgaattgatggaacctggcggcagcgcaaaagatg

SEQ ID NO: 3353 - DNA, 103 bp, Artificial Sequence
  Synthetic Polynucleotide
taatacgactcactatagggagtggcgcatctggctgccatcaattcatcaacagaggagagatgaaatgatggcagccaacctggcggcagcgcaaaagatg

SEQ ID NO: 3354 - DNA, 103 bp, Artificial Sequence
  Synthetic Polynucleotide
taatacgactcactatagggccttccgtcaggtctgttgaacataatcctaacagaggagaaggattatgttcaacagaaacctggcggcagcgcaaaagatg

SEQ ID NO: 3355 - DNA, 103 bp, Artificial Sequence
  Synthetic Polynucleotide
taatacgactcactatagggatccaagtggcgcatctggctgccatcaataacagaggagaattgatatgagccagatgaacctggcggcagcgcaaaagatg

SEQ ID NO: 3356 - DNA, 103 bp, Artificial Sequence
  Synthetic Polynucleotide
taatacgactcactatagggtgttcatccaagtggcgcatctggctgccaaacagaggagatggcagatggatgcgccaaacctggcggcagcgcaaaagatg

SEQ ID NO: 3357 - DNA, 103 bp, Artificial Sequence
  Synthetic Polynucleotide
taatacgactcactatagggttccatgttcatccaagtggcgcatctggcaacagaggagagccagaatggccacttggaacctggcggcagcgcaaaagatg

SEQ ID NO: 3358 - DNA, 103 bp, Artificial Sequence
  Synthetic Polynucleotide
taatacgactcactatagggttcacttccatgttcatccaagtggcgcataacagaggagaatgcgcatgttggatgaaaacctggcggcagcgcaaaagatg

SEQ ID NO: 3359 - DNA, 103 bp, Artificial Sequence
  Synthetic Polynucleotide
taatacgactcactatagggtgatcttcacttccatgttcatccaagtggaacagaggagaccacttatgtgaacatggaacctggcggcagcgcaaaagatg

SEQ ID NO: 3360 - DNA, 103 bp, Artificial Sequence
  Synthetic Polynucleotide
taatacgactcactatagggatctatgatcttcacttccatgttcatccaaacagaggagatggatgatgatggaagtgaacctggcggcagcgcaaaagatg

SEQ ID NO: 3361 - DNA, 103 bp, Artificial Sequence
  Synthetic Polynucleotide
taatacgactcactatagggactgcatctatgatcttcacttccatgttcaacagaggagagaacatatgagtgaagataacctggcggcagcgcaaaagatg

SEQ ID NO: 3362 - DNA, 103 bp, Artificial Sequence
  Synthetic Polynucleotide
taatacgactcactatagggatacaactgcatctatgatcttcacttccaaacagaggagatggaagatgagatcatagaacctggcggcagcgcaaaagatg

SEQ ID NO: 3363 - DNA, 103 bp, Artificial Sequence
  Synthetic Polynucleotide
taatacgactcactatagggctgggatacaactgcatctatgatcttcacaacagaggagagtgaagatgatagatgcaaacctggcggcagcgcaaaagatg

SEQ ID NO: 3364 - DNA, 103 bp, Artificial Sequence
  Synthetic Polynucleotide
taatacgactcactataggggctttctgggatacaactgcatctatgatcaacagaggagagatcatatgtgcagttgtaacctggcggcagcgcaaaagatg

SEQ ID NO: 3365 - DNA, 103 bp, Artificial Sequence
  Synthetic Polynucleotide
taatacgactcactataggggtctaccttccgtcaggtctgttgaacataaacagaggagatatgttatgcagacctgaaacctggcggcagcgcaaaagatg

SEQ ID NO: 3366 - DNA, 103 bp, Artificial Sequence
  Synthetic Polynucleotide
taatacgactcactatagggaaggggctttctgggatacaactgcatctaaacagaggagatagatgatgttgtatcccaacctggcggcagcgcaaaagatg

SEQ ID NO: 3367 - DNA, 103 bp, Artificial Sequence
  Synthetic Polynucleotide
taatacgactcactatagggaaagtaaggggctttctgggatacaactgcaacagaggagagcagttatgtcccagaaaaacctggcggcagcgcaaaagatg

SEQ ID NO: 3368 - DNA, 103 bp, Artificial Sequence
  Synthetic Polynucleotide
taatacgactcactatagggccacaaaagtaaggggctttctgggatacaaacagaggagatgtatcatggaaagccccaacctggcggcagcgcaaaagatg

SEQ ID NO: 3369 - DNA, 103 bp, Artificial Sequence
  Synthetic Polynucleotide
taatacgactcactatagggaccctccacaaaagtaaggggctttctgggaacagaggagacccagaatgccccttactaacctggcggcagcgcaaaagatg

SEQ ID NO: 3370 - DNA, 103 bp, Artificial Sequence
  Synthetic Polynucleotide
taatacgactcactatagggtataaaccctccacaaaagtaaggggctttaacagaggagaaaagccatgtacttttgtaacctggcggcagcgcaaaagatg

SEQ ID NO: 3371 - DNA, 103 bp, Artificial Sequence
  Synthetic Polynucleotide
taatacgactcactatagggtgcagtataaaccctccacaaaagtaagggaacagaggagacccttaatgttgtggaggaacctggcggcagcgcaaaagatg

SEQ ID NO: 3372 - DNA, 103 bp, Artificial Sequence
  Synthetic Polynucleotide
taatacgactcactatagggtatcgtgcagtataaaccctccacaaaagtaacagaggagaacttttatggagggtttaaacctggcggcagcgcaaaagatg

SEQ ID NO: 3373 - DNA, 103 bp, Artificial Sequence
  Synthetic Polynucleotide
taatacgactcactatagggcacgatatcgtgcagtataaaccctccacaaacagaggagatgtggaatgtttatactgaacctggcggcagcgcaaaagatg

SEQ ID NO: 3374 - DNA, 103 bp, Artificial Sequence
  Synthetic Polynucleotide
taatacgactcactatagggcctgtcacgatatcgtgcagtataaaccctaacagaggagaagggttatgactgcacgaaacctggcggcagcgcaaaagatg

SEQ ID NO: 3375 - DNA, 103 bp, Artificial Sequence
  Synthetic Polynucleotide
taatacgactcactatagggctgttcctgtcacgatatcgtgcagtataaaacagaggagattatacatgacgatatcgaacctggcggcagcgcaaaagatg

SEQ ID NO: 3376 - DNA, 103 bp, Artificial Sequence
  Synthetic Polynucleotide
taatacgactcactataggggcctcgtctaccttccgtcaggtctgttgaaacagaggagatcaacaatgctgacggaaaacctggcggcagcgcaaaagatg

SEQ ID NO: 3377 - DNA, 103 bp, Artificial Sequence
  Synthetic Polynucleotide
taatacgactcactataggggcaagctgttcctgtcacgatatcgtgcagaacagaggagactgcacatgatcgtgacaaacctggcggcagcgcaaaagatg

SEQ ID NO: 3378 - DNA, 103 bp, Artificial Sequence
  Synthetic Polynucleotide
taatacgactcactatagggactctgcaagctgttcctgtcacgatatcgaacagaggagacgatatatggacaggaacaacctggcggcagcgcaaaagatg

SEQ ID NO: 3379 - DNA, 103 bp, Artificial Sequence
  Synthetic Polynucleotide
taatacgactcactatagggctgccactctgcaagctgttcctgtcacgaaacagaggagatcgtgaatggaacagcttaacctggcggcagcgcaaaagatg

SEQ ID NO: 3380 - DNA, 103 bp, Artificial Sequence
  Synthetic Polynucleotide
taatacgactcactatagggcgggtctgccactctgcaagctgttcctgtaacagaggagaacaggaatggcttgcagaaacctggcggcagcgcaaaagatg

SEQ ID NO: 3381 - DNA, 103 bp, Artificial Sequence
  Synthetic Polynucleotide
taatacgactcactatagggtttagcgggtctgccactctgcaagctgttaacagaggagaaacagcatgcagagtggcaacctggcggcagcgcaaaagatg

SEQ ID NO: 3382 - DNA, 103 bp, Artificial Sequence
  Synthetic Polynucleotide
taatacgactcactataggggcctttttagcgggtctgccactctgcaagaacagaggagacttgcaatgtggcagaccaacctggcggcagcgcaaaagatg

SEQ ID NO: 3383 - DNA, 103 bp, Artificial Sequence
  Synthetic Polynucleotide
taatacgactcactatagggaaatagcctttttagcgggtctgccactctaacagaggagaagagtgatggacccgctaaacctggcggcagcgcaaaagatg

SEQ ID NO: 3384 - DNA, 103 bp, Artificial Sequence
  Synthetic Polynucleotide
taatacgactcactatagggagtttaaatagcctttttagcgggtctgccaacagaggagaggcagaatggctaaaaagaacctggcggcagcgcaaaagatg

SEQ ID NO: 3385 - DNA, 103 bp, Artificial Sequence
  Synthetic Polynucleotide
taatacgactcactatagggtgcccagtttaaatagcctttttagcgggtaacagaggagaacccgcatgaaaggctataacctggcggcagcgcaaaagatg

SEQ ID NO: 3386 - DNA, 103 bp, Artificial Sequence
  Synthetic Polynucleotide
taatacgactcactatagggcggtttgcccagtttaaatagcctttttagaacagaggagactaaaaatgctatttaaaaacctggcggcagcgcaaaagatg

SEQ ID NO: 3387 - DNA, 103 bp, Artificial Sequence
  Synthetic Polynucleotide
taatacgactcactatagggaatttgcctcgtctaccttccgtcaggtctaacagaggagaagacctatgggaaggtagaacctggcggcagcgcaaaagatg

SEQ ID NO: 3388 - DNA, 103 bp, Artificial Sequence
  Synthetic Polynucleotide
taatacgactcactataggggctagcggtttgcccagtttaaatagccttaacagaggagaaaggctatgtaaactgggaacctggcggcagcgcaaaagatg

SEQ ID NO: 3389 - DNA, 103 bp, Artificial Sequence
  Synthetic Polynucleotide
taatacgactcactatagggctgccgctagcggtttgcccagtttaaataaacagaggagatatttaatgtgggcaaacaacctggcggcagcgcaaaagatg

SEQ ID NO: 3390 - DNA, 103 bp, Artificial Sequence
  Synthetic Polynucleotide
taatacgactcactataggggtcacctgccgctagcggtttgcccagtttaacagaggagaaaactgatgaaaccgctaaacctggcggcagcgcaaaagatg

SEQ ID NO: 3391 - DNA, 103 bp, Artificial Sequence
  Synthetic Polynucleotide
taatacgactcactatagggtgttcgtcacctgccgctagcggtttgcccaacagaggagagggcaaatggctagcggcaacctggcggcagcgcaaaagatg

SEQ ID NO: 3392 - DNA, 103 bp, Artificial Sequence
  Synthetic Polynucleotide
taatacgactcactatagggcatcttgttcgtcacctgccgctagcggttaacagaggagaaaccgcatgcggcaggtgaacctggcggcagcgcaaaagatg

SEQ ID NO: 3393 - DNA, 103 bp, Artificial Sequence
  Synthetic Polynucleotide
taatacgactcactatagggatcctcatcttgttcgtcacctgccgctagaacagaggagactagcgatgggtgacgaaaacctggcggcagcgcaaaagatg

SEQ ID NO: 3394 - DNA, 103 bp, Artificial Sequence
  Synthetic Polynucleotide
taatacgactcactatagggcttctatcctcatcttgttcgtcacctgccaacagaggagaggcaggatgcgaacaagaaacctggcggcagcgcaaaagatg

SEQ ID NO: 3395 - DNA, 103 bp, Artificial Sequence
  Synthetic Polynucleotide
taatacgactcactatagggctcgtcttctatcctcatcttgttcgtcacaacagaggagagtgacgatgaagatgaggaacctggcggcagcgcaaaagatg

SEQ ID NO: 3396 - DNA, 103 bp, Artificial Sequence
  Synthetic Polynucleotide
taatacgactcactatagggcagcgctcgtcttctatcctcatcttgttcaacagaggagagaacaaatggaggatagaaacctggcggcagcgcaaaagatg

SEQ ID NO: 3397 - DNA, 103 bp, Artificial Sequence
  Synthetic Polynucleotide
taatacgactcactatagggtcagccagcgctcgtcttctatcctcatctaacagaggagaagatgaatgtagaagacgaacctggcggcagcgcaaaagatg

SEQ ID NO: 3398 - DNA, 103 bp, Artificial Sequence
  Synthetic Polynucleotide
taatacgactcactatagggtagacaatttgcctcgtctaccttccgtcaaacagaggagatgacggatggtagacgagaacctggcggcagcgcaaaagatg

SEQ ID NO: 3399 - DNA, 103 bp, Artificial Sequence
  Synthetic Polynucleotide
taatacgactcactatagggcttcgtcagccagcgctcgtcttctatcctaacagaggagaaggataatggacgagcgcaacctggcggcagcgcaaaagatg

SEQ ID NO: 3400 - DNA, 103 bp, Artificial Sequence
  Synthetic Polynucleotide
taatacgactcactataggggaccacttcgtcagccagcgctcgtcttctaacagaggagaagaagaatggcgctggctaacctggcggcagcgcaaaagatg

SEQ ID NO: 3401 - DNA, 103 bp, Artificial Sequence
  Synthetic Polynucleotide
taatacgactcactatagggcatctgaccacttcgtcagccagcgctcgtaacagaggagaacgagcatgggctgacgaaacctggcggcagcgcaaaagatg

SEQ ID NO: 3402 - DNA, 103 bp, Artificial Sequence
  Synthetic Polynucleotide
taatacgactcactataggggttgccatctgaccacttcgtcagccagcgaacagaggagacgctggatgacgaagtggaacctggcggcagcgcaaaagatg

SEQ ID NO: 3403 - DNA, 103 bp, Artificial Sequence
  Synthetic Polynucleotide
taatacgactcactatagggtgttcgttgccatctgaccacttcgtcagcaacagaggagagctgacatggtggtcagaaacctggcggcagcgcaaaagatg

SEQ ID NO: 3404 - DNA, 103 bp, Artificial Sequence
  Synthetic Polynucleotide
taatacgactcactatagggagccctgttcgttgccatctgaccacttcgaacagaggagacgaagtatgcagatggcaaacctggcggcagcgcaaaagatg

SEQ ID NO: 3405 - DNA, 103 bp, Artificial Sequence
  Synthetic Polynucleotide
taatacgactcactatagggcaattagccctgttcgttgccatctgaccaaacagaggagatggtcaatgggcaacgaaaacctggcggcagcgcaaaagatg

SEQ ID NO: 3406 - DNA, 103 bp, Artificial Sequence
  Synthetic Polynucleotide
taatacgactcactatagggctcatcaattagccctgttcgttgccatctaacagaggagaagatggatgcgaacagggaacctggcggcagcgcaaaagatg

SEQ ID NO: 3407 - DNA, 103 bp, Artificial Sequence
  Synthetic Polynucleotide
taatacgactcactatagggtccaactcatcaattagccctgttcgttgcaacagaggagagcaacgatgagggctaataacctggcggcagcgcaaaagatg

SEQ ID NO: 3408 - DNA, 103 bp, Artificial Sequence
  Synthetic Polynucleotide
taatacgactcactatagggctttctccaactcatcaattagccctgttcaacagaggagagaacagatgtaattgatgaacctggcggcagcgcaaaagatg

SEQ ID NO: 3409 - DNA, 103 bp, Artificial Sequence
  Synthetic Polynucleotide
taatacgactcactatagggcataatagacaatttgcctcgtctaccttcaacagaggagagaaggtatgcgaggcaaaaacctggcggcagcgcaaaagatg

SEQ ID NO: 3410 - DNA, 103 bp, Artificial Sequence
  Synthetic Polynucleotide
taatacgactcactatagggtaccgctttctccaactcatcaattagcccaacagaggagagggctaatggatgagttgaacctggcggcagcgcaaaagatg

SEQ ID NO: 3411 - DNA, 103 bp, Artificial Sequence
  Synthetic Polynucleotide
taatacgactcactataggggagtataccgctttctccaactcatcaattaacagaggagaaattgaatggttggagaaaacctggcggcagcgcaaaagatg

SEQ ID NO: 3412 - DNA, 103 bp, Artificial Sequence
  Synthetic Polynucleotide
taatacgactcactatagggacctagagtataccgctttctccaactcataacagaggagaatgagtatgagaaagcggaacctggcggcagcgcaaaagatg

SEQ ID NO: 3413 - DNA, 103 bp, Artificial Sequence
  Synthetic Polynucleotide
taatacgactcactatagggttcatacctagagtataccgctttctccaaaacagaggagattggagatggcggtatacaacctggcggcagcgcaaaagatg

SEQ ID NO: 3414 - DNA, 103 bp, Artificial Sequence
  Synthetic Polynucleotide
taatacgactcactatagggtgcacttcatacctagagtataccgctttcaacagaggagagaaagcatgatactctagaacctggcggcagcgcaaaagatg

SEQ ID NO: 3415 - DNA, 103 bp, Artificial Sequence
  Synthetic Polynucleotide
taatacgactcactatagggtaccctgcacttcatacctagagtataccgaacagaggagacggtatatgctaggtatgaacctggcggcagcgcaaaagatg

SEQ ID NO: 3416 - DNA, 103 bp, Artificial Sequence
  Synthetic Polynucleotide
taatacgactcactatagggtgatataccctgcacttcatacctagagtaaacagaggagatactctatgtatgaagtgaacctggcggcagcgcaaaagatg

SEQ ID NO: 3417 - DNA, 103 bp, Artificial Sequence
  Synthetic Polynucleotide
taatacgactcactatagggacaactgatataccctgcacttcatacctaaacagaggagataggtaatgagtgcagggaacctggcggcagcgcaaaagatg

SEQ ID NO: 3418 - DNA, 103 bp, Artificial Sequence
  Synthetic Polynucleotide
taatacgactcactatagggttaccacaactgatataccctgcacttcataacagaggagaatgaagatgagggtatataacctggcggcagcgcaaaagatg

SEQ ID NO: 3419 - DNA, 103 bp, Artificial Sequence
  Synthetic Polynucleotide
taatacgactcactatagggggacattaccacaactgatataccctgcacaacagaggagagtgcagatgatatcagttaacctggcggcagcgcaaaagatg

SEQ ID NO: 3420 - DNA, 103 bp, Artificial Sequence
  Synthetic Polynucleotide
taatacgactcactatagggcctctcataatagacaatttgcctcgtctaaacagaggagatagacgatgcaaattgtcaacctggcggcagcgcaaaagatg

SEQ ID NO: 3421 - DNA, 103 bp, Artificial Sequence
  Synthetic Polynucleotide
taatacgactcactataggggccatggacattaccacaactgatatacccaacagaggagagggtatatgagttgtggtaacctggcggcagcgcaaaagatg

SEQ ID NO: 3422 - DNA, 103 bp, Artificial Sequence
  Synthetic Polynucleotide
taatacgactcactatagggaggtggccatggacattaccacaactgataaacagaggagatatcagatgtggtaatgtaacctggcggcagcgcaaaagatg

SEQ ID NO: 3423 - DNA, 103 bp, Artificial Sequence
  Synthetic Polynucleotide
taatacgactcactatagggtgcaaaggtggccatggacattaccacaacaacagaggagagttgtgatgatgtccatgaacctggcggcagcgcaaaagatg

SEQ ID NO: 3424 - DNA, 103 bp, Artificial Sequence
  Synthetic Polynucleotide
taatacgactcactataggggagcttgcaaaggtggccatggacattaccaacagaggagaggtaatatgcatggccacaacctggcggcagcgcaaaagatg

SEQ ID NO: 3425 - DNA, 103 bp, Artificial Sequence
  Synthetic Polynucleotide
taatacgactcactatagggatctggagcttgcaaaggtggccatggacaaacagaggagatgtccaatgccacctttgaacctggcggcagcgcaaaagatg

SEQ ID NO: 3426 - DNA, 103 bp, Artificial Sequence
  Synthetic Polynucleotide
taatacgactcactataggggttggatctggagcttgcaaaggtggccataacagaggagaatggccatgtttgcaagcaacctggcggcagcgcaaaagatg

SEQ ID NO: 3427 - DNA, 103 bp, Artificial Sequence
  Synthetic Polynucleotide
taatacgactcactatagggtcgaagttggatctggagcttgcaaaggtgaacagaggagacaccttatgaagctccagaacctggcggcagcgcaaaagatg

SEQ ID NO: 3428 - DNA, 103 bp, Artificial Sequence
  Synthetic Polynucleotide
taatacgactcactataggggcttctcgaagttggatctggagcttgcaaaacagaggagattgcaaatgccagatccaaacctggcggcagcgcaaaagatg

SEQ ID NO: 3429 - DNA, 103 bp, Artificial Sequence
  Synthetic Polynucleotide
taatacgactcactatagggtctgagcttctcgaagttggatctggagctaacagaggagaagctccatgtccaacttcaacctggcggcagcgcaaaagatg

SEQ ID NO: 3430 - DNA, 103 bp, Artificial Sequence
  Synthetic Polynucleotide
taatacgactcactatagggggtcctctgagcttctcgaagttggatctgaacagaggagacagatcatgcttcgagaaaacctggcggcagcgcaaaagatg

SEQ ID NO: 3431 - DNA, 103 bp, Artificial Sequence
  Synthetic Polynucleotide
taatacgactcactatagggtttttcctctcataatagacaatttgcctcaacagaggagagaggcaatgtgtctattaaacctggcggcagcgcaaaagatg

SEQ ID NO: 3432 - DNA, 103 bp, Artificial Sequence
  Synthetic Polynucleotide
taatacgactcactatagggcgacgggtcctctgagcttctcgaagttggaacagaggagaccaactatgagaagctcaaacctggcggcagcgcaaaagatg

SEQ ID NO: 3433 - DNA, 103 bp, Artificial Sequence
  Synthetic Polynucleotide
taatacgactcactatagggagttacgacgggtcctctgagcttctcgaaaacagaggagattcgagatgctcagaggaaacctggcggcagcgcaaaagatg

SEQ ID NO: 3434 - DNA, 103 bp, Artificial Sequence
  Synthetic Polynucleotide
taatacgactcactatagggtacaaagttacgacgggtcctctgagcttcaacagaggagagaagctatgaggacccgtaacctggcggcagcgcaaaagatg

SEQ ID NO: 3435 - DNA, 103 bp, Artificial Sequence
  Synthetic Polynucleotide
taatacgactcactatagggcgccgtacaaagttacgacgggtcctctgaaacagaggagatcagagatgccgtcgtaaaacctggcggcagcgcaaaagatg

SEQ ID NO: 3436 - DNA, 103 bp, Artificial Sequence
  Synthetic Polynucleotide
taatacgactcactatagggaggaccgccgtacaaagttacgacgggtccaacagaggagaggacccatggtaactttgaacctggcggcagcgcaaaagatg

SEQ ID NO: 3437 - DNA, 103 bp, Artificial Sequence
  Synthetic Polynucleotide
taatacgactcactatagggtatttaggaccgccgtacaaagttacgacgaacagaggagacgtcgtatgtttgtacggaacctggcggcagcgcaaaagatg

SEQ ID NO: 3438 - DNA, 103 bp, Artificial Sequence
  Synthetic Polynucleotide
taatacgactcactataggggtacctatttaggaccgccgtacaaagttaaacagaggagataacttatgacggcggtcaacctggcggcagcgcaaaagatg

SEQ ID NO: 3439 - DNA, 103 bp, Artificial Sequence
  Synthetic Polynucleotide
taatacgactcactatagggagtgcgtacctatttaggaccgccgtacaaaacagaggagattgtacatgggtcctaaaaacctggcggcagcgcaaaagatg

SEQ ID NO: 3440 - DNA, 103 bp, Artificial Sequence
  Synthetic Polynucleotide
taatacgactcactataggggctgtagtgcgtacctatttaggaccgccgaacagaggagacggcggatgtaaataggtaacctggcggcagcgcaaaagatg

SEQ ID NO: 3441 - DNA, 103 bp, Artificial Sequence
  Synthetic Polynucleotide
taatacgactcactatagggaggtagctgtagtgcgtacctatttaggacaacagaggagagtcctaatgaggtacgcaaacctggcggcagcgcaaaagatg

SEQ ID NO: 3442 - DNA, 103 bp, Artificial Sequence
  Synthetic Polynucleotide
taatacgactcactatagggtatgtccacgtacacaggatccatgatgggaacagaggagacccatcatggatcctgtgaacctggcggcagcgcaaaagatg

SEQ ID NO: 3443 - DNA, 103 bp, Artificial Sequence
  Synthetic Polynucleotide
taatacgactcactatagggtagcttttttcctctcataatagacaatttaacagaggagaaaattgatgattatgagaaacctggcggcagcgcaaaagatg

SEQ ID NO: 3444 - DNA, 103 bp, Artificial Sequence
  Synthetic Polynucleotide
taatacgactcactatagggaaaataggtagctgtagtgcgtacctatttaacagaggagaaaatagatgcgcactacaaacctggcggcagcgcaaaagatg

SEQ ID NO: 3445 - DNA, 103 bp, Artificial Sequence
  Synthetic Polynucleotide
taatacgactcactatagggtctgcaaaataggtagctgtagtgcgtaccaacagaggagaggtacgatgtacagctacaacctggcggcagcgcaaaagatg

SEQ ID NO: 3446 - DNA, 103 bp, Artificial Sequence
  Synthetic Polynucleotide
taatacgactcactatagggcggcttctgcaaaataggtagctgtagtgcaacagaggagagcactaatgctacctattaacctggcggcagcgcaaaagatg

SEQ ID NO: 3447 - DNA, 103 bp, Artificial Sequence
  Synthetic Polynucleotide
taatacgactcactatagggactgtcggcttctgcaaaataggtagctgtaacagaggagaacagctatgtattttgcaaacctggcggcagcgcaaaagatg

SEQ ID NO: 3448 - DNA, 103 bp, Artificial Sequence
  Synthetic Polynucleotide
taatacgactcactatagggtacttactgtcggcttctgcaaaataggtaaacagaggagatacctaatgtgcagaagcaacctggcggcagcgcaaaagatg

SEQ ID NO: 3449 - DNA, 103 bp, Artificial Sequence
  Synthetic Polynucleotide
taatacgactcactatagggttaggtacttactgtcggcttctgcaaaataacagaggagaattttgatgaagccgacaaacctggcggcagcgcaaaagatg

SEQ ID NO: 3450 - DNA, 103 bp, Artificial Sequence
  Synthetic Polynucleotide
taatacgactcactatagggagtgtttaggtacttactgtcggcttctgcaacagaggagagcagaaatggacagtaagaacctggcggcagcgcaaaagatg

SEQ ID NO: 3451 - DNA, 103 bp, Artificial Sequence
  Synthetic Polynucleotide
taatacgactcactatagggtgattagtgtttaggtacttactgtcggctaacagaggagaagccgaatgtaagtacctaacctggcggcagcgcaaaagatg

SEQ ID NO: 3452 - DNA, 103 bp, Artificial Sequence
  Synthetic Polynucleotide
taatacgactcactataggggtagctgattagtgtttaggtacttactgtaacagaggagaacagtaatgacctaaacaaacctggcggcagcgcaaaagatg

SEQ ID NO: 3453 - DNA, 103 bp, Artificial Sequence
  Synthetic Polynucleotide
taatacgactcactatagggccattgtagctgattagtgtttaggtacttaacagaggagaaagtacatgaacactaataacctggcggcagcgcaaaagatg

SEQ ID NO: 3454 - DNA, 103 bp, Artificial Sequence
  Synthetic Polynucleotide
taatacgactcactatagggggttctagcttttttcctctcataatagacaacagaggagagtctatatggagaggaaaaacctggcggcagcgcaaaagatg

SEQ ID NO: 3455 - DNA, 103 bp, Artificial Sequence
  Synthetic Polynucleotide
taatacgactcactataggggaactccattgtagctgattagtgtttaggaacagaggagacctaaaatgtaatcagctaacctggcggcagcgcaaaagatg

SEQ ID NO: 3456 - DNA, 103 bp, Artificial Sequence
  Synthetic Polynucleotide
taatacgactcactataggggggatgaactccattgtagctgattagtgtaacagaggagaacactaatgagctacaataacctggcggcagcgcaaaagatg

SEQ ID NO: 3457 - DNA, 103 bp, Artificial Sequence
  Synthetic Polynucleotide
taatacgactcactataggggggttgggatgaactccattgtagctgattaacagaggagaaatcagatgcaatggagtaacctggcggcagcgcaaaagatg

SEQ ID NO: 3458 - DNA, 103 bp, Artificial Sequence
  Synthetic Polynucleotide
taatacgactcactatagggagtttgggttgggatgaactccattgtagcaacagaggagagctacaatggagttcatcaacctggcggcagcgcaaaagatg

SEQ ID NO: 3459 - DNA, 103 bp, Artificial Sequence
  Synthetic Polynucleotide
taatacgactcactatagggtaaaaagtttgggttgggatgaactccattaacagaggagaaatggaatgcatcccaacaacctggcggcagcgcaaaagatg

SEQ ID NO: 3460 - DNA, 103 bp, Artificial Sequence
  Synthetic Polynucleotide
taatacgactcactatagggtgttgtaaaaagtttgggttgggatgaactaacagaggagaagttcaatgcaacccaaaaacctggcggcagcgcaaaagatg

SEQ ID NO: 3461 - DNA, 103 bp, Artificial Sequence
  Synthetic Polynucleotide
taatacgactcactatagggcctcctgttgtaaaaagtttgggttgggataacagaggagaatcccaatgcaaacttttaacctggcggcagcgcaaaagatg

SEQ ID NO: 3462 - DNA, 103 bp, Artificial Sequence
  Synthetic Polynucleotide
taatacgactcactatagggtggtacctcctgttgtaaaaagtttgggttaacagaggagaaacccaatgtttttacaaaacctggcggcagcgcaaaagatg

SEQ ID NO: 3463 - DNA, 103 bp, Artificial Sequence
  Synthetic Polynucleotide
taatacgactcactataggggaggctggtacctcctgttgtaaaaagtttaacagaggagaaaacttatgacaacaggaaacctggcggcagcgcaaaagatg

SEQ ID NO: 3464 - DNA, 103 bp, Artificial Sequence
  Synthetic Polynucleotide
taatacgactcactataggggggtcgaggctggtacctcctgttgtaaaaaacagaggagattttacatgaggaggtacaacctggcggcagcgcaaaagatg

SEQ ID NO: 3465 - DNA, 103 bp, Artificial Sequence
  Synthetic Polynucleotide
taatacgactcactatagggcgcacggttctagcttttttcctctcataaaacagaggagattatgaatggaaaaaagcaacctggcggcagcgcaaaagatg

SEQ ID NO: 3466 - DNA, 103 bp, Artificial Sequence
  Synthetic Polynucleotide
taatacgactcactataggggtccagggtcgaggctggtacctcctgttgaacagaggagacaacagatggtaccagccaacctggcggcagcgcaaaagatg

SEQ ID NO: 3467 - DNA, 103 bp, Artificial Sequence
  Synthetic Polynucleotide
taatacgactcactataggggcggagtccagggtcgaggctggtacctccaacagaggagaggaggtatgagcctcgacaacctggcggcagcgcaaaagatg

SEQ ID NO: 3468 - DNA, 103 bp, Artificial Sequence
  Synthetic Polynucleotide
taatacgactcactatagggagggcgcggagtccagggtcgaggctggtaaacagaggagataccagatgcgaccctggaacctggcggcagcgcaaaagatg

SEQ ID NO: 3469 - DNA, 103 bp, Artificial Sequence
  Synthetic Polynucleotide
taatacgactcactatagggatagtagggcgcggagtccagggtcgaggcaacagaggagagcctcgatgctggactccaacctggcggcagcgcaaaagatg

SEQ ID NO: 3470 - DNA, 103 bp, Artificial Sequence
  Synthetic Polynucleotide
taatacgactcactatagggcttggatagtagggcgcggagtccagggtcaacagaggagagaccctatgctccgcgccaacctggcggcagcgcaaaagatg

SEQ ID NO: 3471 - DNA, 103 bp, Artificial Sequence
  Synthetic Polynucleotide
taatacgactcactataggggatgacttggatagtagggcgcggagtccaaacagaggagatggactatgcgccctactaacctggcggcagcgcaaaagatg

SEQ ID NO: 3472 - DNA, 103 bp, Artificial Sequence
  Synthetic Polynucleotide
taatacgactcactatagggggcctgatgacttggatagtagggcgcggaaacagaggagatccgcgatgtactatccaaacctggcggcagcgcaaaagatg

SEQ ID NO: 3473 - DNA, 103 bp, Artificial Sequence
  Synthetic Polynucleotide
taatacgactcactataggggtctgggcctgatgacttggatagtagggcaacagaggagagccctaatgtccaagtcaaacctggcggcagcgcaaaagatg

SEQ ID NO: 3474 - DNA, 103 bp, Artificial Sequence
  Synthetic Polynucleotide
taatacgactcactataggggcgcggtctgggcctgatgacttggatagtaacagaggagaactatcatggtcatcaggaacctggcggcagcgcaaaagatg

SEQ ID NO: 3475 - DNA, 103 bp, Artificial Sequence
  Synthetic Polynucleotide
taatacgactcactatagggtgcgggcgcggtctgggcctgatgacttggaacagaggagaccaagtatgcaggcccagaacctggcggcagcgcaaaagatg

SEQ ID NO: 3476 - DNA, 103 bp, Artificial Sequence
  Synthetic Polynucleotide
taatacgactcactatagggacggtcgcacggttctagcttttttcctctaacagaggagaagaggaatgaagctagaaaacctggcggcagcgcaaaagatg

SEQ ID NO: 3477 - DNA, 103 bp, Artificial Sequence
  Synthetic Polynucleotide
taatacgactcactataggggcctctgcgggcgcggtctgggcctgatgaaacagaggagatcatcaatgccagaccgcaacctggcggcagcgcaaaagatg

SEQ ID NO: 3478 - DNA, 103 bp, Artificial Sequence
  Synthetic Polynucleotide
taatacgactcactatagggagcttgcctctgcgggcgcggtctgggcctaacagaggagaaggcccatgccgcgcccgaacctggcggcagcgcaaaagatg

SEQ ID NO: 3479 - DNA, 103 bp, Artificial Sequence
  Synthetic Polynucleotide
taatacgactcactatagggtgcccagcttgcctctgcgggcgcggtctgaacagaggagacagaccatgcccgcagagaacctggcggcagcgcaaaagatg

SEQ ID NO: 3480 - DNA, 103 bp, Artificial Sequence
  Synthetic Polynucleotide
taatacgactcactatagggcaagttgcccagcttgcctctgcgggcgcgaacagaggagacgcgccatgagaggcaagaacctggcggcagcgcaaaagatg

SEQ ID NO: 3481 - DNA, 103 bp, Artificial Sequence
  Synthetic Polynucleotide
taatacgactcactatagggctgggcaagttgcccagcttgcctctgcggaacagaggagaccgcagatgcaagctgggaacctggcggcagcgcaaaagatg

SEQ ID NO: 3482 - DNA, 103 bp, Artificial Sequence
  Synthetic Polynucleotide
taatacgactcactatagggatcagctgggcaagttgcccagcttgcctcaacagaggagagaggcaatgtgggcaactaacctggcggcagcgcaaaagatg

SEQ ID NO: 3483 - DNA, 103 bp, Artificial Sequence
  Synthetic Polynucleotide
taatacgactcactatagggctgagatcagctgggcaagttgcccagcttaacagaggagaaagctgatgaacttgcccaacctggcggcagcgcaaaagatg

SEQ ID NO: 3484 - DNA, 103 bp, Artificial Sequence
  Synthetic Polynucleotide
taatacgactcactatagggaactgctgagatcagctgggcaagttgcccaacagaggagagggcaaatggcccagctgaacctggcggcagcgcaaaagatg

SEQ ID NO: 3485 - DNA, 103 bp, Artificial Sequence
  Synthetic Polynucleotide
taatacgactcactatagggttattaactgctgagatcagctgggcaagtaacagaggagaacttgcatggctgatctcaacctggcggcagcgcaaaagatg

SEQ ID NO: 3486 - DNA, 103 bp, Artificial Sequence
  Synthetic Polynucleotide
taatacgactcactatagggtcagtttattaactgctgagatcagctgggaacagaggagacccagcatgtctcagcagaacctggcggcagcgcaaaagatg

SEQ ID NO: 3487 - DNA, 103 bp, Artificial Sequence
  Synthetic Polynucleotide
taatacgactcactatagggagcacacggtcgcacggttctagcttttttaacagaggagaaaaaaaatgagaaccgtgaacctggcggcagcgcaaaagatg

SEQ ID NO: 3488 - DNA, 103 bp, Artificial Sequence
  Synthetic Polynucleotide
taatacgactcactatagggcattgtcagtttattaactgctgagatcagaacagaggagactgatcatggcagttaataacctggcggcagcgcaaaagatg

SEQ ID NO: 3489 - DNA, 103 bp, Artificial Sequence
  Synthetic Polynucleotide
taatacgactcactataggggcgcgcattgtcagtttattaactgctgagaacagaggagactcagcatgtaataaactaacctggcggcagcgcaaaagatg

SEQ ID NO: 3490 - DNA, 103 bp, Artificial Sequence
  Synthetic Polynucleotide
taatacgactcactataggggtaccgcgcgcattgtcagtttattaactgaacagaggagacagttaatgaactgacaaaacctggcggcagcgcaaaagatg

SEQ ID NO: 3491 - DNA, 103 bp, Artificial Sequence
  Synthetic Polynucleotide
taatacgactcactatagggttggggtaccgcgcgcattgtcagtttattaacagaggagaaataaaatgacaatgcgcaacctggcggcagcgcaaaagatg

SEQ ID NO: 3492 - DNA, 103 bp, Artificial Sequence
  Synthetic Polynucleotide
taatacgactcactatagggttctgttggggtaccgcgcgcattgtcagtaacagaggagaactgacatggcgcgcggtaacctggcggcagcgcaaaagatg

SEQ ID NO: 3493 - DNA, 103 bp, Artificial Sequence
  Synthetic Polynucleotide
taatacgactcactataggggtggcttctgttggggtaccgcgcgcattgaacagaggagacaatgcatgcggtaccccaacctggcggcagcgcaaaagatg

SEQ ID NO: 3494 - DNA, 103 bp, Artificial Sequence
  Synthetic Polynucleotide
taatacgactcactatagggcttgcgtggcttctgttggggtaccgcgcgaacagaggagacgcgcgatgccccaacagaacctggcggcagcgcaaaagatg

SEQ ID NO: 3495 - DNA, 103 bp, Artificial Sequence
  Synthetic Polynucleotide
taatacgactcactatagggcgattcttgcgtggcttctgttggggtaccaacagaggagaggtaccatgacagaagccaacctggcggcagcgcaaaagatg

SEQ ID NO: 3496 - DNA, 103 bp, Artificial Sequence
  Synthetic Polynucleotide
taatacgactcactatagggtcttccgattcttgcgtggcttctgttgggaacagaggagacccaacatgagccacgcaaacctggcggcagcgcaaaagatg

SEQ ID NO: 3497 - DNA, 103 bp, Artificial Sequence
  Synthetic Polynucleotide
taatacgactcactatagggcttattcttccgattcttgcgtggcttctgaacagaggagacagaagatgcgcaagaataacctggcggcagcgcaaaagatg

SEQ ID NO: 3498 - DNA, 103 bp, Artificial Sequence
  Synthetic Polynucleotide
taatacgactcactatagggagaacagcacacggtcgcacggttctagctaacagaggagaagctagatgcgtgcgaccaacctggcggcagcgcaaaagatg

SEQ ID NO: 3499 - DNA, 103 bp, Artificial Sequence
  Synthetic Polynucleotide
taatacgactcactatagggtgcttcttattcttccgattcttgcgtggcaacagaggagagccacgatggaatcggaaaacctggcggcagcgcaaaagatg

SEQ ID NO: 3500 - DNA, 103 bp, Artificial Sequence
  Synthetic Polynucleotide
taatacgactcactataggggcttttgcttcttattcttccgattcttgcaacagaggagagcaagaatgggaagaataaacctggcggcagcgcaaaagatg

SEQ ID NO: 3501 - DNA, 103 bp, Artificial Sequence
  Synthetic Polynucleotide
taatacgactcactatagggcttttgcttttgcttcttattcttccgattaacagaggagaaatcggatgaataagaagaacctggcggcagcgcaaaagatg

SEQ ID NO: 3502 - DNA, 103 bp, Artificial Sequence
  Synthetic Polynucleotide
taatacgactcactatagggtgctgcttttgcttttgcttcttattcttcaacagaggagagaagaaatggaagcaaaaaacctggcggcagcgcaaaagatg

SEQ ID NO: 3503 - DNA, 103 bp, Artificial Sequence
  Synthetic Polynucleotide
taatacgactcactataggggcgcctgctgcttttgcttttgcttcttataacagaggagaataagaatgaaaagcaaaaacctggcggcagcgcaaaagatg

SEQ ID NO: 3504 - DNA, 103 bp, Artificial Sequence
  Synthetic Polynucleotide
taatacgactcactatagggttgtggcgcctgctgcttttgcttttgcttaacagaggagaaagcaaatgcaaaagcagaacctggcggcagcgcaaaagatg

SEQ ID NO: 3505 - DNA, 103 bp, Artificial Sequence
  Synthetic Polynucleotide
taatacgactcactatagggttgttttgtggcgcctgctgcttttgctttaacagaggagaaaagcaatggcagcaggcaacctggcggcagcgcaaaagatg

SEQ ID NO: 3506 - DNA, 103 bp, Artificial Sequence
  Synthetic Polynucleotide
taatacgactcactatagggttgtgttgttttgtggcgcctgctgcttttaacagaggagaaaaagcatgaggcgccacaacctggcggcagcgcaaaagatg

SEQ ID NO: 3507 - DNA, 103 bp, Artificial Sequence
  Synthetic Polynucleotide
taatacgactcactatagggttggtttgtgttgttttgtggcgcctgctgaacagaggagacagcagatgccacaaaacaacctggcggcagcgcaaaagatg

SEQ ID NO: 3508 - DNA, 103 bp, Artificial Sequence
  Synthetic Polynucleotide
taatacgactcactatagggttcttttggtttgtgttgttttgtggcgccaacagaggagaggcgccatgaaacaacacaacctggcggcagcgcaaaagatg

SEQ ID NO: 3509 - DNA, 103 bp, Artificial Sequence
  Synthetic Polynucleotide
taatacgactcactatagggtactgagaacagcacacggtcgcacggttcaacagaggagagaaccgatggaccgtgtgaacctggcggcagcgcaaaagatg

SEQ ID NO: 3510 - DNA, 103 bp, Artificial Sequence
  Synthetic Polynucleotide
taatacgactcactataggggctgcttcttttggtttgtgttgttttgtgaacagaggagacacaaaatgacacaaaccaacctggcggcagcgcaaaagatg

SEQ ID NO: 3511 - DNA, 103 bp, Artificial Sequence
  Synthetic Polynucleotide
taatacgactcactatagggaggtggctgcttcttttggtttgtgttgttaacagaggagaaacaacatgaaccaaaagaacctggcggcagcgcaaaagatg

SEQ ID NO: 3512 - DNA, 103 bp, Artificial Sequence
  Synthetic Polynucleotide
taatacgactcactatagggtttttaggtggctgcttcttttggtttgtgaacagaggagacacaaaatgaaagaagcaaacctggcggcagcgcaaaagatg

SEQ ID NO: 3513 - DNA, 103 bp, Artificial Sequence
  Synthetic Polynucleotide
taatacgactcactataggggtttctttttaggtggctgcttcttttggtaacagaggagaaccaaaatgagcagccacaacctggcggcagcgcaaaagatg

SEQ ID NO: 3514 - DNA, 103 bp, Artificial Sequence
  Synthetic Polynucleotide
taatacgactcactatagggagctggtttctttttaggtggctgcttcttaacagaggagaaagaagatgccacctaaaaacctggcggcagcgcaaaagatg

SEQ ID NO: 3515 - DNA, 103 bp, Artificial Sequence
  Synthetic Polynucleotide
taatacgactcactatagggttttgagctggtttctttttaggtggctgcaacagaggagagcagccatgtaaaaagaaaacctggcggcagcgcaaaagatg

SEQ ID NO: 3516 - DNA, 103 bp, Artificial Sequence
  Synthetic Polynucleotide
taatacgactcactatagggttttcttttgagctggtttctttttaggtgaacagaggagacacctaatgagaaaccagaacctggcggcagcgcaaaagatg

SEQ ID NO: 3517 - DNA, 103 bp, Artificial Sequence
  Synthetic Polynucleotide
taatacgactcactatagggcttctttttcttttgagctggtttctttttaacagaggagaaaaaagatgccagctcaaaacctggcggcagcgcaaaagatg

SEQ ID NO: 3518 - DNA, 103 bp, Artificial Sequence
  Synthetic Polynucleotide
taatacgactcactatagggcccggcttctttttcttttgagctggtttcaacagaggagagaaaccatgtcaaaagaaaacctggcggcagcgcaaaagatg

SEQ ID NO: 3519 - DNA, 103 bp, Artificial Sequence
  Synthetic Polynucleotide
taatacgactcactatagggtgcggcccggcttctttttcttttgagctgaacagaggagacagctcatgagaaaaagaaacctggcggcagcgcaaaagatg

SEQ ID NO: 3520 - DNA, 103 bp, Artificial Sequence
  Synthetic Polynucleotide
taatacgactcactataggggaccctactgagaacagcacacggtcgcacaacagaggagagtgcgaatgtgtgctgttaacctggcggcagcgcaaaagatg

SEQ ID NO: 3521 - DNA, 103 bp, Artificial Sequence
  Synthetic Polynucleotide
taatacgactcactatagggctctctgcggcccggcttctttttcttttgaacagaggagacaaaagatgaagaagccgaacctggcggcagcgcaaaagatg

SEQ ID NO: 3522 - DNA, 103 bp, Artificial Sequence
  Synthetic Polynucleotide
taatacgactcactatagggatcctctctctgcggcccggcttctttttcaacagaggagagaaaaaatggccgggccgaacctggcggcagcgcaaaagatg

SEQ ID NO: 3523 - DNA, 103 bp, Artificial Sequence
  Synthetic Polynucleotide
taatacgactcactatagggtgcacatcctctctctgcggcccggcttctaacagaggagaagaagcatggccgcagagaacctggcggcagcgcaaaagatg

SEQ ID NO: 3524 - DNA, 103 bp, Artificial Sequence
  Synthetic Polynucleotide
taatacgactcactatagggtttcatgcacatcctctctctgcggcccggaacagaggagaccgggcatgagagagaggaacctggcggcagcgcaaaagatg

SEQ ID NO: 3525 - DNA, 103 bp, Artificial Sequence
  Synthetic Polynucleotide
taatacgactcactatagggtcgattttcatgcacatcctctctctgcggaacagaggagaccgcagatggaggatgtgaacctggcggcagcgcaaaagatg

SEQ ID NO: 3526 - DNA, 103 bp, Artificial Sequence
  Synthetic Polynucleotide
taatacgactcactatagggcattttcgattttcatgcacatcctctctcaacagaggagagagagaatgtgtgcatgaaacctggcggcagcgcaaaagatg

SEQ ID NO: 3527 - DNA, 103 bp, Artificial Sequence
  Synthetic Polynucleotide
taatacgactcactatagggacagtcattttcgattttcatgcacatcctaacagaggagaaggatgatgatgaaaatcaacctggcggcagcgcaaaagatg

SEQ ID NO: 3528 - DNA, 103 bp, Artificial Sequence
  Synthetic Polynucleotide
taatacgactcactatagggaaaatacagtcattttcgattttcatgcacaacagaggagagtgcatatgaatcgaaaaaacctggcggcagcgcaaaagatg

SEQ ID NO: 3529 - DNA, 103 bp, Artificial Sequence
  Synthetic Polynucleotide
taatacgactcactatagggcttcgaaaatacagtcattttcgattttcaaacagaggagatgaaaaatgaaaatgactaacctggcggcagcgcaaaagatg

SEQ ID NO: 3530 - DNA, 103 bp, Artificial Sequence
  Synthetic Polynucleotide
taatacgactcactatagggcttgacttcgaaaatacagtcattttcgataacagaggagaatcgaaatggactgtattaacctggcggcagcgcaaaagatg

SEQ ID NO: 3531 - DNA, 103 bp, Artificial Sequence
  Synthetic Polynucleotide
taatacgactcactataggggcgttgaccctactgagaacagcacacggtaacagaggagaaccgtgatgtgttctcagaacctggcggcagcgcaaaagatg

SEQ ID NO: 3532 - DNA, 103 bp, Artificial Sequence
  Synthetic Polynucleotide
taatacgactcactatagggtcgtgcttgacttcgaaaatacagtcatttaacagaggagaaaatgaatgtattttcgaaacctggcggcagcgcaaaagatg

SEQ ID NO: 3533 - DNA, 103 bp, Artificial Sequence
  Synthetic Polynucleotide
taatacgactcactatagggtaccttcgtgcttgacttcgaaaatacagtaacagaggagaactgtaatgtcgaagtcaaacctggcggcagcgcaaaagatg

SEQ ID NO: 3534 - DNA, 103 bp, Artificial Sequence
  Synthetic Polynucleotide
taatacgactcactatagggtaccttaccttcgtgcttgacttcgaaaataacagaggagaattttcatggtcaagcacaacctggcggcagcgcaaaagatg

SEQ ID NO: 3535 - DNA, 103 bp, Artificial Sequence
  Synthetic Polynucleotide
taatacgactcactatagggcctgttaccttaccttcgtgcttgacttcgaacagaggagacgaagtatggcacgaaggaacctggcggcagcgcaaaagatg

SEQ ID NO: 3536 - DNA, 103 bp, Artificial Sequence
  Synthetic Polynucleotide
taatacgactcactatagggcgtaacctgttaccttaccttcgtgcttgaaacagaggagatcaagcatgaaggtaaggaacctggcggcagcgcaaaagatg

SEQ ID NO: 3537 - DNA, 103 bp, Artificial Sequence
  Synthetic Polynucleotide
taatacgactcactataggggcacgcgtaacctgttaccttaccttcgtgaacagaggagacacgaaatgaaggtaacaaacctggcggcagcgcaaaagatg

SEQ ID NO: 3538 - DNA, 103 bp, Artificial Sequence
  Synthetic Polynucleotide
taatacgactcactatagggaccaagcacgcgtaacctgttaccttacctaacagaggagaaggtaaatgaacaggttaaacctggcggcagcgcaaaagatg

SEQ ID NO: 3539 - DNA, 103 bp, Artificial Sequence
  Synthetic Polynucleotide
taatacgactcactatagggcccccaccaagcacgcgtaacctgttacctaacagaggagaaggtaaatggttacgcgtaacctggcggcagcgcaaaagatg

SEQ ID NO: 3540 - DNA, 103 bp, Artificial Sequence
  Synthetic Polynucleotide
taatacgactcactatagggtttgtcccccaccaagcacgcgtaacctgtaacagaggagaacaggtatggcgtgcttgaacctggcggcagcgcaaaagatg

SEQ ID NO: 3541 - DNA, 103 bp, Artificial Sequence
  Synthetic Polynucleotide
taatacgactcactatagggattactttgtcccccaccaagcacgcgtaaaacagaggagattacgcatgcttggtgggaacctggcggcagcgcaaaagatg

SEQ ID NO: 3542 - DNA, 103 bp, Artificial Sequence
  Synthetic Polynucleotide
taatacgactcactataggggtagagcgttgaccctactgagaacagcacaacagaggagagtgctgatgtcagtagggaacctggcggcagcgcaaaagatg

SEQ ID NO: 3543 - DNA, 103 bp, Artificial Sequence
  Synthetic Polynucleotide
taatacgactcactataggggtttcattactttgtcccccaccaagcacgaacagaggagacgtgctatgtgggggacaaacctggcggcagcgcaaaagatg

SEQ ID NO: 3544 - DNA, 103 bp, Artificial Sequence
  Synthetic Polynucleotide
taatacgactcactatagggtgctggtttcattactttgtcccccaccaaaacagaggagattggtgatggacaaagtaaacctggcggcagcgcaaaagatg

SEQ ID NO: 3545 - DNA, 103 bp, Artificial Sequence
  Synthetic Polynucleotide
taatacgactcactatagggacgtgtgctggtttcattactttgtcccccaacagaggagagggggaatgagtaatgaaaacctggcggcagcgcaaaagatg

SEQ ID NO: 3546 - DNA, 103 bp, Artificial Sequence
  Synthetic Polynucleotide
taatacgactcactatagggcctttacgtgtgctggtttcattactttgtaacagaggagaacaaagatgtgaaaccagaacctggcggcagcgcaaaagatg

SEQ ID NO: 3547 - DNA, 103 bp, Artificial Sequence
  Synthetic Polynucleotide
taatacgactcactatagggggtcccctttacgtgtgctggtttcattacaacagaggagagtaatgatgccagcacacaacctggcggcagcgcaaaagatg

SEQ ID NO: 3548 - DNA, 103 bp, Artificial Sequence
  Synthetic Polynucleotide
taatacgactcactatagggtcgatggtcccctttacgtgtgctggtttcaacagaggagagaaaccatgacacgtaaaaacctggcggcagcgcaaaagatg

SEQ ID NO: 3549 - DNA, 103 bp, Artificial Sequence
  Synthetic Polynucleotide
taatacgactcactatagggcgttatcgatggtcccctttacgtgtgctgaacagaggagacagcacatgtaaaggggaaacctggcggcagcgcaaaagatg

SEQ ID NO: 3550 - DNA, 103 bp, Artificial Sequence
  Synthetic Polynucleotide
taatacgactcactataggggtccgcgttatcgatggtcccctttacgtgaacagaggagacacgtaatggggaccatcaacctggcggcagcgcaaaagatg

SEQ ID NO: 3551 - DNA, 103 bp, Artificial Sequence
  Synthetic Polynucleotide
taatacgactcactataggggccaggtccgcgttatcgatggtcccctttaacagaggagaaaagggatgcatcgataaaacctggcggcagcgcaaaagatg

SEQ ID NO: 3552 - DNA, 103 bp, Artificial Sequence
  Synthetic Polynucleotide
taatacgactcactatagggatttggccaggtccgcgttatcgatggtccaacagaggagaggaccaatgataacgcggaacctggcggcagcgcaaaagatg

SEQ ID NO: 3553 - DNA, 103 bp, Artificial Sequence
  Synthetic Polynucleotide
taatacgactcactataggggcgtctatgtccacgtacacaggatccatgaacagaggagacatggaatgtgtgtacgtaacctggcggcagcgcaaaagatg

SEQ ID NO: 3554 - DNA, 103 bp, Artificial Sequence
  Synthetic Polynucleotide
taatacgactcactatagggtccgggtagagcgttgaccctactgagaacaacagaggagagttctcatgagggtcaacaacctggcggcagcgcaaaagatg

SEQ ID NO: 3555 - DNA, 103 bp, Artificial Sequence
  Synthetic Polynucleotide
taatacgactcactatagggggccaatttggccaggtccgcgttatcgataacagaggagaatcgatatggcggacctgaacctggcggcagcgcaaaagatg

SEQ ID NO: 3556 - DNA, 103 bp, Artificial Sequence
  Synthetic Polynucleotide
taatacgactcactatagggttaaaggccaatttggccaggtccgcgttaaacagaggagataacgcatgcctggccaaaacctggcggcagcgcaaaagatg

SEQ ID NO: 3557 - DNA, 103 bp, Artificial Sequence
  Synthetic Polynucleotide
taatacgactcactatagggaccgcttaaaggccaatttggccaggtccgaacagaggagacggaccatgccaaattggaacctggcggcagcgcaaaagatg

SEQ ID NO: 3558 - DNA, 103 bp, Artificial Sequence
  Synthetic Polynucleotide
taatacgactcactatagggagatgaccgcttaaaggccaatttggccagaacagaggagactggccatgttggcctttaacctggcggcagcgcaaaagatg

SEQ ID NO: 3559 - DNA, 103 bp, Artificial Sequence
  Synthetic Polynucleotide
taatacgactcactatagggtacttagatgaccgcttaaaggccaatttgaacagaggagacaaattatgctttaagcgaacctggcggcagcgcaaaagatg

SEQ ID NO: 3560 - DNA, 103 bp, Artificial Sequence
  Synthetic Polynucleotide
taatacgactcactatagggggtcgtacttagatgaccgcttaaaggccaaacagaggagatggcctatgagcggtcataacctggcggcagcgcaaaagatg

SEQ ID NO: 3561 - DNA, 103 bp, Artificial Sequence
  Synthetic Polynucleotide
taatacgactcactatagggttcaaggtcgtacttagatgaccgcttaaaaacagaggagatttaagatgtcatctaagaacctggcggcagcgcaaaagatg

SEQ ID NO: 3562 - DNA, 103 bp, Artificial Sequence
  Synthetic Polynucleotide
taatacgactcactataggggcgcattcaaggtcgtacttagatgaccgcaacagaggagagcggtcatgtaagtacgaaacctggcggcagcgcaaaagatg

SEQ ID NO: 3563 - DNA, 103 bp, Artificial Sequence
  Synthetic Polynucleotide
taatacgactcactatagggtctgcgcgcattcaaggtcgtacttagatgaacagaggagacatctaatgacgaccttgaacctggcggcagcgcaaaagatg

SEQ ID NO: 3564 - DNA, 103 bp, Artificial Sequence
  Synthetic Polynucleotide
taatacgactcactataggggggtatctgcgcgcattcaaggtcgtacttaacagaggagaaagtacatgcttgaatgcaacctggcggcagcgcaaaagatg

SEQ ID NO: 3565 - DNA, 103 bp, Artificial Sequence
  Synthetic Polynucleotide
taatacgactcactatagggggctttccgggtagagcgttgaccctactgaacagaggagacagtagatgcaacgctctaacctggcggcagcgcaaaagatg

SEQ ID NO: 3566 - DNA, 103 bp, Artificial Sequence
  Synthetic Polynucleotide
taatacgactcactatagggtgcacgggtatctgcgcgcattcaaggtcgaacagaggagacgacctatgatgcgcgcaaacctggcggcagcgcaaaagatg

SEQ ID NO: 3567 - DNA, 103 bp, Artificial Sequence
  Synthetic Polynucleotide
taatacgactcactatagggtcatgtgcacgggtatctgcgcgcattcaaaacagaggagattgaatatgcgcagatacaacctggcggcagcgcaaaagatg

SEQ ID NO: 3568 - DNA, 103 bp, Artificial Sequence
  Synthetic Polynucleotide
taatacgactcactatagggggacttcatgtgcacgggtatctgcgcgcaaacagaggagatgcgcgatgatacccgtgaacctggcggcagcgcaaaagatg

SEQ ID NO: 3569 - DNA, 103 bp, Artificial Sequence
  Synthetic Polynucleotide
taatacgactcactataggggcgtcggacttcatgtgcacgggtatctgcaacagaggagagcagatatgcgtgcacataacctggcggcagcgcaaaagatg

SEQ ID NO: 3570 - DNA, 103 bp, Artificial Sequence
  Synthetic Polynucleotide
taatacgactcactatagggtcgaagcgtcggacttcatgtgcacgggtaaacagaggagatacccgatgacatgaagtaacctggcggcagcgcaaaagatg

SEQ ID NO: 3571 - DNA, 103 bp, Artificial Sequence
  Synthetic Polynucleotide
taatacgactcactataggggaacttcgaagcgtcggacttcatgtgcacaacagaggagagtgcacatgaagtccgacaacctggcggcagcgcaaaagatg

SEQ ID NO: 3572 - DNA, 103 bp, Artificial Sequence
  Synthetic Polynucleotide
taatacgactcactatagggtgggtgaacttcgaagcgtcggacttcatgaacagaggagacatgaaatgcgacgcttcaacctggcggcagcgcaaaagatg

SEQ ID NO: 3573 - DNA, 103 bp, Artificial Sequence
  Synthetic Polynucleotide
taatacgactcactatagggtctcatgggtgaacttcgaagcgtcggactaacagaggagaagtccgatgcttcgaagtaacctggcggcagcgcaaaagatg

SEQ ID NO: 3574 - DNA, 103 bp, Artificial Sequence
  Synthetic Polynucleotide
taatacgactcactatagggcggtttctcatgggtgaacttcgaagcgtcaacagaggagagacgctatgaagttcaccaacctggcggcagcgcaaaagatg

SEQ ID NO: 3575 - DNA, 103 bp, Artificial Sequence
  Synthetic Polynucleotide
taatacgactcactatagggccctccggtttctcatgggtgaacttcgaaaacagaggagattcgaaatgcacccatgaaacctggcggcagcgcaaaagatg

SEQ ID NO: 3576 - DNA, 103 bp, Artificial Sequence
  Synthetic Polynucleotide
taatacgactcactatagggcttacggctttccgggtagagcgttgacccaacagaggagagggtcaatgctctacccgaacctggcggcagcgcaaaagatg

SEQ ID NO: 3577 - DNA, 103 bp, Artificial Sequence
  Synthetic Polynucleotide
taatacgactcactatagggagtacccctccggtttctcatgggtgaactaacagaggagaagttcaatgatgagaaacaacctggcggcagcgcaaaagatg

SEQ ID NO: 3578 - DNA, 103 bp, Artificial Sequence
  Synthetic Polynucleotide
taatacgactcactataggggttgtagtacccctccggtttctcatgggtaacagaggagaacccatatgaaaccggagaacctggcggcagcgcaaaagatg

SEQ ID NO: 3579 - DNA, 103 bp, Artificial Sequence
  Synthetic Polynucleotide
taatacgactcactatagggtgccagttgtagtacccctccggtttctcaaacagaggagatgagaaatgggaggggtaaacctggcggcagcgcaaaagatg

SEQ ID NO: 3580 - DNA, 103 bp, Artificial Sequence
  Synthetic Polynucleotide
taatacgactcactatagggcgtggtgccagttgtagtacccctccggttaacagaggagaaaccggatgggtactacaaacctggcggcagcgcaaaagatg

SEQ ID NO: 3581 - DNA, 103 bp, Artificial Sequence
  Synthetic Polynucleotide
taatacgactcactatagggtgctccgtggtgccagttgtagtacccctcaacagaggagagaggggatgtacaactggaacctggcggcagcgcaaaagatg

SEQ ID NO: 3582 - DNA, 103 bp, Artificial Sequence
  Synthetic Polynucleotide
taatacgactcactatagggtgtactgctccgtggtgccagttgtagtacaacagaggagagtactaatgctggcaccaaacctggcggcagcgcaaaagatg

SEQ ID NO: 3583 - DNA, 103 bp, Artificial Sequence
  Synthetic Polynucleotide
taatacgactcactatagggagtactgtactgctccgtggtgccagttgtaacagaggagaacaactatgaccacggagaacctggcggcagcgcaaaagatg

SEQ ID NO: 3584 - DNA, 103 bp, Artificial Sequence
  Synthetic Polynucleotide
taatacgactcactatagggtcctgagtactgtactgctccgtggtgccaaacagaggagatggcacatgggagcagtaaacctggcggcagcgcaaaagatg

SEQ ID NO: 3585 - DNA, 103 bp, Artificial Sequence
  Synthetic Polynucleotide
taatacgactcactatagggcggcctcctgagtactgtactgctccgtggaacagaggagaccacggatgagtacagtaaacctggcggcagcgcaaaagatg

SEQ ID NO: 3586 - DNA, 103 bp, Artificial Sequence
  Synthetic Polynucleotide
taatacgactcactatagggtgaaccggcctcctgagtactgtactgctcaacagaggagagagcagatgagtactcagaacctggcggcagcgcaaaagatg

SEQ ID NO: 3587 - DNA, 103 bp, Artificial Sequence
  Synthetic Polynucleotide
taatacgactcactatagggagtagcttacggctttccgggtagagcgttaacagaggagaaacgctatgcccggaaagaacctggcggcagcgcaaaagatg

SEQ ID NO: 3588 - DNA, 103 bp, Artificial Sequence
  Synthetic Polynucleotide
taatacgactcactataggggatggtgaaccggcctcctgagtactgtacaacagaggagagtacagatgtcaggaggcaacctggcggcagcgcaaaagatg

SEQ ID NO: 3589 - DNA, 103 bp, Artificial Sequence
  Synthetic Polynucleotide
taatacgactcactataggggtagggatggtgaaccggcctcctgagtacaacagaggagagtactcatgaggccggttaacctggcggcagcgcaaaagatg

SEQ ID NO: 3590 - DNA, 103 bp, Artificial Sequence
  Synthetic Polynucleotide
taatacgactcactatagggcacctgtagggatggtgaaccggcctcctgaacagaggagacaggagatgggttcaccaaacctggcggcagcgcaaaagatg

SEQ ID NO: 3591 - DNA, 103 bp, Artificial Sequence
  Synthetic Polynucleotide
taatacgactcactataggggcccgcacctgtagggatggtgaaccggccaacagaggagaggccggatgaccatccctaacctggcggcagcgcaaaagatg

SEQ ID NO: 3592 - DNA, 103 bp, Artificial Sequence
  Synthetic Polynucleotide
taatacgactcactatagggggtttgcccgcacctgtagggatggtgaacaacagaggagagttcacatgccctacaggaacctggcggcagcgcaaaagatg

SEQ ID NO: 3593 - DNA, 103 bp, Artificial Sequence
  Synthetic Polynucleotide
taatacgactcactatagggcccctggtttgcccgcacctgtagggatggaacagaggagaccatccatgcaggtgcggaacctggcggcagcgcaaaagatg

SEQ ID NO: 3594 - DNA, 103 bp, Artificial Sequence
  Synthetic Polynucleotide
taatacgactcactataggggctgtcccctggtttgcccgcacctgtaggaacagaggagacctacaatggcgggcaaaaacctggcggcagcgcaaaagatg

SEQ ID NO: 3595 - DNA, 103 bp, Artificial Sequence
  Synthetic Polynucleotide
taatacgactcactatagggctaccgctgtcccctggtttgcccgcacctaacagaggagaaggtgcatgcaaaccaggaacctggcggcagcgcaaaagatg

SEQ ID NO: 3596 - DNA, 103 bp, Artificial Sequence
  Synthetic Polynucleotide
taatacgactcactatagggtcggtctaccgctgtcccctggtttgcccgaacagaggagacgggcaatgcaggggacaaacctggcggcagcgcaaaagatg

SEQ ID NO: 3597 - DNA, 103 bp, Artificial Sequence
  Synthetic Polynucleotide
taatacgactcactataggggaagatcggtctaccgctgtcccctggtttaacagaggagaaaaccaatggacagcggtaacctggcggcagcgcaaaagatg

SEQ ID NO: 3598 - DNA, 103 bp, Artificial Sequence
  Synthetic Polynucleotide
taatacgactcactatagggtcttaagtagcttacggctttccgggtagaaacagaggagatctaccatgaaagccgtaaacctggcggcagcgcaaaagatg

SEQ ID NO: 3599 - DNA, 103 bp, Artificial Sequence
  Synthetic Polynucleotide
taatacgactcactatagggttgtcgaagatcggtctaccgctgtcccctaacagaggagaaggggaatgcggtagaccaacctggcggcagcgcaaaagatg

SEQ ID NO: 3600 - DNA, 103 bp, Artificial Sequence
  Synthetic Polynucleotide
taatacgactcactatagggccttgttgtcgaagatcggtctaccgctgtaacagaggagaacagcgatggaccgatctaacctggcggcagcgcaaaagatg

SEQ ID NO: 3601 - DNA, 103 bp, Artificial Sequence
  Synthetic Polynucleotide
taatacgactcactataggggcgtcccttgttgtcgaagatcggtctaccaacagaggagaggtagaatgatcttcgacaacctggcggcagcgcaaaagatg

SEQ ID NO: 3602 - DNA, 103 bp, Artificial Sequence
  Synthetic Polynucleotide
taatacgactcactatagggaccacgcgtcccttgttgtcgaagatcggtaacagaggagaaccgatatgcgacaacaaaacctggcggcagcgcaaaagatg

SEQ ID NO: 3603 - DNA, 103 bp, Artificial Sequence
  Synthetic Polynucleotide
taatacgactcactatagggtggccaccacgcgtcccttgttgtcgaagaaacagaggagatcttcgatgacaagggacaacctggcggcagcgcaaaagatg

SEQ ID NO: 3604 - DNA, 103 bp, Artificial Sequence
  Synthetic Polynucleotide
taatacgactcactataggggactatggccaccacgcgtcccttgttgtcaacagaggagagacaacatgggacgcgtgaacctggcggcagcgcaaaagatg

SEQ ID NO: 3605 - DNA, 103 bp, Artificial Sequence
  Synthetic Polynucleotide
taatacgactcactatagggcctaagactatggccaccacgcgtcccttgaacagaggagacaagggatgcgtggtggcaacctggcggcagcgcaaaagatg

SEQ ID NO: 3606 - DNA, 103 bp, Artificial Sequence
  Synthetic Polynucleotide
taatacgactcactatagggctcctcctaagactatggccaccacgcgtcaacagaggagagacgcgatgtggccatagaacctggcggcagcgcaaaagatg

SEQ ID NO: 3607 - DNA, 103 bp, Artificial Sequence
  Synthetic Polynucleotide
taatacgactcactatagggattagctcctcctaagactatggccaccacaacagaggagagtggtgatgatagtcttaaacctggcggcagcgcaaaagatg

SEQ ID NO: 3608 - DNA, 103 bp, Artificial Sequence
  Synthetic Polynucleotide
taatacgactcactatagggccttcattagctcctcctaagactatggccaacagaggagaggccatatgcttaggaggaacctggcggcagcgcaaaagatg

SEQ ID NO: 3609 - DNA, 103 bp, Artificial Sequence
  Synthetic Polynucleotide
taatacgactcactatagggccagctcttaagtagcttacggctttccggaacagaggagaccggaaatgcgtaagctaaacctggcggcagcgcaaaagatg

SEQ ID NO: 3610 - DNA, 103 bp, Artificial Sequence
  Synthetic Polynucleotide
taatacgactcactataggggggctccttcattagctcctcctaagactaaacagaggagatagtctatggaggagctaaacctggcggcagcgcaaaagatg

SEQ ID NO: 3611 - DNA, 103 bp, Artificial Sequence
  Synthetic Polynucleotide
taatacgactcactatagggtgtacgggctccttcattagctcctcctaaaacagaggagattaggaatggctaatgaaaacctggcggcagcgcaaaagatg

SEQ ID NO: 3612 - DNA, 103 bp, Artificial Sequence
  Synthetic Polynucleotide
taatacgactcactatagggagggctgtacgggctccttcattagctcctaacagaggagaaggagcatgtgaaggagcaacctggcggcagcgcaaaagatg

SEQ ID NO: 3613 - DNA, 103 bp, Artificial Sequence
  Synthetic Polynucleotide
taatacgactcactatagggctgagagggctgtacgggctccttcattagaacagaggagactaatgatggagcccgtaaacctggcggcagcgcaaaagatg

SEQ ID NO: 3614 - DNA, 103 bp, Artificial Sequence
  Synthetic Polynucleotide
taatacgactcactatagggcaccactgagagggctgtacgggctccttcaacagaggagagaaggaatgcgtacagccaacctggcggcagcgcaaaagatg

SEQ ID NO: 3615 - DNA, 103 bp, Artificial Sequence
  Synthetic Polynucleotide
taatacgactcactatagggcaggtcaccactgagagggctgtacgggctaacagaggagaagcccgatgagccctctcaacctggcggcagcgcaaaagatg

SEQ ID NO: 3616 - DNA, 103 bp, Artificial Sequence
  Synthetic Polynucleotide
taatacgactcactatagggtattccaggtcaccactgagagggctgtacaacagaggagagtacagatgtctcagtggaacctggcggcagcgcaaaagatg

SEQ ID NO: 3617 - DNA, 103 bp, Artificial Sequence
  Synthetic Polynucleotide
taatacgactcactataggggtctttattccaggtcaccactgagagggcaacagaggagagccctcatggtggtgaccaacctggcggcagcgcaaaagatg

SEQ ID NO: 3618 - DNA, 103 bp, Artificial Sequence
  Synthetic Polynucleotide
taatacgactcactatagggacaatgtctttattccaggtcaccactgagaacagaggagactcagtatggacctggaaaacctggcggcagcgcaaaagatg

SEQ ID NO: 3619 - DNA, 103 bp, Artificial Sequence
  Synthetic Polynucleotide
taatacgactcactatagggtagtgacaatgtctttattccaggtcaccaaacagaggagatggtgaatgggaataaagaacctggcggcagcgcaaaagatg

SEQ ID NO: 3620 - DNA, 103 bp, Artificial Sequence
  Synthetic Polynucleotide
taatacgactcactatagggaggtgccagctcttaagtagcttacggcttaacagaggagaaagccgatggctacttaaaacctggcggcagcgcaaaagatg

SEQ ID NO: 3621 - DNA, 103 bp, Artificial Sequence
  Synthetic Polynucleotide
taatacgactcactataggggattttagtgacaatgtctttattccaggtaacagaggagaacctggatgaaagacattaacctggcggcagcgcaaaagatg

SEQ ID NO: 3622 - DNA, 103 bp, Artificial Sequence
  Synthetic Polynucleotide
taatacgactcactatagggggggtgattttagtgacaatgtctttattcaacagaggagagaataaatgcattgtcacaacctggcggcagcgcaaaagatg

SEQ ID NO: 3623 - DNA, 103 bp, Artificial Sequence
  Synthetic Polynucleotide
taatacgactcactatagggcctcaggggtgattttagtgacaatgtcttaacagaggagaaagacaatgtcactaaaaaacctggcggcagcgcaaaagatg

SEQ ID NO: 3624 - DNA, 103 bp, Artificial Sequence
  Synthetic Polynucleotide
taatacgactcactatagggggctccctcaggggtgattttagtgacaataacagaggagaattgtcatgaaaatcaccaacctggcggcagcgcaaaagatg

SEQ ID NO: 3625 - DNA, 103 bp, Artificial Sequence
  Synthetic Polynucleotide
taatacgactcactatagggtcttcggctccctcaggggtgattttagtgaacagaggagacactaaatgcacccctgaaacctggcggcagcgcaaaagatg

SEQ ID NO: 3626 - DNA, 103 bp, Artificial Sequence
  Synthetic Polynucleotide
taatacgactcactatagggtccactcttcggctccctcaggggtgatttaacagaggagaaaatcaatgctgagggagaacctggcggcagcgcaaaagatg

SEQ ID NO: 3627 - DNA, 103 bp, Artificial Sequence
  Synthetic Polynucleotide
taatacgactcactatagggaagactccactcttcggctccctcaggggtaacagaggagaacccctatgggagccgaaaacctggcggcagcgcaaaagatg

SEQ ID NO: 3628 - DNA, 103 bp, Artificial Sequence
  Synthetic Polynucleotide
taatacgactcactatagggatggcaagactccactcttcggctccctcaaacagaggagatgagggatgcgaagagtgaacctggcggcagcgcaaaagatg

SEQ ID NO: 3629 - DNA, 103 bp, Artificial Sequence
  Synthetic Polynucleotide
taatacgactcactatagggctgggatggcaagactccactcttcggctcaacagaggagagagccgatgagtggagtcaacctggcggcagcgcaaaagatg

SEQ ID NO: 3630 - DNA, 103 bp, Artificial Sequence
  Synthetic Polynucleotide
taatacgactcactatagggcataactgggatggcaagactccactcttcaacagaggagagaagagatgagtcttgccaacctggcggcagcgcaaaagatg

SEQ ID NO: 3631 - DNA, 103 bp, Artificial Sequence
  Synthetic Polynucleotide
taatacgactcactatagggatggtaggtgccagctcttaagtagcttacaacagaggagagtaagcatgttaagagctaacctggcggcagcgcaaaagatg

SEQ ID NO: 3632 - DNA, 103 bp, Artificial Sequence
  Synthetic Polynucleotide
taatacgactcactatagggaggcacataactgggatggcaagactccacaacagaggagagtggagatgtgccatcccaacctggcggcagcgcaaaagatg

SEQ ID NO: 3633 - DNA, 103 bp, Artificial Sequence
  Synthetic Polynucleotide
taatacgactcactatagggccaacaggcacataactgggatggcaagacaacagaggagagtcttgatgtcccagttaaacctggcggcagcgcaaaagatg

SEQ ID NO: 3634 - DNA, 103 bp, Artificial Sequence
  Synthetic Polynucleotide
taatacgactcactatagggatttgccaacaggcacataactgggatggcaacagaggagagccatcatggttatgtgcaacctggcggcagcgcaaaagatg

SEQ ID NO: 3635 - DNA, 103 bp, Artificial Sequence
  Synthetic Polynucleotide
taatacgactcactataggggtggtatttgccaacaggcacataactgggaacagaggagacccagtatggtgcctgttaacctggcggcagcgcaaaagatg

SEQ ID NO: 3636 - DNA, 103 bp, Artificial Sequence
  Synthetic Polynucleotide
taatacgactcactatagggggaacgtggtatttgccaacaggcacataaaacagaggagattatgtatgtgttggcaaaacctggcggcagcgcaaaagatg

SEQ ID NO: 3637 - DNA, 103 bp, Artificial Sequence
  Synthetic Polynucleotide
taatacgactcactataggggcaggggaacgtggtatttgccaacaggcaaacagaggagatgcctgatggcaaataccaacctggcggcagcgcaaaagatg

SEQ ID NO: 3638 - DNA, 103 bp, Artificial Sequence
  Synthetic Polynucleotide
taatacgactcactatagggtgggagcaggggaacgtggtatttgccaacaacagaggagagttggcatgtaccacgttaacctggcggcagcgcaaaagatg

SEQ ID NO: 3639 - DNA, 103 bp, Artificial Sequence
  Synthetic Polynucleotide
taatacgactcactatagggggggctgggagcaggggaacgtggtatttgaacagaggagacaaataatgcgttcccctaacctggcggcagcgcaaaagatg

SEQ ID NO: 3640 - DNA, 103 bp, Artificial Sequence
  Synthetic Polynucleotide
taatacgactcactataggggcaagggggctgggagcaggggaacgtggtaacagaggagaaccacgatgccctgctccaacctggcggcagcgcaaaagatg

SEQ ID NO: 3641 - DNA, 103 bp, Artificial Sequence
  Synthetic Polynucleotide
taatacgactcactatagggggtatgcaagggggctgggagcaggggaacaacagaggagagttcccatgctcccagccaacctggcggcagcgcaaaagatg

SEQ ID NO: 3642 - DNA, 103 bp, Artificial Sequence
  Synthetic Polynucleotide
taatacgactcactatagggcaccgatggtaggtgccagctcttaagtagaacagaggagactacttatgagctggcacaacctggcggcagcgcaaaagatg

SEQ ID NO: 3643 - DNA, 103 bp, Artificial Sequence
  Synthetic Polynucleotide
taatacgactcactatagggagcagggtatgcaagggggctgggagcaggaacagaggagacctgctatgagcccccttaacctggcggcagcgcaaaagatg

SEQ ID NO: 3644 - DNA, 103 bp, Artificial Sequence
  Synthetic Polynucleotide
taatacgactcactataggggtagcagcagggtatgcaagggggctgggaaacagaggagatcccagatgccttgcataaacctggcggcagcgcaaaagatg

SEQ ID NO: 3645 - DNA, 103 bp, Artificial Sequence
  Synthetic Polynucleotide
taatacgactcactatagggttttcgtagcagcagggtatgcaagggggcaacagaggagagcccccatgcataccctgaacctggcggcagcgcaaaagatg

SEQ ID NO: 3646 - DNA, 103 bp, Artificial Sequence
  Synthetic Polynucleotide
taatacgactcactataggggttccttttcgtagcagcagggtatgcaagaacagaggagacttgcaatgcctgctgctaacctggcggcagcgcaaaagatg

SEQ ID NO: 3647 - DNA, 103 bp, Artificial Sequence
  Synthetic Polynucleotide
taatacgactcactatagggctccggttccttttcgtagcagcagggtataacagaggagaatacccatgtgctacgaaaacctggcggcagcgcaaaagatg

SEQ ID NO: 3648 - DNA, 103 bp, Artificial Sequence
  Synthetic Polynucleotide
taatacgactcactataggggtttcctccggttccttttcgtagcagcagaacagaggagactgctgatgcgaaaaggaaacctggcggcagcgcaaaagatg

SEQ ID NO: 3649 - DNA, 103 bp, Artificial Sequence
  Synthetic Polynucleotide
taatacgactcactataggggtagggtttcctccggttccttttcgtagcaacagaggagagctacgatgaggaaccggaacctggcggcagcgcaaaagatg

SEQ ID NO: 3650 - DNA, 103 bp, Artificial Sequence
  Synthetic Polynucleotide
taatacgactcactatagggcatgcgtagggtttcctccggttccttttcaacagaggagagaaaagatgccggaggaaaacctggcggcagcgcaaaagatg

SEQ ID NO: 3651 - DNA, 103 bp, Artificial Sequence
  Synthetic Polynucleotide
taatacgactcactatagggtcaagcatgcgtagggtttcctccggttccaacagaggagaggaaccatgggaaaccctaacctggcggcagcgcaaaagatg

SEQ ID NO: 3652 - DNA, 103 bp, Artificial Sequence
  Synthetic Polynucleotide
taatacgactcactatagggtgtcctcaagcatgcgtagggtttcctccgaacagaggagacggaggatgccctacgcaaacctggcggcagcgcaaaagatg

SEQ ID NO: 3653 - DNA, 103 bp, Artificial Sequence
  Synthetic Polynucleotide
taatacgactcactatagggtggaacaccgatggtaggtgccagctcttaaacagaggagataagagatggcacctaccaacctggcggcagcgcaaaagatg

SEQ ID NO: 3654 - DNA, 103 bp, Artificial Sequence
  Synthetic Polynucleotide
taatacgactcactataggggacgttgtcctcaagcatgcgtagggtttcaacagaggagagaaaccatgcgcatgcttaacctggcggcagcgcaaaagatg

SEQ ID NO: 3655 - DNA, 103 bp, Artificial Sequence
  Synthetic Polynucleotide
taatacgactcactatagggctcatgacgttgtcctcaagcatgcgtaggaacagaggagacctacgatggcttgaggaaacctggcggcagcgcaaaagatg

SEQ ID NO: 3656 - DNA, 103 bp, Artificial Sequence
  Synthetic Polynucleotide
taatacgactcactatagggcaggtctcatgacgttgtcctcaagcatgcaacagaggagagcatgcatgaggacaacgaacctggcggcagcgcaaaagatg

SEQ ID NO: 3657 - DNA, 103 bp, Artificial Sequence
  Synthetic Polynucleotide
taatacgactcactataggggtacccaggtctcatgacgttgtcctcaagaacagaggagacttgagatgaacgtcatgaacctggcggcagcgcaaaagatg

SEQ ID NO: 3658 - DNA, 103 bp, Artificial Sequence
  Synthetic Polynucleotide
taatacgactcactatagggtgatagtacccaggtctcatgacgttgtccaacagaggagaggacaaatgcatgagaccaacctggcggcagcgcaaaagatg

SEQ ID NO: 3659 - DNA, 103 bp, Artificial Sequence
  Synthetic Polynucleotide
taatacgactcactataggggcagctgatagtacccaggtctcatgacgtaacagaggagaacgtcaatggacctgggtaacctggcggcagcgcaaaagatg

SEQ ID NO: 3660 - DNA, 103 bp, Artificial Sequence
  Synthetic Polynucleotide
taatacgactcactatagggttgtagcagctgatagtacccaggtctcataacagaggagaatgagaatggggtactataacctggcggcagcgcaaaagatg

SEQ ID NO: 3661 - DNA, 103 bp, Artificial Sequence
  Synthetic Polynucleotide
taatacgactcactataggggatgcttgtagcagctgatagtacccaggtaacagaggagaacctggatgctatcagctaacctggcggcagcgcaaaagatg

SEQ ID NO: 3662 - DNA, 103 bp, Artificial Sequence
  Synthetic Polynucleotide
taatacgactcactatagggttaatgatgcttgtagcagctgatagtaccaacagaggagaggtactatgagctgctacaacctggcggcagcgcaaaagatg

SEQ ID NO: 3663 - DNA, 103 bp, Artificial Sequence
  Synthetic Polynucleotide
taatacgactcactatagggacatgttaatgatgcttgtagcagctgataaacagaggagatatcagatgctacaagcaaacctggcggcagcgcaaaagatg

SEQ ID NO: 3664 - DNA, 103 bp, Artificial Sequence
  Synthetic Polynucleotide
taatacgactcactatagggtgtcagcgtctatgtccacgtacacaggataacagaggagaatcctgatgacgtggacaaacctggcggcagcgcaaaagatg

SEQ ID NO: 3665 - DNA, 103 bp, Artificial Sequence
  Synthetic Polynucleotide
taatacgactcactatagggttaaatggaacaccgatggtaggtgccagcaacagaggagagctggcatgtaccatcggaacctggcggcagcgcaaaagatg

SEQ ID NO: 3666 - DNA, 103 bp, Artificial Sequence
  Synthetic Polynucleotide
taatacgactcactatagggggagaacatgttaatgatgcttgtagcagcaacagaggagagctgctatgagcatcattaacctggcggcagcgcaaaagatg

SEQ ID NO: 3667 - DNA, 103 bp, Artificial Sequence
  Synthetic Polynucleotide
taatacgactcactatagggggtggggagaacatgttaatgatgcttgtaaacagaggagatacaagatgcattaacataacctggcggcagcgcaaaagatg

SEQ ID NO: 3668 - DNA, 103 bp, Artificial Sequence
  Synthetic Polynucleotide
taatacgactcactatagggctggcggtggggagaacatgttaatgatgcaacagaggagagcatcaatgacatgttctaacctggcggcagcgcaaaagatg

SEQ ID NO: 3669 - DNA, 103 bp, Artificial Sequence
  Synthetic Polynucleotide
taatacgactcactatagggcgtcgctggcggtggggagaacatgttaataacagaggagaattaacatgttctccccaaacctggcggcagcgcaaaagatg

SEQ ID NO: 3670 - DNA, 103 bp, Artificial Sequence
  Synthetic Polynucleotide
taatacgactcactatagggtgctgcgtcgctggcggtggggagaacatgaacagaggagacatgttatgcccaccgccaacctggcggcagcgcaaaagatg

SEQ ID NO: 3671 - DNA, 103 bp, Artificial Sequence
  Synthetic Polynucleotide
taatacgactcactatagggcttggtgctgcgtcgctggcggtggggagaaacagaggagatctcccatgcgccagcgaaacctggcggcagcgcaaaagatg

SEQ ID NO: 3672 - DNA, 103 bp, Artificial Sequence
  Synthetic Polynucleotide
taatacgactcactatagggttgtccttggtgctgcgtcgctggcggtggaacagaggagaccaccgatggcgacgcagaacctggcggcagcgcaaaagatg

SEQ ID NO: 3673 - DNA, 103 bp, Artificial Sequence
  Synthetic Polynucleotide
taatacgactcactatagggtgaagttgtccttggtgctgcgtcgctggcaacagaggagagccagcatggcagcaccaaacctggcggcagcgcaaaagatg

SEQ ID NO: 3674 - DNA, 103 bp, Artificial Sequence
  Synthetic Polynucleotide
taatacgactcactataggggacattgaagttgtccttggtgctgcgtcgaacagaggagacgacgcatgaccaaggacaacctggcggcagcgcaaaagatg

SEQ ID NO: 3675 - DNA, 103 bp, Artificial Sequence
  Synthetic Polynucleotide
taatacgactcactatagggttatagacattgaagttgtccttggtgctgaacagaggagacagcacatgggacaacttaacctggcggcagcgcaaaagatg

SEQ ID NO: 3676 - DNA, 103 bp, Artificial Sequence
  Synthetic Polynucleotide
taatacgactcactataggggccctttaaatggaacaccgatggtaggtgaacagaggagacacctaatgtcggtgttcaacctggcggcagcgcaaaagatg

SEQ ID NO: 3677 - DNA, 103 bp, Artificial Sequence
  Synthetic Polynucleotide
taatacgactcactatagggtggctttatagacattgaagttgtccttggaacagaggagaccaaggatgacttcaatgaacctggcggcagcgcaaaagatg

SEQ ID NO: 3678 - DNA, 103 bp, Artificial Sequence
  Synthetic Polynucleotide
taatacgactcactatagggtcttgtggctttatagacattgaagttgtcaacagaggagagacaacatgaatgtctataacctggcggcagcgcaaaagatg

SEQ ID NO: 3679 - DNA, 103 bp, Artificial Sequence
  Synthetic Polynucleotide
taatacgactcactatagggtatggtcttgtggctttatagacattgaagaacagaggagacttcaaatgctataaagcaacctggcggcagcgcaaaagatg

SEQ ID NO: 3680 - DNA, 103 bp, Artificial Sequence
  Synthetic Polynucleotide
taatacgactcactatagggctaggtatggtcttgtggctttatagacataacagaggagaatgtctatgaagccacaaaacctggcggcagcgcaaaagatg

SEQ ID NO: 3681 - DNA, 103 bp, Artificial Sequence
  Synthetic Polynucleotide
taatacgactcactataggggtgagctaggtatggtcttgtggctttataaacagaggagatataaaatgacaagaccaaacctggcggcagcgcaaaagatg

SEQ ID NO: 3682 - DNA, 103 bp, Artificial Sequence
  Synthetic Polynucleotide
taatacgactcactatagggggacagtgagctaggtatggtcttgtggctaacagaggagaagccacatgaccatacctaacctggcggcagcgcaaaagatg

SEQ ID NO: 3683 - DNA, 103 bp, Artificial Sequence
  Synthetic Polynucleotide
taatacgactcactatagggagtcgggacagtgagctaggtatggtcttgaacagaggagacaagacatgacctagctcaacctggcggcagcgcaaaagatg

SEQ ID NO: 3684 - DNA, 103 bp, Artificial Sequence
  Synthetic Polynucleotide
taatacgactcactatagggtccacagtcgggacagtgagctaggtatggaacagaggagaccatacatggctcactgtaacctggcggcagcgcaaaagatg

SEQ ID NO: 3685 - DNA, 103 bp, Artificial Sequence
  Synthetic Polynucleotide
taatacgactcactatagggccttctccacagtcgggacagtgagctaggaacagaggagacctagcatgctgtcccgaaacctggcggcagcgcaaaagatg

SEQ ID NO: 3686 - DNA, 103 bp, Artificial Sequence
  Synthetic Polynucleotide
taatacgactcactatagggagtgcccttctccacagtcgggacagtgagaacagaggagactcactatgccgactgtgaacctggcggcagcgcaaaagatg

SEQ ID NO: 3687 - DNA, 103 bp, Artificial Sequence
  Synthetic Polynucleotide
taatacgactcactatagggagcttgccctttaaatggaacaccgatggtaacagaggagaaccatcatggttccatttaacctggcggcagcgcaaaagatg

SEQ ID NO: 3688 - DNA, 103 bp, Artificial Sequence
  Synthetic Polynucleotide
taatacgactcactataggggcacgagtgcccttctccacagtcgggacaaacagaggagatgtcccatgtgtggagaaaacctggcggcagcgcaaaagatg

SEQ ID NO: 3689 - DNA, 103 bp, Artificial Sequence
  Synthetic Polynucleotide
taatacgactcactatagggctatggcacgagtgcccttctccacagtcgaacagaggagacgactgatgagaagggcaaacctggcggcagcgcaaaagatg

SEQ ID NO: 3690 - DNA, 103 bp, Artificial Sequence
  Synthetic Polynucleotide
taatacgactcactatagggcgggactatggcacgagtgcccttctccacaacagaggagagtggagatgggcactcgtaacctggcggcagcgcaaaagatg

SEQ ID NO: 3691 - DNA, 103 bp, Artificial Sequence
  Synthetic Polynucleotide
taatacgactcactatagggtgctacgggactatggcacgagtgcccttcaacagaggagagaagggatgtcgtgccataacctggcggcagcgcaaaagatg

SEQ ID NO: 3692 - DNA, 103 bp, Artificial Sequence
  Synthetic Polynucleotide
taatacgactcactatagggtctagtgctacgggactatggcacgagtgcaacagaggagagcactcatgccatagtccaacctggcggcagcgcaaaagatg

SEQ ID NO: 3693 - DNA, 103 bp, Artificial Sequence
  Synthetic Polynucleotide
taatacgactcactatagggtgcgttctagtgctacgggactatggcacgaacagaggagacgtgccatggtcccgtagaacctggcggcagcgcaaaagatg

SEQ ID NO: 3694 - DNA, 103 bp, Artificial Sequence
  Synthetic Polynucleotide
taatacgactcactatagggtctgatgcgttctagtgctacgggactatgaacagaggagacatagtatggtagcactaaacctggcggcagcgcaaaagatg

SEQ ID NO: 3695 - DNA, 103 bp, Artificial Sequence
  Synthetic Polynucleotide
taatacgactcactatagggtcatttctgatgcgttctagtgctacgggaaacagaggagatcccgtatgactagaacgaacctggcggcagcgcaaaagatg

SEQ ID NO: 3696 - DNA, 103 bp, Artificial Sequence
  Synthetic Polynucleotide
taatacgactcactatagggtcgcttcatttctgatgcgttctagtgctaaacagaggagatagcacatgaacgcatcaaacctggcggcagcgcaaaagatg

SEQ ID NO: 3697 - DNA, 103 bp, Artificial Sequence
  Synthetic Polynucleotide
taatacgactcactataggggtctgtcgcttcatttctgatgcgttctagaacagaggagactagaaatgatcagaaataacctggcggcagcgcaaaagatg

SEQ ID NO: 3698 - DNA, 103 bp, Artificial Sequence
  Synthetic Polynucleotide
taatacgactcactatagggagctgagcttgccctttaaatggaacaccgaacagaggagacggtgtatgatttaaaggaacctggcggcagcgcaaaagatg

SEQ ID NO: 3699 - DNA, 103 bp, Artificial Sequence
  Synthetic Polynucleotide
taatacgactcactataggggtcccgtctgtcgcttcatttctgatgcgtaacagaggagaacgcatatgaaatgaagcaacctggcggcagcgcaaaagatg

SEQ ID NO: 3700 - DNA, 103 bp, Artificial Sequence
  Synthetic Polynucleotide
taatacgactcactatagggtcagcgtcccgtctgtcgcttcatttctgaaacagaggagatcagaaatgaagcgacagaacctggcggcagcgcaaaagatg

SEQ ID NO: 3701 - DNA, 103 bp, Artificial Sequence
  Synthetic Polynucleotide
taatacgactcactataggggattttcagcgtcccgtctgtcgcttcattaacagaggagaaatgaaatgacagacgggaacctggcggcagcgcaaaagatg

SEQ ID NO: 3702 - DNA, 103 bp, Artificial Sequence
  Synthetic Polynucleotide
taatacgactcactatagggacctggattttcagcgtcccgtctgtcgctaacagaggagaagcgacatgcgggacgctaacctggcggcagcgcaaaagatg

SEQ ID NO: 3703 - DNA, 103 bp, Artificial Sequence
  Synthetic Polynucleotide
taatacgactcactatagggaggagacctggattttcagcgtcccgtctgaacagaggagacagacgatgcgctgaaaaaacctggcggcagcgcaaaagatg

SEQ ID NO: 3704 - DNA, 103 bp, Artificial Sequence
  Synthetic Polynucleotide
taatacgactcactatagggttgcaaggagacctggattttcagcgtcccaacagaggagagggacgatgaaaatccagaacctggcggcagcgcaaaagatg

SEQ ID NO: 3705 - DNA, 103 bp, Artificial Sequence
  Synthetic Polynucleotide
taatacgactcactatagggccaatttgcaaggagacctggattttcagcaacagaggagagctgaaatgccaggtctcaacctggcggcagcgcaaaagatg

SEQ ID NO: 3706 - DNA, 103 bp, Artificial Sequence
  Synthetic Polynucleotide
taatacgactcactatagggctattccaatttgcaaggagacctggatttaacagaggagaaaatccatgtctccttgcaacctggcggcagcgcaaaagatg

SEQ ID NO: 3707 - DNA, 103 bp, Artificial Sequence
  Synthetic Polynucleotide
taatacgactcactatagggcgtccctattccaatttgcaaggagacctgaacagaggagacaggtcatgttgcaaattaacctggcggcagcgcaaaagatg

SEQ ID NO: 3708 - DNA, 103 bp, Artificial Sequence
  Synthetic Polynucleotide
taatacgactcactatagggtcatccgtccctattccaatttgcaaggagaacagaggagactccttatgaattggaataacctggcggcagcgcaaaagatg

SEQ ID NO: 3709 - DNA, 103 bp, Artificial Sequence
  Synthetic Polynucleotide
taatacgactcactatagggtgtgaagctgagcttgccctttaaatggaaaacagaggagattccatatgaagggcaagaacctggcggcagcgcaaaagatg

SEQ ID NO: 3710 - DNA, 103 bp, Artificial Sequence
  Synthetic Polynucleotide
taatacgactcactatagggggctatcatccgtccctattccaatttgcaaacagaggagatgcaaaatggaatagggaaacctggcggcagcgcaaaagatg

SEQ ID NO: 3711 - DNA, 103 bp, Artificial Sequence
  Synthetic Polynucleotide
taatacgactcactatagggatcatggctatcatccgtccctattccaataacagaggagaattggaatggggacggataacctggcggcagcgcaaaagatg

SEQ ID NO: 3712 - DNA, 103 bp, Artificial Sequence
  Synthetic Polynucleotide
taatacgactcactataggggtccaatcatggctatcatccgtccctattaacagaggagaaataggatgggatgatagaacctggcggcagcgcaaaagatg

SEQ ID NO: 3713 - DNA, 103 bp, Artificial Sequence
  Synthetic Polynucleotide
taatacgactcactataggggcttggtccaatcatggctatcatccgtccaacagaggagaggacggatgatagccatgaacctggcggcagcgcaaaagatg

SEQ ID NO: 3714 - DNA, 103 bp, Artificial Sequence
  Synthetic Polynucleotide
taatacgactcactatagggacgcagcttggtccaatcatggctatcatcaacagaggagagatgatatgcatgattggaacctggcggcagcgcaaaagatg

SEQ ID NO: 3715 - DNA, 103 bp, Artificial Sequence
  Synthetic Polynucleotide
taatacgactcactatagggatgtaacgcagcttggtccaatcatggctaaacagaggagatagccaatgttggaccaaaacctggcggcagcgcaaaagatg

SEQ ID NO: 3716 - DNA, 103 bp, Artificial Sequence
  Synthetic Polynucleotide
taatacgactcactatagggtgtccatgtaacgcagcttggtccaatcataacagaggagaatgattatgccaagctgcaacctggcggcagcgcaaaagatg

SEQ ID NO: 3717 - DNA, 103 bp, Artificial Sequence
  Synthetic Polynucleotide
taatacgactcactataggggtgattgtccatgtaacgcagcttggtccaaacagaggagatggaccatgctgcgttacaacctggcggcagcgcaaaagatg

SEQ ID NO: 3718 - DNA, 103 bp, Artificial Sequence
  Synthetic Polynucleotide
taatacgactcactatagggggtatgtgattgtccatgtaacgcagcttgaacagaggagacaagctatgttacatggaaacctggcggcagcgcaaaagatg

SEQ ID NO: 3719 - DNA, 103 bp, Artificial Sequence
  Synthetic Polynucleotide
taatacgactcactatagggctgctggtatgtgattgtccatgtaacgcaaacagaggagatgcgttatgtggacaatcaacctggcggcagcgcaaaagatg

SEQ ID NO: 3720 - DNA, 103 bp, Artificial Sequence
  Synthetic Polynucleotide
taatacgactcactatagggcggcatgtgaagctgagcttgccctttaaaaacagaggagatttaaaatgcaagctcagaacctggcggcagcgcaaaagatg

SEQ ID NO: 3721 - DNA, 103 bp, Artificial Sequence
  Synthetic Polynucleotide
taatacgactcactatagggtgcgtctgctggtatgtgattgtccatgtaaacagaggagatacatgatgaatcacataaacctggcggcagcgcaaaagatg

SEQ ID NO: 3722 - DNA, 103 bp, Artificial Sequence
  Synthetic Polynucleotide
taatacgactcactatagggctccctgcgtctgctggtatgtgattgtccaacagaggagaggacaaatgcataccagcaacctggcggcagcgcaaaagatg

SEQ ID NO: 3723 - DNA, 103 bp, Artificial Sequence
  Synthetic Polynucleotide
taatacgactcactatagggcggccctccctgcgtctgctggtatgtgataacagaggagaatcacaatgcagcagacgaacctggcggcagcgcaaaagatg

SEQ ID NO: 3724 - DNA, 103 bp, Artificial Sequence
  Synthetic Polynucleotide
taatacgactcactatagggtagcccggccctccctgcgtctgctggtataacagaggagaataccaatggacgcagggaacctggcggcagcgcaaaagatg

SEQ ID NO: 3725 - DNA, 103 bp, Artificial Sequence
  Synthetic Polynucleotide
taatacgactcactatagggacaaatagcccggccctccctgcgtctgctaacagaggagaagcagaatgagggagggcaacctggcggcagcgcaaaagatg

SEQ ID NO: 3726 - DNA, 103 bp, Artificial Sequence
  Synthetic Polynucleotide
taatacgactcactatagggttcttacaaatagcccggccctccctgcgtaacagaggagaacgcagatggggccgggcaacctggcggcagcgcaaaagatg

SEQ ID NO: 3727 - DNA, 103 bp, Artificial Sequence
  Synthetic Polynucleotide
taatacgactcactatagggtgatgttcttacaaatagcccggccctcccaacagaggagagggaggatggggctatttaacctggcggcagcgcaaaagatg

SEQ ID NO: 3728 - DNA, 103 bp, Artificial Sequence
  Synthetic Polynucleotide
taatacgactcactatagggggtgctgatgttcttacaaatagcccggccaacagaggagaggccggatgatttgtaagaacctggcggcagcgcaaaagatg

SEQ ID NO: 3729 - DNA, 103 bp, Artificial Sequence
  Synthetic Polynucleotide
taatacgactcactatagggtgcatggtgctgatgttcttacaaatagccaacagaggagaggctatatgtaagaacataacctggcggcagcgcaaaagatg

SEQ ID NO: 3730 - DNA, 103 bp, Artificial Sequence
  Synthetic Polynucleotide
taatacgactcactatagggaatcgtgcatggtgctgatgttcttacaaaaacagaggagatttgtaatgacatcagcaaacctggcggcagcgcaaaagatg

SEQ ID NO: 3731 - DNA, 103 bp, Artificial Sequence
  Synthetic Polynucleotide
taatacgactcactatagggcacagcggcatgtgaagctgagcttgccctaacagaggagaagggcaatgtcagcttcaaacctggcggcagcgcaaaagatg

SEQ ID NO: 3732 - DNA, 103 bp, Artificial Sequence
  Synthetic Polynucleotide
taatacgactcactatagggccagtaatcgtgcatggtgctgatgttcttaacagaggagaaagaacatgagcaccatgaacctggcggcagcgcaaaagatg

SEQ ID NO: 3733 - DNA, 103 bp, Artificial Sequence
  Synthetic Polynucleotide
taatacgactcactatagggttgttccagtaatcgtgcatggtgctgatgaacagaggagacatcagatgcatgcacgaaacctggcggcagcgcaaaagatg

SEQ ID NO: 3734 - DNA, 103 bp, Artificial Sequence
  Synthetic Polynucleotide
taatacgactcactatagggtcccattgttccagtaatcgtgcatggtgcaacagaggagagcaccaatgacgattactaacctggcggcagcgcaaaagatg

SEQ ID NO: 3735 - DNA, 103 bp, Artificial Sequence
  Synthetic Polynucleotide
taatacgactcactatagggaagtgtcccattgttccagtaatcgtgcataacagaggagaatgcacatgtactggaacaacctggcggcagcgcaaaagatg

SEQ ID NO: 3736 - DNA, 103 bp, Artificial Sequence
  Synthetic Polynucleotide
taatacgactcactatagggggatgaagtgtcccattgttccagtaatcgaacagaggagacgattaatggaacaatggaacctggcggcagcgcaaaagatg

SEQ ID NO: 3737 - DNA, 103 bp, Artificial Sequence
  Synthetic Polynucleotide
taatacgactcactatagggggccaggatgaagtgtcccattgttccagtaacagaggagaactggaatgatgggacacaacctggcggcagcgcaaaagatg

SEQ ID NO: 3738 - DNA, 103 bp, Artificial Sequence
  Synthetic Polynucleotide
taatacgactcactatagggcatcgggccaggatgaagtgtcccattgttaacagaggagaaacaatatgacacttcataacctggcggcagcgcaaaagatg

SEQ ID NO: 3739 - DNA, 103 bp, Artificial Sequence
  Synthetic Polynucleotide
taatacgactcactatagggtcggacatcgggccaggatgaagtgtcccaaacagaggagatgggacatgtcatcctggaacctggcggcagcgcaaaagatg

SEQ ID NO: 3740 - DNA, 103 bp, Artificial Sequence
  Synthetic Polynucleotide
taatacgactcactatagggtcctttcggacatcgggccaggatgaagtgaacagaggagacacttcatgctggcccgaaacctggcggcagcgcaaaagatg

SEQ ID NO: 3741 - DNA, 103 bp, Artificial Sequence
  Synthetic Polynucleotide
taatacgactcactataggggtttctcctttcggacatcgggccaggatgaacagaggagacatcctatgccgatgtccaacctggcggcagcgcaaaagatg

SEQ ID NO: 3742 - DNA, 103 bp, Artificial Sequence
  Synthetic Polynucleotide
taatacgactcactatagggtgtatcacagcggcatgtgaagctgagcttaacagaggagaaagctcatgttcacatgcaacctggcggcagcgcaaaagatg

SEQ ID NO: 3743 - DNA, 103 bp, Artificial Sequence
  Synthetic Polynucleotide
taatacgactcactatagggtcagagtttctcctttcggacatcgggccaaacagaggagatggcccatggtccgaaagaacctggcggcagcgcaaaagatg

SEQ ID NO: 3744 - DNA, 103 bp, Artificial Sequence
  Synthetic Polynucleotide
taatacgactcactatagggcaccgtcagagtttctcctttcggacatcgaacagaggagacgatgtatgaaaggagaaaacctggcggcagcgcaaaagatg

SEQ ID NO: 3745 - DNA, 103 bp, Artificial Sequence
  Synthetic Polynucleotide
taatacgactcactatagggaatcccaccgtcagagtttctcctttcggaaacagaggagatccgaaatgagaaactctaacctggcggcagcgcaaaagatg

SEQ ID NO: 3746 - DNA, 103 bp, Artificial Sequence
  Synthetic Polynucleotide
taatacgactcactatagggcagtgaatcccaccgtcagagtttctccttaacagaggagaaaggagatgctctgacggaacctggcggcagcgcaaaagatg

SEQ ID NO: 3747 - DNA, 103 bp, Artificial Sequence
  Synthetic Polynucleotide
taatacgactcactatagggactgtcagtgaatcccaccgtcagagtttcaacagaggagagaaactatgacggtgggaaacctggcggcagcgcaaaagatg

SEQ ID NO: 3748 - DNA, 103 bp, Artificial Sequence
  Synthetic Polynucleotide
taatacgactcactatagggttcctactgtcagtgaatcccaccgtcagaaacagaggagatctgacatggggattcacaacctggcggcagcgcaaaagatg

SEQ ID NO: 3749 - DNA, 103 bp, Artificial Sequence
  Synthetic Polynucleotide
taatacgactcactatagggtaatcttcctactgtcagtgaatcccaccgaacagaggagacggtggatgtcactgacaaacctggcggcagcgcaaaagatg

SEQ ID NO: 3750 - DNA, 103 bp, Artificial Sequence
  Synthetic Polynucleotide
taatacgactcactataggggtgactaatcttcctactgtcagtgaatccaacagaggagaggattcatggacagtaggaacctggcggcagcgcaaaagatg

SEQ ID NO: 3751 - DNA, 103 bp, Artificial Sequence
  Synthetic Polynucleotide
taatacgactcactatagggcatgagtgactaatcttcctactgtcagtgaacagaggagacactgaatgtaggaagataacctggcggcagcgcaaaagatg

SEQ ID NO: 3752 - DNA, 103 bp, Artificial Sequence
  Synthetic Polynucleotide
taatacgactcactataggggcgtacatgagtgactaatcttcctactgtaacagaggagaacagtaatgagattagtcaacctggcggcagcgcaaaagatg

SEQ ID NO: 3753 - DNA, 103 bp, Artificial Sequence
  Synthetic Polynucleotide
taatacgactcactatagggaccactgtatcacagcggcatgtgaagctgaacagaggagacagcttatgatgccgctgaacctggcggcagcgcaaaagatg

SEQ ID NO: 3754 - DNA, 103 bp, Artificial Sequence
  Synthetic Polynucleotide
taatacgactcactatagggtgggtgcgtacatgagtgactaatcttcctaacagaggagaaggaagatgagtcactcaaacctggcggcagcgcaaaagatg

SEQ ID NO: 3755 - DNA, 103 bp, Artificial Sequence
  Synthetic Polynucleotide
taatacgactcactatagggtgaaatgggtgcgtacatgagtgactaatcaacagaggagagattagatgctcatgtacaacctggcggcagcgcaaaagatg

SEQ ID NO: 3756 - DNA, 103 bp, Artificial Sequence
  Synthetic Polynucleotide
taatacgactcactatagggcgtggtgaaatgggtgcgtacatgagtgacaacagaggagagtcactatggtacgcaccaacctggcggcagcgcaaaagatg

SEQ ID NO: 3757 - DNA, 103 bp, Artificial Sequence
  Synthetic Polynucleotide
taatacgactcactatagggagggtcgtggtgaaatgggtgcgtacatgaaacagaggagatcatgtatgcacccatttaacctggcggcagcgcaaaagatg

SEQ ID NO: 3758 - DNA, 103 bp, Artificial Sequence
  Synthetic Polynucleotide
taatacgactcactatagggacaggagggtcgtggtgaaatgggtgcgtaaacagaggagatacgcaatgatttcaccaaacctggcggcagcgcaaaagatg

SEQ ID NO: 3759 - DNA, 103 bp, Artificial Sequence
  Synthetic Polynucleotide
taatacgactcactatagggctatcacaggagggtcgtggtgaaatgggtaacagaggagaacccatatgaccacgaccaacctggcggcagcgcaaaagatg

SEQ ID NO: 3760 - DNA, 103 bp, Artificial Sequence
  Synthetic Polynucleotide
taatacgactcactatagggccggcctatcacaggagggtcgtggtgaaaaacagaggagatttcacatggaccctcctaacctggcggcagcgcaaaagatg

SEQ ID NO: 3761 - DNA, 103 bp, Artificial Sequence
  Synthetic Polynucleotide
taatacgactcactatagggttttcccggcctatcacaggagggtcgtggaacagaggagaccacgaatgtcctgtgataacctggcggcagcgcaaaagatg

SEQ ID NO: 3762 - DNA, 103 bp, Artificial Sequence
  Synthetic Polynucleotide
taatacgactcactatagggggaatttttcccggcctatcacaggagggtaacagaggagaaccctcatgtgataggccaacctggcggcagcgcaaaagatg

SEQ ID NO: 3763 - DNA, 103 bp, Artificial Sequence
  Synthetic Polynucleotide
taatacgactcactatagggggaatggaatttttcccggcctatcacaggaacagaggagacctgtgatgggccgggaaaacctggcggcagcgcaaaagatg

SEQ ID NO: 3764 - DNA, 103 bp, Artificial Sequence
  Synthetic Polynucleotide
taatacgactcactatagggacgaaaccactgtatcacagcggcatgtgaaacagaggagatcacatatggctgtgataaacctggcggcagcgcaaaagatg

SEQ ID NO: 3765 - DNA, 103 bp, Artificial Sequence
  Synthetic Polynucleotide
taatacgactcactatagggggtcgggaatggaatttttcccggcctatcaacagaggagagataggatgggaaaaattaacctggcggcagcgcaaaagatg

SEQ ID NO: 3766 - DNA, 103 bp, Artificial Sequence
  Synthetic Polynucleotide
taatacgactcactataggggctgcggtcgggaatggaatttttcccggcaacagaggagagccgggatgaattccattaacctggcggcagcgcaaaagatg

SEQ ID NO: 3767 - DNA, 103 bp, Artificial Sequence
  Synthetic Polynucleotide
taatacgactcactatagggaccgtgctgcggtcgggaatggaatttttcaacagaggagagaaaaaatgcattcccgaaacctggcggcagcgcaaaagatg

SEQ ID NO: 3768 - DNA, 103 bp, Artificial Sequence
  Synthetic Polynucleotide
taatacgactcactatagggtctttaccgtgctgcggtcgggaatggaataacagaggagaattccaatgccgaccgcaaacctggcggcagcgcaaaagatg

SEQ ID NO: 3769 - DNA, 103 bp, Artificial Sequence
  Synthetic Polynucleotide
taatacgactcactataggggtagctctttaccgtgctgcggtcgggaataacagaggagaattcccatgcgcagcacgaacctggcggcagcgcaaaagatg

SEQ ID NO: 3770 - DNA, 103 bp, Artificial Sequence
  Synthetic Polynucleotide
taatacgactcactataggggcaaggtagctctttaccgtgctgcggtcgaacagaggagacgaccgatgcacggtaaaaacctggcggcagcgcaaaagatg

SEQ ID NO: 3771 - DNA, 103 bp, Artificial Sequence
  Synthetic Polynucleotide
taatacgactcactataggggtgctgcaaggtagctctttaccgtgctgcaacagaggagagcagcaatgtaaagagctaacctggcggcagcgcaaaagatg

SEQ ID NO: 3772 - DNA, 103 bp, Artificial Sequence
  Synthetic Polynucleotide
taatacgactcactatagggcgtacgtgctgcaaggtagctctttaccgtaacagaggagaacggtaatgagctaccttaacctggcggcagcgcaaaagatg

SEQ ID NO: 3773 - DNA, 103 bp, Artificial Sequence
  Synthetic Polynucleotide
taatacgactcactatagggctgcacgtacgtgctgcaaggtagctctttaacagaggagaaaagagatgccttgcagcaacctggcggcagcgcaaaagatg

SEQ ID NO: 3774 - DNA, 103 bp, Artificial Sequence
  Synthetic Polynucleotide
taatacgactcactatagggttgctctgcacgtacgtgctgcaaggtagcaacagaggagagctaccatgcagcacgtaaacctggcggcagcgcaaaagatg

SEQ ID NO: 3775 - DNA, 103 bp, Artificial Sequence
  Synthetic Polynucleotide
taatacgactcactatagggggcgctgtcagcgtctatgtccacgtacacaacagaggagagtgtacatggacatagacaacctggcggcagcgcaaaagatg

SEQ ID NO: 3776 - DNA, 103 bp, Artificial Sequence
  Synthetic Polynucleotide
taatacgactcactatagggttcgcacgaaaccactgtatcacagcggcaaacagaggagatgccgcatggatacagtgaacctggcggcagcgcaaaagatg

SEQ ID NO: 3777 - DNA, 103 bp, Artificial Sequence
  Synthetic Polynucleotide
taatacgactcactatagggcggcgttgctctgcacgtacgtgctgcaagaacagaggagacttgcaatgcgtacgtgcaacctggcggcagcgcaaaagatg

SEQ ID NO: 3778 - DNA, 103 bp, Artificial Sequence
  Synthetic Polynucleotide
taatacgactcactatagggagttgcggcgttgctctgcacgtacgtgctaacagaggagaagcacgatggtgcagagcaacctggcggcagcgcaaaagatg

SEQ ID NO: 3779 - DNA, 103 bp, Artificial Sequence
  Synthetic Polynucleotide
taatacgactcactatagggtcggcagttgcggcgttgctctgcacgtacaacagaggagagtacgtatggagcaacgcaacctggcggcagcgcaaaagatg

SEQ ID NO: 3780 - DNA, 103 bp, Artificial Sequence
  Synthetic Polynucleotide
taatacgactcactatagggtctcctcggcagttgcggcgttgctctgcaaacagaggagatgcagaatgacgccgcaaaacctggcggcagcgcaaaagatg

SEQ ID NO: 3781 - DNA, 103 bp, Artificial Sequence
  Synthetic Polynucleotide
taatacgactcactatagggctctatctcctcggcagttgcggcgttgctaacagaggagaagcaacatggcaactgccaacctggcggcagcgcaaaagatg

SEQ ID NO: 3782 - DNA, 103 bp, Artificial Sequence
  Synthetic Polynucleotide
taatacgactcactatagggtgtacctctatctcctcggcagttgcggcgaacagaggagacgccgcatgtgccgaggaaacctggcggcagcgcaaaagatg

SEQ ID NO: 3783 - DNA, 103 bp, Artificial Sequence
  Synthetic Polynucleotide
taatacgactcactataggggcatgtgtacctctatctcctcggcagttgaacagaggagacaactgatgaggagatagaacctggcggcagcgcaaaagatg

SEQ ID NO: 3784 - DNA, 103 bp, Artificial Sequence
  Synthetic Polynucleotide
taatacgactcactatagggtgggggcatgtgtacctctatctcctcggcaacagaggagagccgagatgatagaggtaaacctggcggcagcgcaaaagatg

SEQ ID NO: 3785 - DNA, 103 bp, Artificial Sequence
  Synthetic Polynucleotide
taatacgactcactataggggtgtctgggggcatgtgtacctctatctccaacagaggagaggagatatgggtacacataacctggcggcagcgcaaaagatg

SEQ ID NO: 3786 - DNA, 103 bp, Artificial Sequence
  Synthetic Polynucleotide
taatacgactcactatagggcaggggtgtctgggggcatgtgtacctctaaacagaggagatagaggatgacatgccccaacctggcggcagcgcaaaagatg

SEQ ID NO: 3787 - DNA, 103 bp, Artificial Sequence
  Synthetic Polynucleotide
taatacgactcactatagggtagccttcgcacgaaaccactgtatcacagaacagaggagactgtgaatgagtggtttcaacctggcggcagcgcaaaagatg

SEQ ID NO: 3788 - DNA, 103 bp, Artificial Sequence
  Synthetic Polynucleotide
taatacgactcactataggggcgatcaggggtgtctgggggcatgtgtacaacagaggagagtacacatgcccccagacaacctggcggcagcgcaaaagatg

SEQ ID NO: 3789 - DNA, 103 bp, Artificial Sequence
  Synthetic Polynucleotide
taatacgactcactatagggaatgtgcgatcaggggtgtctgggggcatgaacagaggagacatgccatgagacaccccaacctggcggcagcgcaaaagatg

SEQ ID NO: 3790 - DNA, 103 bp, Artificial Sequence
  Synthetic Polynucleotide
taatacgactcactatagggacagcaatgtgcgatcaggggtgtctggggaacagaggagaccccagatgcccctgatcaacctggcggcagcgcaaaagatg

SEQ ID NO: 3791 - DNA, 103 bp, Artificial Sequence
  Synthetic Polynucleotide
taatacgactcactatagggttgtgacagcaatgtgcgatcaggggtgtcaacagaggagagacaccatggatcgcacaaacctggcggcagcgcaaaagatg

SEQ ID NO: 3792 - DNA, 103 bp, Artificial Sequence
  Synthetic Polynucleotide
taatacgactcactataggggactgttgtgacagcaatgtgcgatcagggaacagaggagaccctgaatgcacattgctaacctggcggcagcgcaaaagatg

SEQ ID NO: 3793 - DNA, 103 bp, Artificial Sequence
  Synthetic Polynucleotide
taatacgactcactatagggtgccggactgttgtgacagcaatgtgcgataacagaggagaatcgcaatgtgctgtcacaacctggcggcagcgcaaaagatg

SEQ ID NO: 3794 - DNA, 103 bp, Artificial Sequence
  Synthetic Polynucleotide
taatacgactcactatagggtacgttgccggactgttgtgacagcaatgtaacagaggagaacattgatgtcacaacagaacctggcggcagcgcaaaagatg

SEQ ID NO: 3795 - DNA, 103 bp, Artificial Sequence
  Synthetic Polynucleotide
taatacgactcactatagggatctttacgttgccggactgttgtgacagcaacagaggagagctgtcatgacagtccggaacctggcggcagcgcaaaagatg

SEQ ID NO: 3796 - DNA, 103 bp, Artificial Sequence
  Synthetic Polynucleotide
taatacgactcactatagggctgtgatctttacgttgccggactgttgtgaacagaggagacacaacatgccggcaacgaacctggcggcagcgcaaaagatg

SEQ ID NO: 3797 - DNA, 103 bp, Artificial Sequence
  Synthetic Polynucleotide
taatacgactcactatagggattgactgtgatctttacgttgccggactgaacagaggagacagtccatgaacgtaaagaacctggcggcagcgcaaaagatg

SEQ ID NO: 3798 - DNA, 103 bp, Artificial Sequence
  Synthetic Polynucleotide
taatacgactcactatagggcgacgtagccttcgcacgaaaccactgtataacagaggagaatacagatgtttcgtgcgaacctggcggcagcgcaaaagatg

SEQ ID NO: 3799 - DNA, 103 bp, Artificial Sequence
  Synthetic Polynucleotide
taatacgactcactatagggtgactattgactgtgatctttacgttgccgaacagaggagacggcaaatgaaagatcacaacctggcggcagcgcaaaagatg

SEQ ID NO: 3800 - DNA, 103 bp, Artificial Sequence
  Synthetic Polynucleotide
taatacgactcactatagggccgtctgactattgactgtgatctttacgtaacagaggagaacgtaaatgtcacagtcaaacctggcggcagcgcaaaagatg

SEQ ID NO: 3801 - DNA, 103 bp, Artificial Sequence
  Synthetic Polynucleotide
taatacgactcactatagggccgcaccgtctgactattgactgtgatcttaacagaggagaaagatcatggtcaatagtaacctggcggcagcgcaaaagatg

SEQ ID NO: 3802 - DNA, 103 bp, Artificial Sequence
  Synthetic Polynucleotide
taatacgactcactatagggttataccgcaccgtctgactattgactgtgaacagaggagacacagtatgtagtcagacaacctggcggcagcgcaaaagatg

SEQ ID NO: 3803 - DNA, 103 bp, Artificial Sequence
  Synthetic Polynucleotide
taatacgactcactatagggtacacttataccgcaccgtctgactattgaaacagaggagatcaataatgagacggtgcaacctggcggcagcgcaaaagatg

SEQ ID NO: 3804 - DNA, 103 bp, Artificial Sequence
  Synthetic Polynucleotide
taatacgactcactataggggcaattacacttataccgcaccgtctgactaacagaggagaagtcagatggtgcggtataacctggcggcagcgcaaaagatg

SEQ ID NO: 3805 - DNA, 103 bp, Artificial Sequence
  Synthetic Polynucleotide
taatacgactcactatagggccaccgcaattacacttataccgcaccgtcaacagaggagagacggtatggtataagtgaacctggcggcagcgcaaaagatg

SEQ ID NO: 3806 - DNA, 103 bp, Artificial Sequence
  Synthetic Polynucleotide
taatacgactcactatagggttgagccaccgcaattacacttataccgcaaacagaggagatgcggtatgagtgtaattaacctggcggcagcgcaaaagatg

SEQ ID NO: 3807 - DNA, 103 bp, Artificial Sequence
  Synthetic Polynucleotide
taatacgactcactatagggttcatttgagccaccgcaattacacttataaacagaggagatataagatgaattgcggtaacctggcggcagcgcaaaagatg

SEQ ID NO: 3808 - DNA, 103 bp, Artificial Sequence
  Synthetic Polynucleotide
taatacgactcactatagggagtccttcatttgagccaccgcaattacacaacagaggagagtgtaaatgcggtggctcaacctggcggcagcgcaaaagatg

SEQ ID NO: 3809 - DNA, 103 bp, Artificial Sequence
  Synthetic Polynucleotide
taatacgactcactatagggcttaacgacgtagccttcgcacgaaaccacaacagaggagagtggttatgtgcgaaggcaacctggcggcagcgcaaaagatg

SEQ ID NO: 3810 - DNA, 103 bp, Artificial Sequence
  Synthetic Polynucleotide
taatacgactcactatagggttattagtccttcatttgagccaccgcaataacagaggagaattgcgatggctcaaatgaacctggcggcagcgcaaaagatg

SEQ ID NO: 3811 - DNA, 103 bp, Artificial Sequence
  Synthetic Polynucleotide
taatacgactcactatagggtgtagttattagtccttcatttgagccaccaacagaggagaggtggcatgaatgaaggaaacctggcggcagcgcaaaagatg

SEQ ID NO: 3812 - DNA, 103 bp, Artificial Sequence
  Synthetic Polynucleotide
taatacgactcactatagggttatctgtagttattagtccttcatttgagaacagaggagactcaaaatgaggactaataacctggcggcagcgcaaaagatg

SEQ ID NO: 3813 - DNA, 103 bp, Artificial Sequence
  Synthetic Polynucleotide
taatacgactcactatagggtcactttatctgtagttattagtccttcataacagaggagaatgaagatgtaataactaaacctggcggcagcgcaaaagatg

SEQ ID NO: 3814 - DNA, 103 bp, Artificial Sequence
  Synthetic Polynucleotide
taatacgactcactatagggattaatcactttatctgtagttattagtccaacagaggagaggactaatgactacagataacctggcggcagcgcaaaagatg

SEQ ID NO: 3815 - DNA, 103 bp, Artificial Sequence
  Synthetic Polynucleotide
taatacgactcactatagggcagttattaatcactttatctgtagttattaacagaggagaaataacatgagataaagtaacctggcggcagcgcaaaagatg

SEQ ID NO: 3816 - DNA, 103 bp, Artificial Sequence
  Synthetic Polynucleotide
taatacgactcactatagggccttgcagttattaatcactttatctgtagaacagaggagactacagatgaagtgattaaacctggcggcagcgcaaaagatg

SEQ ID NO: 3817 - DNA, 103 bp, Artificial Sequence
  Synthetic Polynucleotide
taatacgactcactatagggatcaaccttgcagttattaatcactttatcaacagaggagagataaaatgattaataacaacctggcggcagcgcaaaagatg

SEQ ID NO: 3818 - DNA, 103 bp, Artificial Sequence
  Synthetic Polynucleotide
taatacgactcactatagggcattgatcaaccttgcagttattaatcactaacagaggagaagtgatatgtaactgcaaaacctggcggcagcgcaaaagatg

SEQ ID NO: 3819 - DNA, 103 bp, Artificial Sequence
  Synthetic Polynucleotide
taatacgactcactatagggcatgacattgatcaaccttgcagttattaaaacagaggagattaataatggcaaggttgaacctggcggcagcgcaaaagatg

SEQ ID NO: 3820 - DNA, 103 bp, Artificial Sequence
  Synthetic Polynucleotide
taatacgactcactatagggattctcttaacgacgtagccttcgcacgaaaacagaggagattcgtgatgaggctacgtaacctggcggcagcgcaaaagatg

SEQ ID NO: 3821 - DNA, 103 bp, Artificial Sequence
  Synthetic Polynucleotide
taatacgactcactatagggcgcggcatgacattgatcaaccttgcagttaacagaggagaaactgcatggttgatcaaaacctggcggcagcgcaaaagatg

SEQ ID NO: 3822 - DNA, 103 bp, Artificial Sequence
  Synthetic Polynucleotide
taatacgactcactataggggtgaccgcggcatgacattgatcaaccttgaacagaggagacaaggtatgtcaatgtcaaacctggcggcagcgcaaaagatg

SEQ ID NO: 3823 - DNA, 103 bp, Artificial Sequence
  Synthetic Polynucleotide
taatacgactcactataggggattggtgaccgcggcatgacattgatcaaaacagaggagattgatcatggtcatgccgaacctggcggcagcgcaaaagatg

SEQ ID NO: 3824 - DNA, 103 bp, Artificial Sequence
  Synthetic Polynucleotide
taatacgactcactatagggtttgtgattggtgaccgcggcatgacattgaacagaggagacaatgtatggccgcggtcaacctggcggcagcgcaaaagatg

SEQ ID NO: 3825 - DNA, 103 bp, Artificial Sequence
  Synthetic Polynucleotide
taatacgactcactatagggcactttttgtgattggtgaccgcggcatgaaacagaggagatcatgcatgggtcaccaaaacctggcggcagcgcaaaagatg

SEQ ID NO: 3826 - DNA, 103 bp, Artificial Sequence
  Synthetic Polynucleotide
taatacgactcactatagggactgccactttttgtgattggtgaccgcggaacagaggagaccgcggatgccaatcacaaacctggcggcagcgcaaaagatg

SEQ ID NO: 3827 - DNA, 103 bp, Artificial Sequence
  Synthetic Polynucleotide
taatacgactcactataggggttatactgccactttttgtgattggtgacaacagaggagagtcaccatgcacaaaaagaacctggcggcagcgcaaaagatg

SEQ ID NO: 3828 - DNA, 103 bp, Artificial Sequence
  Synthetic Polynucleotide
taatacgactcactatagggggggagttatactgccactttttgtgattgaacagaggagacaatcaatgaaagtggcaaacctggcggcagcgcaaaagatg

SEQ ID NO: 3829 - DNA, 103 bp, Artificial Sequence
  Synthetic Polynucleotide
taatacgactcactatagggccagaggggagttatactgccactttttgtaacagaggagaacaaaaatgggcagtataaacctggcggcagcgcaaaagatg

SEQ ID NO: 3830 - DNA, 103 bp, Artificial Sequence
  Synthetic Polynucleotide
taatacgactcactatagggcgggaccagaggggagttatactgccacttaacagaggagaaagtggatgtataactccaacctggcggcagcgcaaaagatg

SEQ ID NO: 3831 - DNA, 103 bp, Artificial Sequence
  Synthetic Polynucleotide
taatacgactcactatagggtcgttattctcttaacgacgtagccttcgcaacagaggagagcgaagatgacgtcgttaaacctggcggcagcgcaaaagatg

SEQ ID NO: 3832 - DNA, 103 bp, Artificial Sequence
  Synthetic Polynucleotide
taatacgactcactatagggttacgcgggaccagaggggagttatactgcaacagaggagagcagtaatgctcccctctaacctggcggcagcgcaaaagatg

SEQ ID NO: 3833 - DNA, 103 bp, Artificial Sequence
  Synthetic Polynucleotide
taatacgactcactatagggcagcgttacgcgggaccagaggggagttataacagaggagaataactatgctctggtccaacctggcggcagcgcaaaagatg

SEQ ID NO: 3834 - DNA, 103 bp, Artificial Sequence
  Synthetic Polynucleotide
taatacgactcactataggggagttcagcgttacgcgggaccagaggggaaacagaggagatcccctatggtcccgcgtaacctggcggcagcgcaaaagatg

SEQ ID NO: 3835 - DNA, 103 bp, Artificial Sequence
  Synthetic Polynucleotide
taatacgactcactatagggtccccgagttcagcgttacgcgggaccagaaacagaggagatctggtatggcgtaacgcaacctggcggcagcgcaaaagatg

SEQ ID NO: 3836 - DNA, 103 bp, Artificial Sequence
  Synthetic Polynucleotide
taatacgactcactatagggttcggtccccgagttcagcgttacgcgggaaacagaggagatcccgcatgacgctgaacaacctggcggcagcgcaaaagatg

SEQ ID NO: 3837 - DNA, 103 bp, Artificial Sequence
  Synthetic Polynucleotide
taatacgactcactatagggtccttttcggtccccgagttcagcgttacgaacagaggagacgtaacatggaactcgggaacctggcggcagcgcaaaagatg

SEQ ID NO: 3838 - DNA, 103 bp, Artificial Sequence
  Synthetic Polynucleotide
taatacgactcactatagggatttttccttttcggtccccgagttcagcgaacagaggagacgctgaatgcggggaccgaacctggcggcagcgcaaaagatg

SEQ ID NO: 3839 - DNA, 103 bp, Artificial Sequence
  Synthetic Polynucleotide
taatacgactcactatagggtgtgaatttttccttttcggtccccgagttaacagaggagaaactcgatgaccgaaaagaacctggcggcagcgcaaaagatg

SEQ ID NO: 3840 - DNA, 103 bp, Artificial Sequence
  Synthetic Polynucleotide
taatacgactcactatagggcgggatgtgaatttttccttttcggtccccaacagaggagaggggacatgaaaggaaaaaacctggcggcagcgcaaaagatg

SEQ ID NO: 3841 - DNA, 103 bp, Artificial Sequence
  Synthetic Polynucleotide
taatacgactcactatagggggaaacgggatgtgaatttttccttttcggaacagaggagaccgaaaatgaaaaattcaaacctggcggcagcgcaaaagatg

SEQ ID NO: 3842 - DNA, 103 bp, Artificial Sequence
  Synthetic Polynucleotide
taatacgactcactataggggctcatcgttattctcttaacgacgtagccaacagaggagaggctacatggttaagagaaacctggcggcagcgcaaaagatg

SEQ ID NO: 3843 - DNA, 103 bp, Artificial Sequence
  Synthetic Polynucleotide
taatacgactcactatagggccagcggaaacgggatgtgaatttttccttaacagaggagaaaggaaatgttcacatccaacctggcggcagcgcaaaagatg

SEQ ID NO: 3844 - DNA, 103 bp, Artificial Sequence
  Synthetic Polynucleotide
taatacgactcactatagggatttgccagcggaaacgggatgtgaattttaacagaggagaaaaattatgatcccgtttaacctggcggcagcgcaaaagatg

SEQ ID NO: 3845 - DNA, 103 bp, Artificial Sequence
  Synthetic Polynucleotide
taatacgactcactataggggttacatttgccagcggaaacgggatgtgaaacagaggagatcacatatggtttccgctaacctggcggcagcgcaaaagatg

SEQ ID NO: 3846 - DNA, 103 bp, Artificial Sequence
  Synthetic Polynucleotide
taatacgactcactatagggtgcatgttacatttgccagcggaaacgggaaacagaggagatcccgtatgcgctggcaaaacctggcggcagcgcaaaagatg

SEQ ID NO: 3847 - DNA, 103 bp, Artificial Sequence
  Synthetic Polynucleotide
taatacgactcactatagggcaccatgcatgttacatttgccagcggaaaaacagaggagatttccgatggcaaatgtaaacctggcggcagcgcaaaagatg

SEQ ID NO: 3848 - DNA, 103 bp, Artificial Sequence
  Synthetic Polynucleotide
taatacgactcactatagggttaggcaccatgcatgttacatttgccagcaacagaggagagctggcatgtgtaacatgaacctggcggcagcgcaaaagatg

SEQ ID NO: 3849 - DNA, 103 bp, Artificial Sequence
  Synthetic Polynucleotide
taatacgactcactatagggttgctttaggcaccatgcatgttacatttgaacagaggagacaaatgatgcatgcatggaacctggcggcagcgcaaaagatg

SEQ ID NO: 3850 - DNA, 103 bp, Artificial Sequence
  Synthetic Polynucleotide
taatacgactcactataggggttccttgctttaggcaccatgcatgttacaacagaggagagtaacaatgatggtgcctaacctggcggcagcgcaaaagatg

SEQ ID NO: 3851 - DNA, 103 bp, Artificial Sequence
  Synthetic Polynucleotide
taatacgactcactataggggtggggttccttgctttaggcaccatgcataacagaggagaatgcatatggcctaaagcaacctggcggcagcgcaaaagatg

SEQ ID NO: 3852 - DNA, 103 bp, Artificial Sequence
  Synthetic Polynucleotide
taatacgactcactatagggtcacggtggggttccttgctttaggcaccaaacagaggagatggtgcatgaagcaaggaaacctggcggcagcgcaaaagatg

SEQ ID NO: 3853 - DNA, 103 bp, Artificial Sequence
  Synthetic Polynucleotide
taatacgactcactatagggcctgggctcatcgttattctcttaacgacgaacagaggagacgtcgtatggagaataacaacctggcggcagcgcaaaagatg

SEQ ID NO: 3854 - DNA, 103 bp, Artificial Sequence
  Synthetic Polynucleotide
taatacgactcactataggggtacgtcacggtggggttccttgctttaggaacagaggagacctaaaatgaggaaccccaacctggcggcagcgcaaaagatg

SEQ ID NO: 3855 - DNA, 103 bp, Artificial Sequence
  Synthetic Polynucleotide
taatacgactcactatagggttcccgtacgtcacggtggggttccttgctaacagaggagaagcaagatgccccaccgtaacctggcggcagcgcaaaagatg

SEQ ID NO: 3856 - DNA, 103 bp, Artificial Sequence
  Synthetic Polynucleotide
taatacgactcactatagggggtttttcccgtacgtcacggtggggttccaacagaggagaggaaccatgccgtgacgtaacctggcggcagcgcaaaagatg

SEQ ID NO: 3857 - DNA, 103 bp, Artificial Sequence
  Synthetic Polynucleotide
taatacgactcactataggggacttggtttttcccgtacgtcacggtgggaacagaggagacccaccatgacgtacgggaacctggcggcagcgcaaaagatg

SEQ ID NO: 3858 - DNA, 103 bp, Artificial Sequence
  Synthetic Polynucleotide
taatacgactcactatagggatgatgacttggtttttcccgtacgtcacgaacagaggagacgtgacatgcgggaaaaaaacctggcggcagcgcaaaagatg

SEQ ID NO: 3859 - DNA, 103 bp, Artificial Sequence
  Synthetic Polynucleotide
taatacgactcactataggggtagcatgatgacttggtttttcccgtacgaacagaggagacgtacgatgaaaaccaagaacctggcggcagcgcaaaagatg

SEQ ID NO: 3860 - DNA, 103 bp, Artificial Sequence
  Synthetic Polynucleotide
taatacgactcactatagggatacagtagcatgatgacttggtttttcccaacagaggagagggaaaatgcaagtcatcaacctggcggcagcgcaaaagatg

SEQ ID NO: 3861 - DNA, 103 bp, Artificial Sequence
  Synthetic Polynucleotide
taatacgactcactatagggtcaggatacagtagcatgatgacttggtttaacagaggagaaaaccaatgcatcatgctaacctggcggcagcgcaaaagatg

SEQ ID NO: 3862 - DNA, 103 bp, Artificial Sequence
  Synthetic Polynucleotide
taatacgactcactatagggggtggtcaggatacagtagcatgatgacttaacagaggagaaagtcaatgtgctactgtaacctggcggcagcgcaaaagatg

SEQ ID NO: 3863 - DNA, 103 bp, Artificial Sequence
  Synthetic Polynucleotide
taatacgactcactatagggtgttgggtggtcaggatacagtagcatgataacagaggagaatcatgatgctgtatcctaacctggcggcagcgcaaaagatg

SEQ ID NO: 3864 - DNA, 103 bp, Artificial Sequence
  Synthetic Polynucleotide
taatacgactcactatagggaaaggcctgggctcatcgttattctcttaaaacagaggagattaagaatgtaacgatgaaacctggcggcagcgcaaaagatg

SEQ ID NO: 3865 - DNA, 103 bp, Artificial Sequence
  Synthetic Polynucleotide
taatacgactcactatagggaggagtgttgggtggtcaggatacagtagcaacagaggagagctactatgtcctgaccaaacctggcggcagcgcaaaagatg

SEQ ID NO: 3866 - DNA, 103 bp, Artificial Sequence
  Synthetic Polynucleotide
taatacgactcactatagggaggacaggagtgttgggtggtcaggatacaaacagaggagatgtatcatgaccacccaaaacctggcggcagcgcaaaagatg

SEQ ID NO: 3867 - DNA, 103 bp, Artificial Sequence
  Synthetic Polynucleotide
taatacgactcactatagggccggtaggacaggagtgttgggtggtcaggaacagaggagacctgacatgccaacactcaacctggcggcagcgcaaaagatg

SEQ ID NO: 3868 - DNA, 103 bp, Artificial Sequence
  Synthetic Polynucleotide
taatacgactcactatagggatactccggtaggacaggagtgttgggtggaacagaggagaccacccatgactcctgtcaacctggcggcagcgcaaaagatg

SEQ ID NO: 3869 - DNA, 103 bp, Artificial Sequence
  Synthetic Polynucleotide
taatacgactcactatagggctcccatactccggtaggacaggagtgttgaacagaggagacaacacatgtgtcctaccaacctggcggcagcgcaaaagatg

SEQ ID NO: 3870 - DNA, 103 bp, Artificial Sequence
  Synthetic Polynucleotide
taatacgactcactatagggttcttctcccatactccggtaggacaggagaacagaggagactcctgatgtaccggagtaacctggcggcagcgcaaaagatg

SEQ ID NO: 3871 - DNA, 103 bp, Artificial Sequence
  Synthetic Polynucleotide
taatacgactcactatagggtttggttcttctcccatactccggtaggacaacagaggagagtcctaatggagtatgggaacctggcggcagcgcaaaagatg

SEQ ID NO: 3872 - DNA, 103 bp, Artificial Sequence
  Synthetic Polynucleotide
taatacgactcactataggggatagtttggttcttctcccatactccggtaacagaggagaaccggaatgtgggagaagaacctggcggcagcgcaaaagatg

SEQ ID NO: 3873 - DNA, 103 bp, Artificial Sequence
  Synthetic Polynucleotide
taatacgactcactatagggttcttgatagtttggttcttctcccatactaacagaggagaagtatgatggaagaaccaaacctggcggcagcgcaaaagatg

SEQ ID NO: 3874 - DNA, 103 bp, Artificial Sequence
  Synthetic Polynucleotide
taatacgactcactatagggcactcttcttgatagtttggttcttctcccaacagaggagagggagaatgaccaaactaaacctggcggcagcgcaaaagatg

SEQ ID NO: 3875 - DNA, 103 bp, Artificial Sequence
  Synthetic Polynucleotide
taatacgactcactatagggtccgtaaaggcctgggctcatcgttattctaacagaggagaagaataatgatgagcccaaacctggcggcagcgcaaaagatg

SEQ ID NO: 3876 - DNA, 103 bp, Artificial Sequence
  Synthetic Polynucleotide
taatacgactcactatagggtcacccactcttcttgatagtttggttcttaacagaggagaaagaacatgactatcaagaacctggcggcagcgcaaaagatg

SEQ ID NO: 3877 - DNA, 103 bp, Artificial Sequence
  Synthetic Polynucleotide
taatacgactcactataggggtgcgtcacccactcttcttgatagtttggaacagaggagaccaaacatgcaagaagagaacctggcggcagcgcaaaagatg

SEQ ID NO: 3878 - DNA, 103 bp, Artificial Sequence
  Synthetic Polynucleotide
taatacgactcactatagggttcttgtgcgtcacccactcttcttgatagaacagaggagactatcaatgagagtgggtaacctggcggcagcgcaaaagatg

SEQ ID NO: 3879 - DNA, 103 bp, Artificial Sequence
  Synthetic Polynucleotide
taatacgactcactatagggcctccttcttgtgcgtcacccactcttcttaacagaggagaaagaagatggggtgacgcaacctggcggcagcgcaaaagatg

SEQ ID NO: 3880 - DNA, 103 bp, Artificial Sequence
  Synthetic Polynucleotide
taatacgactcactatagggcacgacctccttcttgtgcgtcacccactcaacagaggagagagtggatgacgcacaagaacctggcggcagcgcaaaagatg

SEQ ID NO: 3881 - DNA, 103 bp, Artificial Sequence
  Synthetic Polynucleotide
taatacgactcactataggggttagcacgacctccttcttgtgcgtcaccaacagaggagaggtgacatgcaagaaggaaacctggcggcagcgcaaaagatg

SEQ ID NO: 3882 - DNA, 103 bp, Artificial Sequence
  Synthetic Polynucleotide
taatacgactcactataggggcacggttagcacgacctccttcttgtgcgaacagaggagacgcacaatgaggaggtcgaacctggcggcagcgcaaaagatg

SEQ ID NO: 3883 - DNA, 103 bp, Artificial Sequence
  Synthetic Polynucleotide
taatacgactcactatagggagtcggcacggttagcacgacctccttcttaacagaggagaaagaagatggtcgtgctaaacctggcggcagcgcaaaagatg

SEQ ID NO: 3884 - DNA, 103 bp, Artificial Sequence
  Synthetic Polynucleotide
taatacgactcactatagggccttcagtcggcacggttagcacgacctccaacagaggagaggaggtatggctaaccgtaacctggcggcagcgcaaaagatg

SEQ ID NO: 3885 - DNA, 103 bp, Artificial Sequence
  Synthetic Polynucleotide
taatacgactcactatagggcgagcccttcagtcggcacggttagcacgaaacagaggagatcgtgcatgccgtgccgaaacctggcggcagcgcaaaagatg

SEQ ID NO: 3886 - DNA, 103 bp, Artificial Sequence
  Synthetic Polynucleotide
taatacgactcactatagggaaaaaggcgctgtcagcgtctatgtccacgaacagaggagacgtggaatgagacgctgaaacctggcggcagcgcaaaagatg

SEQ ID NO: 3887 - DNA, 103 bp, Artificial Sequence
  Synthetic Polynucleotide
taatacgactcactataggggtttttccgtaaaggcctgggctcatcgttaacagaggagaaacgatatgcccaggcctaacctggcggcagcgcaaaagatg

SEQ ID NO: 3888 - DNA, 103 bp, Artificial Sequence
  Synthetic Polynucleotide
taatacgactcactatagggaacctcgagcccttcagtcggcacggttagaacagaggagactaaccatgccgactgaaaacctggcggcagcgcaaaagatg

SEQ ID NO: 3889 - DNA, 103 bp, Artificial Sequence
  Synthetic Polynucleotide
taatacgactcactatagggcacgtaacctcgagcccttcagtcggcacgaacagaggagacgtgccatgtgaagggctaacctggcggcagcgcaaaagatg

SEQ ID NO: 3890 - DNA, 103 bp, Artificial Sequence
  Synthetic Polynucleotide
taatacgactcactatagggtgccccacgtaacctcgagcccttcagtcgaacagaggagacgactgatgggctcgaggaacctggcggcagcgcaaaagatg

SEQ ID NO: 3891 - DNA, 103 bp, Artificial Sequence
  Synthetic Polynucleotide
taatacgactcactataggggttgttgccccacgtaacctcgagcccttcaacagaggagagaagggatggaggttacgaacctggcggcagcgcaaaagatg

SEQ ID NO: 3892 - DNA, 103 bp, Artificial Sequence
  Synthetic Polynucleotide
taatacgactcactatagggggctcgttgttgccccacgtaacctcgagcaacagaggagagctcgaatgtacgtggggaacctggcggcagcgcaaaagatg

SEQ ID NO: 3893 - DNA, 103 bp, Artificial Sequence
  Synthetic Polynucleotide
taatacgactcactatagggtatacggctcgttgttgccccacgtaacctaacagaggagaaggttaatgggggcaacaaacctggcggcagcgcaaaagatg

SEQ ID NO: 3894 - DNA, 103 bp, Artificial Sequence
  Synthetic Polynucleotide
taatacgactcactatagggatacttatacggctcgttgttgccccacgtaacagaggagaacgtggatgaacaacgagaacctggcggcagcgcaaaagatg

SEQ ID NO: 3895 - DNA, 103 bp, Artificial Sequence
  Synthetic Polynucleotide
taatacgactcactatagggggccaatacttatacggctcgttgttgcccaacagaggagagggcaaatgcgagccgtaaacctggcggcagcgcaaaagatg

SEQ ID NO: 3896 - DNA, 103 bp, Artificial Sequence
  Synthetic Polynucleotide
taatacgactcactatagggactgcggccaatacttatacggctcgttgtaacagaggagaacaacgatgcgtataagtaacctggcggcagcgcaaaagatg

SEQ ID NO: 3897 - DNA, 103 bp, Artificial Sequence
  Synthetic Polynucleotide
taatacgactcactatagggagataactgcggccaatacttatacggctcaacagaggagagagccgatgaagtattggaacctggcggcagcgcaaaagatg

SEQ ID NO: 3898 - DNA, 103 bp, Artificial Sequence
  Synthetic Polynucleotide
taatacgactcactatagggctgtggtttttccgtaaaggcctgggctcaaacagaggagatgagccatggcctttacgaacctggcggcagcgcaaaagatg

SEQ ID NO: 3899 - DNA, 103 bp, Artificial Sequence
  Synthetic Polynucleotide
taatacgactcactatagggtttgcagataactgcggccaatacttatacaacagaggagagtataaatgttggccgcaaacctggcggcagcgcaaaagatg

SEQ ID NO: 3900 - DNA, 103 bp, Artificial Sequence
  Synthetic Polynucleotide
taatacgactcactatagggtaccgtttgcagataactgcggccaatactaacagaggagaagtattatgcgcagttataacctggcggcagcgcaaaagatg

SEQ ID NO: 3901 - DNA, 103 bp, Artificial Sequence
  Synthetic Polynucleotide
taatacgactcactatagggggctgtaccgtttgcagataactgcggccaaacagaggagatggccgatgttatctgcaaacctggcggcagcgcaaaagatg

SEQ ID NO: 3902 - DNA, 103 bp, Artificial Sequence
  Synthetic Polynucleotide
taatacgactcactatagggccgtgggctgtaccgtttgcagataactgcaacagaggagagcagttatgtgcaaacggaacctggcggcagcgcaaaagatg

SEQ ID NO: 3903 - DNA, 103 bp, Artificial Sequence
  Synthetic Polynucleotide
taatacgactcactatagggggtggccgtgggctgtaccgtttgcagataaacagaggagatatctgatgacggtacagaacctggcggcagcgcaaaagatg

SEQ ID NO: 3904 - DNA, 103 bp, Artificial Sequence
  Synthetic Polynucleotide
taatacgactcactatagggatgcgggtggccgtgggctgtaccgtttgcaacagaggagagcaaacatgacagcccacaacctggcggcagcgcaaaagatg

SEQ ID NO: 3905 - DNA, 103 bp, Artificial Sequence
  Synthetic Polynucleotide
taatacgactcactatagggatctcatgcgggtggccgtgggctgtaccgaacagaggagacggtacatgccacggccaaacctggcggcagcgcaaaagatg

SEQ ID NO: 3906 - DNA, 103 bp, Artificial Sequence
  Synthetic Polynucleotide
taatacgactcactatagggagattatctcatgcgggtggccgtgggctgaacagaggagacagcccatggccacccgcaacctggcggcagcgcaaaagatg

SEQ ID NO: 3907 - DNA, 103 bp, Artificial Sequence
  Synthetic Polynucleotide
taatacgactcactataggggtacaagattatctcatgcgggtggccgtgaacagaggagacacggcatgccgcatgagaacctggcggcagcgcaaaagatg

SEQ ID NO: 3908 - DNA, 103 bp, Artificial Sequence
  Synthetic Polynucleotide
taatacgactcactatagggtaatagtacaagattatctcatgcgggtggaacagaggagaccacccatgtgagataataacctggcggcagcgcaaaagatg

SEQ ID NO: 3909 - DNA, 103 bp, Artificial Sequence
  Synthetic Polynucleotide
taatacgactcactatagggataccctgtggtttttccgtaaaggcctggaacagaggagaccaggcatgtacggaaaaaacctggcggcagcgcaaaagatg

SEQ ID NO: 3910 - DNA, 103 bp, Artificial Sequence
  Synthetic Polynucleotide
taatacgactcactataggggctcataatagtacaagattatctcatgcgaacagaggagacgcatgatgtaatcttgtaacctggcggcagcgcaaaagatg

SEQ ID NO: 3911 - DNA, 103 bp, Artificial Sequence
  Synthetic Polynucleotide
taatacgactcactataggggtacagctcataatagtacaagattatctcaacagaggagagagataatgttgtactataacctggcggcagcgcaaaagatg

SEQ ID NO: 3912 - DNA, 103 bp, Artificial Sequence
  Synthetic Polynucleotide
taatacgactcactataggggtagggtacagctcataatagtacaagattaacagaggagaaatcttatgctattatgaaacctggcggcagcgcaaaagatg

SEQ ID NO: 3913 - DNA, 103 bp, Artificial Sequence
  Synthetic Polynucleotide
taatacgactcactatagggtcatagtagggtacagctcataatagtacaaacagaggagatgtactatgatgagctgtaacctggcggcagcgcaaaagatg

SEQ ID NO: 3914 - DNA, 103 bp, Artificial Sequence
  Synthetic Polynucleotide
taatacgactcactatagggtacagtcatagtagggtacagctcataataaacagaggagatattatatgctgtaccctaacctggcggcagcgcaaaagatg

SEQ ID NO: 3915 - DNA, 103 bp, Artificial Sequence
  Synthetic Polynucleotide
taatacgactcactatagggactactacagtcatagtagggtacagctcaaacagaggagatgagctatgccctactataacctggcggcagcgcaaaagatg

SEQ ID NO: 3916 - DNA, 103 bp, Artificial Sequence
  Synthetic Polynucleotide
taatacgactcactatagggacacaactactacagtcatagtagggtacaaacagaggagatgtaccatgctatgactgaacctggcggcagcgcaaaagatg

SEQ ID NO: 3917 - DNA, 103 bp, Artificial Sequence
  Synthetic Polynucleotide
taatacgactcactatagggcactgacacaactactacagtcatagtaggaacagaggagacctactatgactgtagtaaacctggcggcagcgcaaaagatg

SEQ ID NO: 3918 - DNA, 103 bp, Artificial Sequence
  Synthetic Polynucleotide
taatacgactcactataggggaggccactgacacaactactacagtcataaacagaggagatatgacatgagtagttgtaacctggcggcagcgcaaaagatg

SEQ ID NO: 3919 - DNA, 103 bp, Artificial Sequence
  Synthetic Polynucleotide
taatacgactcactatagggtgaacgaggccactgacacaactactacagaacagaggagactgtagatgttgtgtcagaacctggcggcagcgcaaaagatg

SEQ ID NO: 3920 - DNA, 103 bp, Artificial Sequence
  Synthetic Polynucleotide
taatacgactcactatagggaccgcataccctgtggtttttccgtaaaggaacagaggagacctttaatgaaaaaccacaacctggcggcagcgcaaaagatg

SEQ ID NO: 3921 - DNA, 103 bp, Artificial Sequence
  Synthetic Polynucleotide
taatacgactcactataggggagtatgaacgaggccactgacacaactacaacagaggagagtagttatgtcagtggccaacctggcggcagcgcaaaagatg

SEQ ID NO: 3922 - DNA, 103 bp, Artificial Sequence
  Synthetic Polynucleotide
taatacgactcactataggggacaggagtatgaacgaggccactgacacaaacagaggagatgtgtcatgggcctcgttaacctggcggcagcgcaaaagatg

SEQ ID NO: 3923 - DNA, 103 bp, Artificial Sequence
  Synthetic Polynucleotide
taatacgactcactatagggccatcgacaggagtatgaacgaggccactgaacagaggagacagtggatgcgttcatacaacctggcggcagcgcaaaagatg

SEQ ID NO: 3924 - DNA, 103 bp, Artificial Sequence
  Synthetic Polynucleotide
taatacgactcactatagggacccaccatcgacaggagtatgaacgaggcaacagaggagagcctcgatgatactcctgaacctggcggcagcgcaaaagatg

SEQ ID NO: 3925 - DNA, 103 bp, Artificial Sequence
  Synthetic Polynucleotide
taatacgactcactataggggccatacccaccatcgacaggagtatgaacaacagaggagagttcatatgcctgtcgataacctggcggcagcgcaaaagatg

SEQ ID NO: 3926 - DNA, 103 bp, Artificial Sequence
  Synthetic Polynucleotide
taatacgactcactatagggccactgccatacccaccatcgacaggagtaaacagaggagatactccatgcgatggtggaacctggcggcagcgcaaaagatg

SEQ ID NO: 3927 - DNA, 103 bp, Artificial Sequence
  Synthetic Polynucleotide
taatacgactcactatagggcatccccactgccatacccaccatcgacagaacagaggagactgtcgatggtgggtatgaacctggcggcagcgcaaaagatg

SEQ ID NO: 3928 - DNA, 103 bp, Artificial Sequence
  Synthetic Polynucleotide
taatacgactcactatagggatgcacatccccactgccatacccaccatcaacagaggagagatggtatgtatggcagtaacctggcggcagcgcaaaagatg

SEQ ID NO: 3929 - DNA, 103 bp, Artificial Sequence
  Synthetic Polynucleotide
taatacgactcactatagggcacacatgcacatccccactgccatacccaaacagaggagatgggtaatgcagtggggaaacctggcggcagcgcaaaagatg

SEQ ID NO: 3930 - DNA, 103 bp, Artificial Sequence
  Synthetic Polynucleotide
taatacgactcactatagggtcgtgcacacatgcacatccccactgccataacagaggagaatggcaatggggatgtgcaacctggcggcagcgcaaaagatg

SEQ ID NO: 3931 - DNA, 103 bp, Artificial Sequence
  Synthetic Polynucleotide
taatacgactcactataggggggttaccgcataccctgtggtttttccgtaacagaggagaacggaaatgccacagggtaacctggcggcagcgcaaaagatg

SEQ ID NO: 3932 - DNA, 103 bp, Artificial Sequence
  Synthetic Polynucleotide
taatacgactcactatagggctgcgtcgtgcacacatgcacatccccactaacagaggagaagtgggatggtgcatgtgaacctggcggcagcgcaaaagatg

SEQ ID NO: 3933 - DNA, 103 bp, Artificial Sequence
  Synthetic Polynucleotide
taatacgactcactatagggtgcatctgcgtcgtgcacacatgcacatccaacagaggagaggatgtatgtgtgtgcacaacctggcggcagcgcaaaagatg

SEQ ID NO: 3934 - DNA, 103 bp, Artificial Sequence
  Synthetic Polynucleotide
taatacgactcactatagggtgtgatgcatctgcgtcgtgcacacatgcaaacagaggagatgcatgatggcacgacgcaacctggcggcagcgcaaaagatg

SEQ ID NO: 3935 - DNA, 103 bp, Artificial Sequence
  Synthetic Polynucleotide
taatacgactcactatagggtatggtgtgatgcatctgcgtcgtgcacacaacagaggagagtgtgcatgacgcagatgaacctggcggcagcgcaaaagatg

SEQ ID NO: 3936 - DNA, 103 bp, Artificial Sequence
  Synthetic Polynucleotide
taatacgactcactataggggttcgtatggtgtgatgcatctgcgtcgtgaacagaggagacacgacatggatgcatcaaacctggcggcagcgcaaaagatg

SEQ ID NO: 3937 - DNA, 103 bp, Artificial Sequence
  Synthetic Polynucleotide
taatacgactcactatagggtgtcagttcgtatggtgtgatgcatctgcgaacagaggagacgcagaatgatcacaccaaacctggcggcagcgcaaaagatg

SEQ ID NO: 3938 - DNA, 103 bp, Artificial Sequence
  Synthetic Polynucleotide
taatacgactcactatagggcctggtgtcagttcgtatggtgtgatgcataacagaggagaatgcatatgaccatacgaaacctggcggcagcgcaaaagatg

SEQ ID NO: 3939 - DNA, 103 bp, Artificial Sequence
  Synthetic Polynucleotide
taatacgactcactatagggtagctcctggtgtcagttcgtatggtgtgaaacagaggagatcacacatgacgaactgaaacctggcggcagcgcaaaagatg

SEQ ID NO: 3940 - DNA, 103 bp, Artificial Sequence
  Synthetic Polynucleotide
taatacgactcactataggggacggtagctcctggtgtcagttcgtatggaacagaggagaccatacatgctgacaccaaacctggcggcagcgcaaaagatg

SEQ ID NO: 3941 - DNA, 103 bp, Artificial Sequence
  Synthetic Polynucleotide
taatacgactcactatagggaaagggacggtagctcctggtgtcagttcgaacagaggagacgaactatgaccaggagcaacctggcggcagcgcaaaagatg

SEQ ID NO: 3942 - DNA, 103 bp, Artificial Sequence
  Synthetic Polynucleotide
taatacgactcactataggggtggtgggttaccgcataccctgtggttttaacagaggagaaaaaccatggggtatgcgaacctggcggcagcgcaaaagatg

SEQ ID NO: 3943 - DNA, 103 bp, Artificial Sequence
  Synthetic Polynucleotide
taatacgactcactataggggcaggaaagggacggtagctcctggtgtcaaacagaggagatgacacatggagctaccgaacctggcggcagcgcaaaagatg

SEQ ID NO: 3944 - DNA, 103 bp, Artificial Sequence
  Synthetic Polynucleotide
taatacgactcactataggggctaagcaggaaagggacggtagctcctggaacagaggagaccaggaatgaccgtccctaacctggcggcagcgcaaaagatg

SEQ ID NO: 3945 - DNA, 103 bp, Artificial Sequence
  Synthetic Polynucleotide
taatacgactcactatagggattaggctaagcaggaaagggacggtagctaacagaggagaagctacatgccctttcctaacctggcggcagcgcaaaagatg

SEQ ID NO: 3946 - DNA, 103 bp, Artificial Sequence
  Synthetic Polynucleotide
taatacgactcactatagggagcatattaggctaagcaggaaagggacggaacagaggagaccgtccatgtcctgcttaaacctggcggcagcgcaaaagatg

SEQ ID NO: 3947 - DNA, 103 bp, Artificial Sequence
  Synthetic Polynucleotide
taatacgactcactataggggatgcagcatattaggctaagcaggaaaggaacagaggagacctttcatgcttagcctaaacctggcggcagcgcaaaagatg

SEQ ID NO: 3948 - DNA, 103 bp, Artificial Sequence
  Synthetic Polynucleotide
taatacgactcactataggggttctgatgcagcatattaggctaagcaggaacagaggagacctgctatgcctaatatgaacctggcggcagcgcaaaagatg

SEQ ID NO: 3949 - DNA, 103 bp, Artificial Sequence
  Synthetic Polynucleotide
taatacgactcactatagggtagctgttctgatgcagcatattaggctaaaacagaggagattagccatgtatgctgcaaacctggcggcagcgcaaaagatg

SEQ ID NO: 3950 - DNA, 103 bp, Artificial Sequence
  Synthetic Polynucleotide
taatacgactcactatagggcgctttagctgttctgatgcagcatattagaacagaggagactaataatgtgcatcagaaacctggcggcagcgcaaaagatg

SEQ ID NO: 3951 - DNA, 103 bp, Artificial Sequence
  Synthetic Polynucleotide
taatacgactcactataggggtggccgctttagctgttctgatgcagcataacagaggagaatgctgatgcagaacagcaacctggcggcagcgcaaaagatg

SEQ ID NO: 3952 - DNA, 103 bp, Artificial Sequence
  Synthetic Polynucleotide
taatacgactcactatagggggtatgtggccgctttagctgttctgatgcaacagaggagagcatcaatgcagctaaagaacctggcggcagcgcaaaagatg

SEQ ID NO: 3953 - DNA, 103 bp, Artificial Sequence
  Synthetic Polynucleotide
taatacgactcactatagggtctgcgtggtgggttaccgcataccctgtgaacagaggagacacaggatgtgcggtaacaacctggcggcagcgcaaaagatg

SEQ ID NO: 3954 - DNA, 103 bp, Artificial Sequence
  Synthetic Polynucleotide
taatacgactcactatagggctcttggtatgtggccgctttagctgttctaacagaggagaagaacaatgaaagcggccaacctggcggcagcgcaaaagatg

SEQ ID NO: 3955 - DNA, 103 bp, Artificial Sequence
  Synthetic Polynucleotide
taatacgactcactataggggcagcctcttggtatgtggccgctttagctaacagaggagaagctaaatgggccacataaacctggcggcagcgcaaaagatg

SEQ ID NO: 3956 - DNA, 103 bp, Artificial Sequence
  Synthetic Polynucleotide
taatacgactcactatagggataccgcagcctcttggtatgtggccgcttaacagaggagaaagcggatgcataccaagaacctggcggcagcgcaaaagatg

SEQ ID NO: 3957 - DNA, 103 bp, Artificial Sequence
  Synthetic Polynucleotide
taatacgactcactatagggcaggtataccgcagcctcttggtatgtggcaacagaggagagccacaatgcaagaggctaacctggcggcagcgcaaaagatg

SEQ ID NO: 3958 - DNA, 103 bp, Artificial Sequence
  Synthetic Polynucleotide
taatacgactcactatagggttccacaggtataccgcagcctcttggtataacagaggagaataccaatgggctgcggtaacctggcggcagcgcaaaagatg

SEQ ID NO: 3959 - DNA, 103 bp, Artificial Sequence
  Synthetic Polynucleotide
taatacgactcactataggggctcgttccacaggtataccgcagcctcttaacagaggagaaagaggatgcggtataccaacctggcggcagcgcaaaagatg

SEQ ID NO: 3960 - DNA, 103 bp, Artificial Sequence
  Synthetic Polynucleotide
taatacgactcactatagggttgctgctcgttccacaggtataccgcagcaacagaggagagctgcgatgtacctgtggaacctggcggcagcgcaaaagatg

SEQ ID NO: 3961 - DNA, 103 bp, Artificial Sequence
  Synthetic Polynucleotide
taatacgactcactatagggaaaggttgctgctcgttccacaggtataccaacagaggagaggtataatggtggaacgaaacctggcggcagcgcaaaagatg

SEQ ID NO: 3962 - DNA, 103 bp, Artificial Sequence
  Synthetic Polynucleotide
taatacgactcactatagggaaaacaaaggttgctgctcgttccacaggtaacagaggagaacctgtatgacgagcagcaacctggcggcagcgcaaaagatg

SEQ ID NO: 3963 - DNA, 103 bp, Artificial Sequence
  Synthetic Polynucleotide
taatacgactcactatagggtagccaaaacaaaggttgctgctcgttccaaacagaggagatggaacatgcagcaacctaacctggcggcagcgcaaaagatg

SEQ ID NO: 3964 - DNA, 103 bp, Artificial Sequence
  Synthetic Polynucleotide
taatacgactcactatagggatccgtctgcgtggtgggttaccgcataccaacagaggagaggtatgatgtaacccaccaacctggcggcagcgcaaaagatg

SEQ ID NO: 3965 - DNA, 103 bp, Artificial Sequence
  Synthetic Polynucleotide
taatacgactcactataggggcttgtagccaaaacaaaggttgctgctcgaacagaggagacgagcaatgacctttgttaacctggcggcagcgcaaaagatg

SEQ ID NO: 3966 - DNA, 103 bp, Artificial Sequence
  Synthetic Polynucleotide
taatacgactcactatagggtaagggcttgtagccaaaacaaaggttgctaacagaggagaagcaacatgtgttttggcaacctggcggcagcgcaaaagatg

SEQ ID NO: 3967 - DNA, 103 bp, Artificial Sequence
  Synthetic Polynucleotide
taatacgactcactatagggcggaataagggcttgtagccaaaacaaaggaacagaggagacctttgatgtggctacaaaacctggcggcagcgcaaaagatg

SEQ ID NO: 3968 - DNA, 103 bp, Artificial Sequence
  Synthetic Polynucleotide
taatacgactcactataggggccagcggaataagggcttgtagccaaaacaacagaggagagttttgatgacaagccctaacctggcggcagcgcaaaagatg

SEQ ID NO: 3969 - DNA, 103 bp, Artificial Sequence
  Synthetic Polynucleotide
taatacgactcactataggggggctgccagcggaataagggcttgtagccaacagaggagaggctacatgcccttattcaacctggcggcagcgcaaaagatg

SEQ ID NO: 3970 - DNA, 103 bp, Artificial Sequence
  Synthetic Polynucleotide
taatacgactcactatagggaatcagggctgccagcggaataagggcttgaacagaggagacaagccatgattccgctgaacctggcggcagcgcaaaagatg

SEQ ID NO: 3971 - DNA, 103 bp, Artificial Sequence
  Synthetic Polynucleotide
taatacgactcactatagggaggacaatcagggctgccagcggaataaggaacagaggagaccttatatggctggcagcaacctggcggcagcgcaaaagatg

SEQ ID NO: 3972 - DNA, 103 bp, Artificial Sequence
  Synthetic Polynucleotide
taatacgactcactatagggtgcataggacaatcagggctgccagcggaaaacagaggagattccgcatgcagccctgaaacctggcggcagcgcaaaagatg

SEQ ID NO: 3973 - DNA, 103 bp, Artificial Sequence
  Synthetic Polynucleotide
taatacgactcactatagggacagttgcataggacaatcagggctgccagaacagaggagactggcaatgctgattgtcaacctggcggcagcgcaaaagatg

SEQ ID NO: 3974 - DNA, 103 bp, Artificial Sequence
  Synthetic Polynucleotide
taatacgactcactatagggctcagacagttgcataggacaatcagggctaacagaggagaagccctatgtgtcctatgaacctggcggcagcgcaaaagatg

SEQ ID NO: 3975 - DNA, 103 bp, Artificial Sequence
  Synthetic Polynucleotide
taatacgactcactatagggcaggaatccgtctgcgtggtgggttaccgcaacagaggagagcggtaatgcaccacgcaaacctggcggcagcgcaaaagatg

SEQ ID NO: 3976 - DNA, 103 bp, Artificial Sequence
  Synthetic Polynucleotide
taatacgactcactatagggagagtctcagacagttgcataggacaatcaaacagaggagatgattgatgtatgcaactaacctggcggcagcgcaaaagatg

SEQ ID NO: 3977 - DNA, 103 bp, Artificial Sequence
  Synthetic Polynucleotide
taatacgactcactatagggtggtaagagtctcagacagttgcataggacaacagaggagagtcctaatgaactgtctgaacctggcggcagcgcaaaagatg

SEQ ID NO: 3978 - DNA, 103 bp, Artificial Sequence
  Synthetic Polynucleotide
taatacgactcactatagggcagcatggtaagagtctcagacagttgcataacagaggagaatgcaaatgtctgagactaacctggcggcagcgcaaaagatg

SEQ ID NO: 3979 - DNA, 103 bp, Artificial Sequence
  Synthetic Polynucleotide
taatacgactcactatagggtacaacagcatggtaagagtctcagacagtaacagaggagaactgtcatggactcttacaacctggcggcagcgcaaaagatg

SEQ ID NO: 3980 - DNA, 103 bp, Artificial Sequence
  Synthetic Polynucleotide
taatacgactcactatagggcgttttacaacagcatggtaagagtctcagaacagaggagactgagaatgttaccatgcaacctggcggcagcgcaaaagatg

SEQ ID NO: 3981 - DNA, 103 bp, Artificial Sequence
  Synthetic Polynucleotide
taatacgactcactataggggccaacgttttacaacagcatggtaagagtaacagaggagaactcttatgatgctgttgaacctggcggcagcgcaaaagatg

SEQ ID NO: 3982 - DNA, 103 bp, Artificial Sequence
  Synthetic Polynucleotide
taatacgactcactatagggaaaaagccaacgttttacaacagcatggtaaacagaggagataccatatggttgtaaaaaacctggcggcagcgcaaaagatg

SEQ ID NO: 3983 - DNA, 103 bp, Artificial Sequence
  Synthetic Polynucleotide
taatacgactcactatagggggctaaaaaagccaacgttttacaacagcaaacagaggagatgctgtatgaaaacgttgaacctggcggcagcgcaaaagatg

SEQ ID NO: 3984 - DNA, 103 bp, Artificial Sequence
  Synthetic Polynucleotide
taatacgactcactatagggattacggctaaaaaagccaacgttttacaaaacagaggagattgtaaatggttggctttaacctggcggcagcgcaaaagatg

SEQ ID NO: 3985 - DNA, 103 bp, Artificial Sequence
  Synthetic Polynucleotide
taatacgactcactatagggtgctcattacggctaaaaaagccaacgtttaacagaggagaaaacgtatgcttttttagaacctggcggcagcgcaaaagatg

SEQ ID NO: 3986 - DNA, 103 bp, Artificial Sequence
  Synthetic Polynucleotide
taatacgactcactatagggcacatcaggaatccgtctgcgtggtgggttaacagaggagaaacccaatgcgcagacggaacctggcggcagcgcaaaagatg

SEQ ID NO: 3987 - DNA, 103 bp, Artificial Sequence
  Synthetic Polynucleotide
taatacgactcactatagggaccgatgctcattacggctaaaaaagccaaaacagaggagattggctatgttagccgtaaacctggcggcagcgcaaaagatg

SEQ ID NO: 3988 - DNA, 103 bp, Artificial Sequence
  Synthetic Polynucleotide
taatacgactcactatagggtgggcaccgatgctcattacggctaaaaaaaacagaggagattttttatgcgtaatgagaacctggcggcagcgcaaaagatg

SEQ ID NO: 3989 - DNA, 103 bp, Artificial Sequence
  Synthetic Polynucleotide
taatacgactcactatagggcagtgtgggcaccgatgctcattacggctaaacagaggagatagccgatgtgagcatcgaacctggcggcagcgcaaaagatg

SEQ ID NO: 3990 - DNA, 103 bp, Artificial Sequence
  Synthetic Polynucleotide
taatacgactcactataggggctcacagtgtgggcaccgatgctcattacaacagaggagagtaatgatgatcggtgccaacctggcggcagcgcaaaagatg

SEQ ID NO: 3991 - DNA, 103 bp, Artificial Sequence
  Synthetic Polynucleotide
taatacgactcactatagggtacgcgctcacagtgtgggcaccgatgctcaacagaggagagagcatatgtgcccacacaacctggcggcagcgcaaaagatg

SEQ ID NO: 3992 - DNA, 103 bp, Artificial Sequence
  Synthetic Polynucleotide
taatacgactcactataggggttcgtacgcgctcacagtgtgggcaccgaaacagaggagatcggtgatgacactgtgaaacctggcggcagcgcaaaagatg

SEQ ID NO: 3993 - DNA, 103 bp, Artificial Sequence
  Synthetic Polynucleotide
taatacgactcactatagggtacgtgttcgtacgcgctcacagtgtgggcaacagaggagagcccacatggtgagcgcgaacctggcggcagcgcaaaagatg

SEQ ID NO: 3994 - DNA, 103 bp, Artificial Sequence
  Synthetic Polynucleotide
taatacgactcactatagggactgttacgtgttcgtacgcgctcacagtgaacagaggagacactgtatgcgcgtacgaaacctggcggcagcgcaaaagatg

SEQ ID NO: 3995 - DNA, 103 bp, Artificial Sequence
  Synthetic Polynucleotide
taatacgactcactatagggggatcactgttacgtgttcgtacgcgctcaaacagaggagatgagcgatgacgaacacgaacctggcggcagcgcaaaagatg

SEQ ID NO: 3996 - DNA, 103 bp, Artificial Sequence
  Synthetic Polynucleotide
taatacgactcactataggggttcgggatcactgttacgtgttcgtacgcaacagaggagagcgtacatgcacgtaacaaacctggcggcagcgcaaaagatg

SEQ ID NO: 3997 - DNA, 103 bp, Artificial Sequence
  Synthetic Polynucleotide
taatacgactcactataggggaaactggtaggctacgtgtgtctcacgcaaacagaggagatgcgtgatgcacacgtagaacctggcggcagcgcaaaagatg

SEQ ID NO: 3998 - DNA, 103 bp, Artificial Sequence
  Synthetic Polynucleotide
taatacgactcactatagggccttcaaaaaggcgctgtcagcgtctatgtaacagaggagaacatagatgctgacagcgaacctggcggcagcgcaaaagatg

SEQ ID NO: 3999 - DNA, 103 bp, Artificial Sequence
  Synthetic Polynucleotide
taatacgactcactatagggtcttgcacatcaggaatccgtctgcgtggtaacagaggagaaccacgatgacggattccaacctggcggcagcgcaaaagatg

SEQ ID NO: 4000 - DNA, 103 bp, Artificial Sequence
  Synthetic Polynucleotide
taatacgactcactatagggaccgtgttcgggatcactgttacgtgttcgaacagaggagacgaacaatgaacagtgataacctggcggcagcgcaaaagatg

SEQ ID NO: 4001 - DNA, 103 bp, Artificial Sequence
  Synthetic Polynucleotide
taatacgactcactatagggctcccaccgtgttcgggatcactgttacgtaacagaggagaacgtaaatgtgatcccgaaacctggcggcagcgcaaaagatg

SEQ ID NO: 4002 - DNA, 103 bp, Artificial Sequence
  Synthetic Polynucleotide
taatacgactcactatagggcggtactcccaccgtgttcgggatcactgtaacagaggagaacagtgatgccgaacacgaacctggcggcagcgcaaaagatg

SEQ ID NO: 4003 - DNA, 103 bp, Artificial Sequence
  Synthetic Polynucleotide
taatacgactcactatagggttatacggtactcccaccgtgttcgggatcaacagaggagagatcccatgcacggtgggaacctggcggcagcgcaaaagatg

SEQ ID NO: 4004 - DNA, 103 bp, Artificial Sequence
  Synthetic Polynucleotide
taatacgactcactataggggagtcttatacggtactcccaccgtgttcgaacagaggagacgaacaatgtgggagtacaacctggcggcagcgcaaaagatg

SEQ ID NO: 4005 - DNA, 103 bp, Artificial Sequence
  Synthetic Polynucleotide
taatacgactcactataggggactagagtcttatacggtactcccaccgtaacagaggagaacggtgatggtaccgtataacctggcggcagcgcaaaagatg

SEQ ID NO: 4006 - DNA, 103 bp, Artificial Sequence
  Synthetic Polynucleotide
taatacgactcactatagggctgttgactagagtcttatacggtactcccaacagaggagagggagtatggtataagacaacctggcggcagcgcaaaagatg

SEQ ID NO: 4007 - DNA, 103 bp, Artificial Sequence
  Synthetic Polynucleotide
taatacgactcactatagggccggtctgttgactagagtcttatacggtaaacagaggagataccgtatgagactctagaacctggcggcagcgcaaaagatg

SEQ ID NO: 4008 - DNA, 103 bp, Artificial Sequence
  Synthetic Polynucleotide
taatacgactcactataggggtagcccggtctgttgactagagtcttataaacagaggagatataagatgctagtcaacaacctggcggcagcgcaaaagatg

SEQ ID NO: 4009 - DNA, 103 bp, Artificial Sequence
  Synthetic Polynucleotide
taatacgactcactataggggggctgtagcccggtctgttgactagagtcaacagaggagagactctatgcaacagaccaacctggcggcagcgcaaaagatg

SEQ ID NO: 4010 - DNA, 103 bp, Artificial Sequence
  Synthetic Polynucleotide
taatacgactcactatagggggtggtcttgcacatcaggaatccgtctgcaacagaggagagcagacatgttcctgatgaacctggcggcagcgcaaaagatg

SEQ ID NO: 4011 - DNA, 103 bp, Artificial Sequence
  Synthetic Polynucleotide
taatacgactcactatagggccatggggctgtagcccggtctgttgactaaacagaggagatagtcaatggaccgggctaacctggcggcagcgcaaaagatg

SEQ ID NO: 4012 - DNA, 103 bp, Artificial Sequence
  Synthetic Polynucleotide
taatacgactcactatagggcagtaccatggggctgtagcccggtctgttaacagaggagaaacagaatgggctacagcaacctggcggcagcgcaaaagatg

SEQ ID NO: 4013 - DNA, 103 bp, Artificial Sequence
  Synthetic Polynucleotide
taatacgactcactatagggatctccagtaccatggggctgtagcccggtaacagaggagaaccgggatgcagccccataacctggcggcagcgcaaaagatg

SEQ ID NO: 4014 - DNA, 103 bp, Artificial Sequence
  Synthetic Polynucleotide
taatacgactcactataggggctccatctccagtaccatggggctgtagcaacagaggagagctacaatgccatggtacaacctggcggcagcgcaaaagatg

SEQ ID NO: 4015 - DNA, 103 bp, Artificial Sequence
  Synthetic Polynucleotide
taatacgactcactatagggcagtagctccatctccagtaccatggggctaacagaggagaagccccatggtactggagaacctggcggcagcgcaaaagatg

SEQ ID NO: 4016 - DNA, 103 bp, Artificial Sequence
  Synthetic Polynucleotide
taatacgactcactatagggactgacagtagctccatctccagtaccatgaacagaggagacatggtatgggagatggaaacctggcggcagcgcaaaagatg

SEQ ID NO: 4017 - DNA, 103 bp, Artificial Sequence
  Synthetic Polynucleotide
taatacgactcactatagggaagtgactgacagtagctccatctccagtaaacagaggagatactggatgtggagctacaacctggcggcagcgcaaaagatg

SEQ ID NO: 4018 - DNA, 103 bp, Artificial Sequence
  Synthetic Polynucleotide
taatacgactcactatagggctccaaagtgactgacagtagctccatctcaacagaggagagagatgatgctactgtcaaacctggcggcagcgcaaaagatg

SEQ ID NO: 4019 - DNA, 103 bp, Artificial Sequence
  Synthetic Polynucleotide
taatacgactcactataggggttggctccaaagtgactgacagtagctccaacagaggagaggagctatggtcagtcacaacctggcggcagcgcaaaagatg

SEQ ID NO: 4020 - DNA, 103 bp, Artificial Sequence
  Synthetic Polynucleotide
taatacgactcactatagggatagcgttggctccaaagtgactgacagtaaacagaggagatactgtatgtcactttggaacctggcggcagcgcaaaagatg

SEQ ID NO: 4021 - DNA, 103 bp, Artificial Sequence
  Synthetic Polynucleotide
taatacgactcactataggggtgtcggtggtcttgcacatcaggaatccgaacagaggagacggattatggatgtgcaaaacctggcggcagcgcaaaagatg

SEQ ID NO: 4022 - DNA, 103 bp, Artificial Sequence
  Synthetic Polynucleotide
taatacgactcactatagggaagcgatagcgttggctccaaagtgactgaaacagaggagatcagtcatgttggagccaaacctggcggcagcgcaaaagatg

SEQ ID NO: 4023 - DNA, 103 bp, Artificial Sequence
  Synthetic Polynucleotide
taatacgactcactatagggtaatcaagcgatagcgttggctccaaagtgaacagaggagacactttatggccaacgctaacctggcggcagcgcaaaagatg

SEQ ID NO: 4024 - DNA, 103 bp, Artificial Sequence
  Synthetic Polynucleotide
taatacgactcactatagggtgatgtaatcaagcgatagcgttggctccaaacagaggagatggagcatgcgctatcgcaacctggcggcagcgcaaaagatg

SEQ ID NO: 4025 - DNA, 103 bp, Artificial Sequence
  Synthetic Polynucleotide
taatacgactcactataggggcacgtgatgtaatcaagcgatagcgttggaacagaggagaccaacgatgtcgcttgataacctggcggcagcgcaaaagatg

SEQ ID NO: 4026 - DNA, 103 bp, Artificial Sequence
  Synthetic Polynucleotide
taatacgactcactatagggtattcgcacgtgatgtaatcaagcgatagcaacagaggagagctatcatgtgattacataacctggcggcagcgcaaaagatg

SEQ ID NO: 4027 - DNA, 103 bp, Artificial Sequence
  Synthetic Polynucleotide
taatacgactcactatagggttttgtattcgcacgtgatgtaatcaagcgaacagaggagacgcttgatgacatcacgtaacctggcggcagcgcaaaagatg

SEQ ID NO: 4028 - DNA, 103 bp, Artificial Sequence
  Synthetic Polynucleotide
taatacgactcactataggggacggttttgtattcgcacgtgatgtaatcaacagaggagagattacatgacgtgcgaaaacctggcggcagcgcaaaagatg

SEQ ID NO: 4029 - DNA, 103 bp, Artificial Sequence
  Synthetic Polynucleotide
taatacgactcactataggggggatgacggttttgtattcgcacgtgatgaacagaggagacatcacatgcgaatacaaaacctggcggcagcgcaaaagatg

SEQ ID NO: 4030 - DNA, 103 bp, Artificial Sequence
  Synthetic Polynucleotide
taatacgactcactataggggagacgggatgacggttttgtattcgcacgaacagaggagacgtgcgatgacaaaaccgaacctggcggcagcgcaaaagatg

SEQ ID NO: 4031 - DNA, 103 bp, Artificial Sequence
  Synthetic Polynucleotide
taatacgactcactataggggtacggagacgggatgacggttttgtattcaacagaggagagaatacatgaccgtcatcaacctggcggcagcgcaaaagatg

SEQ ID NO: 4032 - DNA, 103 bp, Artificial Sequence
  Synthetic Polynucleotide
taatacgactcactatagggcaaccgtgtcggtggtcttgcacatcaggaaacagaggagatcctgaatggcaagaccaaacctggcggcagcgcaaaagatg

SEQ ID NO: 4033 - DNA, 103 bp, Artificial Sequence
  Synthetic Polynucleotide
taatacgactcactatagggttcacgtacggagacgggatgacggttttgaacagaggagacaaaacatgcatcccgtcaacctggcggcagcgcaaaagatg

SEQ ID NO: 4034 - DNA, 103 bp, Artificial Sequence
  Synthetic Polynucleotide
taatacgactcactatagggagcatttcacgtacggagacgggatgacggaacagaggagaccgtcaatgcgtctccgtaacctggcggcagcgcaaaagatg

SEQ ID NO: 4035 - DNA, 103 bp, Artificial Sequence
  Synthetic Polynucleotide
taatacgactcactatagggaccgcagcatttcacgtacggagacgggataacagaggagaatcccgatgccgtacgtgaacctggcggcagcgcaaaagatg

SEQ ID NO: 4036 - DNA, 103 bp, Artificial Sequence
  Synthetic Polynucleotide
taatacgactcactataggggctgtaccgcagcatttcacgtacggagacaacagaggagagtctccatgcgtgaaatgaacctggcggcagcgcaaaagatg

SEQ ID NO: 4037 - DNA, 103 bp, Artificial Sequence
  Synthetic Polynucleotide
taatacgactcactatagggactctgctgtaccgcagcatttcacgtacgaacagaggagacgtacgatgaatgctgcgaacctggcggcagcgcaaaagatg

SEQ ID NO: 4038 - DNA, 103 bp, Artificial Sequence
  Synthetic Polynucleotide
taatacgactcactatagggcttgcactctgctgtaccgcagcatttcacaacagaggagagtgaaaatgtgcggtacaaacctggcggcagcgcaaaagatg

SEQ ID NO: 4039 - DNA, 103 bp, Artificial Sequence
  Synthetic Polynucleotide
taatacgactcactatagggttgtccttgcactctgctgtaccgcagcataacagaggagaatgctgatgtacagcagaaacctggcggcagcgcaaaagatg

SEQ ID NO: 4040 - DNA, 103 bp, Artificial Sequence
  Synthetic Polynucleotide
taatacgactcactatagggggtttttgtccttgcactctgctgtaccgcaacagaggagagcggtaatgcagagtgcaaacctggcggcagcgcaaaagatg

SEQ ID NO: 4041 - DNA, 103 bp, Artificial Sequence
  Synthetic Polynucleotide
taatacgactcactatagggaggtaggtttttgtccttgcactctgctgtaacagaggagaacagcaatgtgcaaggacaacctggcggcagcgcaaaagatg

SEQ ID NO: 4042 - DNA, 103 bp, Artificial Sequence
  Synthetic Polynucleotide
taatacgactcactatagggtagtcaggtaggtttttgtccttgcactctaacagaggagaagagtgatgggacaaaaaaacctggcggcagcgcaaaagatg

SEQ ID NO: 4043 - DNA, 103 bp, Artificial Sequence
  Synthetic Polynucleotide
taatacgactcactataggggccgtcaaccgtgtcggtggtcttgcacataacagaggagaatgtgcatgaccaccgacaacctggcggcagcgcaaaagatg

SEQ ID NO: 4044 - DNA, 103 bp, Artificial Sequence
  Synthetic Polynucleotide
taatacgactcactatagggagctgtagtcaggtaggtttttgtccttgcaacagaggagagcaaggatgaaaacctacaacctggcggcagcgcaaaagatg

SEQ ID NO: 4045 - DNA, 103 bp, Artificial Sequence
  Synthetic Polynucleotide
taatacgactcactatagggcttacagctgtagtcaggtaggtttttgtcaacagaggagagacaaaatgctacctgacaacctggcggcagcgcaaaagatg

SEQ ID NO: 4046 - DNA, 103 bp, Artificial Sequence
  Synthetic Polynucleotide
taatacgactcactatagggaagaccttacagctgtagtcaggtaggtttaacagaggagaaaacctatgtgactacagaacctggcggcagcgcaaaagatg

SEQ ID NO: 4047 - DNA, 103 bp, Artificial Sequence
  Synthetic Polynucleotide
taatacgactcactatagggcggtgaagaccttacagctgtagtcaggtaaacagaggagatacctgatgacagctgtaaacctggcggcagcgcaaaagatg

SEQ ID NO: 4048 - DNA, 103 bp, Artificial Sequence
  Synthetic Polynucleotide
taatacgactcactataggggacgccggtgaagaccttacagctgtagtcaacagaggagagactacatgtgtaaggtcaacctggcggcagcgcaaaagatg

SEQ ID NO: 4049 - DNA, 103 bp, Artificial Sequence
  Synthetic Polynucleotide
taatacgactcactataggggggtagacgccggtgaagaccttacagctgaacagaggagacagctgatgggtcttcacaacctggcggcagcgcaaaagatg

SEQ ID NO: 4050 - DNA, 103 bp, Artificial Sequence
  Synthetic Polynucleotide
taatacgactcactatagggtaaatgggtagacgccggtgaagaccttacaacagaggagagtaaggatgtcaccggcgaacctggcggcagcgcaaaagatg

SEQ ID NO: 4051 - DNA, 103 bp, Artificial Sequence
  Synthetic Polynucleotide
taatacgactcactatagggccacataaatgggtagacgccggtgaagacaacagaggagagtcttcatgggcgtctacaacctggcggcagcgcaaaagatg

SEQ ID NO: 4052 - DNA, 103 bp, Artificial Sequence
  Synthetic Polynucleotide
taatacgactcactatagggccgccccacataaatgggtagacgccggtgaacagaggagacaccggatgctacccattaacctggcggcagcgcaaaagatg

SEQ ID NO: 4053 - DNA, 103 bp, Artificial Sequence
  Synthetic Polynucleotide
taatacgactcactatagggaggcgccgccccacataaatgggtagacgcaacagaggagagcgtctatgcatttatgtaacctggcggcagcgcaaaagatg

SEQ ID NO: 4054 - DNA, 103 bp, Artificial Sequence
  Synthetic Polynucleotide
taatacgactcactatagggctttcgccgtcaaccgtgtcggtggtcttgaacagaggagacaagacatgcgacacggtaacctggcggcagcgcaaaagatg

SEQ ID NO: 4055 - DNA, 103 bp, Artificial Sequence
  Synthetic Polynucleotide
taatacgactcactataggggcagtaggcgccgccccacataaatgggtaaacagaggagatacccaatgatgtggggcaacctggcggcagcgcaaaagatg

SEQ ID NO: 4056 - DNA, 103 bp, Artificial Sequence
  Synthetic Polynucleotide
taatacgactcactatagggcagaagcagtaggcgccgccccacataaataacagaggagaatttatatggggcggcgcaacctggcggcagcgcaaaagatg

SEQ ID NO: 4057 - DNA, 103 bp, Artificial Sequence
  Synthetic Polynucleotide
taatacgactcactatagggcgtcgcagaagcagtaggcgccgccccacaaacagaggagatgtgggatggcgcctactaacctggcggcagcgcaaaagatg

SEQ ID NO: 4058 - DNA, 103 bp, Artificial Sequence
  Synthetic Polynucleotide
taatacgactcactatagggttcagcgtcgcagaagcagtaggcgccgccaacagaggagaggcggcatgtactgcttcaacctggcggcagcgcaaaagatg

SEQ ID NO: 4059 - DNA, 103 bp, Artificial Sequence
  Synthetic Polynucleotide
taatacgactcactataggggtgttttcagcgtcgcagaagcagtaggcgaacagaggagacgcctaatgcttctgcgaaacctggcggcagcgcaaaagatg

SEQ ID NO: 4060 - DNA, 103 bp, Artificial Sequence
  Synthetic Polynucleotide
taatacgactcactatagggattgcgtgttttcagcgtcgcagaagcagtaacagaggagaactgctatggcgacgctgaacctggcggcagcgcaaaagatg

SEQ ID NO: 4061 - DNA, 103 bp, Artificial Sequence
  Synthetic Polynucleotide
taatacgactcactataggggctcaattgcgtgttttcagcgtcgcagaaaacagaggagattctgcatggctgaaaacaacctggcggcagcgcaaaagatg

SEQ ID NO: 4062 - DNA, 103 bp, Artificial Sequence
  Synthetic Polynucleotide
taatacgactcactataggggcttcgctcaattgcgtgttttcagcgtcgaacagaggagacgacgcatgaaacacgcaaacctggcggcagcgcaaaagatg

SEQ ID NO: 4063 - DNA, 103 bp, Artificial Sequence
  Synthetic Polynucleotide
taatacgactcactatagggcatgtgcttcgctcaattgcgtgttttcagaacagaggagactgaaaatgcgcaattgaaacctggcggcagcgcaaaagatg

SEQ ID NO: 4064 - DNA, 103 bp, Artificial Sequence
  Synthetic Polynucleotide
taatacgactcactatagggctccacatgtgcttcgctcaattgcgtgttaacagaggagaaacacgatgttgagcgaaaacctggcggcagcgcaaaagatg

SEQ ID NO: 4065 - DNA, 103 bp, Artificial Sequence
  Synthetic Polynucleotide
taatacgactcactatagggacactctttcgccgtcaaccgtgtcggtggaacagaggagaccaccgatgcggttgacgaacctggcggcagcgcaaaagatg

SEQ ID NO: 4066 - DNA, 103 bp, Artificial Sequence
  Synthetic Polynucleotide
taatacgactcactataggggacttctccacatgtgcttcgctcaattgcaacagaggagagcaattatgcgaagcacaaacctggcggcagcgcaaaagatg

SEQ ID NO: 4067 - DNA, 103 bp, Artificial Sequence
  Synthetic Polynucleotide
taatacgactcactatagggattcggacttctccacatgtgcttcgctcaaacagaggagatgagcgatgcacatgtggaacctggcggcagcgcaaaagatg

SEQ ID NO: 4068 - DNA, 103 bp, Artificial Sequence
  Synthetic Polynucleotide
taatacgactcactataggggcatgattcggacttctccacatgtgcttcaacagaggagagaagcaatggtggagaagaacctggcggcagcgcaaaagatg

SEQ ID NO: 4069 - DNA, 103 bp, Artificial Sequence
  Synthetic Polynucleotide
taatacgactcactataggggttttgcatgattcggacttctccacatgtaacagaggagaacatgtatggaagtccgaaacctggcggcagcgcaaaagatg

SEQ ID NO: 4070 - DNA, 103 bp, Artificial Sequence
  Synthetic Polynucleotide
taatacgactcactatagggattctgttttgcatgattcggacttctccaaacagaggagatggagaatgccgaatcataacctggcggcagcgcaaaagatg

SEQ ID NO: 4071 - DNA, 103 bp, Artificial Sequence
  Synthetic Polynucleotide
taatacgactcactatagggtgcaaattctgttttgcatgattcggacttaacagaggagaaagtccatgtcatgcaaaaacctggcggcagcgcaaaagatg

SEQ ID NO: 4072 - DNA, 103 bp, Artificial Sequence
  Synthetic Polynucleotide
taatacgactcactataggggctgatgcaaattctgttttgcatgattcgaacagaggagacgaatcatgcaaaacagaaacctggcggcagcgcaaaagatg

SEQ ID NO: 4073 - DNA, 103 bp, Artificial Sequence
  Synthetic Polynucleotide
taatacgactcactatagggtgtatgctgatgcaaattctgttttgcatgaacagaggagacatgcaatgcagaatttgaacctggcggcagcgcaaaagatg

SEQ ID NO: 4074 - DNA, 103 bp, Artificial Sequence
  Synthetic Polynucleotide
taatacgactcactatagggagccctgtatgctgatgcaaattctgttttaacagaggagaaaaacaatgtttgcatcaaacctggcggcagcgcaaaagatg

SEQ ID NO: 4075 - DNA, 103 bp, Artificial Sequence
  Synthetic Polynucleotide
taatacgactcactataggggtatgagccctgtatgctgatgcaaattctaacagaggagaagaattatgatcagcataaacctggcggcagcgcaaaagatg

SEQ ID NO: 4076 - DNA, 103 bp, Artificial Sequence
  Synthetic Polynucleotide
taatacgactcactataggggaatgacactctttcgccgtcaaccgtgtcaacagaggagagacacgatggacggcgaaaacctggcggcagcgcaaaagatg

SEQ ID NO: 4077 - DNA, 103 bp, Artificial Sequence
  Synthetic Polynucleotide
taatacgactcactatagggatgcggtatgagccctgtatgctgatgcaaaacagaggagattgcatatgcatacagggaacctggcggcagcgcaaaagatg

SEQ ID NO: 4078 - DNA, 103 bp, Artificial Sequence
  Synthetic Polynucleotide
taatacgactcactatagggtgcggatgcggtatgagccctgtatgctgaaacagaggagatcagcaatgagggctcataacctggcggcagcgcaaaagatg

SEQ ID NO: 4079 - DNA, 103 bp, Artificial Sequence
  Synthetic Polynucleotide
taatacgactcactataggggctgatgcggatgcggtatgagccctgtataacagaggagaatacagatgtcataccgcaacctggcggcagcgcaaaagatg

SEQ ID NO: 4080 - DNA, 103 bp, Artificial Sequence
  Synthetic Polynucleotide
taatacgactcactataggggcttagctgatgcggatgcggtatgagcccaacagaggagagggctcatgccgcatccgaacctggcggcagcgcaaaagatg

SEQ ID NO: 4081 - DNA, 103 bp, Artificial Sequence
  Synthetic Polynucleotide
taatacgactcactataggggcggagcttagctgatgcggatgcggtatgaacagaggagacataccatgtccgcatcaaacctggcggcagcgcaaaagatg

SEQ ID NO: 4082 - DNA, 103 bp, Artificial Sequence
  Synthetic Polynucleotide
taatacgactcactatagggaggacgcggagcttagctgatgcggatgcgaacagaggagacgcatcatgatcagctaaaacctggcggcagcgcaaaagatg

SEQ ID NO: 4083 - DNA, 103 bp, Artificial Sequence
  Synthetic Polynucleotide
taatacgactcactatagggggtaaaggacgcggagcttagctgatgcggaacagaggagaccgcatatgctaagctccaacctggcggcagcgcaaaagatg

SEQ ID NO: 4084 - DNA, 103 bp, Artificial Sequence
  Synthetic Polynucleotide
taatacgactcactatagggtccttggtaaaggacgcggagcttagctgaaacagaggagatcagctatgctccgcgtcaacctggcggcagcgcaaaagatg

SEQ ID NO: 4085 - DNA, 103 bp, Artificial Sequence
  Synthetic Polynucleotide
taatacgactcactatagggttatttccttggtaaaggacgcggagcttaaacagaggagataagctatgcgtcctttaaacctggcggcagcgcaaaagatg

SEQ ID NO: 4086 - DNA, 103 bp, Artificial Sequence
  Synthetic Polynucleotide
taatacgactcactatagggtgatgttatttccttggtaaaggacgcggaaacagaggagatccgcgatgtttaccaagaacctggcggcagcgcaaaagatg

SEQ ID NO: 4087 - DNA, 103 bp, Artificial Sequence
  Synthetic Polynucleotide
taatacgactcactatagggaccgagaatgacactctttcgccgtcaaccaacagaggagaggttgaatgcgaaagagtaacctggcggcagcgcaaaagatg

SEQ ID NO: 4088 - DNA, 103 bp, Artificial Sequence
  Synthetic Polynucleotide
taatacgactcactatagggtacagtgatgttatttccttggtaaaggacaacagaggagagtccttatgcaaggaaataacctggcggcagcgcaaaagatg

SEQ ID NO: 4089 - DNA, 103 bp, Artificial Sequence
  Synthetic Polynucleotide
taatacgactcactataggggcagttacagtgatgttatttccttggtaaaacagaggagattaccaatgaaataacataacctggcggcagcgcaaaagatg

SEQ ID NO: 4090 - DNA, 103 bp, Artificial Sequence
  Synthetic Polynucleotide
taatacgactcactatagggcataggcagttacagtgatgttatttccttaacagaggagaaaggaaatgacatcactgaacctggcggcagcgcaaaagatg

SEQ ID NO: 4091 - DNA, 103 bp, Artificial Sequence
  Synthetic Polynucleotide
taatacgactcactataggggtttgcataggcagttacagtgatgttattaacagaggagaaataacatgactgtaactaacctggcggcagcgcaaaagatg

SEQ ID NO: 4092 - DNA, 103 bp, Artificial Sequence
  Synthetic Polynucleotide
taatacgactcactatagggtcgccgtttgcataggcagttacagtgatgaacagaggagacatcacatgaactgcctaaacctggcggcagcgcaaaagatg

SEQ ID NO: 4093 - DNA, 103 bp, Artificial Sequence
  Synthetic Polynucleotide
taatacgactcactatagggcatggtcgccgtttgcataggcagttacagaacagaggagactgtaaatgcctatgcaaaacctggcggcagcgcaaaagatg

SEQ ID NO: 4094 - DNA, 103 bp, Artificial Sequence
  Synthetic Polynucleotide
taatacgactcactataggggacggcatggtcgccgtttgcataggcagtaacagaggagaactgccatggcaaacggcaacctggcggcagcgcaaaagatg

SEQ ID NO: 4095 - DNA, 103 bp, Artificial Sequence
  Synthetic Polynucleotide
taatacgactcactatagggactgtgacggcatggtcgccgtttgcatagaacagaggagactatgcatgcggcgaccaaacctggcggcagcgcaaaagatg

SEQ ID NO: 4096 - DNA, 103 bp, Artificial Sequence
  Synthetic Polynucleotide
taatacgactcactatagggccttaactgtgacggcatggtcgccgtttgaacagaggagacaaacgatgaccatgccgaacctggcggcagcgcaaaagatg

SEQ ID NO: 4097 - DNA, 103 bp, Artificial Sequence
  Synthetic Polynucleotide
taatacgactcactatagggggcgtccttaactgtgacggcatggtcgccaacagaggagaggcgacatggccgtcacaaacctggcggcagcgcaaaagatg

SEQ ID NO: 4098 - DNA, 103 bp, Artificial Sequence
  Synthetic Polynucleotide
taatacgactcactatagggtgcacaccgagaatgacactctttcgccgtaacagaggagaacggcgatggagtgtcataacctggcggcagcgcaaaagatg

SEQ ID NO: 4099 - DNA, 103 bp, Artificial Sequence
  Synthetic Polynucleotide
taatacgactcactatagggaatttggcgtccttaactgtgacggcatggaacagaggagaccatgcatgcacagttaaaacctggcggcagcgcaaaagatg

SEQ ID NO: 4100 - DNA, 103 bp, Artificial Sequence
  Synthetic Polynucleotide
taatacgactcactatagggcaatgaatttggcgtccttaactgtgacggaacagaggagaccgtcaatgttaaggacgaacctggcggcagcgcaaaagatg

SEQ ID NO: 4101 - DNA, 103 bp, Artificial Sequence
  Synthetic Polynucleotide
taatacgactcactatagggccccacaatgaatttggcgtccttaactgtaacagaggagaacagttatggacgccaaaaacctggcggcagcgcaaaagatg

SEQ ID NO: 4102 - DNA, 103 bp, Artificial Sequence
  Synthetic Polynucleotide
taatacgactcactatagggattggccccacaatgaatttggcgtccttaaacagaggagataaggaatgcaaattcataacctggcggcagcgcaaaagatg

SEQ ID NO: 4103 - DNA, 103 bp, Artificial Sequence
  Synthetic Polynucleotide
taatacgactcactatagggaagacattggccccacaatgaatttggcgtaacagaggagaacgccaatgtcattgtggaacctggcggcagcgcaaaagatg

SEQ ID NO: 4104 - DNA, 103 bp, Artificial Sequence
  Synthetic Polynucleotide
taatacgactcactatagggggctgaagacattggccccacaatgaatttaacagaggagaaaattcatggtggggccaaacctggcggcagcgcaaaagatg

SEQ ID NO: 4105 - DNA, 103 bp, Artificial Sequence
  Synthetic Polynucleotide
taatacgactcactataggggtccaggctgaagacattggccccacaatgaacagaggagacattgtatggccaatgtcaacctggcggcagcgcaaaagatg

SEQ ID NO: 4106 - DNA, 103 bp, Artificial Sequence
  Synthetic Polynucleotide
taatacgactcactatagggaaggtgtccaggctgaagacattggccccaaacagaggagatggggcatgtgtcttcagaacctggcggcagcgcaaaagatg

SEQ ID NO: 4107 - DNA, 103 bp, Artificial Sequence
  Synthetic Polynucleotide
taatacgactcactataggggtcaaaaggtgtccaggctgaagacattggaacagaggagaccaatgatgtcagcctggaacctggcggcagcgcaaaagatg

SEQ ID NO: 4108 - DNA, 103 bp, Artificial Sequence
  Synthetic Polynucleotide
taatacgactcactatagggttgttgtcaaaaggtgtccaggctgaagacaacagaggagagtcttcatgctggacaccaacctggcggcagcgcaaaagatg

SEQ ID NO: 4109 - DNA, 103 bp, Artificial Sequence
  Synthetic Polynucleotide
taatacgactcactatagggcagggccttcaaaaaggcgctgtcagcgtcaacagaggagagacgctatgagcgcctttaacctggcggcagcgcaaaagatg

SEQ ID NO: 4110 - DNA, 103 bp, Artificial Sequence
  Synthetic Polynucleotide
taatacgactcactataggggtacgtgcacaccgagaatgacactctttcaacagaggagagaaagaatgtcattctcgaacctggcggcagcgcaaaagatg

SEQ ID NO: 4111 - DNA, 103 bp, Artificial Sequence
  Synthetic Polynucleotide
taatacgactcactatagggcgattttgttgtcaaaaggtgtccaggctgaacagaggagacagcctatgcaccttttgaacctggcggcagcgcaaaagatg

SEQ ID NO: 4112 - DNA, 103 bp, Artificial Sequence
  Synthetic Polynucleotide
taatacgactcactatagggcaccacgattttgttgtcaaaaggtgtccaaacagaggagatggacaatgtttgacaacaacctggcggcagcgcaaaagatg

SEQ ID NO: 4113 - DNA, 103 bp, Artificial Sequence
  Synthetic Polynucleotide
taatacgactcactatagggttgtacaccacgattttgttgtcaaaaggtaacagaggagaacctttatgcaacaaaataacctggcggcagcgcaaaagatg

SEQ ID NO: 4114 - DNA, 103 bp, Artificial Sequence
  Synthetic Polynucleotide
taatacgactcactatagggcacctttgtacaccacgattttgttgtcaaaacagaggagattgacaatgaaatcgtggaacctggcggcagcgcaaaagatg

SEQ ID NO: 4115 - DNA, 103 bp, Artificial Sequence
  Synthetic Polynucleotide
taatacgactcactatagggaacgtcacctttgtacaccacgattttgttaacagaggagaaacaaaatggtggtgtacaacctggcggcagcgcaaaagatg

SEQ ID NO: 4116 - DNA, 103 bp, Artificial Sequence
  Synthetic Polynucleotide
taatacgactcactatagggttgtaaacgtcacctttgtacaccacgattaacagaggagaaatcgtatggtacaaaggaacctggcggcagcgcaaaagatg

SEQ ID NO: 4117 - DNA, 103 bp, Artificial Sequence
  Synthetic Polynucleotide
taatacgactcactatagggccatgttgtaaacgtcacctttgtacaccaaacagaggagatggtgtatgaaggtgacgaacctggcggcagcgcaaaagatg

SEQ ID NO: 4118 - DNA, 103 bp, Artificial Sequence
  Synthetic Polynucleotide
taatacgactcactataggggtagtccatgttgtaaacgtcacctttgtaaacagaggagatacaaaatggacgtttacaacctggcggcagcgcaaaagatg

SEQ ID NO: 4119 - DNA, 103 bp, Artificial Sequence
  Synthetic Polynucleotide
taatacgactcactatagggggcgggtagtccatgttgtaaacgtcacctaacagaggagaaggtgaatgttacaacataacctggcggcagcgcaaaagatg

SEQ ID NO: 4120 - DNA, 103 bp, Artificial Sequence
  Synthetic Polynucleotide
taatacgactcactatagggcaaagggcgggtagtccatgttgtaaacgtaacagaggagaacgtttatgacatggactaacctggcggcagcgcaaaagatg

SEQ ID NO: 4121 - DNA, 103 bp, Artificial Sequence
  Synthetic Polynucleotide
taatacgactcactatagggggcacgtacgtgcacaccgagaatgacactaacagaggagaagtgtcatgctcggtgtgaacctggcggcagcgcaaaagatg

SEQ ID NO: 4122 - DNA, 103 bp, Artificial Sequence
  Synthetic Polynucleotide
taatacgactcactatagggtgcgccaaagggcgggtagtccatgttgtaaacagaggagatacaacatggactacccgaacctggcggcagcgcaaaagatg

SEQ ID NO: 4123 - DNA, 103 bp, Artificial Sequence
  Synthetic Polynucleotide
taatacgactcactatagggcttcctgcgccaaagggcgggtagtccatgaacagaggagacatggaatgcccgcccttaacctggcggcagcgcaaaagatg

SEQ ID NO: 4124 - DNA, 103 bp, Artificial Sequence
  Synthetic Polynucleotide
taatacgactcactatagggctggtcttcctgcgccaaagggcgggtagtaacagaggagaactaccatgcctttggcgaacctggcggcagcgcaaaagatg

SEQ ID NO: 4125 - DNA, 103 bp, Artificial Sequence
  Synthetic Polynucleotide
taatacgactcactatagggttgtcctggtcttcctgcgccaaagggcggaacagaggagaccgcccatgggcgcaggaaacctggcggcagcgcaaaagatg

SEQ ID NO: 4126 - DNA, 103 bp, Artificial Sequence
  Synthetic Polynucleotide
taatacgactcactatagggccaaattgtcctggtcttcctgcgccaaagaacagaggagactttggatgaggaagaccaacctggcggcagcgcaaaagatg

SEQ ID NO: 4127 - DNA, 103 bp, Artificial Sequence
  Synthetic Polynucleotide
taatacgactcactatagggtatcgccaaattgtcctggtcttcctgcgcaacagaggagagcgcagatggaccaggacaacctggcggcagcgcaaaagatg

SEQ ID NO: 4128 - DNA, 103 bp, Artificial Sequence
  Synthetic Polynucleotide
taatacgactcactatagggttggatatcgccaaattgtcctggtcttccaacagaggagaggaagaatgggacaatttaacctggcggcagcgcaaaagatg

SEQ ID NO: 4129 - DNA, 103 bp, Artificial Sequence
  Synthetic Polynucleotide
taatacgactcactatagggcgactttggatatcgccaaattgtcctggtaacagaggagaaccaggatgatttggcgaaacctggcggcagcgcaaaagatg

SEQ ID NO: 4130 - DNA, 103 bp, Artificial Sequence
  Synthetic Polynucleotide
taatacgactcactataggggcgtgcgactttggatatcgccaaattgtcaacagaggagagacaatatggcgatatccaacctggcggcagcgcaaaagatg

SEQ ID NO: 4131 - DNA, 103 bp, Artificial Sequence
  Synthetic Polynucleotide
taatacgactcactatagggctcaggcgtgcgactttggatatcgccaaaaacagaggagatttggcatgatccaaagtaacctggcggcagcgcaaaagatg

SEQ ID NO: 4132 - DNA, 103 bp, Artificial Sequence
  Synthetic Polynucleotide
taatacgactcactatagggtcgccggcacgtacgtgcacaccgagaatgaacagaggagacattctatgtgtgcacgtaacctggcggcagcgcaaaagatg

SEQ ID NO: 4133 - DNA, 103 bp, Artificial Sequence
  Synthetic Polynucleotide
taatacgactcactatagggttgctctcaggcgtgcgactttggatatcgaacagaggagacgatatatgaagtcgcacaacctggcggcagcgcaaaagatg

SEQ ID NO: 4134 - DNA, 103 bp, Artificial Sequence
  Synthetic Polynucleotide
taatacgactcactatagggcgtctttgctctcaggcgtgcgactttggaaacagaggagatccaaaatggcacgcctgaacctggcggcagcgcaaaagatg

SEQ ID NO: 4135 - DNA, 103 bp, Artificial Sequence
  Synthetic Polynucleotide
taatacgactcactatagggatagacgtctttgctctcaggcgtgcgactaacagaggagaagtcgcatgcctgagagcaacctggcggcagcgcaaaagatg

SEQ ID NO: 4136 - DNA, 103 bp, Artificial Sequence
  Synthetic Polynucleotide
taatacgactcactatagggttagcatagacgtctttgctctcaggcgtgaacagaggagacacgccatggagcaaagaaacctggcggcagcgcaaaagatg

SEQ ID NO: 4137 - DNA, 103 bp, Artificial Sequence
  Synthetic Polynucleotide
taatacgactcactataggggtgtgttagcatagacgtctttgctctcagaacagaggagactgagaatgaagacgtctaacctggcggcagcgcaaaagatg

SEQ ID NO: 4138 - DNA, 103 bp, Artificial Sequence
  Synthetic Polynucleotide
taatacgactcactatagggcagttgtgtgttagcatagacgtctttgctaacagaggagaagcaaaatggtctatgctaacctggcggcagcgcaaaagatg

SEQ ID NO: 4139 - DNA, 103 bp, Artificial Sequence
  Synthetic Polynucleotide
taatacgactcactatagggagtaccagttgtgtgttagcatagacgtctaacagaggagaagacgtatgtgctaacacaacctggcggcagcgcaaaagatg

SEQ ID NO: 4140 - DNA, 103 bp, Artificial Sequence
  Synthetic Polynucleotide
taatacgactcactatagggtctgcagtaccagttgtgtgttagcatagaaacagaggagatctatgatgacacacaacaacctggcggcagcgcaaaagatg

SEQ ID NO: 4141 - DNA, 103 bp, Artificial Sequence
  Synthetic Polynucleotide
taatacgactcactatagggcggtctctgcagtaccagttgtgtgttagcaacagaggagagctaacatgcaactggtaaacctggcggcagcgcaaaagatg

SEQ ID NO: 4142 - DNA, 103 bp, Artificial Sequence
  Synthetic Polynucleotide
taatacgactcactataggggcagccggtctctgcagtaccagttgtgtgaacagaggagacacacaatgggtactgcaaacctggcggcagcgcaaaagatg

SEQ ID NO: 4143 - DNA, 103 bp, Artificial Sequence
  Synthetic Polynucleotide
taatacgactcactatagggaatggtcgccggcacgtacgtgcacaccgaaacagaggagatcggtgatgacgtacgtgaacctggcggcagcgcaaaagatg

SEQ ID NO: 4144 - DNA, 103 bp, Artificial Sequence
  Synthetic Polynucleotide
taatacgactcactatagggtacccgcagccggtctctgcagtaccagttaacagaggagaaactggatgtgcagagacaacctggcggcagcgcaaaagatg

SEQ ID NO: 4145 - DNA, 103 bp, Artificial Sequence
  Synthetic Polynucleotide
taatacgactcactatagggtaccgtacccgcagccggtctctgcagtacaacagaggagagtactgatgagaccggctaacctggcggcagcgcaaaagatg

SEQ ID NO: 4146 - DNA, 103 bp, Artificial Sequence
  Synthetic Polynucleotide
taatacgactcactatagggacgtgtaccgtacccgcagccggtctctgcaacagaggagagcagagatgggctgcgggaacctggcggcagcgcaaaagatg

SEQ ID NO: 4147 - DNA, 103 bp, Artificial Sequence
  Synthetic Polynucleotide
taatacgactcactatagggatggcacgtgtaccgtacccgcagccggtcaacagaggagagaccggatgcgggtacggaacctggcggcagcgcaaaagatg

SEQ ID NO: 4148 - DNA, 103 bp, Artificial Sequence
  Synthetic Polynucleotide
taatacgactcactatagggagagtatggcacgtgtaccgtacccgcagcaacagaggagagctgcgatgacggtacacaacctggcggcagcgcaaaagatg

SEQ ID NO: 4149 - DNA, 103 bp, Artificial Sequence
  Synthetic Polynucleotide
taatacgactcactataggggcctgagagtatggcacgtgtaccgtacccaacagaggagagggtacatgacacgtgccaacctggcggcagcgcaaaagatg

SEQ ID NO: 4150 - DNA, 103 bp, Artificial Sequence
  Synthetic Polynucleotide
taatacgactcactatagggatggtgcctgagagtatggcacgtgtaccgaacagaggagacggtacatgtgccatactaacctggcggcagcgcaaaagatg

SEQ ID NO: 4151 - DNA, 103 bp, Artificial Sequence
  Synthetic Polynucleotide
taatacgactcactataggggccagatggtgcctgagagtatggcacgtgaacagaggagacacgtgatgtactctcagaacctggcggcagcgcaaaagatg

SEQ ID NO: 4152 - DNA, 103 bp, Artificial Sequence
  Synthetic Polynucleotide
taatacgactcactatagggttaaagccagatggtgcctgagagtatggcaacagaggagagccataatgtcaggcaccaacctggcggcagcgcaaaagatg

SEQ ID NO: 4153 - DNA, 103 bp, Artificial Sequence
  Synthetic Polynucleotide
taatacgactcactatagggaatacttaaagccagatggtgcctgagagtaacagaggagaactctcatgcaccatctgaacctggcggcagcgcaaaagatg

SEQ ID NO: 4154 - DNA, 103 bp, Artificial Sequence
  Synthetic Polynucleotide
taatacgactcactatagggtcacaaatggtcgccggcacgtacgtgcacaacagaggagagtgcacatgcgtgccggcaacctggcggcagcgcaaaagatg

SEQ ID NO: 4155 - DNA, 103 bp, Artificial Sequence
  Synthetic Polynucleotide
taatacgactcactatagggtaaccaatacttaaagccagatggtgcctgaacagaggagacaggcaatgtctggctttaacctggcggcagcgcaaaagatg

SEQ ID NO: 4156 - DNA, 103 bp, Artificial Sequence
  Synthetic Polynucleotide
taatacgactcactatagggtcttttaaccaatacttaaagccagatggtaacagaggagaaccatcatgctttaagtaaacctggcggcagcgcaaaagatg

SEQ ID NO: 4157 - DNA, 103 bp, Artificial Sequence
  Synthetic Polynucleotide
taatacgactcactatagggctcgttcttttaaccaatacttaaagccagaacagaggagactggctatgagtattggtaacctggcggcagcgcaaaagatg

SEQ ID NO: 4158 - DNA, 103 bp, Artificial Sequence
  Synthetic Polynucleotide
taatacgactcactatagggcgcccctcgttcttttaaccaatacttaaaaacagaggagatttaagatgtggttaaaaaacctggcggcagcgcaaaagatg

SEQ ID NO: 4159 - DNA, 103 bp, Artificial Sequence
  Synthetic Polynucleotide
taatacgactcactatagggagcgacgcccctcgttcttttaaccaatacaacagaggagagtattgatgaaaagaacgaacctggcggcagcgcaaaagatg

SEQ ID NO: 4160 - DNA, 103 bp, Artificial Sequence
  Synthetic Polynucleotide
taatacgactcactataggggctgtagcgacgcccctcgttcttttaaccaacagaggagaggttaaatgaacgaggggaacctggcggcagcgcaaaagatg

SEQ ID NO: 4161 - DNA, 103 bp, Artificial Sequence
  Synthetic Polynucleotide
taatacgactcactatagggtgtgtgctgtagcgacgcccctcgttctttaacagaggagaaaagaaatgggggcgtcgaacctggcggcagcgcaaaagatg

SEQ ID NO: 4162 - DNA, 103 bp, Artificial Sequence
  Synthetic Polynucleotide
taatacgactcactatagggggtgctgtgtgctgtagcgacgcccctcgtaacagaggagaacgaggatggtcgctacaaacctggcggcagcgcaaaagatg

SEQ ID NO: 4163 - DNA, 103 bp, Artificial Sequence
  Synthetic Polynucleotide
taatacgactcactatagggcaaatggtgctgtgtgctgtagcgacgcccaacagaggagagggcgtatgtacagcacaaacctggcggcagcgcaaaagatg

SEQ ID NO: 4164 - DNA, 103 bp, Artificial Sequence
  Synthetic Polynucleotide
taatacgactcactataggggcagccaaatggtgctgtgtgctgtagcgaaacagaggagatcgctaatgcacacagcaaacctggcggcagcgcaaaagatg

SEQ ID NO: 4165 - DNA, 103 bp, Artificial Sequence
  Synthetic Polynucleotide
taatacgactcactatagggtttgatcacaaatggtcgccggcacgtacgaacagaggagacgtacgatgcggcgaccaaacctggcggcagcgcaaaagatg

SEQ ID NO: 4166 - DNA, 103 bp, Artificial Sequence
  Synthetic Polynucleotide
taatacgactcactatagggatttggcagccaaatggtgctgtgtgctgtaacagaggagaacagcaatgagcaccattaacctggcggcagcgcaaaagatg

SEQ ID NO: 4167 - DNA, 103 bp, Artificial Sequence
  Synthetic Polynucleotide
taatacgactcactatagggttgctatttggcagccaaatggtgctgtgtaacagaggagaacacagatgcatttggctaacctggcggcagcgcaaaagatg

SEQ ID NO: 4168 - DNA, 103 bp, Artificial Sequence
  Synthetic Polynucleotide
taatacgactcactataggggtttgttgctatttggcagccaaatggtgcaacagaggagagcaccaatgggctgccaaaacctggcggcagcgcaaaagatg

SEQ ID NO: 4169 - DNA, 103 bp, Artificial Sequence
  Synthetic Polynucleotide
taatacgactcactatagggaccgggtttgttgctatttggcagccaaataacagaggagaatttggatgccaaatagcaacctggcggcagcgcaaaagatg

SEQ ID NO: 4170 - DNA, 103 bp, Artificial Sequence
  Synthetic Polynucleotide
taatacgactcactatagggctcttaccgggtttgttgctatttggcagcaacagaggagagctgccatgtagcaacaaaacctggcggcagcgcaaaagatg

SEQ ID NO: 4171 - DNA, 103 bp, Artificial Sequence
  Synthetic Polynucleotide
taatacgactcactatagggcatcgctcttaccgggtttgttgctatttgaacagaggagacaaataatgacaaacccgaacctggcggcagcgcaaaagatg

SEQ ID NO: 4172 - DNA, 103 bp, Artificial Sequence
  Synthetic Polynucleotide
taatacgactcactatagggcagttcatcgctcttaccgggtttgttgctaacagaggagaagcaacatgcccggtaagaacctggcggcagcgcaaaagatg

SEQ ID NO: 4173 - DNA, 103 bp, Artificial Sequence
  Synthetic Polynucleotide
taatacgactcactatagggcggcgcagttcatcgctcttaccgggtttgaacagaggagacaaaccatgtaagagcgaaacctggcggcagcgcaaaagatg

SEQ ID NO: 4174 - DNA, 103 bp, Artificial Sequence
  Synthetic Polynucleotide
taatacgactcactatagggccctacggcgcagttcatcgctcttaccggaacagaggagaccggtaatggcgatgaacaacctggcggcagcgcaaaagatg

SEQ ID NO: 4175 - DNA, 103 bp, Artificial Sequence
  Synthetic Polynucleotide
taatacgactcactatagggatgttccctacggcgcagttcatcgctcttaacagaggagaaagagcatggaactgcgcaacctggcggcagcgcaaaagatg

SEQ ID NO: 4176 - DNA, 103 bp, Artificial Sequence
  Synthetic Polynucleotide
taatacgactcactatagggggtcatttgatcacaaatggtcgccggcacaacagaggagagtgccgatgaccatttgtaacctggcggcagcgcaaaagatg

SEQ ID NO: 4177 - DNA, 103 bp, Artificial Sequence
  Synthetic Polynucleotide
taatacgactcactatagggtgggcatgttccctacggcgcagttcatcgaacagaggagacgatgaatggcgccgtagaacctggcggcagcgcaaaagatg

SEQ ID NO: 4178 - DNA, 103 bp, Artificial Sequence
  Synthetic Polynucleotide
taatacgactcactatagggggagatgggcatgttccctacggcgcagttaacagaggagaaactgcatggtagggaacaacctggcggcagcgcaaaagatg

SEQ ID NO: 4179 - DNA, 103 bp, Artificial Sequence
  Synthetic Polynucleotide
taatacgactcactatagggtcgatggagatgggcatgttccctacggcgaacagaggagacgccgtatggaacatgccaacctggcggcagcgcaaaagatg

SEQ ID NO: 4180 - DNA, 103 bp, Artificial Sequence
  Synthetic Polynucleotide
taatacgactcactataggggtatgtcgatggagatgggcatgttccctaaacagaggagatagggaatgtgcccatctaacctggcggcagcgcaaaagatg

SEQ ID NO: 4181 - DNA, 103 bp, Artificial Sequence
  Synthetic Polynucleotide
taatacgactcactatagggatccggtatgtcgatggagatgggcatgttaacagaggagaaacatgatgatctccatcaacctggcggcagcgcaaaagatg

SEQ ID NO: 4182 - DNA, 103 bp, Artificial Sequence
  Synthetic Polynucleotide
taatacgactcactataggggccgcatccggtatgtcgatggagatgggcaacagaggagagcccatatgcatcgacataacctggcggcagcgcaaaagatg

SEQ ID NO: 4183 - DNA, 103 bp, Artificial Sequence
  Synthetic Polynucleotide
taatacgactcactatagggtgaaggccgcatccggtatgtcgatggagaaacagaggagatctccaatgacataccggaacctggcggcagcgcaaaagatg

SEQ ID NO: 4184 - DNA, 103 bp, Artificial Sequence
  Synthetic Polynucleotide
taatacgactcactatagggcctagtgaaggccgcatccggtatgtcgataacagaggagaatcgacatgccggatgcgaacctggcggcagcgcaaaagatg

SEQ ID NO: 4185 - DNA, 103 bp, Artificial Sequence
  Synthetic Polynucleotide
taatacgactcactatagggacgaccctagtgaaggccgcatccggtatgaacagaggagacataccatgtgcggccttaacctggcggcagcgcaaaagatg

SEQ ID NO: 4186 - DNA, 103 bp, Artificial Sequence
  Synthetic Polynucleotide
taatacgactcactatagggcgtcgacgaccctagtgaaggccgcatccgaacagaggagacggatgatgccttcactaaacctggcggcagcgcaaaagatg

SEQ ID NO: 4187 - DNA, 103 bp, Artificial Sequence
  Synthetic Polynucleotide
taatacgactcactatagggatgccggtcatttgatcacaaatggtcgccaacagaggagaggcgacatgttgtgatcaaacctggcggcagcgcaaaagatg

SEQ ID NO: 4188 - DNA, 103 bp, Artificial Sequence
  Synthetic Polynucleotide
taatacgactcactataggggggcgcgtcgacgaccctagtgaaggccgcaacagaggagagcggccatgactagggtcaacctggcggcagcgcaaaagatg

SEQ ID NO: 4189 - DNA, 103 bp, Artificial Sequence
  Synthetic Polynucleotide
taatacgactcactatagggaaagagggcgcgtcgacgaccctagtgaagaacagaggagacttcacatgggtcgtcgaaacctggcggcagcgcaaaagatg

SEQ ID NO: 4190 - DNA, 103 bp, Artificial Sequence
  Synthetic Polynucleotide
taatacgactcactatagggccgttaaagagggcgcgtcgacgaccctagaacagaggagactagggatgtcgacgcgcaacctggcggcagcgcaaaagatg

SEQ ID NO: 4191 - DNA, 103 bp, Artificial Sequence
  Synthetic Polynucleotide
taatacgactcactatagggcatgtccgttaaagagggcgcgtcgacgacaacagaggagagtcgtcatggcgccctctaacctggcggcagcgcaaaagatg

SEQ ID NO: 4192 - DNA, 103 bp, Artificial Sequence
  Synthetic Polynucleotide
taatacgactcactatagggcatgacatgtccgttaaagagggcgcgtcgaacagaggagacgacgcatgctctttaacaacctggcggcagcgcaaaagatg

SEQ ID NO: 4193 - DNA, 103 bp, Artificial Sequence
  Synthetic Polynucleotide
taatacgactcactatagggcctcgcatgacatgtccgttaaagagggcgaacagaggagacgccctatgtaacggacaaacctggcggcagcgcaaaagatg

SEQ ID NO: 4194 - DNA, 103 bp, Artificial Sequence
  Synthetic Polynucleotide
taatacgactcactatagggtggtacctcgcatgacatgtccgttaaagaaacagaggagatctttaatggacatgtcaaacctggcggcagcgcaaaagatg

SEQ ID NO: 4195 - DNA, 103 bp, Artificial Sequence
  Synthetic Polynucleotide
taatacgactcactatagggcaggctggtacctcgcatgacatgtccgttaacagaggagaaacggaatggtcatgcgaaacctggcggcagcgcaaaagatg

SEQ ID NO: 4196 - DNA, 103 bp, Artificial Sequence
  Synthetic Polynucleotide
taatacgactcactataggggggtgcaggctggtacctcgcatgacatgtaacagaggagaacatgtatggcgaggtacaacctggcggcagcgcaaaagatg

SEQ ID NO: 4197 - DNA, 103 bp, Artificial Sequence
  Synthetic Polynucleotide
taatacgactcactatagggggaatgggtgcaggctggtacctcgcatgaaacagaggagatcatgcatggtaccagccaacctggcggcagcgcaaaagatg

SEQ ID NO: 4198 - DNA, 103 bp, Artificial Sequence
  Synthetic Polynucleotide
taatacgactcactatagggcaaggatgccggtcatttgatcacaaatggaacagaggagaccatttatgatcaaatgaaacctggcggcagcgcaaaagatg

SEQ ID NO: 4199 - DNA, 103 bp, Artificial Sequence
  Synthetic Polynucleotide
taatacgactcactatagggtctgaggaatgggtgcaggctggtacctcgaacagaggagacgaggtatgagcctgcacaacctggcggcagcgcaaaagatg

SEQ ID NO: 4200 - DNA, 103 bp, Artificial Sequence
  Synthetic Polynucleotide
taatacgactcactatagggcaaagtctgaggaatgggtgcaggctggtaaacagaggagataccagatggcacccattaacctggcggcagcgcaaaagatg

SEQ ID NO: 4201 - DNA, 103 bp, Artificial Sequence
  Synthetic Polynucleotide
taatacgactcactataggggcccccaaagtctgaggaatgggtgcaggcaacagaggagagcctgcatgcattcctcaaacctggcggcagcgcaaaagatg

SEQ ID NO: 4202 - DNA, 103 bp, Artificial Sequence
  Synthetic Polynucleotide
taatacgactcactataggggcgacgcccccaaagtctgaggaatgggtgaacagaggagacacccaatgctcagacttaacctggcggcagcgcaaaagatg

SEQ ID NO: 4203 - DNA, 103 bp, Artificial Sequence
  Synthetic Polynucleotide
taatacgactcactatagggtaatggcgacgcccccaaagtctgaggaataacagaggagaattcctatgactttggggaacctggcggcagcgcaaaagatg

SEQ ID NO: 4204 - DNA, 103 bp, Artificial Sequence
  Synthetic Polynucleotide
taatacgactcactatagggtttaataatggcgacgcccccaaagtctgaaacagaggagatcagacatggggggcgtcaacctggcggcagcgcaaaagatg

SEQ ID NO: 4205 - DNA, 103 bp, Artificial Sequence
  Synthetic Polynucleotide
taatacgactcactataggggcatatttaataatggcgacgcccccaaagaacagaggagactttggatgcgtcgccataacctggcggcagcgcaaaagatg

SEQ ID NO: 4206 - DNA, 103 bp, Artificial Sequence
  Synthetic Polynucleotide
taatacgactcactatagggtgactgcatatttaataatggcgacgccccaacagaggagaggggcgatgccattattaaacctggcggcagcgcaaaagatg

SEQ ID NO: 4207 - DNA, 103 bp, Artificial Sequence
  Synthetic Polynucleotide
taatacgactcactatagggcttgctgactgcatatttaataatggcgacaacagaggagagtcgccatgattaaatataacctggcggcagcgcaaaagatg

SEQ ID NO: 4208 - DNA, 103 bp, Artificial Sequence
  Synthetic Polynucleotide
taatacgactcactatagggcctttcttgctgactgcatatttaataatgaacagaggagacattatatgatatgcagtaacctggcggcagcgcaaaagatg

SEQ ID NO: 4209 - DNA, 103 bp, Artificial Sequence
  Synthetic Polynucleotide
taatacgactcactatagggtgtagcaaggatgccggtcatttgatcacaaacagaggagatgtgatatgatgaccggcaacctggcggcagcgcaaaagatg

SEQ ID NO: 4210 - DNA, 103 bp, Artificial Sequence
  Synthetic Polynucleotide
taatacgactcactatagggacttgcctttcttgctgactgcatatttaaaacagaggagattaaatatgcagtcagcaaacctggcggcagcgcaaaagatg

SEQ ID NO: 4211 - DNA, 103 bp, Artificial Sequence
  Synthetic Polynucleotide
taatacgactcactatagggcgcacacttgcctttcttgctgactgcataaacagaggagatatgcaatgagcaagaaaaacctggcggcagcgcaaaagatg

SEQ ID NO: 4212 - DNA, 103 bp, Artificial Sequence
  Synthetic Polynucleotide
taatacgactcactatagggtgcaccgcacacttgcctttcttgctgactaacagaggagaagtcagatggaaaggcaaaacctggcggcagcgcaaaagatg

SEQ ID NO: 4213 - DNA, 103 bp, Artificial Sequence
  Synthetic Polynucleotide
taatacgactcactatagggtcgaatgcaccgcacacttgcctttcttgcaacagaggagagcaagaatggcaagtgtgaacctggcggcagcgcaaaagatg

SEQ ID NO: 4214 - DNA, 103 bp, Artificial Sequence
  Synthetic Polynucleotide
taatacgactcactatagggggtcatcgaatgcaccgcacacttgcctttaacagaggagaaaaggcatgtgtgcggtgaacctggcggcagcgcaaaagatg

SEQ ID NO: 4215 - DNA, 103 bp, Artificial Sequence
  Synthetic Polynucleotide
taatacgactcactataggggcgttggtcatcgaatgcaccgcacacttgaacagaggagacaagtgatgggtgcattcaacctggcggcagcgcaaaagatg

SEQ ID NO: 4216 - DNA, 103 bp, Artificial Sequence
  Synthetic Polynucleotide
taatacgactcactatagggtgacggcgttggtcatcgaatgcaccgcacaacagaggagagtgcggatgattcgatgaaacctggcggcagcgcaaaagatg

SEQ ID NO: 4217 - DNA, 103 bp, Artificial Sequence
  Synthetic Polynucleotide
taatacgactcactataggggatagtgacggcgttggtcatcgaatgcacaacagaggagagtgcatatgatgaccaacaacctggcggcagcgcaaaagatg

SEQ ID NO: 4218 - DNA, 103 bp, Artificial Sequence
  Synthetic Polynucleotide
taatacgactcactatagggtcccggatagtgacggcgttggtcatcgaaaacagaggagattcgatatgcaacgccgtaacctggcggcagcgcaaaagatg

SEQ ID NO: 4219 - DNA, 103 bp, Artificial Sequence
  Synthetic Polynucleotide
taatacgactcactatagggcagcttcccggatagtgacggcgttggtcaaacagaggagatgaccaatgccgtcactaaacctggcggcagcgcaaaagatg

SEQ ID NO: 4220 - DNA, 103 bp, Artificial Sequence
  Synthetic Polynucleotide
taatacgactcactatagggcgttgcagggccttcaaaaaggcgctgtcaaacagaggagatgacagatgctttttgaaaacctggcggcagcgcaaaagatg

SEQ ID NO: 4221 - DNA, 103 bp, Artificial Sequence
  Synthetic Polynucleotide
taatacgactcactatagggacttctgtagcaaggatgccggtcatttgaaacagaggagatcaaatatgcggcatcctaacctggcggcagcgcaaaagatg

SEQ ID NO: 4222 - DNA, 103 bp, Artificial Sequence
  Synthetic Polynucleotide
taatacgactcactatagggtatctcagcttcccggatagtgacggcgttaacagaggagaaacgccatgactatccggaacctggcggcagcgcaaaagatg

SEQ ID NO: 4223 - DNA, 103 bp, Artificial Sequence
  Synthetic Polynucleotide
taatacgactcactatagggacttctatctcagcttcccggatagtgacgaacagaggagacgtcacatgccgggaagcaacctggcggcagcgcaaaagatg

SEQ ID NO: 4224 - DNA, 103 bp, Artificial Sequence
  Synthetic Polynucleotide
taatacgactcactatagggcttcaacttctatctcagcttcccggatagaacagaggagactatccatgaagctgagaaacctggcggcagcgcaaaagatg

SEQ ID NO: 4225 - DNA, 103 bp, Artificial Sequence
  Synthetic Polynucleotide
taatacgactcactatagggattcccttcaacttctatctcagcttcccgaacagaggagacgggaaatggagatagaaaacctggcggcagcgcaaaagatg

SEQ ID NO: 4226 - DNA, 103 bp, Artificial Sequence
  Synthetic Polynucleotide
taatacgactcactatagggtgagaattcccttcaacttctatctcagctaacagaggagaagctgaatgagaagttgaaacctggcggcagcgcaaaagatg

SEQ ID NO: 4227 - DNA, 103 bp, Artificial Sequence
  Synthetic Polynucleotide
taatacgactcactataggggcagctgagaattcccttcaacttctatctaacagaggagaagatagatgttgaagggaaacctggcggcagcgcaaaagatg

SEQ ID NO: 4228 - DNA, 103 bp, Artificial Sequence
  Synthetic Polynucleotide
taatacgactcactataggggatttgcagctgagaattcccttcaacttcaacagaggagagaagttatggggaattctaacctggcggcagcgcaaaagatg

SEQ ID NO: 4229 - DNA, 103 bp, Artificial Sequence
  Synthetic Polynucleotide
taatacgactcactatagggaaagagatttgcagctgagaattcccttcaaacagaggagatgaaggatgttctcagctaacctggcggcagcgcaaaagatg

SEQ ID NO: 4230 - DNA, 103 bp, Artificial Sequence
  Synthetic Polynucleotide
taatacgactcactatagggtcgagaaagagatttgcagctgagaattccaacagaggagaggaattatgagctgcaaaaacctggcggcagcgcaaaagatg

SEQ ID NO: 4231 - DNA, 103 bp, Artificial Sequence
  Synthetic Polynucleotide
taatacgactcactatagggggccgtcgagaaagagatttgcagctgagaaacagaggagatctcagatgcaaatctctaacctggcggcagcgcaaaagatg

SEQ ID NO: 4232 - DNA, 103 bp, Artificial Sequence
  Synthetic Polynucleotide
taatacgactcactataggggcgtgacttctgtagcaaggatgccggtcaaacagaggagatgaccgatgtccttgctaaacctggcggcagcgcaaaagatg

SEQ ID NO: 4233 - DNA, 103 bp, Artificial Sequence
  Synthetic Polynucleotide
taatacgactcactataggggccaaggccgtcgagaaagagatttgcagcaacagaggagagctgcaatgctctttctcaacctggcggcagcgcaaaagatg

SEQ ID NO: 4234 - DNA, 103 bp, Artificial Sequence
  Synthetic Polynucleotide
taatacgactcactatagggcgctggccaaggccgtcgagaaagagatttaacagaggagaaaatctatgtctcgacggaacctggcggcagcgcaaaagatg

SEQ ID NO: 4235 - DNA, 103 bp, Artificial Sequence
  Synthetic Polynucleotide
taatacgactcactatagggttcggcgctggccaaggccgtcgagaaagaaacagaggagatctttcatgacggccttgaacctggcggcagcgcaaaagatg

SEQ ID NO: 4236 - DNA, 103 bp, Artificial Sequence
  Synthetic Polynucleotide
taatacgactcactatagggcggaattcggcgctggccaaggccgtcgagaacagaggagactcgacatgcttggccagaacctggcggcagcgcaaaagatg

SEQ ID NO: 4237 - DNA, 103 bp, Artificial Sequence
  Synthetic Polynucleotide
taatacgactcactataggggtacgcggaattcggcgctggccaaggccgaacagaggagacggcctatgccagcgccgaacctggcggcagcgcaaaagatg

SEQ ID NO: 4238 - DNA, 103 bp, Artificial Sequence
  Synthetic Polynucleotide
taatacgactcactataggggacttgtacgcggaattcggcgctggccaaaacagaggagattggccatggccgaattcaacctggcggcagcgcaaaagatg

SEQ ID NO: 4239 - DNA, 103 bp, Artificial Sequence
  Synthetic Polynucleotide
taatacgactcactataggggaacagacttgtacgcggaattcggcgctgaacagaggagacagcgcatgattccgcgtaacctggcggcagcgcaaaagatg

SEQ ID NO: 4240 - DNA, 103 bp, Artificial Sequence
  Synthetic Polynucleotide
taatacgactcactataggggtgtagaacagacttgtacgcggaattcggaacagaggagaccgaatatggcgtacaagaacctggcggcagcgcaaaagatg

SEQ ID NO: 4241 - DNA, 103 bp, Artificial Sequence
  Synthetic Polynucleotide
taatacgactcactatagggtacttgtgtagaacagacttgtacgcggaaaacagaggagattccgcatgcaagtctgtaacctggcggcagcgcaaaagatg

SEQ ID NO: 4242 - DNA, 103 bp, Artificial Sequence
  Synthetic Polynucleotide
taatacgactcactatagggcagtgtacttgtgtagaacagacttgtacgaacagaggagacgtacaatgctgttctacaacctggcggcagcgcaaaagatg

SEQ ID NO: 4243 - DNA, 103 bp, Artificial Sequence
  Synthetic Polynucleotide
taatacgactcactatagggctccggcgtgacttctgtagcaaggatgccaacagaggagaggcatcatggctacagaaaacctggcggcagcgcaaaagatg

SEQ ID NO: 4244 - DNA, 103 bp, Artificial Sequence
  Synthetic Polynucleotide
taatacgactcactatagggctgcacagtgtacttgtgtagaacagacttaacagaggagaaagtctatgctacacaagaacctggcggcagcgcaaaagatg

SEQ ID NO: 4245 - DNA, 103 bp, Artificial Sequence
  Synthetic Polynucleotide
taatacgactcactatagggctcggctgcacagtgtacttgtgtagaacaaacagaggagatgttctatgcaagtacacaacctggcggcagcgcaaaagatg

SEQ ID NO: 4246 - DNA, 103 bp, Artificial Sequence
  Synthetic Polynucleotide
taatacgactcactatagggtggcactcggctgcacagtgtacttgtgtaaacagaggagatacacaatgacactgtgcaacctggcggcagcgcaaaagatg

SEQ ID NO: 4247 - DNA, 103 bp, Artificial Sequence
  Synthetic Polynucleotide
taatacgactcactataggggagggtggcactcggctgcacagtgtacttaacagaggagaaagtacatggtgcagccgaacctggcggcagcgcaaaagatg

SEQ ID NO: 4248 - DNA, 103 bp, Artificial Sequence
  Synthetic Polynucleotide
taatacgactcactatagggcttcggagggtggcactcggctgcacagtgaacagaggagacactgtatggccgagtgcaacctggcggcagcgcaaaagatg

SEQ ID NO: 4249 - DNA, 103 bp, Artificial Sequence
  Synthetic Polynucleotide
taatacgactcactatagggtggtccttcggagggtggcactcggctgcaaacagaggagatgcagcatggtgccacccaacctggcggcagcgcaaaagatg

SEQ ID NO: 4250 - DNA, 103 bp, Artificial Sequence
  Synthetic Polynucleotide
taatacgactcactatagggctatgtggtccttcggagggtggcactcggaacagaggagaccgagtatgaccctccgaaacctggcggcagcgcaaaagatg

SEQ ID NO: 4251 - DNA, 103 bp, Artificial Sequence
  Synthetic Polynucleotide
taatacgactcactataggggttgactatgtggtccttcggagggtggcaaacagaggagatgccacatgccgaaggacaacctggcggcagcgcaaaagatg

SEQ ID NO: 4252 - DNA, 103 bp, Artificial Sequence
  Synthetic Polynucleotide
taatacgactcactataggggggtagttgactatgtggtccttcggagggaacagaggagaccctccatgggaccacataacctggcggcagcgcaaaagatg

SEQ ID NO: 4253 - DNA, 103 bp, Artificial Sequence
  Synthetic Polynucleotide
taatacgactcactatagggacgccgggtagttgactatgtggtccttcgaacagaggagacgaaggatgacatagtcaaacctggcggcagcgcaaaagatg

SEQ ID NO: 4254 - DNA, 103 bp, Artificial Sequence
  Synthetic Polynucleotide
taatacgactcactataggggcatcctccggcgtgacttctgtagcaaggaacagaggagaccttgcatgagaagtcacaacctggcggcagcgcaaaagatg

SEQ ID NO: 4255 - DNA, 103 bp, Artificial Sequence
  Synthetic Polynucleotide
taatacgactcactatagggatgtgacgccgggtagttgactatgtggtcaacagaggagagaccacatggtcaactacaacctggcggcagcgcaaaagatg

SEQ ID NO: 4256 - DNA, 103 bp, Artificial Sequence
  Synthetic Polynucleotide
taatacgactcactataggggtggtatgtgacgccgggtagttgactatgaacagaggagacatagtatgctacccggcaacctggcggcagcgcaaaagatg

SEQ ID NO: 4257 - DNA, 103 bp, Artificial Sequence
  Synthetic Polynucleotide
taatacgactcactatagggcgagggtggtatgtgacgccgggtagttgaaacagaggagatcaactatgcggcgtcacaacctggcggcagcgcaaaagatg

SEQ ID NO: 4258 - DNA, 103 bp, Artificial Sequence
  Synthetic Polynucleotide
taatacgactcactataggggaccccgagggtggtatgtgacgccgggtaaacagaggagatacccgatgtcacataccaacctggcggcagcgcaaaagatg

SEQ ID NO: 4259 - DNA, 103 bp, Artificial Sequence
  Synthetic Polynucleotide
taatacgactcactatagggtcctggaccccgagggtggtatgtgacgccaacagaggagaggcgtcatgtaccaccctaacctggcggcagcgcaaaagatg

SEQ ID NO: 4260 - DNA, 103 bp, Artificial Sequence
  Synthetic Polynucleotide
taatacgactcactatagggaaatgtcctggaccccgagggtggtatgtgaacagaggagacacataatgccctcggggaacctggcggcagcgcaaaagatg

SEQ ID NO: 4261 - DNA, 103 bp, Artificial Sequence
  Synthetic Polynucleotide
taatacgactcactatagggagcggaaatgtcctggaccccgagggtggtaacagaggagaaccaccatgggggtccagaacctggcggcagcgcaaaagatg

SEQ ID NO: 4262 - DNA, 103 bp, Artificial Sequence
  Synthetic Polynucleotide
taatacgactcactataggggccgtagcggaaatgtcctggaccccgaggaacagaggagacctcggatgccaggacataacctggcggcagcgcaaaagatg

SEQ ID NO: 4263 - DNA, 103 bp, Artificial Sequence
  Synthetic Polynucleotide
taatacgactcactatagggacatcgccgtagcggaaatgtcctggacccaacagaggagagggtccatgacatttccgaacctggcggcagcgcaaaagatg

SEQ ID NO: 4264 - DNA, 103 bp, Artificial Sequence
  Synthetic Polynucleotide
taatacgactcactatagggccatgacatcgccgtagcggaaatgtcctgaacagaggagacaggacatgtccgctacgaacctggcggcagcgcaaaagatg

SEQ ID NO: 4265 - DNA, 103 bp, Artificial Sequence
  Synthetic Polynucleotide
taatacgactcactatagggtctgtgcatcctccggcgtgacttctgtagaacagaggagactacagatgtcacgccggaacctggcggcagcgcaaaagatg

SEQ ID NO: 4266 - DNA, 103 bp, Artificial Sequence
  Synthetic Polynucleotide
taatacgactcactatagggtgcacccatgacatcgccgtagcggaaatgaacagaggagacatttcatgtacggcgataacctggcggcagcgcaaaagatg

SEQ ID NO: 4267 - DNA, 103 bp, Artificial Sequence
  Synthetic Polynucleotide
taatacgactcactatagggtcttctgcacccatgacatcgccgtagcggaacagaggagaccgctaatgcgatgtcataacctggcggcagcgcaaaagatg

SEQ ID NO: 4268 - DNA, 103 bp, Artificial Sequence
  Synthetic Polynucleotide
taatacgactcactatagggcgtgatcttctgcacccatgacatcgccgtaacagaggagaacggcgatgtcatgggtgaacctggcggcagcgcaaaagatg

SEQ ID NO: 4269 - DNA, 103 bp, Artificial Sequence
  Synthetic Polynucleotide
taatacgactcactatagggcctcccgtgatcttctgcacccatgacatcaacagaggagagatgtcatgggtgcagaaaacctggcggcagcgcaaaagatg

SEQ ID NO: 4270 - DNA, 103 bp, Artificial Sequence
  Synthetic Polynucleotide
taatacgactcactatagggccacacctcccgtgatcttctgcacccatgaacagaggagacatgggatgagaagatcaaacctggcggcagcgcaaaagatg

SEQ ID NO: 4271 - DNA, 103 bp, Artificial Sequence
  Synthetic Polynucleotide
taatacgactcactatagggcagtcccacacctcccgtgatcttctgcacaacagaggagagtgcagatgatcacgggaaacctggcggcagcgcaaaagatg

SEQ ID NO: 4272 - DNA, 103 bp, Artificial Sequence
  Synthetic Polynucleotide
taatacgactcactatagggacaaccagtcccacacctcccgtgatcttcaacagaggagagaagatatggggaggtgtaacctggcggcagcgcaaaagatg

SEQ ID NO: 4273 - DNA, 103 bp, Artificial Sequence
  Synthetic Polynucleotide
taatacgactcactatagggcagcgacaaccagtcccacacctcccgtgaaacagaggagatcacggatggtgtgggacaacctggcggcagcgcaaaagatg

SEQ ID NO: 4274 - DNA, 103 bp, Artificial Sequence
  Synthetic Polynucleotide
taatacgactcactatagggtgcaacagcgacaaccagtcccacacctccaacagaggagaggaggtatgggactggttaacctggcggcagcgcaaaagatg

SEQ ID NO: 4275 - DNA, 103 bp, Artificial Sequence
  Synthetic Polynucleotide
taatacgactcactatagggagtgctgcaacagcgacaaccagtcccacaaacagaggagatgtgggatgggttgtcgcaacctggcggcagcgcaaaagatg

SEQ ID NO: 4276 - DNA, 103 bp, Artificial Sequence
  Synthetic Polynucleotide
taatacgactcactatagggcagcttctgtgcatcctccggcgtgacttcaacagaggagagaagtcatgccggaggataacctggcggcagcgcaaaagatg

SEQ ID NO: 4277 - DNA, 103 bp, Artificial Sequence
  Synthetic Polynucleotide
taatacgactcactataggggaatcagtgctgcaacagcgacaaccagtcaacagaggagagactggatgtcgctgttgaacctggcggcagcgcaaaagatg

SEQ ID NO: 4278 - DNA, 103 bp, Artificial Sequence
  Synthetic Polynucleotide
taatacgactcactataggggattagaatcagtgctgcaacagcgacaacaacagaggagagttgtcatggttgcagcaaacctggcggcagcgcaaaagatg

SEQ ID NO: 4279 - DNA, 103 bp, Artificial Sequence
  Synthetic Polynucleotide
taatacgactcactatagggaccacgattagaatcagtgctgcaacagcgaacagaggagacgctgtatgagcactgataacctggcggcagcgcaaaagatg

SEQ ID NO: 4280 - DNA, 103 bp, Artificial Sequence
  Synthetic Polynucleotide
taatacgactcactatagggatagcaccacgattagaatcagtgctgcaaaacagaggagattgcagatgtgattctaaaacctggcggcagcgcaaaagatg

SEQ ID NO: 4281 - DNA, 103 bp, Artificial Sequence
  Synthetic Polynucleotide
taatacgactcactatagggcacgcatagcaccacgattagaatcagtgcaacagaggagagcactgatgctaatcgtgaacctggcggcagcgcaaaagatg

SEQ ID NO: 4282 - DNA, 103 bp, Artificial Sequence
  Synthetic Polynucleotide
taatacgactcactatagggaacgacacgcatagcaccacgattagaatcaacagaggagagattctatgcgtggtgctaacctggcggcagcgcaaaagatg

SEQ ID NO: 4283 - DNA, 103 bp, Artificial Sequence
  Synthetic Polynucleotide
taatacgactcactatagggtgctgaacgacacgcatagcaccacgattaaacagaggagataatcgatgtgctatgcgaacctggcggcagcgcaaaagatg

SEQ ID NO: 4284 - DNA, 103 bp, Artificial Sequence
  Synthetic Polynucleotide
taatacgactcactataggggtgcctgctgaacgacacgcatagcaccacaacagaggagagtggtgatgtgcgtgtcgaacctggcggcagcgcaaaagatg

SEQ ID NO: 4285 - DNA, 103 bp, Artificial Sequence
  Synthetic Polynucleotide
taatacgactcactatagggagttagtgcctgctgaacgacacgcatagcaacagaggagagctatgatggtcgttcagaacctggcggcagcgcaaaagatg

SEQ ID NO: 4286 - DNA, 103 bp, Artificial Sequence
  Synthetic Polynucleotide
taatacgactcactatagggcgtcaagttagtgcctgctgaacgacacgcaacagaggagagcgtgtatgtcagcaggcaacctggcggcagcgcaaaagatg

SEQ ID NO: 4287 - DNA, 103 bp, Artificial Sequence
  Synthetic Polynucleotide
taatacgactcactatagggaccaacagcttctgtgcatcctccggcgtgaacagaggagacacgccatgggatgcacaaacctggcggcagcgcaaaagatg

SEQ ID NO: 4288 - DNA, 103 bp, Artificial Sequence
  Synthetic Polynucleotide
taatacgactcactatagggttagtcgtcaagttagtgcctgctgaacgaaacagaggagatcgttcatgaggcactaaaacctggcggcagcgcaaaagatg

SEQ ID NO: 4289 - DNA, 103 bp, Artificial Sequence
  Synthetic Polynucleotide
taatacgactcactatagggcatgcttagtcgtcaagttagtgcctgctgaacagaggagacagcagatgctaacttgaaacctggcggcagcgcaaaagatg

SEQ ID NO: 4290 - DNA, 103 bp, Artificial Sequence
  Synthetic Polynucleotide
taatacgactcactatagggaccttcatgcttagtcgtcaagttagtgccaacagaggagaggcactatgttgacgactaacctggcggcagcgcaaaagatg

SEQ ID NO: 4291 - DNA, 103 bp, Artificial Sequence
  Synthetic Polynucleotide
taatacgactcactatagggcatataccttcatgcttagtcgtcaagttaaacagaggagataacttatggactaagcaaacctggcggcagcgcaaaagatg

SEQ ID NO: 4292 - DNA, 103 bp, Artificial Sequence
  Synthetic Polynucleotide
taatacgactcactatagggggacacatataccttcatgcttagtcgtcaaacagaggagatgacgaatgagcatgaagaacctggcggcagcgcaaaagatg

SEQ ID NO: 4293 - DNA, 103 bp, Artificial Sequence
  Synthetic Polynucleotide
taatacgactcactatagggttaggggacacatataccttcatgcttagtaacagaggagaactaagatggaaggtataaacctggcggcagcgcaaaagatg

SEQ ID NO: 4294 - DNA, 103 bp, Artificial Sequence
  Synthetic Polynucleotide
taatacgactcactataggggtctcttaggggacacatataccttcatgcaacagaggagagcatgaatgtatatgtgtaacctggcggcagcgcaaaagatg

SEQ ID NO: 4295 - DNA, 103 bp, Artificial Sequence
  Synthetic Polynucleotide
taatacgactcactatagggggtgtgtctcttaggggacacatataccttaacagaggagaaaggtaatggtgtcccctaacctggcggcagcgcaaaagatg

SEQ ID NO: 4296 - DNA, 103 bp, Artificial Sequence
  Synthetic Polynucleotide
taatacgactcactatagggtatacggtgtgtctcttaggggacacatataacagaggagaatatgtatgccctaagagaacctggcggcagcgcaaaagatg

SEQ ID NO: 4297 - DNA, 103 bp, Artificial Sequence
  Synthetic Polynucleotide
taatacgactcactatagggagctatatacggtgtgtctcttaggggacaaacagaggagatgtcccatgagagacacaaacctggcggcagcgcaaaagatg

SEQ ID NO: 4298 - DNA, 103 bp, Artificial Sequence
  Synthetic Polynucleotide
taatacgactcactataggggccccaccaacagcttctgtgcatcctccgaacagaggagacggaggatgcacagaagcaacctggcggcagcgcaaaagatg

SEQ ID NO: 4299 - DNA, 103 bp, Artificial Sequence
  Synthetic Polynucleotide
taatacgactcactatagggttattagctatatacggtgtgtctcttaggaacagaggagacctaagatgcacaccgtaaacctggcggcagcgcaaaagatg

SEQ ID NO: 4300 - DNA, 103 bp, Artificial Sequence
  Synthetic Polynucleotide
taatacgactcactatagggacagattattagctatatacggtgtgtctcaacagaggagagagacaatgcgtatatagaacctggcggcagcgcaaaagatg

SEQ ID NO: 4301 - DNA, 103 bp, Artificial Sequence
  Synthetic Polynucleotide
taatacgactcactataggggatctacagattattagctatatacggtgtaacagaggagaacaccgatgatagctaataacctggcggcagcgcaaaagatg

SEQ ID NO: 4302 - DNA, 103 bp, Artificial Sequence
  Synthetic Polynucleotide
taatacgactcactatagggcctttgatctacagattattagctatatacaacagaggagagtatatatgtaataatctaacctggcggcagcgcaaaagatg

SEQ ID NO: 4303 - DNA, 103 bp, Artificial Sequence
  Synthetic Polynucleotide
taatacgactcactatagggatagccctttgatctacagattattagctaaacagaggagatagctaatgatctgtagaaacctggcggcagcgcaaaagatg

SEQ ID NO: 4304 - DNA, 103 bp, Artificial Sequence
  Synthetic Polynucleotide
taatacgactcactataggggttatatagccctttgatctacagattattaacagaggagaaataatatgtagatcaaaaacctggcggcagcgcaaaagatg

SEQ ID NO: 4305 - DNA, 103 bp, Artificial Sequence
  Synthetic Polynucleotide
taatacgactcactatagggcaggggttatatagccctttgatctacagaaacagaggagatctgtaatgcaaagggctaacctggcggcagcgcaaaagatg

SEQ ID NO: 4306 - DNA, 103 bp, Artificial Sequence
  Synthetic Polynucleotide
taatacgactcactatagggctattcaggggttatatagccctttgatctaacagaggagaagatcaatgggctatataaacctggcggcagcgcaaaagatg

SEQ ID NO: 4307 - DNA, 103 bp, Artificial Sequence
  Synthetic Polynucleotide
taatacgactcactatagggtgttactattcaggggttatatagccctttaacagaggagaaaagggatgtataaccccaacctggcggcagcgcaaaagatg

SEQ ID NO: 4308 - DNA, 103 bp, Artificial Sequence
  Synthetic Polynucleotide
taatacgactcactatagggtattttgttactattcaggggttatatagcaacagaggagagctataatgcccctgaataacctggcggcagcgcaaaagatg

SEQ ID NO: 4309 - DNA, 103 bp, Artificial Sequence
  Synthetic Polynucleotide
taatacgactcactataggggttcagccccaccaacagcttctgtgcatcaacagaggagagatgcaatgaagctgttgaacctggcggcagcgcaaaagatg

SEQ ID NO: 4310 - DNA, 103 bp, Artificial Sequence
  Synthetic Polynucleotide
taatacgactcactatagggttttgtattttgttactattcaggggttataacagaggagaataaccatggaatagtaaaacctggcggcagcgcaaaagatg

SEQ ID NO: 4311 - DNA, 103 bp, Artificial Sequence
  Synthetic Polynucleotide
taatacgactcactatagggagtgattttgtattttgttactattcagggaacagaggagaccctgaatggtaacaaaaaacctggcggcagcgcaaaagatg

SEQ ID NO: 4312 - DNA, 103 bp, Artificial Sequence
  Synthetic Polynucleotide
taatacgactcactatagggtttttagtgattttgtattttgttactattaacagaggagaaatagtatgaaaatacaaaacctggcggcagcgcaaaagatg

SEQ ID NO: 4313 - DNA, 103 bp, Artificial Sequence
  Synthetic Polynucleotide
taatacgactcactatagggtataatttttagtgattttgtattttgttaaacagaggagataacaaatgacaaaatcaaacctggcggcagcgcaaaagatg

SEQ ID NO: 4314 - DNA, 103 bp, Artificial Sequence
  Synthetic Polynucleotide
taatacgactcactatagggttttttataatttttagtgattttgtatttaacagaggagaaaatacatgatcactaaaaacctggcggcagcgcaaaagatg

SEQ ID NO: 4315 - DNA, 103 bp, Artificial Sequence
  Synthetic Polynucleotide
taatacgactcactatagggtttttttttttataatttttagtgattttgaacagaggagacaaaatatgtaaaaattaaacctggcggcagcgcaaaagatg

SEQ ID NO: 4316 - DNA, 103 bp, Artificial Sequence
  Synthetic Polynucleotide
taatacgactcactatagggttttttttttttttttataatttttagtgaaacagaggagatcactaatgattataaaaaacctggcggcagcgcaaaagatg

SEQ ID NO: 4317 - DNA, 103 bp, Artificial Sequence
  Synthetic Polynucleotide
taatacgactcactatagggtgtttttttttttttttttttataatttttaacagaggagaaaaaatatgaaaaaaaaaaacctggcggcagcgcaaaagatg

SEQ ID NO: 4318 - DNA, 103 bp, Artificial Sequence
  Synthetic Polynucleotide
taatacgactcactatagggttttctgtttttttttttttttttttataaaacagaggagattataaatgaaaaaaaaaaacctggcggcagcgcaaaagatg

SEQ ID NO: 4319 - DNA, 103 bp, Artificial Sequence
  Synthetic Polynucleotide
taatacgactcactatagggtatatttttctgttttttttttttttttttaacagaggagaaaaaaaatgaaaaaaaaaaacctggcggcagcgcaaaagatg

SEQ ID NO: 4320 - DNA, 103 bp, Artificial Sequence
  Synthetic Polynucleotide
taatacgactcactatagggctctggttcagccccaccaacagcttctgtaacagaggagaacagaaatggttggtgggaacctggcggcagcgcaaaagatg

SEQ ID NO: 4321 - DNA, 103 bp, Artificial Sequence
  Synthetic Polynucleotide
taatacgactcactatagggatttatatatttttctgtttttttttttttaacagaggagaaaaaaaatgaaaacagaaaacctggcggcagcgcaaaagatg

SEQ ID NO: 4322 - DNA, 103 bp, Artificial Sequence
  Synthetic Polynucleotide
taatacgactcactatagggtacctatttatatatttttctgttttttttaacagaggagaaaaaaaatgagaaaaataaacctggcggcagcgcaaaagatg

SEQ ID NO: 4323 - DNA, 103 bp, Artificial Sequence
  Synthetic Polynucleotide
taatacgactcactatagggacgtatacctatttatatatttttctgtttaacagaggagaaaacagatgaatatataaaacctggcggcagcgcaaaagatg

SEQ ID NO: 4324 - DNA, 103 bp, Artificial Sequence
  Synthetic Polynucleotide
taatacgactcactataggggggacacgtatacctatttatatatttttcaacagaggagagaaaaaatgataaataggaacctggcggcagcgcaaaagatg

SEQ ID NO: 4325 - DNA, 103 bp, Artificial Sequence
  Synthetic Polynucleotide
taatacgactcactatagggcttaggggacacgtatacctatttatatataacagaggagaatatatatgtaggtatacaacctggcggcagcgcaaaagatg

SEQ ID NO: 4326 - DNA, 103 bp, Artificial Sequence
  Synthetic Polynucleotide
taatacgactcactatagggtgtctcttaggggacacgtatacctatttaaacagaggagataaataatgatacgtgtcaacctggcggcagcgcaaaagatg

SEQ ID NO: 4327 - DNA, 103 bp, Artificial Sequence
  Synthetic Polynucleotide
taatacgactcactatagggcaatgtgtctcttaggggacacgtatacctaacagaggagaaggtatatgtgtcccctaaacctggcggcagcgcaaaagatg

SEQ ID NO: 4328 - DNA, 103 bp, Artificial Sequence
  Synthetic Polynucleotide
taatacgactcactatagggacatacaatgtgtctcttaggggacacgtaaacagaggagatacgtgatgcctaagagaaacctggcggcagcgcaaaagatg

SEQ ID NO: 4329 - DNA, 103 bp, Artificial Sequence
  Synthetic Polynucleotide
taatacgactcactatagggcacctacatacaatgtgtctcttaggggacaacagaggagagtccccatggagacacataacctggcggcagcgcaaaagatg

SEQ ID NO: 4330 - DNA, 103 bp, Artificial Sequence
  Synthetic Polynucleotide
taatacgactcactatagggcttatcacctacatacaatgtgtctcttagaacagaggagactaagaatgacattgtataacctggcggcagcgcaaaagatg

SEQ ID NO: 4331 - DNA, 103 bp, Artificial Sequence
  Synthetic Polynucleotide
taatacgactcactatagggacgcacgttgcagggccttcaaaaaggcgcaacagaggagagcgcctatgtgaaggcccaacctggcggcagcgcaaaagatg

SEQ ID NO: 4332 - DNA, 103 bp, Artificial Sequence
  Synthetic Polynucleotide
taatacgactcactatagggctattctctggttcagccccaccaacagctaacagaggagaagctgtatgtggggctgaaacctggcggcagcgcaaaagatg

SEQ ID NO: 4333 - DNA, 103 bp, Artificial Sequence
  Synthetic Polynucleotide
taatacgactcactatagggctatacttatcacctacatacaatgtgtctaacagaggagaagacacatggtatgtaggaacctggcggcagcgcaaaagatg

SEQ ID NO: 4334 - DNA, 103 bp, Artificial Sequence
  Synthetic Polynucleotide
taatacgactcactatagggttgatctatacttatcacctacatacaatgaacagaggagacattgtatgtaggtgataaacctggcggcagcgcaaaagatg

SEQ ID NO: 4335 - DNA, 103 bp, Artificial Sequence
  Synthetic Polynucleotide
taatacgactcactataggggccctttgatctatacttatcacctacataaacagaggagatatgtaatggataagtataacctggcggcagcgcaaaagatg

SEQ ID NO: 4336 - DNA, 103 bp, Artificial Sequence
  Synthetic Polynucleotide
taatacgactcactataggggttcggccctttgatctatacttatcacctaacagaggagaaggtgaatggtatagatcaacctggcggcagcgcaaaagatg

SEQ ID NO: 4337 - DNA, 103 bp, Artificial Sequence
  Synthetic Polynucleotide
taatacgactcactataggggggttgttcggccctttgatctatacttataacagaggagaataagtatggatcaaaggaacctggcggcagcgcaaaagatg

SEQ ID NO: 4338 - DNA, 103 bp, Artificial Sequence
  Synthetic Polynucleotide
taatacgactcactatagggttcaggggttgttcggccctttgatctataaacagaggagatatagaatgaagggccgaaacctggcggcagcgcaaaagatg

SEQ ID NO: 4339 - DNA, 103 bp, Artificial Sequence
  Synthetic Polynucleotide
taatacgactcactatagggtactattcaggggttgttcggccctttgataacagaggagaatcaaaatgccgaacaacaacctggcggcagcgcaaaagatg

SEQ ID NO: 4340 - DNA, 103 bp, Artificial Sequence
  Synthetic Polynucleotide
taatacgactcactatagggtttgttactattcaggggttgttcggccctaacagaggagaagggccatgcaacccctgaacctggcggcagcgcaaaagatg

SEQ ID NO: 4341 - DNA, 103 bp, Artificial Sequence
  Synthetic Polynucleotide
taatacgactcactatagggtatattttgttactattcaggggttgttcgaacagaggagacgaacaatgcctgaatagaacctggcggcagcgcaaaagatg

SEQ ID NO: 4342 - DNA, 103 bp, Artificial Sequence
  Synthetic Polynucleotide
taatacgactcactatagggatttttatattttgttactattcaggggttaacagaggagaaaccccatgatagtaacaaacctggcggcagcgcaaaagatg

SEQ ID NO: 4343 - DNA, 103 bp, Artificial Sequence
  Synthetic Polynucleotide
taatacgactcactatagggaaccactattctctggttcagccccaccaaaacagaggagattggtgatgctgaaccagaacctggcggcagcgcaaaagatg

SEQ ID NO: 4344 - DNA, 103 bp, Artificial Sequence
  Synthetic Polynucleotide
taatacgactcactatagggtattaatttttatattttgttactattcagaacagaggagactgaatatgaacaaaataaacctggcggcagcgcaaaagatg

SEQ ID NO: 4345 - DNA, 103 bp, Artificial Sequence
  Synthetic Polynucleotide
taatacgactcactatagggatttttattaatttttatattttgttactaaacagaggagatagtaaatgaatataaaaaacctggcggcagcgcaaaagatg

SEQ ID NO: 4346 - DNA, 103 bp, Artificial Sequence
  Synthetic Polynucleotide
taatacgactcactatagggttatgatttttattaatttttatattttgtaacagaggagaacaaaaatgaaaaattaaaacctggcggcagcgcaaaagatg

SEQ ID NO: 4347 - DNA, 103 bp, Artificial Sequence
  Synthetic Polynucleotide
taatacgactcactatagggctattttatgatttttattaatttttatataacagaggagaatataaatgttaataaaaaacctggcggcagcgcaaaagatg

SEQ ID NO: 4348 - DNA, 103 bp, Artificial Sequence
  Synthetic Polynucleotide
taatacgactcactatagggtttttctattttatgatttttattaattttaacagaggagaaaaattatgaaaaatcataacctggcggcagcgcaaaagatg

SEQ ID NO: 4349 - DNA, 103 bp, Artificial Sequence
  Synthetic Polynucleotide
taatacgactcactatagggtatggtttttctattttatgatttttattaaacagaggagataataaatgtcataaaataacctggcggcagcgcaaaagatg

SEQ ID NO: 4350 - DNA, 103 bp, Artificial Sequence
  Synthetic Polynucleotide
taatacgactcactatagggctgtttatggtttttctattttatgattttaacagaggagaaaaatcatgaaatagaaaaacctggcggcagcgcaaaagatg

SEQ ID NO: 4351 - DNA, 103 bp, Artificial Sequence
  Synthetic Polynucleotide
taatacgactcactatagggtacttctgtttatggtttttctattttatgaacagaggagacataaaatggaaaaaccaaacctggcggcagcgcaaaagatg

SEQ ID NO: 4352 - DNA, 103 bp, Artificial Sequence
  Synthetic Polynucleotide
taatacgactcactatagggtgaactacttctgtttatggtttttctattaacagaggagaaatagaatgaccataaacaacctggcggcagcgcaaaagatg

SEQ ID NO: 4353 - DNA, 103 bp, Artificial Sequence
  Synthetic Polynucleotide
taatacgactcactatagggccctttgaactacttctgtttatggtttttaacagaggagaaaaaacatgaaacagaagaacctggcggcagcgcaaaagatg

SEQ ID NO: 4354 - DNA, 103 bp, Artificial Sequence
  Synthetic Polynucleotide
taatacgactcactatagggccgttaaccactattctctggttcagccccaacagaggagaggggctatgccagagaataacctggcggcagcgcaaaagatg

SEQ ID NO: 4355 - DNA, 103 bp, Artificial Sequence
  Synthetic Polynucleotide
taatacgactcactatagggtatagccctttgaactacttctgtttatggaacagaggagaccataaatggaagtagttaacctggcggcagcgcaaaagatg

SEQ ID NO: 4356 - DNA, 103 bp, Artificial Sequence
  Synthetic Polynucleotide
taatacgactcactataggggtttttatagccctttgaactacttctgttaacagaggagaaacagaatgagttcaaagaacctggcggcagcgcaaaagatg

SEQ ID NO: 4357 - DNA, 103 bp, Artificial Sequence
  Synthetic Polynucleotide
taatacgactcactatagggcaggggtttttatagccctttgaactacttaacagaggagaaagtagatgaaagggctaaacctggcggcagcgcaaaagatg

SEQ ID NO: 4358 - DNA, 103 bp, Artificial Sequence
  Synthetic Polynucleotide
taatacgactcactatagggctattcaggggtttttatagccctttgaacaacagaggagagttcaaatggctataaaaaacctggcggcagcgcaaaagatg

SEQ ID NO: 4359 - DNA, 103 bp, Artificial Sequence
  Synthetic Polynucleotide
taatacgactcactatagggtgttactattcaggggtttttatagcccttaacagaggagaaagggcatgaaaaaccccaacctggcggcagcgcaaaagatg

SEQ ID NO: 4360 - DNA, 103 bp, Artificial Sequence
  Synthetic Polynucleotide
taatacgactcactatagggtgttttgttactattcaggggtttttatagaacagaggagactataaatgcccctgaataacctggcggcagcgcaaaagatg

SEQ ID NO: 4361 - DNA, 103 bp, Artificial Sequence
  Synthetic Polynucleotide
taatacgactcactatagggttttatgttttgttactattcaggggttttaacagaggagaaaaaccatggaatagtaaaacctggcggcagcgcaaaagatg

SEQ ID NO: 4362 - DNA, 103 bp, Artificial Sequence
  Synthetic Polynucleotide
taatacgactcactatagggattagttttatgttttgttactattcagggaacagaggagaccctgaatggtaacaaaaaacctggcggcagcgcaaaagatg

SEQ ID NO: 4363 - DNA, 103 bp, Artificial Sequence
  Synthetic Polynucleotide
taatacgactcactatagggtttttattagttttatgttttgttactattaacagaggagaaatagtatgaaaacataaaacctggcggcagcgcaaaagatg

SEQ ID NO: 4364 - DNA, 103 bp, Artificial Sequence
  Synthetic Polynucleotide
taatacgactcactatagggtttgatttttattagttttatgttttgttaaacagaggagataacaaatgataaaactaaacctggcggcagcgcaaaagatg

SEQ ID NO: 4365 - DNA, 103 bp, Artificial Sequence
  Synthetic Polynucleotide
taatacgactcactatagggttctgccgttaaccactattctctggttcaaacagaggagatgaaccatggaatagtggaacctggcggcagcgcaaaagatg

SEQ ID NO: 4366 - DNA, 103 bp, Artificial Sequence
  Synthetic Polynucleotide
taatacgactcactatagggattcatttgatttttattagttttatgtttaacagaggagaaaacatatgactaataaaaacctggcggcagcgcaaaagatg

SEQ ID NO: 4367 - DNA, 103 bp, Artificial Sequence
  Synthetic Polynucleotide
taatacgactcactatagggatggtattcatttgatttttattagttttaaacagaggagataaaacatgtaaaaatcaaacctggcggcagcgcaaaagatg

SEQ ID NO: 4368 - DNA, 103 bp, Artificial Sequence
  Synthetic Polynucleotide
taatacgactcactatagggcaattatggtattcatttgatttttattagaacagaggagactaataatgatcaaatgaaacctggcggcagcgcaaaagatg

SEQ ID NO: 4369 - DNA, 103 bp, Artificial Sequence
  Synthetic Polynucleotide
taatacgactcactatagggtttgccaattatggtattcatttgatttttaacagaggagaaaaaatatgatgaataccaacctggcggcagcgcaaaagatg

SEQ ID NO: 4370 - DNA, 103 bp, Artificial Sequence
  Synthetic Polynucleotide
taatacgactcactatagggttccgtttgccaattatggtattcatttgaaacagaggagatcaaatatgtaccataataacctggcggcagcgcaaaagatg

SEQ ID NO: 4371 - DNA, 103 bp, Artificial Sequence
  Synthetic Polynucleotide
taatacgactcactatagggatctcttccgtttgccaattatggtattcaaacagaggagatgaataatgtaattggcaaacctggcggcagcgcaaaagatg

SEQ ID NO: 4372 - DNA, 103 bp, Artificial Sequence
  Synthetic Polynucleotide
taatacgactcactatagggcctacatctcttccgtttgccaattatggtaacagaggagaaccataatgggcaaacggaacctggcggcagcgcaaaagatg

SEQ ID NO: 4373 - DNA, 103 bp, Artificial Sequence
  Synthetic Polynucleotide
taatacgactcactatagggaagtacctacatctcttccgtttgccaattaacagaggagaaattggatgacggaagagaacctggcggcagcgcaaaagatg

SEQ ID NO: 4374 - DNA, 103 bp, Artificial Sequence
  Synthetic Polynucleotide
taatacgactcactatagggagcttaagtacctacatctcttccgtttgcaacagaggagagcaaacatgagagatgtaaacctggcggcagcgcaaaagatg

SEQ ID NO: 4375 - DNA, 103 bp, Artificial Sequence
  Synthetic Polynucleotide
taatacgactcactatagggtaggaagcttaagtacctacatctcttccgaacagaggagacggaagatgtgtaggtacaacctggcggcagcgcaaaagatg

SEQ ID NO: 4376 - DNA, 103 bp, Artificial Sequence
  Synthetic Polynucleotide
taatacgactcactatagggttgcgttctgccgttaaccactattctctgaacagaggagacagagaatggtggttaacaacctggcggcagcgcaaaagatg

SEQ ID NO: 4377 - DNA, 103 bp, Artificial Sequence
  Synthetic Polynucleotide
taatacgactcactataggggcttttaggaagcttaagtacctacatctcaacagaggagagagatgatggtacttaagaacctggcggcagcgcaaaagatg

SEQ ID NO: 4378 - DNA, 103 bp, Artificial Sequence
  Synthetic Polynucleotide
taatacgactcactatagggcggctgcttttaggaagcttaagtacctacaacagaggagagtaggtatgtaagcttccaacctggcggcagcgcaaaagatg

SEQ ID NO: 4379 - DNA, 103 bp, Artificial Sequence
  Synthetic Polynucleotide
taatacgactcactataggggagttcggctgcttttaggaagcttaagtaaacagaggagatacttaatgttcctaaaaaacctggcggcagcgcaaaagatg

SEQ ID NO: 4380 - DNA, 103 bp, Artificial Sequence
  Synthetic Polynucleotide
taatacgactcactatagggaaagtgagttcggctgcttttaggaagcttaacagaggagaaagcttatgaaaagcagcaacctggcggcagcgcaaaagatg

SEQ ID NO: 4381 - DNA, 103 bp, Artificial Sequence
  Synthetic Polynucleotide
taatacgactcactatagggatctcaaagtgagttcggctgcttttaggaaacagaggagatcctaaatgcagccgaacaacctggcggcagcgcaaaagatg

SEQ ID NO: 4382 - DNA, 103 bp, Artificial Sequence
  Synthetic Polynucleotide
taatacgactcactatagggcctacatctcaaagtgagttcggctgctttaacagaggagaaaagcaatggaactcactaacctggcggcagcgcaaaagatg

SEQ ID NO: 4383 - DNA, 103 bp, Artificial Sequence
  Synthetic Polynucleotide
taatacgactcactatagggctatgcctacatctcaaagtgagttcggctaacagaggagaagccgaatgcactttgagaacctggcggcagcgcaaaagatg

SEQ ID NO: 4384 - DNA, 103 bp, Artificial Sequence
  Synthetic Polynucleotide
taatacgactcactataggggtatgctatgcctacatctcaaagtgagttaacagaggagaaactcaatgtgagatgtaaacctggcggcagcgcaaaagatg

SEQ ID NO: 4385 - DNA, 103 bp, Artificial Sequence
  Synthetic Polynucleotide
taatacgactcactataggggttcggtatgctatgcctacatctcaaagtaacagaggagaactttgatgtgtaggcataacctggcggcagcgcaaaagatg

SEQ ID NO: 4386 - DNA, 103 bp, Artificial Sequence
  Synthetic Polynucleotide
taatacgactcactataggggaagagttcggtatgctatgcctacatctcaacagaggagagagatgatggcatagcataacctggcggcagcgcaaaagatg

SEQ ID NO: 4387 - DNA, 103 bp, Artificial Sequence
  Synthetic Polynucleotide
taatacgactcactatagggttccgttgcgttctgccgttaaccactattaacagaggagaaatagtatgtaacggcagaacctggcggcagcgcaaaagatg

SEQ ID NO: 4388 - DNA, 103 bp, Artificial Sequence
  Synthetic Polynucleotide
taatacgactcactatagggtcgtggaagagttcggtatgctatgcctacaacagaggagagtaggcatggcataccgaaacctggcggcagcgcaaaagatg

SEQ ID NO: 4389 - DNA, 103 bp, Artificial Sequence
  Synthetic Polynucleotide
taatacgactcactataggggagaatcgtggaagagttcggtatgctatgaacagaggagacatagcatgccgaactctaacctggcggcagcgcaaaagatg

SEQ ID NO: 4390 - DNA, 103 bp, Artificial Sequence
  Synthetic Polynucleotide
taatacgactcactataggggttcggagaatcgtggaagagttcggtatgaacagaggagacataccatgctcttccacaacctggcggcagcgcaaaagatg

SEQ ID NO: 4391 - DNA, 103 bp, Artificial Sequence
  Synthetic Polynucleotide
taatacgactcactatagggtgtgggttcggagaatcgtggaagagttcgaacagaggagacgaactatgccacgattcaacctggcggcagcgcaaaagatg

SEQ ID NO: 4392 - DNA, 103 bp, Artificial Sequence
  Synthetic Polynucleotide
taatacgactcactataggggtccctgtgggttcggagaatcgtggaagaaacagaggagatcttccatgattctccgaaacctggcggcagcgcaaaagatg

SEQ ID NO: 4393 - DNA, 103 bp, Artificial Sequence
  Synthetic Polynucleotide
taatacgactcactatagggcctacgtccctgtgggttcggagaatcgtgaacagaggagacacgatatgccgaacccaaacctggcggcagcgcaaaagatg

SEQ ID NO: 4394 - DNA, 103 bp, Artificial Sequence
  Synthetic Polynucleotide
taatacgactcactatagggcatctcctacgtccctgtgggttcggagaaaacagaggagattctccatgcccacagggaacctggcggcagcgcaaaagatg

SEQ ID NO: 4395 - DNA, 103 bp, Artificial Sequence
  Synthetic Polynucleotide
taatacgactcactatagggaataacatctcctacgtccctgtgggttcgaacagaggagacgaaccatgagggacgtaaacctggcggcagcgcaaaagatg

SEQ ID NO: 4396 - DNA, 103 bp, Artificial Sequence
  Synthetic Polynucleotide
taatacgactcactatagggaacaaaataacatctcctacgtccctgtggaacagaggagaccacagatgcgtaggagaaacctggcggcagcgcaaaagatg

SEQ ID NO: 4397 - DNA, 103 bp, Artificial Sequence
  Synthetic Polynucleotide
taatacgactcactatagggttaaaaacaaaataacatctcctacgtcccaacagaggagagggacgatggagatgttaaacctggcggcagcgcaaaagatg

SEQ ID NO: 4398 - DNA, 103 bp, Artificial Sequence
  Synthetic Polynucleotide
taatacgactcactatagggtcgtattccgttgcgttctgccgttaaccaaacagaggagatggttaatggcagaacgcaacctggcggcagcgcaaaagatg

SEQ ID NO: 4399 - DNA, 103 bp, Artificial Sequence
  Synthetic Polynucleotide
taatacgactcactatagggaaatattaaaaacaaaataacatctcctacaacagaggagagtaggaatggttattttgaacctggcggcagcgcaaaagatg

SEQ ID NO: 4400 - DNA, 103 bp, Artificial Sequence
  Synthetic Polynucleotide
taatacgactcactatagggggtgttcgtattccgttgcgttctgccgttaacagaggagaaacggcatgacgcaacggaacctggcggcagcgcaaaagatg

SEQ ID NO: 4401 - DNA, 103 bp, Artificial Sequence
  Synthetic Polynucleotide
taatacgactcactatagggttcatggtgttcgtattccgttgcgttctgaacagaggagacagaacatgacggaatacaacctggcggcagcgcaaaagatg

SEQ ID NO: 4402 - DNA, 103 bp, Artificial Sequence
  Synthetic Polynucleotide
taatacgactcactatagggagtttttcatggtgttcgtattccgttgcgaacagaggagacgcaacatgatacgaacaaacctggcggcagcgcaaaagatg

SEQ ID NO: 4403 - DNA, 103 bp, Artificial Sequence
  Synthetic Polynucleotide
taatacgactcactatagggggggtacgcacgttgcagggccttcaaaaaaacagaggagatttttgatggccctgcaaaacctggcggcagcgcaaaagatg

SEQ ID NO: 4404 - DNA, 103 bp, Artificial Sequence
  Synthetic Polynucleotide
taatacgactcactatagggcatatagtttttcatggtgttcgtattccgaacagaggagacggaatatgaacaccatgaacctggcggcagcgcaaaagatg

SEQ ID NO: 4405 - DNA, 103 bp, Artificial Sequence
  Synthetic Polynucleotide
taatacgactcactatagggggaatcatatagtttttcatggtgttcgtaaacagaggagatacgaaatgcatgaaaaaaacctggcggcagcgcaaaagatg

SEQ ID NO: 4406 - DNA, 103 bp, Artificial Sequence
  Synthetic Polynucleotide
taatacgactcactatagggccacgggaatcatatagtttttcatggtgtaacagaggagaacaccaatgaaaactataaacctggcggcagcgcaaaagatg

SEQ ID NO: 4407 - DNA, 103 bp, Artificial Sequence
  Synthetic Polynucleotide
taatacgactcactatagggggcgaccacgggaatcatatagtttttcataacagaggagaatgaaaatgtatatgattaacctggcggcagcgcaaaagatg

SEQ ID NO: 4408 - DNA, 103 bp, Artificial Sequence
  Synthetic Polynucleotide
taatacgactcactataggggcttgggcgaccacgggaatcatatagtttaacagaggagaaaactaatggattcccgtaacctggcggcagcgcaaaagatg

SEQ ID NO: 4409 - DNA, 103 bp, Artificial Sequence
  Synthetic Polynucleotide
taatacgactcactatagggtgaaggcttgggcgaccacgggaatcatataacagaggagaatatgaatgccgtggtcgaacctggcggcagcgcaaaagatg

SEQ ID NO: 4410 - DNA, 103 bp, Artificial Sequence
  Synthetic Polynucleotide
taatacgactcactatagggcttactgaaggcttgggcgaccacgggaataacagaggagaattcccatggtcgcccaaaacctggcggcagcgcaaaagatg

SEQ ID NO: 4411 - DNA, 103 bp, Artificial Sequence
  Synthetic Polynucleotide
taatacgactcactataggggcccacttactgaaggcttgggcgaccacgaacagaggagacgtggtatgccaagccttaacctggcggcagcgcaaaagatg

SEQ ID NO: 4412 - DNA, 103 bp, Artificial Sequence
  Synthetic Polynucleotide
taatacgactcactatagggcctttgcccacttactgaaggcttgggcgaaacagaggagatcgcccatgccttcagtaaacctggcggcagcgcaaaagatg

SEQ ID NO: 4413 - DNA, 103 bp, Artificial Sequence
  Synthetic Polynucleotide
taatacgactcactataggggcactcctttgcccacttactgaaggcttgaacagaggagacaagccatgagtaagtggaacctggcggcagcgcaaaagatg

SEQ ID NO: 4414 - DNA, 103 bp, Artificial Sequence
  Synthetic Polynucleotide
taatacgactcactatagggaacatggggtacgcacgttgcagggccttcaacagaggagagaaggcatggcaacgtgcaacctggcggcagcgcaaaagatg

SEQ ID NO: 4415 - DNA, 103 bp, Artificial Sequence
  Synthetic Polynucleotide
taatacgactcactatagggttccggcactcctttgcccacttactgaagaacagaggagacttcagatggtgggcaaaaacctggcggcagcgcaaaagatg

SEQ ID NO: 4416 - DNA, 103 bp, Artificial Sequence
  Synthetic Polynucleotide
taatacgactcactatagggtgtctttccggcactcctttgcccacttacaacagaggagagtaagtatgcaaaggagtaacctggcggcagcgcaaaagatg

SEQ ID NO: 4417 - DNA, 103 bp, Artificial Sequence
  Synthetic Polynucleotide
taatacgactcactatagggttccatgtctttccggcactcctttgcccaaacagaggagatgggcaatggagtgccggaacctggcggcagcgcaaaagatg

SEQ ID NO: 4418 - DNA, 103 bp, Artificial Sequence
  Synthetic Polynucleotide
taatacgactcactatagggtcatcttccatgtctttccggcactcctttaacagaggagaaaaggaatgccggaaagaaacctggcggcagcgcaaaagatg

SEQ ID NO: 4419 - DNA, 103 bp, Artificial Sequence
  Synthetic Polynucleotide
taatacgactcactataggggtttttcatcttccatgtctttccggcactaacagaggagaagtgccatgaagacatggaacctggcggcagcgcaaaagatg

SEQ ID NO: 4420 - DNA, 103 bp, Artificial Sequence
  Synthetic Polynucleotide
taatacgactcactatagggcaggagtttttcatcttccatgtctttccgaacagaggagacggaaaatgatggaagataacctggcggcagcgcaaaagatg

SEQ ID NO: 4421 - DNA, 103 bp, Artificial Sequence
  Synthetic Polynucleotide
taatacgactcactatagggacccccaggagtttttcatcttccatgtctaacagaggagaagacatatgagatgaaaaaacctggcggcagcgcaaaagatg

SEQ ID NO: 4422 - DNA, 103 bp, Artificial Sequence
  Synthetic Polynucleotide
taatacgactcactatagggctctgacccccaggagtttttcatcttccaaacagaggagatggaagatgaaaaactccaacctggcggcagcgcaaaagatg

SEQ ID NO: 4423 - DNA, 103 bp, Artificial Sequence
  Synthetic Polynucleotide
taatacgactcactatagggtctttctctgacccccaggagtttttcatcaacagaggagagatgaaatgctcctggggaacctggcggcagcgcaaaagatg

SEQ ID NO: 4424 - DNA, 103 bp, Artificial Sequence
  Synthetic Polynucleotide
taatacgactcactatagggagtgttctttctctgacccccaggagttttaacagaggagaaaaactatggggggtcagaacctggcggcagcgcaaaagatg

SEQ ID NO: 4425 - DNA, 103 bp, Artificial Sequence
  Synthetic Polynucleotide
taatacgactcactatagggcctcaaacatggggtacgcacgttgcagggaacagaggagaccctgcatggtgcgtaccaacctggcggcagcgcaaaagatg

SEQ ID NO: 4426 - DNA, 103 bp, Artificial Sequence
  Synthetic Polynucleotide
taatacgactcactatagggaggtcagtgttctttctctgacccccaggaaacagaggagatcctggatgtcagagaaaaacctggcggcagcgcaaaagatg

SEQ ID NO: 4427 - DNA, 103 bp, Artificial Sequence
  Synthetic Polynucleotide
taatacgactcactataggggcagcaggtcagtgttctttctctgaccccaacagaggagaggggtcatggaaagaacaaacctggcggcagcgcaaaagatg

SEQ ID NO: 4428 - DNA, 103 bp, Artificial Sequence
  Synthetic Polynucleotide
taatacgactcactatagggagacagcagcaggtcagtgttctttctctgaacagaggagacagagaatgaacactgacaacctggcggcagcgcaaaagatg

SEQ ID NO: 4429 - DNA, 103 bp, Artificial Sequence
  Synthetic Polynucleotide
taatacgactcactatagggcccatagacagcagcaggtcagtgttctttaacagaggagaaaagaaatgtgacctgctaacctggcggcagcgcaaaagatg

SEQ ID NO: 4430 - DNA, 103 bp, Artificial Sequence
  Synthetic Polynucleotide
taatacgactcactatagggaaatgcccatagacagcagcaggtcagtgtaacagaggagaacactgatgtgctgctgtaacctggcggcagcgcaaaagatg

SEQ ID NO: 4431 - DNA, 103 bp, Artificial Sequence
  Synthetic Polynucleotide
taatacgactcactatagggttcttaaatgcccatagacagcagcaggtcaacagaggagagacctgatgctgtctatgaacctggcggcagcgcaaaagatg

SEQ ID NO: 4432 - DNA, 103 bp, Artificial Sequence
  Synthetic Polynucleotide
taatacgactcactatagggtctgcttcttaaatgcccatagacagcagcaacagaggagagctgctatgtatgggcataacctggcggcagcgcaaaagatg

SEQ ID NO: 4433 - DNA, 103 bp, Artificial Sequence
  Synthetic Polynucleotide
taatacgactcactatagggtgttttctgcttcttaaatgcccatagacaaacagaggagatgtctaatggcatttaagaacctggcggcagcgcaaaagatg

SEQ ID NO: 4434 - DNA, 103 bp, Artificial Sequence
  Synthetic Polynucleotide
taatacgactcactataggggtgtgtgttttctgcttcttaaatgcccataacagaggagaatgggcatgtaagaagcaaacctggcggcagcgcaaaagatg

SEQ ID NO: 4435 - DNA, 103 bp, Artificial Sequence
  Synthetic Polynucleotide
taatacgactcactatagggagaccgtgtgtgttttctgcttcttaaatgaacagaggagacatttaatgagcagaaaaaacctggcggcagcgcaaaagatg

SEQ ID NO: 4436 - DNA, 103 bp, Artificial Sequence
  Synthetic Polynucleotide
taatacgactcactatagggttccacctcaaacatggggtacgcacgttgaacagaggagacaacgtatgtaccccatgaacctggcggcagcgcaaaagatg

SEQ ID NO: 4437 - DNA, 103 bp, Artificial Sequence
  Synthetic Polynucleotide
taatacgactcactatagggcttgtagaccgtgtgtgttttctgcttcttaacagaggagaaagaagatgaaaacacacaacctggcggcagcgcaaaagatg

SEQ ID NO: 4438 - DNA, 103 bp, Artificial Sequence
  Synthetic Polynucleotide
taatacgactcactatagggggcctcttgtagaccgtgtgtgttttctgcaacagaggagagcagaaatgacacacggtaacctggcggcagcgcaaaagatg

SEQ ID NO: 4439 - DNA, 103 bp, Artificial Sequence
  Synthetic Polynucleotide
taatacgactcactatagggtatcaggcctcttgtagaccgtgtgtgtttaacagaggagaaaacacatgcggtctacaaacctggcggcagcgcaaaagatg

SEQ ID NO: 4440 - DNA, 103 bp, Artificial Sequence
  Synthetic Polynucleotide
taatacgactcactatagggctgggtatcaggcctcttgtagaccgtgtgaacagaggagacacacgatgtacaagaggaacctggcggcagcgcaaaagatg

SEQ ID NO: 4441 - DNA, 103 bp, Artificial Sequence
  Synthetic Polynucleotide
taatacgactcactatagggattgactgggtatcaggcctcttgtagaccaacagaggagaggtctaatggaggcctgaaacctggcggcagcgcaaaagatg

SEQ ID NO: 4442 - DNA, 103 bp, Artificial Sequence
  Synthetic Polynucleotide
taatacgactcactatagggtctgaattgactgggtatcaggcctcttgtaacagaggagaacaagaatgctgatacccaacctggcggcagcgcaaaagatg

SEQ ID NO: 4443 - DNA, 103 bp, Artificial Sequence
  Synthetic Polynucleotide
taatacgactcactatagggaaccttctgaattgactgggtatcaggcctaacagaggagaaggcctatgacccagtcaaacctggcggcagcgcaaaagatg

SEQ ID NO: 4444 - DNA, 103 bp, Artificial Sequence
  Synthetic Polynucleotide
taatacgactcactataggggcctgaaccttctgaattgactgggtatcaaacagaggagatgatacatggtcaattcaaacctggcggcagcgcaaaagatg

SEQ ID NO: 4445 - DNA, 103 bp, Artificial Sequence
  Synthetic Polynucleotide
taatacgactcactatagggactcggcctgaaccttctgaattgactgggaacagaggagacccagtatgttcagaaggaacctggcggcagcgcaaaagatg

SEQ ID NO: 4446 - DNA, 103 bp, Artificial Sequence
  Synthetic Polynucleotide
taatacgactcactataggggtcaaactcggcctgaaccttctgaattgaaacagaggagatcaattatgaaggttcagaacctggcggcagcgcaaaagatg

SEQ ID NO: 4447 - DNA, 103 bp, Artificial Sequence
  Synthetic Polynucleotide
taatacgactcactatagggctaggttccacctcaaacatggggtacgcaaacagaggagatgcgtaatgcatgtttgaaacctggcggcagcgcaaaagatg

SEQ ID NO: 4448 - DNA, 103 bp, Artificial Sequence
  Synthetic Polynucleotide
taatacgactcactatagggaagctgtcaaactcggcctgaaccttctgaaacagaggagatcagaaatgtcaggccgaaacctggcggcagcgcaaaagatg

SEQ ID NO: 4449 - DNA, 103 bp, Artificial Sequence
  Synthetic Polynucleotide
taatacgactcactatagggccacaaagctgtcaaactcggcctgaacctaacagaggagaaggttcatgccgagtttgaacctggcggcagcgcaaaagatg

SEQ ID NO: 4450 - DNA, 103 bp, Artificial Sequence
  Synthetic Polynucleotide
taatacgactcactatagggcggtaccacaaagctgtcaaactcggcctgaacagaggagacaggccatgtttgacagcaacctggcggcagcgcaaaagatg

SEQ ID NO: 4451 - DNA, 103 bp, Artificial Sequence
  Synthetic Polynucleotide
taatacgactcactatagggaggctcggtaccacaaagctgtcaaactcgaacagaggagacgagttatgcagctttgtaacctggcggcagcgcaaaagatg

SEQ ID NO: 4452 - DNA, 103 bp, Artificial Sequence
  Synthetic Polynucleotide
taatacgactcactatagggaccacaggctcggtaccacaaagctgtcaaaacagaggagattgacaatgttgtggtacaacctggcggcagcgcaaaagatg

SEQ ID NO: 4453 - DNA, 103 bp, Artificial Sequence
  Synthetic Polynucleotide
taatacgactcactatagggggacgaccacaggctcggtaccacaaagctaacagaggagaagctttatggtaccgagcaacctggcggcagcgcaaaagatg

SEQ ID NO: 4454 - DNA, 103 bp, Artificial Sequence
  Synthetic Polynucleotide
taatacgactcactatagggaacccggacgaccacaggctcggtaccacaaacagaggagatgtggtatggagcctgtgaacctggcggcagcgcaaaagatg

SEQ ID NO: 4455 - DNA, 103 bp, Artificial Sequence
  Synthetic Polynucleotide
taatacgactcactatagggttgacaacccggacgaccacaggctcggtaaacagaggagataccgaatgtgtggtcgtaacctggcggcagcgcaaaagatg

SEQ ID NO: 4456 - DNA, 103 bp, Artificial Sequence
  Synthetic Polynucleotide
taatacgactcactatagggcgggattgacaacccggacgaccacaggctaacagaggagaagcctgatgtcgtccgggaacctggcggcagcgcaaaagatg

SEQ ID NO: 4457 - DNA, 103 bp, Artificial Sequence
  Synthetic Polynucleotide
taatacgactcactatagggctcaacgggattgacaacccggacgaccacaacagaggagagtggtcatgcgggttgtcaacctggcggcagcgcaaaagatg

SEQ ID NO: 4458 - DNA, 103 bp, Artificial Sequence
  Synthetic Polynucleotide
taatacgactcactatagggcctgcctaggttccacctcaaacatggggtaacagaggagaaccccaatgttgaggtggaacctggcggcagcgcaaaagatg

SEQ ID NO: 4459 - DNA, 103 bp, Artificial Sequence
  Synthetic Polynucleotide
taatacgactcactatagggtagtcctcaacgggattgacaacccggacgaacagaggagacgtccgatgtgtcaatccaacctggcggcagcgcaaaagatg

SEQ ID NO: 4460 - DNA, 103 bp, Artificial Sequence
  Synthetic Polynucleotide
taatacgactcactataggggattctagtcctcaacgggattgacaacccaacagaggagagggttgatgatcccgttgaacctggcggcagcgcaaaagatg

SEQ ID NO: 4461 - DNA, 103 bp, Artificial Sequence
  Synthetic Polynucleotide
taatacgactcactatagggcatttgattctagtcctcaacgggattgacaacagaggagagtcaatatggttgaggacaacctggcggcagcgcaaaagatg

SEQ ID NO: 4462 - DNA, 103 bp, Artificial Sequence
  Synthetic Polynucleotide
taatacgactcactatagggacaaccatttgattctagtcctcaacgggaaacagaggagatcccgtatgggactagaaaacctggcggcagcgcaaaagatg

SEQ ID NO: 4463 - DNA, 103 bp, Artificial Sequence
  Synthetic Polynucleotide
taatacgactcactataggggcttaacaaccatttgattctagtcctcaaaacagaggagattgaggatgagaatcaaaaacctggcggcagcgcaaaagatg

SEQ ID NO: 4464 - DNA, 103 bp, Artificial Sequence
  Synthetic Polynucleotide
taatacgactcactatagggaccttgcttaacaaccatttgattctagtcaacagaggagagactagatgcaaatggttaacctggcggcagcgcaaaagatg

SEQ ID NO: 4465 - DNA, 103 bp, Artificial Sequence
  Synthetic Polynucleotide
taatacgactcactatagggttggcaccttgcttaacaaccatttgattcaacagaggagagaatcaatgggttgttaaaacctggcggcagcgcaaaagatg

SEQ ID NO: 4466 - DNA, 103 bp, Artificial Sequence
  Synthetic Polynucleotide
taatacgactcactatagggggtttttggcaccttgcttaacaaccatttaacagaggagaaaatggatgttaagcaagaacctggcggcagcgcaaaagatg

SEQ ID NO: 4467 - DNA, 103 bp, Artificial Sequence
  Synthetic Polynucleotide
taatacgactcactatagggaggtcggtttttggcaccttgcttaacaacaacagaggagagttgttatgcaaggtgccaacctggcggcagcgcaaaagatg

SEQ ID NO: 4468 - DNA, 103 bp, Artificial Sequence
  Synthetic Polynucleotide
taatacgactcactataggggggtcaggtcggtttttggcaccttgcttaaacagaggagataagcaatgtgccaaaaaaacctggcggcagcgcaaaagatg

SEQ ID NO: 4469 - DNA, 103 bp, Artificial Sequence
  Synthetic Polynucleotide
taatacgactcactatagggagtaagaaactggtaggctacgtgtgtctcaacagaggagagagacaatggtagcctacaacctggcggcagcgcaaaagatg

SEQ ID NO: 4470 - DNA, 103 bp, Artificial Sequence
  Synthetic Polynucleotide
taatacgactcactatagggtgtgacctgcctaggttccacctcaaacataacagaggagaatgtttatggtggaacctaacctggcggcagcgcaaaagatg

SEQ ID NO: 4471 - DNA, 103 bp, Artificial Sequence
  Synthetic Polynucleotide
taatacgactcactataggggtatggggtcaggtcggtttttggcaccttaacagaggagaaaggtgatgaaaaccgacaacctggcggcagcgcaaaagatg

SEQ ID NO: 4472 - DNA, 103 bp, Artificial Sequence
  Synthetic Polynucleotide
taatacgactcactatagggccgctgtatggggtcaggtcggtttttggcaacagaggagagccaaaatgcgacctgacaacctggcggcagcgcaaaagatg

SEQ ID NO: 4473 - DNA, 103 bp, Artificial Sequence
  Synthetic Polynucleotide
taatacgactcactatagggcgtccccgctgtatggggtcaggtcggtttaacagaggagaaaaccgatgtgaccccataacctggcggcagcgcaaaagatg

SEQ ID NO: 4474 - DNA, 103 bp, Artificial Sequence
  Synthetic Polynucleotide
taatacgactcactatagggttgggcgtccccgctgtatggggtcaggtcaacagaggagagacctgatgccatacagcaacctggcggcagcgcaaaagatg

SEQ ID NO: 4475 - DNA, 103 bp, Artificial Sequence
  Synthetic Polynucleotide
taatacgactcactataggggcttcttgggcgtccccgctgtatggggtcaacagaggagagaccccatgcagcggggaaacctggcggcagcgcaaaagatg

SEQ ID NO: 4476 - DNA, 103 bp, Artificial Sequence
  Synthetic Polynucleotide
taatacgactcactatagggcccgggcttcttgggcgtccccgctgtatgaacagaggagacatacaatggggacgcccaacctggcggcagcgcaaaagatg

SEQ ID NO: 4477 - DNA, 103 bp, Artificial Sequence
  Synthetic Polynucleotide
taatacgactcactatagggtgcgtcccgggcttcttgggcgtccccgctaacagaggagaagcgggatggcccaagaaaacctggcggcagcgcaaaagatg

SEQ ID NO: 4478 - DNA, 103 bp, Artificial Sequence
  Synthetic Polynucleotide
taatacgactcactatagggttttctgcgtcccgggcttcttgggcgtccaacagaggagaggacgcatgagaagcccgaacctggcggcagcgcaaaagatg

SEQ ID NO: 4479 - DNA, 103 bp, Artificial Sequence
  Synthetic Polynucleotide
taatacgactcactatagggcttctttttctgcgtcccgggcttcttgggaacagaggagacccaagatgcccgggacgaacctggcggcagcgcaaaagatg

SEQ ID NO: 4480 - DNA, 103 bp, Artificial Sequence
  Synthetic Polynucleotide
taatacgactcactatagggctctgcttctttttctgcgtcccgggcttcaacagaggagagaagccatggacgcagaaaacctggcggcagcgcaaaagatg

SEQ ID NO: 4481 - DNA, 103 bp, Artificial Sequence
  Synthetic Polynucleotide
taatacgactcactatagggttcggtgtgacctgcctaggttccacctcaaacagaggagatgaggtatgacctaggcaaacctggcggcagcgcaaaagatg

SEQ ID NO: 4482 - DNA, 103 bp, Artificial Sequence
  Synthetic Polynucleotide
taatacgactcactatagggtcttcctctgcttctttttctgcgtcccggaacagaggagaccgggaatgagaaaaagaaacctggcggcagcgcaaaagatg

SEQ ID NO: 4483 - DNA, 103 bp, Artificial Sequence
  Synthetic Polynucleotide
taatacgactcactatagggctcgttcttcctctgcttctttttctgcgtaacagaggagaacgcagatgaagaagcagaacctggcggcagcgcaaaagatg

SEQ ID NO: 4484 - DNA, 103 bp, Artificial Sequence
  Synthetic Polynucleotide
taatacgactcactatagggtgcttctcgttcttcctctgcttctttttcaacagaggagagaaaaaatggcagaggaaaacctggcggcagcgcaaaagatg

SEQ ID NO: 4485 - DNA, 103 bp, Artificial Sequence
  Synthetic Polynucleotide
taatacgactcactatagggagttctgcttctcgttcttcctctgcttctaacagaggagaagaagcatgggaagaacgaacctggcggcagcgcaaaagatg

SEQ ID NO: 4486 - DNA, 103 bp, Artificial Sequence
  Synthetic Polynucleotide
taatacgactcactataggggagtcagttctgcttctcgttcttcctctgaacagaggagacagaggatgaacgagaagaacctggcggcagcgcaaaagatg

SEQ ID NO: 4487 - DNA, 103 bp, Artificial Sequence
  Synthetic Polynucleotide
taatacgactcactatagggttcaagagtcagttctgcttctcgttcttcaacagaggagagaagaaatggaagcagaaaacctggcggcagcgcaaaagatg

SEQ ID NO: 4488 - DNA, 103 bp, Artificial Sequence
  Synthetic Polynucleotide
taatacgactcactatagggagggcttcaagagtcagttctgcttctcgtaacagaggagaacgagaatgagaactgacaacctggcggcagcgcaaaagatg

SEQ ID NO: 4489 - DNA, 103 bp, Artificial Sequence
  Synthetic Polynucleotide
taatacgactcactataggggtggtagggcttcaagagtcagttctgcttaacagaggagaaagcagatgtgactcttgaacctggcggcagcgcaaaagatg

SEQ ID NO: 4490 - DNA, 103 bp, Artificial Sequence
  Synthetic Polynucleotide
taatacgactcactatagggaaggggtggtagggcttcaagagtcagttcaacagaggagagaactgatgcttgaagccaacctggcggcagcgcaaaagatg

SEQ ID NO: 4491 - DNA, 103 bp, Artificial Sequence
  Synthetic Polynucleotide
taatacgactcactataggggcctgaaggggtggtagggcttcaagagtcaacagaggagagactctatgagccctaccaacctggcggcagcgcaaaagatg

SEQ ID NO: 4492 - DNA, 103 bp, Artificial Sequence
  Synthetic Polynucleotide
taatacgactcactatagggggtcattcggtgtgacctgcctaggttccaaacagaggagatggaacatgggcaggtcaaacctggcggcagcgcaaaagatg

SEQ ID NO: 4493 - DNA, 103 bp, Artificial Sequence
  Synthetic Polynucleotide
taatacgactcactataggggtgctgcctgaaggggtggtagggcttcaaaacagaggagattgaagatgtaccaccccaacctggcggcagcgcaaaagatg

SEQ ID NO: 4494 - DNA, 103 bp, Artificial Sequence
  Synthetic Polynucleotide
taatacgactcactatagggttcctgtgctgcctgaaggggtggtagggcaacagaggagagccctaatgccccttcagaacctggcggcagcgcaaaagatg

SEQ ID NO: 4495 - DNA, 103 bp, Artificial Sequence
  Synthetic Polynucleotide
taatacgactcactatagggacatcttcctgtgctgcctgaaggggtggtaacagaggagaaccaccatgtcaggcagcaacctggcggcagcgcaaaagatg

SEQ ID NO: 4496 - DNA, 103 bp, Artificial Sequence
  Synthetic Polynucleotide
taatacgactcactatagggcctgaacatcttcctgtgctgcctgaagggaacagaggagacccttcatgcagcacaggaacctggcggcagcgcaaaagatg

SEQ ID NO: 4497 - DNA, 103 bp, Artificial Sequence
  Synthetic Polynucleotide
taatacgactcactatagggttcgacctgaacatcttcctgtgctgcctgaacagaggagacaggcaatgcaggaagataacctggcggcagcgcaaaagatg

SEQ ID NO: 4498 - DNA, 103 bp, Artificial Sequence
  Synthetic Polynucleotide
taatacgactcactatagggtcgatttcgacctgaacatcttcctgtgctaacagaggagaagcacaatgagatgttcaaacctggcggcagcgcaaaagatg

SEQ ID NO: 4499 - DNA, 103 bp, Artificial Sequence
  Synthetic Polynucleotide
taatacgactcactatagggccacgtcgatttcgacctgaacatcttcctaacagaggagaaggaagatgttcaggtcgaacctggcggcagcgcaaaagatg

SEQ ID NO: 4500 - DNA, 103 bp, Artificial Sequence
  Synthetic Polynucleotide
taatacgactcactatagggctgttccacgtcgatttcgacctgaacatcaacagaggagagatgttatggtcgaaatcaacctggcggcagcgcaaaagatg

SEQ ID NO: 4501 - DNA, 103 bp, Artificial Sequence
  Synthetic Polynucleotide
taatacgactcactatagggtcaagctgttccacgtcgatttcgacctgaaacagaggagatcaggtatgaatcgacgtaacctggcggcagcgcaaaagatg

SEQ ID NO: 4502 - DNA, 103 bp, Artificial Sequence
  Synthetic Polynucleotide
taatacgactcactatagggtgtcctcaagctgttccacgtcgatttcgaaacagaggagatcgaaaatgacgtggaacaacctggcggcagcgcaaaagatg

SEQ ID NO: 4503 - DNA, 103 bp, Artificial Sequence
  Synthetic Polynucleotide
taatacgactcactatagggagcatggtcattcggtgtgacctgcctaggaacagaggagacctaggatggtcacaccgaacctggcggcagcgcaaaagatg

SEQ ID NO: 4504 - DNA, 103 bp, Artificial Sequence
  Synthetic Polynucleotide
taatacgactcactatagggcgctctgtcctcaagctgttccacgtcgataacagaggagaatcgacatggaacagcttaacctggcggcagcgcaaaagatg

SEQ ID NO: 4505 - DNA, 103 bp, Artificial Sequence
  Synthetic Polynucleotide
taatacgactcactataggggcacccgctctgtcctcaagctgttccacgaacagaggagacgtggaatggcttgaggaaacctggcggcagcgcaaaagatg

SEQ ID NO: 4506 - DNA, 103 bp, Artificial Sequence
  Synthetic Polynucleotide
taatacgactcactatagggttcctgcacccgctctgtcctcaagctgttaacagaggagaaacagcatgaggacagagaacctggcggcagcgcaaaagatg

SEQ ID NO: 4507 - DNA, 103 bp, Artificial Sequence
  Synthetic Polynucleotide
taatacgactcactatagggtattattcctgcacccgctctgtcctcaagaacagaggagacttgagatgagagcgggtaacctggcggcagcgcaaaagatg

SEQ ID NO: 4508 - DNA, 103 bp, Artificial Sequence
  Synthetic Polynucleotide
taatacgactcactataggggtctctattattcctgcacccgctctgtccaacagaggagaggacagatggggtgcaggaacctggcggcagcgcaaaagatg

SEQ ID NO: 4509 - DNA, 103 bp, Artificial Sequence
  Synthetic Polynucleotide
taatacgactcactatagggtcggagtctctattattcctgcacccgctcaacagaggagagagcggatgcaggaataaaacctggcggcagcgcaaaagatg

SEQ ID NO: 4510 - DNA, 103 bp, Artificial Sequence
  Synthetic Polynucleotide
taatacgactcactatagggtcctctcggagtctctattattcctgcaccaacagaggagaggtgcaatgataatagagaacctggcggcagcgcaaaagatg

SEQ ID NO: 4511 - DNA, 103 bp, Artificial Sequence
  Synthetic Polynucleotide
taatacgactcactatagggatagctcctctcggagtctctattattcctaacagaggagaaggaatatgagagactccaacctggcggcagcgcaaaagatg

SEQ ID NO: 4512 - DNA, 103 bp, Artificial Sequence
  Synthetic Polynucleotide
taatacgactcactatagggctttgatagctcctctcggagtctctattaaacagaggagataatagatgctccgagagaacctggcggcagcgcaaaagatg

SEQ ID NO: 4513 - DNA, 103 bp, Artificial Sequence
  Synthetic Polynucleotide
taatacgactcactatagggagtaactttgatagctcctctcggagtctcaacagaggagagagactatgagaggagctaacctggcggcagcgcaaaagatg

SEQ ID NO: 4514 - DNA, 103 bp, Artificial Sequence
  Synthetic Polynucleotide
taatacgactcactataggggcattagcatggtcattcggtgtgacctgcaacagaggagagcaggtatgaccgaatgaaacctggcggcagcgcaaaagatg

SEQ ID NO: 4515 - DNA, 103 bp, Artificial Sequence
  Synthetic Polynucleotide
taatacgactcactatagggtgggcagtaactttgatagctcctctcggaaacagaggagatccgagatgagctatcaaaacctggcggcagcgcaaaagatg

SEQ ID NO: 4516 - DNA, 103 bp, Artificial Sequence
  Synthetic Polynucleotide
taatacgactcactatagggttggttgggcagtaactttgatagctcctcaacagaggagagaggagatgtcaaagttaaacctggcggcagcgcaaaagatg

SEQ ID NO: 4517 - DNA, 103 bp, Artificial Sequence
  Synthetic Polynucleotide
taatacgactcactataggggtctgttggttgggcagtaactttgatagcaacagaggagagctatcatggttactgccaacctggcggcagcgcaaaagatg

SEQ ID NO: 4518 - DNA, 103 bp, Artificial Sequence
  Synthetic Polynucleotide
taatacgactcactatagggacgtggtctgttggttgggcagtaactttgaacagaggagacaaagtatgtgcccaaccaacctggcggcagcgcaaaagatg

SEQ ID NO: 4519 - DNA, 103 bp, Artificial Sequence
  Synthetic Polynucleotide
taatacgactcactatagggccacgacgtggtctgttggttgggcagtaaaacagaggagattactgatgaaccaacagaacctggcggcagcgcaaaagatg

SEQ ID NO: 4520 - DNA, 103 bp, Artificial Sequence
  Synthetic Polynucleotide
taatacgactcactatagggctctcccacgacgtggtctgttggttgggcaacagaggagagcccaaatgacagaccacaacctggcggcagcgcaaaagatg

SEQ ID NO: 4521 - DNA, 103 bp, Artificial Sequence
  Synthetic Polynucleotide
taatacgactcactatagggaagtactctcccacgacgtggtctgttggtaacagaggagaaccaacatgccacgtcgtaacctggcggcagcgcaaaagatg

SEQ ID NO: 4522 - DNA, 103 bp, Artificial Sequence
  Synthetic Polynucleotide
taatacgactcactataggggaaccaagtactctcccacgacgtggtctgaacagaggagacagaccatgtcgtgggagaacctggcggcagcgcaaaagatg

SEQ ID NO: 4523 - DNA, 103 bp, Artificial Sequence
  Synthetic Polynucleotide
taatacgactcactatagggggaaagaaccaagtactctcccacgacgtgaacagaggagacacgtcatgggagagtacaacctggcggcagcgcaaaagatg

SEQ ID NO: 4524 - DNA, 103 bp, Artificial Sequence
  Synthetic Polynucleotide
taatacgactcactatagggtgcggggaaagaaccaagtactctcccacgaacagaggagacgtgggatggtacttggtaacctggcggcagcgcaaaagatg

SEQ ID NO: 4525 - DNA, 103 bp, Artificial Sequence
  Synthetic Polynucleotide
taatacgactcactatagggctctagcattagcatggtcattcggtgtgaaacagaggagatcacacatgatgaccatgaacctggcggcagcgcaaaagatg

SEQ ID NO: 4526 - DNA, 103 bp, Artificial Sequence
  Synthetic Polynucleotide
taatacgactcactatagggcggtctgcggggaaagaaccaagtactctcaacagaggagagagagtatgtggttctttaacctggcggcagcgcaaaagatg

SEQ ID NO: 4527 - DNA, 103 bp, Artificial Sequence
  Synthetic Polynucleotide
taatacgactcactatagggtagtacggtctgcggggaaagaaccaagtaaacagaggagatacttgatgctttccccgaacctggcggcagcgcaaaagatg

SEQ ID NO: 4528 - DNA, 103 bp, Artificial Sequence
  Synthetic Polynucleotide
taatacgactcactatagggctacgtagtacggtctgcggggaaagaaccaacagaggagaggttctatgcccgcagacaacctggcggcagcgcaaaagatg

SEQ ID NO: 4529 - DNA, 103 bp, Artificial Sequence
  Synthetic Polynucleotide
taatacgactcactatagggtttggctacgtagtacggtctgcggggaaaaacagaggagatttcccatgagaccgtacaacctggcggcagcgcaaaagatg

SEQ ID NO: 4530 - DNA, 103 bp, Artificial Sequence
  Synthetic Polynucleotide
taatacgactcactatagggaagcttttggctacgtagtacggtctgcggaacagaggagaccgcagatggtactacgtaacctggcggcagcgcaaaagatg

SEQ ID NO: 4531 - DNA, 103 bp, Artificial Sequence
  Synthetic Polynucleotide
taatacgactcactatagggaggctaagcttttggctacgtagtacggtcaacagaggagagaccgtatgacgtagccaaacctggcggcagcgcaaaagatg

SEQ ID NO: 4532 - DNA, 103 bp, Artificial Sequence
  Synthetic Polynucleotide
taatacgactcactataggggaatcaggctaagcttttggctacgtagtaaacagaggagatactacatggccaaaagcaacctggcggcagcgcaaaagatg

SEQ ID NO: 4533 - DNA, 103 bp, Artificial Sequence
  Synthetic Polynucleotide
taatacgactcactatagggagcgtgaatcaggctaagcttttggctacgaacagaggagacgtagcatgaagcttagcaacctggcggcagcgcaaaagatg

SEQ ID NO: 4534 - DNA, 103 bp, Artificial Sequence
  Synthetic Polynucleotide
taatacgactcactataggggccaaagcgtgaatcaggctaagcttttggaacagaggagaccaaaaatgtagcctgataacctggcggcagcgcaaaagatg

SEQ ID NO: 4535 - DNA, 103 bp, Artificial Sequence
  Synthetic Polynucleotide
taatacgactcactataggggctccgccaaagcgtgaatcaggctaagctaacagaggagaagcttaatgtgattcacgaacctggcggcagcgcaaaagatg

SEQ ID NO: 4536 - DNA, 103 bp, Artificial Sequence
  Synthetic Polynucleotide
taatacgactcactataggggaacgctctagcattagcatggtcattcggaacagaggagaccgaatatgcatgctaataacctggcggcagcgcaaaagatg

SEQ ID NO: 4537 - DNA, 103 bp, Artificial Sequence
  Synthetic Polynucleotide
taatacgactcactatagggcacttgctccgccaaagcgtgaatcaggctaacagaggagaagcctgatgcacgctttgaacctggcggcagcgcaaaagatg

SEQ ID NO: 4538 - DNA, 103 bp, Artificial Sequence
  Synthetic Polynucleotide
taatacgactcactataggggtcttcacttgctccgccaaagcgtgaatcaacagaggagagattcaatgtttggcggaaacctggcggcagcgcaaaagatg

SEQ ID NO: 4539 - DNA, 103 bp, Artificial Sequence
  Synthetic Polynucleotide
taatacgactcactatagggtgcacgtcttcacttgctccgccaaagcgtaacagaggagaacgcttatgcggagcaagaacctggcggcagcgcaaaagatg

SEQ ID NO: 4540 - DNA, 103 bp, Artificial Sequence
  Synthetic Polynucleotide
taatacgactcactataggggtgcgtgcacgtcttcacttgctccgccaaaacagaggagattggcgatgcaagtgaagaacctggcggcagcgcaaaagatg

SEQ ID NO: 4541 - DNA, 103 bp, Artificial Sequence
  Synthetic Polynucleotide
taatacgactcactatagggccgctgtgcgtgcacgtcttcacttgctccaacagaggagaggagcaatggaagacgtgaacctggcggcagcgcaaaagatg

SEQ ID NO: 4542 - DNA, 103 bp, Artificial Sequence
  Synthetic Polynucleotide
taatacgactcactatagggctcgtccgctgtgcgtgcacgtcttcacttaacagaggagaaagtgaatgcgtgcacgcaacctggcggcagcgcaaaagatg

SEQ ID NO: 4543 - DNA, 103 bp, Artificial Sequence
  Synthetic Polynucleotide
taatacgactcactatagggccctgctcgtccgctgtgcgtgcacgtcttaacagaggagaaagacgatgacgcacagcaacctggcggcagcgcaaaagatg

SEQ ID NO: 4544 - DNA, 103 bp, Artificial Sequence
  Synthetic Polynucleotide
taatacgactcactatagggtacctccctgctcgtccgctgtgcgtgcacaacagaggagagtgcacatgcagcggacgaacctggcggcagcgcaaaagatg

SEQ ID NO: 4545 - DNA, 103 bp, Artificial Sequence
  Synthetic Polynucleotide
taatacgactcactatagggccgcatacctccctgctcgtccgctgtgcgaacagaggagacgcacaatggacgagcagaacctggcggcagcgcaaaagatg

SEQ ID NO: 4546 - DNA, 103 bp, Artificial Sequence
  Synthetic Polynucleotide
taatacgactcactatagggttcgaccgcatacctccctgctcgtccgctaacagaggagaagcggaatggcagggaggaacctggcggcagcgcaaaagatg

SEQ ID NO: 4547 - DNA, 103 bp, Artificial Sequence
  Synthetic Polynucleotide
taatacgactcactatagggtgcgagaacgctctagcattagcatggtcaaacagaggagatgaccaatgtaatgctagaacctggcggcagcgcaaaagatg

SEQ ID NO: 4548 - DNA, 103 bp, Artificial Sequence
  Synthetic Polynucleotide
taatacgactcactatagggtacgcttcgaccgcatacctccctgctcgtaacagaggagaacgagcatggaggtatgcaacctggcggcagcgcaaaagatg

SEQ ID NO: 4549 - DNA, 103 bp, Artificial Sequence
  Synthetic Polynucleotide
taatacgactcactatagggcgtcgtacgcttcgaccgcatacctccctgaacagaggagacagggaatgatgcggtcgaacctggcggcagcgcaaaagatg

SEQ ID NO: 4550 - DNA, 103 bp, Artificial Sequence
  Synthetic Polynucleotide
taatacgactcactatagggtctgccgtcgtacgcttcgaccgcatacctaacagaggagaaggtatatggtcgaagcgaacctggcggcagcgcaaaagatg

SEQ ID NO: 4551 - DNA, 103 bp, Artificial Sequence
  Synthetic Polynucleotide
taatacgactcactatagggaggactctgccgtcgtacgcttcgaccgcaaacagaggagatgcggtatgagcgtacgaaacctggcggcagcgcaaaagatg

SEQ ID NO: 4552 - DNA, 103 bp, Artificial Sequence
  Synthetic Polynucleotide
taatacgactcactataggggcactaggactctgccgtcgtacgcttcgaaacagaggagatcgaagatgacgacggcaaacctggcggcagcgcaaaagatg

SEQ ID NO: 4553 - DNA, 103 bp, Artificial Sequence
  Synthetic Polynucleotide
taatacgactcactatagggtgagggcactaggactctgccgtcgtacgcaacagaggagagcgtacatgggcagagtcaacctggcggcagcgcaaaagatg

SEQ ID NO: 4554 - DNA, 103 bp, Artificial Sequence
  Synthetic Polynucleotide
taatacgactcactatagggtagcctgagggcactaggactctgccgtcgaacagaggagacgacggatgagtcctagtaacctggcggcagcgcaaaagatg

SEQ ID NO: 4555 - DNA, 103 bp, Artificial Sequence
  Synthetic Polynucleotide
taatacgactcactatagggttgcgtagcctgagggcactaggactctgcaacagaggagagcagagatgtagtgccctaacctggcggcagcgcaaaagatg

SEQ ID NO: 4556 - DNA, 103 bp, Artificial Sequence
  Synthetic Polynucleotide
taatacgactcactatagggcgagattgcgtagcctgagggcactaggacaacagaggagagtcctaatgccctcaggcaacctggcggcagcgcaaaagatg

SEQ ID NO: 4557 - DNA, 103 bp, Artificial Sequence
  Synthetic Polynucleotide
taatacgactcactatagggtcaggcgagattgcgtagcctgagggcactaacagaggagaagtgccatgaggctacgcaacctggcggcagcgcaaaagatg

SEQ ID NO: 4558 - DNA, 103 bp, Artificial Sequence
  Synthetic Polynucleotide
taatacgactcactatagggctagatgcgagaacgctctagcattagcataacagaggagaatgctaatgctagagcgtaacctggcggcagcgcaaaagatg

SEQ ID NO: 4559 - DNA, 103 bp, Artificial Sequence
  Synthetic Polynucleotide
taatacgactcactatagggagtcttcaggcgagattgcgtagcctgaggaacagaggagacctcagatgacgcaatctaacctggcggcagcgcaaaagatg

SEQ ID NO: 4560 - DNA, 103 bp, Artificial Sequence
  Synthetic Polynucleotide
taatacgactcactatagggctggaagtcttcaggcgagattgcgtagccaacagaggagaggctacatgatctcgcctaacctggcggcagcgcaaaagatg

SEQ ID NO: 4561 - DNA, 103 bp, Artificial Sequence
  Synthetic Polynucleotide
taatacgactcactatagggaggctctggaagtcttcaggcgagattgcgaacagaggagacgcaatatggcctgaagaaacctggcggcagcgcaaaagatg

SEQ ID NO: 4562 - DNA, 103 bp, Artificial Sequence
  Synthetic Polynucleotide
taatacgactcactatagggcgcttaggctctggaagtcttcaggcgagaaacagaggagatctcgcatgaagacttccaacctggcggcagcgcaaaagatg

SEQ ID NO: 4563 - DNA, 103 bp, Artificial Sequence
  Synthetic Polynucleotide
taatacgactcactataggggctttcgcttaggctctggaagtcttcaggaacagaggagacctgaaatgttccagagcaacctggcggcagcgcaaaagatg

SEQ ID NO: 4564 - DNA, 103 bp, Artificial Sequence
  Synthetic Polynucleotide
taatacgactcactataggggttgcgctttcgcttaggctctggaagtctaacagaggagaagacttatggagcctaagaacctggcggcagcgcaaaagatg

SEQ ID NO: 4565 - DNA, 103 bp, Artificial Sequence
  Synthetic Polynucleotide
taatacgactcactatagggccatcgttgcgctttcgcttaggctctggaaacagaggagatccagaatgtaagcgaaaaacctggcggcagcgcaaaagatg

SEQ ID NO: 4566 - DNA, 103 bp, Artificial Sequence
  Synthetic Polynucleotide
taatacgactcactataggggtacaccatcgttgcgctttcgcttaggctaacagaggagaagcctaatggaaagcgcaaacctggcggcagcgcaaaagatg

SEQ ID NO: 4567 - DNA, 103 bp, Artificial Sequence
  Synthetic Polynucleotide
taatacgactcactatagggtcgttgtacaccatcgttgcgctttcgcttaacagaggagaaagcgaatgcgcaacgataacctggcggcagcgcaaaagatg

SEQ ID NO: 4568 - DNA, 103 bp, Artificial Sequence
  Synthetic Polynucleotide
taatacgactcactatagggctctttcgttgtacaccatcgttgcgctttaacagaggagaaaagcgatgcgatggtgtaacctggcggcagcgcaaaagatg

SEQ ID NO: 4569 - DNA, 103 bp, Artificial Sequence
  Synthetic Polynucleotide
taatacgactcactatagggtatagctagatgcgagaacgctctagcattaacagaggagaaatgctatggcgttctcgaacctggcggcagcgcaaaagatg

SEQ ID NO: 4570 - DNA, 103 bp, Artificial Sequence
  Synthetic Polynucleotide
taatacgactcactataggggaactctctttcgttgtacaccatcgttgcaacagaggagagcaacgatggtgtacaacaacctggcggcagcgcaaaagatg

SEQ ID NO: 4571 - DNA, 103 bp, Artificial Sequence
  Synthetic Polynucleotide
taatacgactcactatagggtttacgaactctctttcgttgtacaccatcaacagaggagagatggtatgcaacgaaagaacctggcggcagcgcaaaagatg

SEQ ID NO: 4572 - DNA, 103 bp, Artificial Sequence
  Synthetic Polynucleotide
taatacgactcactatagggttctgtttacgaactctctttcgttgtacaaacagaggagatgtacaatgaaagagagtaacctggcggcagcgcaaaagatg

SEQ ID NO: 4573 - DNA, 103 bp, Artificial Sequence
  Synthetic Polynucleotide
taatacgactcactatagggtagctttctgtttacgaactctctttcgttaacagaggagaaacgaaatggagttcgtaaacctggcggcagcgcaaaagatg

SEQ ID NO: 4574 - DNA, 103 bp, Artificial Sequence
  Synthetic Polynucleotide
taatacgactcactatagggtggtgtagctttctgtttacgaactctcttaacagaggagaaagagaatgcgtaaacagaacctggcggcagcgcaaaagatg

SEQ ID NO: 4575 - DNA, 103 bp, Artificial Sequence
  Synthetic Polynucleotide
taatacgactcactatagggcaatatggtgtagctttctgtttacgaactaacagaggagaagttcgatgacagaaagcaacctggcggcagcgcaaaagatg

SEQ ID NO: 4576 - DNA, 103 bp, Artificial Sequence
  Synthetic Polynucleotide
taatacgactcactatagggcatcgcaatatggtgtagctttctgtttacaacagaggagagtaaacatgaagctacacaacctggcggcagcgcaaaagatg

SEQ ID NO: 4577 - DNA, 103 bp, Artificial Sequence
  Synthetic Polynucleotide
taatacgactcactatagggccatgcatcgcaatatggtgtagctttctgaacagaggagacagaaaatgacaccatataacctggcggcagcgcaaaagatg

SEQ ID NO: 4578 - DNA, 103 bp, Artificial Sequence
  Synthetic Polynucleotide
taatacgactcactatagggctggtccatgcatcgcaatatggtgtagctaacagaggagaagctacatgatattgcgaaacctggcggcagcgcaaaagatg

SEQ ID NO: 4579 - DNA, 103 bp, Artificial Sequence
  Synthetic Polynucleotide
taatacgactcactatagggcagggctggtccatgcatcgcaatatggtgaacagaggagacaccatatggcgatgcataacctggcggcagcgcaaaagatg

SEQ ID NO: 4580 - DNA, 103 bp, Artificial Sequence
  Synthetic Polynucleotide
taatacgactcactatagggagagcagtaagaaactggtaggctacgtgtaacagaggagaacacgtatgctaccagttaacctggcggcagcgcaaaagatg

SEQ ID NO: 4581 - DNA, 103 bp, Artificial Sequence
  Synthetic Polynucleotide
taatacgactcactatagggagttttatagctagatgcgagaacgctctaaacagaggagatagagcatgctcgcatctaacctggcggcagcgcaaaagatg

SEQ ID NO: 4582 - DNA, 103 bp, Artificial Sequence
  Synthetic Polynucleotide
taatacgactcactataggggtgttcagggctggtccatgcatcgcaataaacagaggagatattgcatggcatggaccaacctggcggcagcgcaaaagatg

SEQ ID NO: 4583 - DNA, 103 bp, Artificial Sequence
  Synthetic Polynucleotide
taatacgactcactatagggcgtcggtgttcagggctggtccatgcatcgaacagaggagacgatgcatggaccagcccaacctggcggcagcgcaaaagatg

SEQ ID NO: 4584 - DNA, 103 bp, Artificial Sequence
  Synthetic Polynucleotide
taatacgactcactatagggctcttcgtcggtgttcagggctggtccatgaacagaggagacatggaatggccctgaacaacctggcggcagcgcaaaagatg

SEQ ID NO: 4585 - DNA, 103 bp, Artificial Sequence
  Synthetic Polynucleotide
taatacgactcactatagggtacgactcttcgtcggtgttcagggctggtaacagaggagaaccagcatggaacaccgaaacctggcggcagcgcaaaagatg

SEQ ID NO: 4586 - DNA, 103 bp, Artificial Sequence
  Synthetic Polynucleotide
taatacgactcactataggggctcatacgactcttcgtcggtgttcagggaacagaggagaccctgaatgccgacgaagaacctggcggcagcgcaaaagatg

SEQ ID NO: 4587 - DNA, 103 bp, Artificial Sequence
  Synthetic Polynucleotide
taatacgactcactatagggcaccagctcatacgactcttcgtcggtgttaacagaggagaaacaccatggaagagtcgaacctggcggcagcgcaaaagatg

SEQ ID NO: 4588 - DNA, 103 bp, Artificial Sequence
  Synthetic Polynucleotide
taatacgactcactataggggccctcaccagctcatacgactcttcgtcgaacagaggagacgacgaatggtcgtatgaaacctggcggcagcgcaaaagatg

SEQ ID NO: 4589 - DNA, 103 bp, Artificial Sequence
  Synthetic Polynucleotide
taatacgactcactatagggtctctgccctcaccagctcatacgactcttaacagaggagaaagagtatgatgagctggaacctggcggcagcgcaaaagatg

SEQ ID NO: 4590 - DNA, 103 bp, Artificial Sequence
  Synthetic Polynucleotide
taatacgactcactatagggtgtcctctctgccctcaccagctcatacgaaacagaggagatcgtatatgctggtgaggaacctggcggcagcgcaaaagatg

SEQ ID NO: 4591 - DNA, 103 bp, Artificial Sequence
  Synthetic Polynucleotide
taatacgactcactatagggtgttctgtcctctctgccctcaccagctcaaacagaggagatgagctatggagggcagaaacctggcggcagcgcaaaagatg

SEQ ID NO: 4592 - DNA, 103 bp, Artificial Sequence
  Synthetic Polynucleotide
taatacgactcactatagggctattagttttatagctagatgcgagaacgaacagaggagacgttctatgatctagctaaacctggcggcagcgcaaaagatg

SEQ ID NO: 4593 - DNA, 103 bp, Artificial Sequence
  Synthetic Polynucleotide
taatacgactcactatagggactcgtgttctgtcctctctgccctcaccaaacagaggagatggtgaatgcagagaggaaacctggcggcagcgcaaaagatg

SEQ ID NO: 4594 - DNA, 103 bp, Artificial Sequence
  Synthetic Polynucleotide
taatacgactcactataggggacgtactcgtgttctgtcctctctgccctaacagaggagaagggcaatgaggacagaaaacctggcggcagcgcaaaagatg

SEQ ID NO: 4595 - DNA, 103 bp, Artificial Sequence
  Synthetic Polynucleotide
taatacgactcactatagggtcgtagacgtactcgtgttctgtcctctctaacagaggagaagagagatgagaacacgaaacctggcggcagcgcaaaagatg

SEQ ID NO: 4596 - DNA, 103 bp, Artificial Sequence
  Synthetic Polynucleotide
taatacgactcactatagggccacgtcgtagacgtactcgtgttctgtccaacagaggagaggacagatgacgagtacgaacctggcggcagcgcaaaagatg

SEQ ID NO: 4597 - DNA, 103 bp, Artificial Sequence
  Synthetic Polynucleotide
taatacgactcactatagggctggtccacgtcgtagacgtactcgtgttcaacagaggagagaacacatgtacgtctacaacctggcggcagcgcaaaagatg

SEQ ID NO: 4598 - DNA, 103 bp, Artificial Sequence
  Synthetic Polynucleotide
taatacgactcactatagggcttctctggtccacgtcgtagacgtactcgaacagaggagacgagtaatgctacgacgtaacctggcggcagcgcaaaagatg

SEQ ID NO: 4599 - DNA, 103 bp, Artificial Sequence
  Synthetic Polynucleotide
taatacgactcactatagggagcatcttctctggtccacgtcgtagacgtaacagaggagaacgtctatgacgtggaccaacctggcggcagcgcaaaagatg

SEQ ID NO: 4600 - DNA, 103 bp, Artificial Sequence
  Synthetic Polynucleotide
taatacgactcactatagggcttacagcatcttctctggtccacgtcgtaaacagaggagatacgacatggaccagagaaacctggcggcagcgcaaaagatg

SEQ ID NO: 4601 - DNA, 103 bp, Artificial Sequence
  Synthetic Polynucleotide
taatacgactcactatagggtccttcttacagcatcttctctggtccacgaacagaggagacgtggaatggagaagatgaacctggcggcagcgcaaaagatg

SEQ ID NO: 4602 - DNA, 103 bp, Artificial Sequence
  Synthetic Polynucleotide
taatacgactcactatagggcttcttccttcttacagcatcttctctggtaacagaggagaaccagaatggatgctgtaaacctggcggcagcgcaaaagatg

SEQ ID NO: 4603 - DNA, 103 bp, Artificial Sequence
  Synthetic Polynucleotide
taatacgactcactatagggctgctctattagttttatagctagatgcgaaacagaggagatcgcatatggctataaaaaacctggcggcagcgcaaaagatg

SEQ ID NO: 4604 - DNA, 103 bp, Artificial Sequence
  Synthetic Polynucleotide
taatacgactcactatagggtgcagcttcttccttcttacagcatcttctaacagaggagaagaagaatgtgtaagaagaacctggcggcagcgcaaaagatg

SEQ ID NO: 4605 - DNA, 103 bp, Artificial Sequence
  Synthetic Polynucleotide
taatacgactcactatagggagtcctgcagcttcttccttcttacagcataacagaggagaatgctgatggaaggaagaaacctggcggcagcgcaaaagatg

SEQ ID NO: 4606 - DNA, 103 bp, Artificial Sequence
  Synthetic Polynucleotide
taatacgactcactataggggtaccagtcctgcagcttcttccttcttacaacagaggagagtaagaatgaagaagctgaacctggcggcagcgcaaaagatg

SEQ ID NO: 4607 - DNA, 103 bp, Artificial Sequence
  Synthetic Polynucleotide
taatacgactcactatagggcaccagtaccagtcctgcagcttcttccttaacagaggagaaaggaaatggctgcaggaaacctggcggcagcgcaaaagatg

SEQ ID NO: 4608 - DNA, 103 bp, Artificial Sequence
  Synthetic Polynucleotide
taatacgactcactatagggtcgcccaccagtaccagtcctgcagcttctaacagaggagaagaagcatgaggactggtaacctggcggcagcgcaaaagatg

SEQ ID NO: 4609 - DNA, 103 bp, Artificial Sequence
  Synthetic Polynucleotide
taatacgactcactatagggtcaagtcgcccaccagtaccagtcctgcagaacagaggagactgcagatgtggtactggaacctggcggcagcgcaaaagatg

SEQ ID NO: 4610 - DNA, 103 bp, Artificial Sequence
  Synthetic Polynucleotide
taatacgactcactatagggattagtcaagtcgcccaccagtaccagtccaacagaggagaggactgatgctggtgggcaacctggcggcagcgcaaaagatg

SEQ ID NO: 4611 - DNA, 103 bp, Artificial Sequence
  Synthetic Polynucleotide
taatacgactcactatagggggcggattagtcaagtcgcccaccagtaccaacagaggagaggtactatggggcgacttaacctggcggcagcgcaaaagatg

SEQ ID NO: 4612 - DNA, 103 bp, Artificial Sequence
  Synthetic Polynucleotide
taatacgactcactatagggggtagggcggattagtcaagtcgcccaccaaacagaggagatggtggatgacttgactaaacctggcggcagcgcaaaagatg

SEQ ID NO: 4613 - DNA, 103 bp, Artificial Sequence
  Synthetic Polynucleotide
taatacgactcactatagggttcgtggtagggcggattagtcaagtcgccaacagaggagaggcgacatgactaatccgaacctggcggcagcgcaaaagatg

SEQ ID NO: 4614 - DNA, 103 bp, Artificial Sequence
  Synthetic Polynucleotide
taatacgactcactatagggatttcctgctctattagttttatagctagaaacagaggagatctagcatgaaaactaataacctggcggcagcgcaaaagatg

SEQ ID NO: 4615 - DNA, 103 bp, Artificial Sequence
  Synthetic Polynucleotide
taatacgactcactataggggcgaattcgtggtagggcggattagtcaagaacagaggagacttgacatgtccgccctaaacctggcggcagcgcaaaagatg

SEQ ID NO: 4616 - DNA, 103 bp, Artificial Sequence
  Synthetic Polynucleotide
taatacgactcactatagggcatatgcgaattcgtggtagggcggattagaacagaggagactaatcatgcctaccacgaacctggcggcagcgcaaaagatg

SEQ ID NO: 4617 - DNA, 103 bp, Artificial Sequence
  Synthetic Polynucleotide
taatacgactcactatagggcccttcatatgcgaattcgtggtagggcggaacagaggagaccgcccatgcacgaattcaacctggcggcagcgcaaaagatg

SEQ ID NO: 4618 - DNA, 103 bp, Artificial Sequence
  Synthetic Polynucleotide
taatacgactcactatagggtttagcccttcatatgcgaattcgtggtagaacagaggagactaccaatgattcgcataaacctggcggcagcgcaaaagatg

SEQ ID NO: 4619 - DNA, 103 bp, Artificial Sequence
  Synthetic Polynucleotide
taatacgactcactatagggggatttttagcccttcatatgcgaattcgtaacagaggagaacgaatatgcatatgaagaacctggcggcagcgcaaaagatg

SEQ ID NO: 4620 - DNA, 103 bp, Artificial Sequence
  Synthetic Polynucleotide
taatacgactcactatagggagggcggatttttagcccttcatatgcgaaaacagaggagattcgcaatggaagggctaaacctggcggcagcgcaaaagatg

SEQ ID NO: 4621 - DNA, 103 bp, Artificial Sequence
  Synthetic Polynucleotide
taatacgactcactatagggcaggcagggcggatttttagcccttcatataacagaggagaatatgaatggctaaaaataacctggcggcagcgcaaaagatg

SEQ ID NO: 4622 - DNA, 103 bp, Artificial Sequence
  Synthetic Polynucleotide
taatacgactcactatagggatgggcaggcagggcggatttttagcccttaacagaggagaaagggcatgaaatccgccaacctggcggcagcgcaaaagatg

SEQ ID NO: 4623 - DNA, 103 bp, Artificial Sequence
  Synthetic Polynucleotide
taatacgactcactatagggtttgtatgggcaggcagggcggatttttagaacagaggagactaaaaatgcgccctgccaacctggcggcagcgcaaaagatg

SEQ ID NO: 4624 - DNA, 103 bp, Artificial Sequence
  Synthetic Polynucleotide
taatacgactcactataggggcaattttgtatgggcaggcagggcggattaacagaggagaaatccgatgtgcctgcccaacctggcggcagcgcaaaagatg

SEQ ID NO: 4625 - DNA, 103 bp, Artificial Sequence
  Synthetic Polynucleotide
taatacgactcactataggggatcaatttcctgctctattagttttatagaacagaggagactataaatgtaatagagcaacctggcggcagcgcaaaagatg

SEQ ID NO: 4626 - DNA, 103 bp, Artificial Sequence
  Synthetic Polynucleotide
taatacgactcactatagggtgactgcaattttgtatgggcaggcagggcaacagaggagagccctgatggcccatacaaacctggcggcagcgcaaaagatg

SEQ ID NO: 4627 - DNA, 103 bp, Artificial Sequence
  Synthetic Polynucleotide
taatacgactcactatagggtcctatgactgcaattttgtatgggcaggcaacagaggagagcctgcatgtacaaaattaacctggcggcagcgcaaaagatg

SEQ ID NO: 4628 - DNA, 103 bp, Artificial Sequence
  Synthetic Polynucleotide
taatacgactcactatagggaagactcctatgactgcaattttgtatgggaacagaggagacccataatgaattgcagtaacctggcggcagcgcaaaagatg

SEQ ID NO: 4629 - DNA, 103 bp, Artificial Sequence
  Synthetic Polynucleotide
taatacgactcactatagggctccgaagactcctatgactgcaattttgtaacagaggagaacaaaaatgcagtcatagaacctggcggcagcgcaaaagatg

SEQ ID NO: 4630 - DNA, 103 bp, Artificial Sequence
  Synthetic Polynucleotide
taatacgactcactatagggtggtactccgaagactcctatgactgcaataacagaggagaattgcaatgataggagtcaacctggcggcagcgcaaaagatg

SEQ ID NO: 4631 - DNA, 103 bp, Artificial Sequence
  Synthetic Polynucleotide
taatacgactcactataggggatcctggtactccgaagactcctatgactaacagaggagaagtcatatgagtcttcggaacctggcggcagcgcaaaagatg

SEQ ID NO: 4632 - DNA, 103 bp, Artificial Sequence
  Synthetic Polynucleotide
taatacgactcactatagggtgccagatcctggtactccgaagactcctaaacagaggagataggagatgtcggagtacaacctggcggcagcgcaaaagatg

SEQ ID NO: 4633 - DNA, 103 bp, Artificial Sequence
  Synthetic Polynucleotide
taatacgactcactatagggtgacttgccagatcctggtactccgaagacaacagaggagagtcttcatggtaccaggaaacctggcggcagcgcaaaagatg

SEQ ID NO: 4634 - DNA, 103 bp, Artificial Sequence
  Synthetic Polynucleotide
taatacgactcactatagggatagctgacttgccagatcctggtactccgaacagaggagacggagtatgaggatctggaacctggcggcagcgcaaaagatg

SEQ ID NO: 4635 - DNA, 103 bp, Artificial Sequence
  Synthetic Polynucleotide
taatacgactcactatagggtgataatagctgacttgccagatcctggtaaacagaggagataccagatgctggcaagtaacctggcggcagcgcaaaagatg

SEQ ID NO: 4636 - DNA, 103 bp, Artificial Sequence
  Synthetic Polynucleotide
taatacgactcactataggggtcgggatcaatttcctgctctattagtttaacagaggagaaaactaatggagcaggaaaacctggcggcagcgcaaaagatg

SEQ ID NO: 4637 - DNA, 103 bp, Artificial Sequence
  Synthetic Polynucleotide
taatacgactcactataggggttcttgataatagctgacttgccagatccaacagaggagaggatctatgaagtcagctaacctggcggcagcgcaaaagatg

SEQ ID NO: 4638 - DNA, 103 bp, Artificial Sequence
  Synthetic Polynucleotide
taatacgactcactatagggactaggttcttgataatagctgacttgccaaacagaggagatggcaaatgagctattataacctggcggcagcgcaaaagatg

SEQ ID NO: 4639 - DNA, 103 bp, Artificial Sequence
  Synthetic Polynucleotide
taatacgactcactatagggtggtaactaggttcttgataatagctgactaacagaggagaagtcagatgttatcaagaaacctggcggcagcgcaaaagatg

SEQ ID NO: 4640 - DNA, 103 bp, Artificial Sequence
  Synthetic Polynucleotide
taatacgactcactatagggttgcctggtaactaggttcttgataatagcaacagaggagagctattatgaagaacctaaacctggcggcagcgcaaaagatg

SEQ ID NO: 4641 - DNA, 103 bp, Artificial Sequence
  Synthetic Polynucleotide
taatacgactcactatagggaggtcttgcctggtaactaggttcttgataaacagaggagatatcaaatgcctagttacaacctggcggcagcgcaaaagatg

SEQ ID NO: 4642 - DNA, 103 bp, Artificial Sequence
  Synthetic Polynucleotide
taatacgactcactatagggtcaccaggtcttgcctggtaactaggttctaacagaggagaagaaccatgttaccaggcaacctggcggcagcgcaaaagatg

SEQ ID NO: 4643 - DNA, 103 bp, Artificial Sequence
  Synthetic Polynucleotide
taatacgactcactataggggctagtcaccaggtcttgcctggtaactagaacagaggagactagttatgaggcaagacaacctggcggcagcgcaaaagatg

SEQ ID NO: 4644 - DNA, 103 bp, Artificial Sequence
  Synthetic Polynucleotide
taatacgactcactatagggtttccgctagtcaccaggtcttgcctggtaaacagaggagataccagatgagacctggtaacctggcggcagcgcaaaagatg

SEQ ID NO: 4645 - DNA, 103 bp, Artificial Sequence
  Synthetic Polynucleotide
taatacgactcactatagggctttctttccgctagtcaccaggtcttgccaacagaggagaggcaagatgtggtgactaaacctggcggcagcgcaaaagatg

SEQ ID NO: 4646 - DNA, 103 bp, Artificial Sequence
  Synthetic Polynucleotide
taatacgactcactataggggttttctttctttccgctagtcaccaggtcaacagaggagagacctgatgactagcggaaacctggcggcagcgcaaaagatg

SEQ ID NO: 4647 - DNA, 103 bp, Artificial Sequence
  Synthetic Polynucleotide
taatacgactcactataggggttgagtcgggatcaatttcctgctctattaacagaggagaaatagaatgggaaattgaaacctggcggcagcgcaaaagatg

SEQ ID NO: 4648 - DNA, 103 bp, Artificial Sequence
  Synthetic Polynucleotide
taatacgactcactatagggtggcagttttctttctttccgctagtcaccaacagaggagaggtgacatgcggaaagaaaacctggcggcagcgcaaaagatg

SEQ ID NO: 4649 - DNA, 103 bp, Artificial Sequence
  Synthetic Polynucleotide
taatacgactcactatagggtttcttggcagttttctttctttccgctagaacagaggagactagcgatgagaaagaaaaacctggcggcagcgcaaaagatg

SEQ ID NO: 4650 - DNA, 103 bp, Artificial Sequence
  Synthetic Polynucleotide
taatacgactcactatagggggtgatttcttggcagttttctttctttccaacagaggagaggaaagatggaaaactgcaacctggcggcagcgcaaaagatg

SEQ ID NO: 4651 - DNA, 103 bp, Artificial Sequence
  Synthetic Polynucleotide
taatacgactcactatagggtcggtggtgatttcttggcagttttctttcaacagaggagagaaagaatgctgccaagaaacctggcggcagcgcaaaagatg

SEQ ID NO: 4652 - DNA, 103 bp, Artificial Sequence
  Synthetic Polynucleotide
taatacgactcactatagggtcacgtcggtggtgatttcttggcagttttaacagaggagaaaaactatgaagaaatcaaacctggcggcagcgcaaaagatg

SEQ ID NO: 4653 - DNA, 103 bp, Artificial Sequence
  Synthetic Polynucleotide
taatacgactcactatagggtctcatcacgtcggtggtgatttcttggcaaacagaggagatgccaaatgatcaccaccaacctggcggcagcgcaaaagatg

SEQ ID NO: 4654 - DNA, 103 bp, Artificial Sequence
  Synthetic Polynucleotide
taatacgactcactatagggctctgtctcatcacgtcggtggtgatttctaacagaggagaagaaatatgcaccgacgtaacctggcggcagcgcaaaagatg

SEQ ID NO: 4655 - DNA, 103 bp, Artificial Sequence
  Synthetic Polynucleotide
taatacgactcactataggggacctctctgtctcatcacgtcggtggtgaaacagaggagatcaccaatgacgtgatgaaacctggcggcagcgcaaaagatg

SEQ ID NO: 4656 - DNA, 103 bp, Artificial Sequence
  Synthetic Polynucleotide
taatacgactcactatagggctctagacctctctgtctcatcacgtcggtaacagaggagaaccgacatgatgagacagaacctggcggcagcgcaaaagatg

SEQ ID NO: 4657 - DNA, 103 bp, Artificial Sequence
  Synthetic Polynucleotide
taatacgactcactataggggatatctctagacctctctgtctcatcacgaacagaggagacgtgatatgacagagaggaacctggcggcagcgcaaaagatg

SEQ ID NO: 4658 - DNA, 103 bp, Artificial Sequence
  Synthetic Polynucleotide
taatacgactcactatagggggatggttgagtcgggatcaatttcctgctaacagaggagaagcaggatgttgatcccgaacctggcggcagcgcaaaagatg

SEQ ID NO: 4659 - DNA, 103 bp, Artificial Sequence
  Synthetic Polynucleotide
taatacgactcactataggggtgcagatatctctagacctctctgtctcaaacagaggagatgagacatggaggtctagaacctggcggcagcgcaaaagatg

SEQ ID NO: 4660 - DNA, 103 bp, Artificial Sequence
  Synthetic Polynucleotide
taatacgactcactatagggcgtacgtgcagatatctctagacctctctgaacagaggagacagagaatgctagagataaacctggcggcagcgcaaaagatg

SEQ ID NO: 4661 - DNA, 103 bp, Artificial Sequence
  Synthetic Polynucleotide
taatacgactcactatagggtcaaccgtacgtgcagatatctctagacctaacagaggagaaggtctatggatatctgcaacctggcggcagcgcaaaagatg

SEQ ID NO: 4662 - DNA, 103 bp, Artificial Sequence
  Synthetic Polynucleotide
taatacgactcactataggggcgagtcaaccgtacgtgcagatatctctaaacagaggagatagagaatgctgcacgtaaacctggcggcagcgcaaaagatg

SEQ ID NO: 4663 - DNA, 103 bp, Artificial Sequence
  Synthetic Polynucleotide
taatacgactcactataggggagcagcgagtcaaccgtacgtgcagatataacagaggagaatatctatgcgtacggttaacctggcggcagcgcaaaagatg

SEQ ID NO: 4664 - DNA, 103 bp, Artificial Sequence
  Synthetic Polynucleotide
taatacgactcactatagggttcaagagcagcgagtcaaccgtacgtgcaaacagaggagatgcacgatgggttgactcaacctggcggcagcgcaaaagatg

SEQ ID NO: 4665 - DNA, 103 bp, Artificial Sequence
  Synthetic Polynucleotide
taatacgactcactatagggatccattcaagagcagcgagtcaaccgtacaacagaggagagtacggatgactcgctgcaacctggcggcagcgcaaaagatg

SEQ ID NO: 4666 - DNA, 103 bp, Artificial Sequence
  Synthetic Polynucleotide
taatacgactcactataggggttacatccattcaagagcagcgagtcaacaacagaggagagttgacatgctgctcttgaacctggcggcagcgcaaaagatg

SEQ ID NO: 4667 - DNA, 103 bp, Artificial Sequence
  Synthetic Polynucleotide
taatacgactcactatagggggtctgttacatccattcaagagcagcgagaacagaggagactcgctatgcttgaatggaacctggcggcagcgcaaaagatg

SEQ ID NO: 4668 - DNA, 103 bp, Artificial Sequence
  Synthetic Polynucleotide
taatacgactcactatagggcgactggtctgttacatccattcaagagcaaacagaggagatgctctatgatggatgtaaacctggcggcagcgcaaaagatg

SEQ ID NO: 4669 - DNA, 103 bp, Artificial Sequence
  Synthetic Polynucleotide
taatacgactcactatagggatccaggatggttgagtcgggatcaatttcaacagaggagagaaattatgcccgactcaaacctggcggcagcgcaaaagatg

SEQ ID NO: 4670 - DNA, 103 bp, Artificial Sequence
  Synthetic Polynucleotide
taatacgactcactatagggcacgtcgactggtctgttacatccattcaaaacagaggagattgaatatgtgtaacagaaacctggcggcagcgcaaaagatg

SEQ ID NO: 4671 - DNA, 103 bp, Artificial Sequence
  Synthetic Polynucleotide
taatacgactcactatagggtacaacacgtcgactggtctgttacatccaaacagaggagatggatgatgcagaccagtaacctggcggcagcgcaaaagatg

SEQ ID NO: 4672 - DNA, 103 bp, Artificial Sequence
  Synthetic Polynucleotide
taatacgactcactatagggctacgtacaacacgtcgactggtctgttacaacagaggagagtaacaatgcagtcgacgaacctggcggcagcgcaaaagatg

SEQ ID NO: 4673 - DNA, 103 bp, Artificial Sequence
  Synthetic Polynucleotide
taatacgactcactatagggctcgtctacgtacaacacgtcgactggtctaacagaggagaagaccaatggacgtgttgaacctggcggcagcgcaaaagatg

SEQ ID NO: 4674 - DNA, 103 bp, Artificial Sequence
  Synthetic Polynucleotide
taatacgactcactatagggaacgcctcgtctacgtacaacacgtcgactaacagaggagaagtcgaatggttgtacgtaacctggcggcagcgcaaaagatg

SEQ ID NO: 4675 - DNA, 103 bp, Artificial Sequence
  Synthetic Polynucleotide
taatacgactcactatagggacgcaaacgcctcgtctacgtacaacacgtaacagaggagaacgtgtatgacgtagacgaacctggcggcagcgcaaaagatg

SEQ ID NO: 4676 - DNA, 103 bp, Artificial Sequence
  Synthetic Polynucleotide
taatacgactcactataggggtggcacgcaaacgcctcgtctacgtacaaaacagaggagattgtacatggacgaggcgaacctggcggcagcgcaaaagatg

SEQ ID NO: 4677 - DNA, 103 bp, Artificial Sequence
  Synthetic Polynucleotide
taatacgactcactatagggccagagtggcacgcaaacgcctcgtctacgaacagaggagacgtagaatgggcgtttgcaacctggcggcagcgcaaaagatg

SEQ ID NO: 4678 - DNA, 103 bp, Artificial Sequence
  Synthetic Polynucleotide
taatacgactcactatagggacgttccagagtggcacgcaaacgcctcgtaacagaggagaacgaggatgttgcgtgccaacctggcggcagcgcaaaagatg

SEQ ID NO: 4679 - DNA, 103 bp, Artificial Sequence
  Synthetic Polynucleotide
taatacgactcactatagggaagtaacgttccagagtggcacgcaaacgcaacagaggagagcgtttatgtgccactctaacctggcggcagcgcaaaagatg

SEQ ID NO: 4680 - DNA, 103 bp, Artificial Sequence
  Synthetic Polynucleotide
taatacgactcactatagggccaatatccaggatggttgagtcgggatcaaacagaggagatgatccatgctcaaccataacctggcggcagcgcaaaagatg

SEQ ID NO: 4681 - DNA, 103 bp, Artificial Sequence
  Synthetic Polynucleotide
taatacgactcactatagggaatgcaagtaacgttccagagtggcacgcaaacagaggagatgcgtgatgctctggaacaacctggcggcagcgcaaaagatg

SEQ ID NO: 4682 - DNA, 103 bp, Artificial Sequence
  Synthetic Polynucleotide
taatacgactcactatagggcgatcaatgcaagtaacgttccagagtggcaacagaggagagccactatggaacgttacaacctggcggcagcgcaaaagatg

SEQ ID NO: 4683 - DNA, 103 bp, Artificial Sequence
  Synthetic Polynucleotide
taatacgactcactatagggcaaggcgatcaatgcaagtaacgttccagaaacagaggagatctggaatgttacttgcaaacctggcggcagcgcaaaagatg

SEQ ID NO: 4684 - DNA, 103 bp, Artificial Sequence
  Synthetic Polynucleotide
taatacgactcactatagggctcaccaaggcgatcaatgcaagtaacgttaacagaggagaaacgttatgtgcattgataacctggcggcagcgcaaaagatg

SEQ ID NO: 4685 - DNA, 103 bp, Artificial Sequence
  Synthetic Polynucleotide
taatacgactcactatagggttggtctcaccaaggcgatcaatgcaagtaaacagaggagatacttgatgtgatcgcctaacctggcggcagcgcaaaagatg

SEQ ID NO: 4686 - DNA, 103 bp, Artificial Sequence
  Synthetic Polynucleotide
taatacgactcactatagggctgtcttggtctcaccaaggcgatcaatgcaacagaggagagcattgatggccttggtgaacctggcggcagcgcaaaagatg

SEQ ID NO: 4687 - DNA, 103 bp, Artificial Sequence
  Synthetic Polynucleotide
taatacgactcactatagggactttctgtcttggtctcaccaaggcgatcaacagaggagagatcgcatgggtgagaccaacctggcggcagcgcaaaagatg

SEQ ID NO: 4688 - DNA, 103 bp, Artificial Sequence
  Synthetic Polynucleotide
taatacgactcactataggggtacaactttctgtcttggtctcaccaaggaacagaggagaccttggatggaccaagacaacctggcggcagcgcaaaagatg

SEQ ID NO: 4689 - DNA, 103 bp, Artificial Sequence
  Synthetic Polynucleotide
taatacgactcactatagggacaaagtacaactttctgtcttggtctcacaacagaggagagtgagaatgagacagaaaaacctggcggcagcgcaaaagatg

SEQ ID NO: 4690 - DNA, 103 bp, Artificial Sequence
  Synthetic Polynucleotide
taatacgactcactatagggtcaccacaaagtacaactttctgtcttggtaacagaggagaaccaagatggaaagttgtaacctggcggcagcgcaaaagatg

SEQ ID NO: 4691 - DNA, 103 bp, Artificial Sequence
  Synthetic Polynucleotide
taatacgactcactatagggagagtagagcagtaagaaactggtaggctaaacagaggagatagcctatgagtttcttaaacctggcggcagcgcaaaagatg

SEQ ID NO: 4692 - DNA, 103 bp, Artificial Sequence
  Synthetic Polynucleotide
taatacgactcactatagggcactaccaatatccaggatggttgagtcggaacagaggagaccgactatgccatcctggaacctggcggcagcgcaaaagatg

SEQ ID NO: 4693 - DNA, 103 bp, Artificial Sequence
  Synthetic Polynucleotide
taatacgactcactatagggtcgggtcaccacaaagtacaactttctgtcaacagaggagagacagaatgttgtactttaacctggcggcagcgcaaaagatg

SEQ ID NO: 4694 - DNA, 103 bp, Artificial Sequence
  Synthetic Polynucleotide
taatacgactcactatagggctgcttcgggtcaccacaaagtacaactttaacagaggagaaaagttatgctttgtggtaacctggcggcagcgcaaaagatg

SEQ ID NO: 4695 - DNA, 103 bp, Artificial Sequence
  Synthetic Polynucleotide
taatacgactcactatagggccgcactgcttcgggtcaccacaaagtacaaacagaggagatgtactatgtggtgacccaacctggcggcagcgcaaaagatg

SEQ ID NO: 4696 - DNA, 103 bp, Artificial Sequence
  Synthetic Polynucleotide
taatacgactcactatagggagaagccgcactgcttcgggtcaccacaaaaacagaggagatttgtgatgacccgaagcaacctggcggcagcgcaaaagatg

SEQ ID NO: 4697 - DNA, 103 bp, Artificial Sequence
  Synthetic Polynucleotide
taatacgactcactatagggattgaagaagccgcactgcttcgggtcaccaacagaggagaggtgacatgaagcagtgcaacctggcggcagcgcaaaagatg

SEQ ID NO: 4698 - DNA, 103 bp, Artificial Sequence
  Synthetic Polynucleotide
taatacgactcactatagggatcatattgaagaagccgcactgcttcgggaacagaggagacccgaaatggtgcggcttaacctggcggcagcgcaaaagatg

SEQ ID NO: 4699 - DNA, 103 bp, Artificial Sequence
  Synthetic Polynucleotide
taatacgactcactatagggtctgcatcatattgaagaagccgcactgctaacagaggagaagcagtatggcttcttcaaacctggcggcagcgcaaaagatg

SEQ ID NO: 4700 - DNA, 103 bp, Artificial Sequence
  Synthetic Polynucleotide
taatacgactcactatagggtttcatctgcatcatattgaagaagccgcaaacagaggagatgcggcatgttcaatatgaacctggcggcagcgcaaaagatg

SEQ ID NO: 4701 - DNA, 103 bp, Artificial Sequence
  Synthetic Polynucleotide
taatacgactcactatagggttgactttcatctgcatcatattgaagaagaacagaggagacttcttatgtatgatgcaaacctggcggcagcgcaaaagatg

SEQ ID NO: 4702 - DNA, 103 bp, Artificial Sequence
  Synthetic Polynucleotide
taatacgactcactatagggtatagttgactttcatctgcatcatattgaaacagaggagatcaataatgtgcagatgaaacctggcggcagcgcaaaagatg

SEQ ID NO: 4703 - DNA, 103 bp, Artificial Sequence
  Synthetic Polynucleotide
taatacgactcactatagggtggcgcactaccaatatccaggatggttgaaacagaggagatcaaccatgctggatattaacctggcggcagcgcaaaagatg

SEQ ID NO: 4704 - DNA, 103 bp, Artificial Sequence
  Synthetic Polynucleotide
taatacgactcactataggggtgattatagttgactttcatctgcatcataacagaggagaatgatgatgatgaaagtcaacctggcggcagcgcaaaagatg

SEQ ID NO: 4705 - DNA, 103 bp, Artificial Sequence
  Synthetic Polynucleotide
taatacgactcactatagggatgttgtgattatagttgactttcatctgcaacagaggagagcagatatgagtcaactaaacctggcggcagcgcaaaagatg

SEQ ID NO: 4706 - DNA, 103 bp, Artificial Sequence
  Synthetic Polynucleotide
taatacgactcactatagggtgcagatgttgtgattatagttgactttcaaacagaggagatgaaagatgactataatcaacctggcggcagcgcaaaagatg

SEQ ID NO: 4707 - DNA, 103 bp, Artificial Sequence
  Synthetic Polynucleotide
taatacgactcactatagggttgggtgcagatgttgtgattatagttgacaacagaggagagtcaacatgaatcacaacaacctggcggcagcgcaaaagatg

SEQ ID NO: 4708 - DNA, 103 bp, Artificial Sequence
  Synthetic Polynucleotide
taatacgactcactatagggtacacttgggtgcagatgttgtgattatagaacagaggagactataaatgcaacatctgaacctggcggcagcgcaaaagatg

SEQ ID NO: 4709 - DNA, 103 bp, Artificial Sequence
  Synthetic Polynucleotide
taatacgactcactatagggtgtggtacacttgggtgcagatgttgtgataacagaggagaatcacaatgtctgcacccaacctggcggcagcgcaaaagatg

SEQ ID NO: 4710 - DNA, 103 bp, Artificial Sequence
  Synthetic Polynucleotide
taatacgactcactatagggacttttgtggtacacttgggtgcagatgttaacagaggagaaacatcatgacccaagtgaacctggcggcagcgcaaaagatg

SEQ ID NO: 4711 - DNA, 103 bp, Artificial Sequence
  Synthetic Polynucleotide
taatacgactcactataggggagatacttttgtggtacacttgggtgcagaacagaggagactgcacatgagtgtaccaaacctggcggcagcgcaaaagatg

SEQ ID NO: 4712 - DNA, 103 bp, Artificial Sequence
  Synthetic Polynucleotide
taatacgactcactataggggcctggagatacttttgtggtacacttgggaacagaggagacccaagatgaccacaaaaaacctggcggcagcgcaaaagatg

SEQ ID NO: 4713 - DNA, 103 bp, Artificial Sequence
  Synthetic Polynucleotide
taatacgactcactatagggacaccgcctggagatacttttgtggtacacaacagaggagagtgtacatgaaaagtatcaacctggcggcagcgcaaaagatg

SEQ ID NO: 4714 - DNA, 103 bp, Artificial Sequence
  Synthetic Polynucleotide
taatacgactcactatagggcttgctggcgcactaccaatatccaggatgaacagaggagacatcctatgtattggtagaacctggcggcagcgcaaaagatg

SEQ ID NO: 4715 - DNA, 103 bp, Artificial Sequence
  Synthetic Polynucleotide
taatacgactcactatagggagtgtacaccgcctggagatacttttgtggaacagaggagaccacaaatgtatctccagaacctggcggcagcgcaaaagatg

SEQ ID NO: 4716 - DNA, 103 bp, Artificial Sequence
  Synthetic Polynucleotide
taatacgactcactatagggcaggcagtgtacaccgcctggagatactttaacagaggagaaaagtaatgccaggcggtaacctggcggcagcgcaaaagatg

SEQ ID NO: 4717 - DNA, 103 bp, Artificial Sequence
  Synthetic Polynucleotide
taatacgactcactatagggagtcacaggcagtgtacaccgcctggagataacagaggagaatctccatgcggtgtacaaacctggcggcagcgcaaaagatg

SEQ ID NO: 4718 - DNA, 103 bp, Artificial Sequence
  Synthetic Polynucleotide
taatacgactcactatagggatggcagtcacaggcagtgtacaccgcctgaacagaggagacaggcgatgtacactgccaacctggcggcagcgcaaaagatg

SEQ ID NO: 4719 - DNA, 103 bp, Artificial Sequence
  Synthetic Polynucleotide
taatacgactcactatagggacacaatggcagtcacaggcagtgtacaccaacagaggagaggtgtaatgtgcctgtgaaacctggcggcagcgcaaaagatg

SEQ ID NO: 4720 - DNA, 103 bp, Artificial Sequence
  Synthetic Polynucleotide
taatacgactcactatagggcgatgacacaatggcagtcacaggcagtgtaacagaggagaacactgatggtgactgccaacctggcggcagcgcaaaagatg

SEQ ID NO: 4721 - DNA, 103 bp, Artificial Sequence
  Synthetic Polynucleotide
taatacgactcactatagggtgcaacgatgacacaatggcagtcacaggcaacagaggagagcctgtatgtgccattgtaacctggcggcagcgcaaaagatg

SEQ ID NO: 4722 - DNA, 103 bp, Artificial Sequence
  Synthetic Polynucleotide
taatacgactcactatagggcgtaatgcaacgatgacacaatggcagtcaaacagaggagatgactgatgttgtgtcataacctggcggcagcgcaaaagatg

SEQ ID NO: 4723 - DNA, 103 bp, Artificial Sequence
  Synthetic Polynucleotide
taatacgactcactataggggccttcgtaatgcaacgatgacacaatggcaacagaggagagccattatgtcatcgttgaacctggcggcagcgcaaaagatg

SEQ ID NO: 4724 - DNA, 103 bp, Artificial Sequence
  Synthetic Polynucleotide
taatacgactcactatagggattttgccttcgtaatgcaacgatgacacaaacagaggagatgtgtcatggttgcattaaacctggcggcagcgcaaaagatg

SEQ ID NO: 4725 - DNA, 103 bp, Artificial Sequence
  Synthetic Polynucleotide
taatacgactcactatagggtcctccttgctggcgcactaccaatatccaaacagaggagatggataatggtagtgcgcaacctggcggcagcgcaaaagatg

SEQ ID NO: 4726 - DNA, 103 bp, Artificial Sequence
  Synthetic Polynucleotide
taatacgactcactatagggtgcgcattttgccttcgtaatgcaacgatgaacagaggagacatcgtatgattacgaagaacctggcggcagcgcaaaagatg

SEQ ID NO: 4727 - DNA, 103 bp, Artificial Sequence
  Synthetic Polynucleotide
taatacgactcactatagggcgtagtgcgcattttgccttcgtaatgcaaaacagaggagattgcatatggaaggcaaaaacctggcggcagcgcaaaagatg

SEQ ID NO: 4728 - DNA, 103 bp, Artificial Sequence
  Synthetic Polynucleotide
taatacgactcactatagggtcattcgtagtgcgcattttgccttcgtaaaacagaggagattacgaatgcaaaatgcgaacctggcggcagcgcaaaagatg

SEQ ID NO: 4729 - DNA, 103 bp, Artificial Sequence
  Synthetic Polynucleotide
taatacgactcactatagggtgtactcattcgtagtgcgcattttgccttaacagaggagaaaggcaatgtgcgcactaaacctggcggcagcgcaaaagatg

SEQ ID NO: 4730 - DNA, 103 bp, Artificial Sequence
  Synthetic Polynucleotide
taatacgactcactatagggcttgttgtactcattcgtagtgcgcattttaacagaggagaaaaatgatgactacgaataacctggcggcagcgcaaaagatg

SEQ ID NO: 4731 - DNA, 103 bp, Artificial Sequence
  Synthetic Polynucleotide
taatacgactcactatagggatcggcttgttgtactcattcgtagtgcgcaacagaggagagcgcacatggaatgagtaaacctggcggcagcgcaaaagatg

SEQ ID NO: 4732 - DNA, 103 bp, Artificial Sequence
  Synthetic Polynucleotide
taatacgactcactatagggctacaatcggcttgttgtactcattcgtagaacagaggagactacgaatgagtacaacaaacctggcggcagcgcaaaagatg

SEQ ID NO: 4733 - DNA, 103 bp, Artificial Sequence
  Synthetic Polynucleotide
taatacgactcactataggggtccactacaatcggcttgttgtactcattaacagaggagaaatgagatgaacaagccgaacctggcggcagcgcaaaagatg

SEQ ID NO: 4734 - DNA, 103 bp, Artificial Sequence
  Synthetic Polynucleotide
taatacgactcactataggggtagtgtccactacaatcggcttgttgtacaacagaggagagtacaaatggccgattgtaacctggcggcagcgcaaaagatg

SEQ ID NO: 4735 - DNA, 103 bp, Artificial Sequence
  Synthetic Polynucleotide
taatacgactcactatagggagcctgtagtgtccactacaatcggcttgtaacagaggagaacaagcatgttgtagtggaacctggcggcagcgcaaaagatg

SEQ ID NO: 4736 - DNA, 103 bp, Artificial Sequence
  Synthetic Polynucleotide
taatacgactcactatagggcatcatcctccttgctggcgcactaccaataacagaggagaattggtatggcgccagcaaacctggcggcagcgcaaaagatg

SEQ ID NO: 4737 - DNA, 103 bp, Artificial Sequence
  Synthetic Polynucleotide
taatacgactcactatagggtgttgagcctgtagtgtccactacaatcggaacagaggagaccgattatggtggacactaacctggcggcagcgcaaaagatg

SEQ ID NO: 4738 - DNA, 103 bp, Artificial Sequence
  Synthetic Polynucleotide
taatacgactcactatagggggttttgttgagcctgtagtgtccactacaaacagaggagatgtagtatgcactacaggaacctggcggcagcgcaaaagatg

SEQ ID NO: 4739 - DNA, 103 bp, Artificial Sequence
  Synthetic Polynucleotide
taatacgactcactatagggggtcaggttttgttgagcctgtagtgtccaaacagaggagatggacaatgcaggctcaaaacctggcggcagcgcaaaagatg

SEQ ID NO: 4740 - DNA, 103 bp, Artificial Sequence
  Synthetic Polynucleotide
taatacgactcactatagggtccagggtcaggttttgttgagcctgtagtaacagaggagaactacaatgtcaacaaaaaacctggcggcagcgcaaaagatg

SEQ ID NO: 4741 - DNA, 103 bp, Artificial Sequence
  Synthetic Polynucleotide
taatacgactcactatagggagatctccagggtcaggttttgttgagcctaacagaggagaaggctcatgaaaacctgaaacctggcggcagcgcaaaagatg

SEQ ID NO: 4742 - DNA, 103 bp, Artificial Sequence
  Synthetic Polynucleotide
taatacgactcactatagggacacgagatctccagggtcaggttttgttgaacagaggagacaacaaatgctgaccctgaacctggcggcagcgcaaaagatg

SEQ ID NO: 4743 - DNA, 103 bp, Artificial Sequence
  Synthetic Polynucleotide
taatacgactcactatagggcgttaacacgagatctccagggtcaggtttaacagaggagaaaacctatgcctggagataacctggcggcagcgcaaaagatg

SEQ ID NO: 4744 - DNA, 103 bp, Artificial Sequence
  Synthetic Polynucleotide
taatacgactcactatagggaagcacgttaacacgagatctccagggtcaaacagaggagatgacccatgagatctcgtaacctggcggcagcgcaaaagatg

SEQ ID NO: 4745 - DNA, 103 bp, Artificial Sequence
  Synthetic Polynucleotide
taatacgactcactatagggctctgaagcacgttaacacgagatctccagaacagaggagactggagatgtcgtgttaaaacctggcggcagcgcaaaagatg

SEQ ID NO: 4746 - DNA, 103 bp, Artificial Sequence
  Synthetic Polynucleotide
taatacgactcactatagggccatcctctgaagcacgttaacacgagatcaacagaggagagatctcatgttaacgtgcaacctggcggcagcgcaaaagatg

SEQ ID NO: 4747 - DNA, 103 bp, Artificial Sequence
  Synthetic Polynucleotide
taatacgactcactatagggtccgacatcatcctccttgctggcgcactaaacagaggagatagtgcatgagcaaggagaacctggcggcagcgcaaaagatg

SEQ ID NO: 4748 - DNA, 103 bp, Artificial Sequence
  Synthetic Polynucleotide
taatacgactcactatagggttaacccatcctctgaagcacgttaacacgaacagaggagacgtgttatggtgcttcagaacctggcggcagcgcaaaagatg

SEQ ID NO: 4749 - DNA, 103 bp, Artificial Sequence
  Synthetic Polynucleotide
taatacgactcactataggggttgtttaacccatcctctgaagcacgttaaacagaggagataacgtatgtcagaggataacctggcggcagcgcaaaagatg

SEQ ID NO: 4750 - DNA, 103 bp, Artificial Sequence
  Synthetic Polynucleotide
taatacgactcactatagggttgcagttgtttaacccatcctctgaagcaaacagaggagatgcttcatgggatgggttaacctggcggcagcgcaaaagatg

SEQ ID NO: 4751 - DNA, 103 bp, Artificial Sequence
  Synthetic Polynucleotide
taatacgactcactatagggtcaatttgcagttgtttaacccatcctctgaacagaggagacagaggatgggttaaacaaacctggcggcagcgcaaaagatg

SEQ ID NO: 4752 - DNA, 103 bp, Artificial Sequence
  Synthetic Polynucleotide
taatacgactcactataggggatagtcaatttgcagttgtttaacccatcaacagaggagagatgggatgaacaactgcaacctggcggcagcgcaaaagatg

SEQ ID NO: 4753 - DNA, 103 bp, Artificial Sequence
  Synthetic Polynucleotide
taatacgactcactatagggtccacgatagtcaatttgcagttgtttaacaacagaggagagttaaaatgctgcaaattaacctggcggcagcgcaaaagatg

SEQ ID NO: 4754 - DNA, 103 bp, Artificial Sequence
  Synthetic Polynucleotide
taatacgactcactatagggtcgtgtccacgatagtcaatttgcagttgtaacagaggagaacaactatgaattgactaaacctggcggcagcgcaaaagatg

SEQ ID NO: 4755 - DNA, 103 bp, Artificial Sequence
  Synthetic Polynucleotide
taatacgactcactatagggtgacctcgtgtccacgatagtcaatttgcaaacagaggagatgcaaaatgactatcgtgaacctggcggcagcgcaaaagatg

SEQ ID NO: 4756 - DNA, 103 bp, Artificial Sequence
  Synthetic Polynucleotide
taatacgactcactatagggtgtcatgacctcgtgtccacgatagtcaataacagaggagaattgacatgcgtggacacaacctggcggcagcgcaaaagatg

SEQ ID NO: 4757 - DNA, 103 bp, Artificial Sequence
  Synthetic Polynucleotide
taatacgactcactataggggctgctgtcatgacctcgtgtccacgatagaacagaggagactatcgatgacacgaggtaacctggcggcagcgcaaaagatg

SEQ ID NO: 4758 - DNA, 103 bp, Artificial Sequence
  Synthetic Polynucleotide
taatacgactcactatagggtcctgtccgacatcatcctccttgctggcgaacagaggagacgccagatgggaggatgaaacctggcggcagcgcaaaagatg

SEQ ID NO: 4759 - DNA, 103 bp, Artificial Sequence
  Synthetic Polynucleotide
taatacgactcactatagggatgcggctgctgtcatgacctcgtgtccacaacagaggagagtggacatgaggtcatgaaacctggcggcagcgcaaaagatg

SEQ ID NO: 4760 - DNA, 103 bp, Artificial Sequence
  Synthetic Polynucleotide
taatacgactcactatagggttgggatgcggctgctgtcatgacctcgtgaacagaggagacacgagatgatgacagcaaacctggcggcagcgcaaaagatg

SEQ ID NO: 4761 - DNA, 103 bp, Artificial Sequence
  Synthetic Polynucleotide
taatacgactcactatagggaacccttgggatgcggctgctgtcatgaccaacagaggagaggtcatatgagcagccgcaacctggcggcagcgcaaaagatg

SEQ ID NO: 4762 - DNA, 103 bp, Artificial Sequence
  Synthetic Polynucleotide
taatacgactcactatagggtggttaacccttgggatgcggctgctgtcaaacagaggagatgacagatgccgcatcccaacctggcggcagcgcaaaagatg

SEQ ID NO: 4763 - DNA, 103 bp, Artificial Sequence
  Synthetic Polynucleotide
taatacgactcactatagggttttctggttaacccttgggatgcggctgcaacagaggagagcagccatgtcccaagggaacctggcggcagcgcaaaagatg

SEQ ID NO: 4764 - DNA, 103 bp, Artificial Sequence
  Synthetic Polynucleotide
taatacgactcactatagggactccttttctggttaacccttgggatgcgaacagaggagacgcatcatgagggttaacaacctggcggcagcgcaaaagatg

SEQ ID NO: 4765 - DNA, 103 bp, Artificial Sequence
  Synthetic Polynucleotide
taatacgactcactatagggcgtaaactccttttctggttaacccttgggaacagaggagacccaagatgtaaccagaaaacctggcggcagcgcaaaagatg

SEQ ID NO: 4766 - DNA, 103 bp, Artificial Sequence
  Synthetic Polynucleotide
taatacgactcactatagggaactgcgtaaactccttttctggttaacccaacagaggagagggttaatgagaaaaggaaacctggcggcagcgcaaaagatg

SEQ ID NO: 4767 - DNA, 103 bp, Artificial Sequence
  Synthetic Polynucleotide
taatacgactcactatagggtgcctaactgcgtaaactccttttctggttaacagaggagaaaccagatgaggagtttaaacctggcggcagcgcaaaagatg

SEQ ID NO: 4768 - DNA, 103 bp, Artificial Sequence
  Synthetic Polynucleotide
taatacgactcactatagggctttttgcctaactgcgtaaactccttttcaacagaggagagaaaagatgtttacgcagaacctggcggcagcgcaaaagatg

SEQ ID NO: 4769 - DNA, 103 bp, Artificial Sequence
  Synthetic Polynucleotide
taatacgactcactataggggtacttcctgtccgacatcatcctccttgcaacagaggagagcaaggatgatgatgtcgaacctggcggcagcgcaaaagatg

SEQ ID NO: 4770 - DNA, 103 bp, Artificial Sequence
  Synthetic Polynucleotide
taatacgactcactataggggttaactttttgcctaactgcgtaaactccaacagaggagaggagttatggcagttaggaacctggcggcagcgcaaaagatg

SEQ ID NO: 4771 - DNA, 103 bp, Artificial Sequence
  Synthetic Polynucleotide
taatacgactcactatagggttttcgttaactttttgcctaactgcgtaaaacagaggagattacgcatgtaggcaaaaaacctggcggcagcgcaaaagatg

SEQ ID NO: 4772 - DNA, 103 bp, Artificial Sequence
  Synthetic Polynucleotide
taatacgactcactataggggcgggttttcgttaactttttgcctaactgaacagaggagacagttaatgaaaaagttaaacctggcggcagcgcaaaagatg

SEQ ID NO: 4773 - DNA, 103 bp, Artificial Sequence
  Synthetic Polynucleotide
taatacgactcactatagggataaagcgggttttcgttaactttttgcctaacagaggagaaggcaaatggttaacgaaaacctggcggcagcgcaaaagatg

SEQ ID NO: 4774 - DNA, 103 bp, Artificial Sequence
  Synthetic Polynucleotide
taatacgactcactataggggatgcataaagcgggttttcgttaacttttaacagaggagaaaaagtatgcgaaaacccaacctggcggcagcgcaaaagatg

SEQ ID NO: 4775 - DNA, 103 bp, Artificial Sequence
  Synthetic Polynucleotide
taatacgactcactatagggacgttgatgcataaagcgggttttcgttaaaacagaggagattaacgatgacccgctttaacctggcggcagcgcaaaagatg

SEQ ID NO: 4776 - DNA, 103 bp, Artificial Sequence
  Synthetic Polynucleotide
taatacgactcactatagggctctgacgttgatgcataaagcgggttttcaacagaggagagaaaacatgctttatgcaaacctggcggcagcgcaaaagatg

SEQ ID NO: 4777 - DNA, 103 bp, Artificial Sequence
  Synthetic Polynucleotide
taatacgactcactatagggacgtgctctgacgttgatgcataaagcgggaacagaggagacccgctatgtgcatcaacaacctggcggcagcgcaaaagatg

SEQ ID NO: 4778 - DNA, 103 bp, Artificial Sequence
  Synthetic Polynucleotide
taatacgactcactatagggcgttgacgtgctctgacgttgatgcataaaaacagaggagatttatgatgcaacgtcagaacctggcggcagcgcaaaagatg

SEQ ID NO: 4779 - DNA, 103 bp, Artificial Sequence
  Synthetic Polynucleotide
taatacgactcactataggggagtacgttgacgtgctctgacgttgatgcaacagaggagagcatcaatgtcagagcacaacctggcggcagcgcaaaagatg

SEQ ID NO: 4780 - DNA, 103 bp, Artificial Sequence
  Synthetic Polynucleotide
taatacgactcactatagggcagtggtacttcctgtccgacatcatcctcaacagaggagagaggatatggtcggacagaacctggcggcagcgcaaaagatg

SEQ ID NO: 4781 - DNA, 103 bp, Artificial Sequence
  Synthetic Polynucleotide
taatacgactcactataggggttaggagtacgttgacgtgctctgacgttaacagaggagaaacgtcatggcacgtcaaaacctggcggcagcgcaaaagatg

SEQ ID NO: 4782 - DNA, 103 bp, Artificial Sequence
  Synthetic Polynucleotide
taatacgactcactatagggtacgcgttaggagtacgttgacgtgctctgaacagaggagacagagcatgtcaacgtacaacctggcggcagcgcaaaagatg

SEQ ID NO: 4783 - DNA, 103 bp, Artificial Sequence
  Synthetic Polynucleotide
taatacgactcactatagggttccgtacgcgttaggagtacgttgacgtgaacagaggagacacgtcatggtactcctaaacctggcggcagcgcaaaagatg

SEQ ID NO: 4784 - DNA, 103 bp, Artificial Sequence
  Synthetic Polynucleotide
taatacgactcactatagggttaccttccgtacgcgttaggagtacgttgaacagaggagacaacgtatgcctaacgcgaacctggcggcagcgcaaaagatg

SEQ ID NO: 4785 - DNA, 103 bp, Artificial Sequence
  Synthetic Polynucleotide
taatacgactcactatagggccagtttaccttccgtacgcgttaggagtaaacagaggagatactccatgcgcgtacggaacctggcggcagcgcaaaagatg

SEQ ID NO: 4786 - DNA, 103 bp, Artificial Sequence
  Synthetic Polynucleotide
taatacgactcactatagggccataccagtttaccttccgtacgcgttagaacagaggagactaacgatgacggaaggtaacctggcggcagcgcaaaagatg

SEQ ID NO: 4787 - DNA, 103 bp, Artificial Sequence
  Synthetic Polynucleotide
taatacgactcactataggggtcttccataccagtttaccttccgtacgcaacagaggagagcgtacatgaggtaaactaacctggcggcagcgcaaaagatg

SEQ ID NO: 4788 - DNA, 103 bp, Artificial Sequence
  Synthetic Polynucleotide
taatacgactcactatagggagagtgtcttccataccagtttaccttccgaacagaggagacggaagatgaactggtataacctggcggcagcgcaaaagatg

SEQ ID NO: 4789 - DNA, 103 bp, Artificial Sequence
  Synthetic Polynucleotide
taatacgactcactatagggaccggagagtgtcttccataccagtttaccaacagaggagaggtaaaatggtatggaagaacctggcggcagcgcaaaagatg

SEQ ID NO: 4790 - DNA, 103 bp, Artificial Sequence
  Synthetic Polynucleotide
taatacgactcactataggggggtcaccggagagtgtcttccataccagtaacagaggagaactggtatggaagacactaacctggcggcagcgcaaaagatg

SEQ ID NO: 4791 - DNA, 103 bp, Artificial Sequence
  Synthetic Polynucleotide
taatacgactcactatagggaaacgcagtggtacttcctgtccgacatcaaacagaggagatgatgtatgacaggaagtaacctggcggcagcgcaaaagatg

SEQ ID NO: 4792 - DNA, 103 bp, Artificial Sequence
  Synthetic Polynucleotide
taatacgactcactatagggtccacgggtcaccggagagtgtcttccataaacagaggagatatggaatgcactctccgaacctggcggcagcgcaaaagatg

SEQ ID NO: 4793 - DNA, 103 bp, Artificial Sequence
  Synthetic Polynucleotide
taatacgactcactatagggctttatccacgggtcaccggagagtgtcttaacagaggagaaagacaatgtccggtgacaacctggcggcagcgcaaaagatg

SEQ ID NO: 4794 - DNA, 103 bp, Artificial Sequence
  Synthetic Polynucleotide
taatacgactcactatagggagcgtctttatccacgggtcaccggagagtaacagaggagaactctcatgtgacccgtgaacctggcggcagcgcaaaagatg

SEQ ID NO: 4795 - DNA, 103 bp, Artificial Sequence
  Synthetic Polynucleotide
taatacgactcactatagggtctgcagcgtctttatccacgggtcaccggaacagaggagaccggtgatgcgtggataaaacctggcggcagcgcaaaagatg

SEQ ID NO: 4796 - DNA, 103 bp, Artificial Sequence
  Synthetic Polynucleotide
taatacgactcactatagggtgggttctgcagcgtctttatccacgggtcaacagaggagagacccgatgataaagacgaacctggcggcagcgcaaaagatg

SEQ ID NO: 4797 - DNA, 103 bp, Artificial Sequence
  Synthetic Polynucleotide
taatacgactcactatagggttcggtgggttctgcagcgtctttatccacaacagaggagagtggatatggacgctgcaaacctggcggcagcgcaaaagatg

SEQ ID NO: 4798 - DNA, 103 bp, Artificial Sequence
  Synthetic Polynucleotide
taatacgactcactatagggttcctttcggtgggttctgcagcgtctttaaacagaggagataaagaatgtgcagaaccaacctggcggcagcgcaaaagatg

SEQ ID NO: 4799 - DNA, 103 bp, Artificial Sequence
  Synthetic Polynucleotide
taatacgactcactataggggaagtttcctttcggtgggttctgcagcgtaacagaggagaacgctgatgaacccaccgaacctggcggcagcgcaaaagatg

SEQ ID NO: 4800 - DNA, 103 bp, Artificial Sequence
  Synthetic Polynucleotide
taatacgactcactataggggctttgaagtttcctttcggtgggttctgcaacagaggagagcagaaatgaccgaaaggaacctggcggcagcgcaaaagatg

SEQ ID NO: 4801 - DNA, 103 bp, Artificial Sequence
  Synthetic Polynucleotide
taatacgactcactatagggtagttgctttgaagtttcctttcggtgggtaacagaggagaacccacatgaaggaaactaacctggcggcagcgcaaaagatg

SEQ ID NO: 4802 - DNA, 103 bp, Artificial Sequence
  Synthetic Polynucleotide
taatacgactcactatagggtttgcagagtagagcagtaagaaactggtaaacagaggagataccagatgcttactgctaacctggcggcagcgcaaaagatg

SEQ ID NO: 4803 - DNA, 103 bp, Artificial Sequence
  Synthetic Polynucleotide
taatacgactcactatagggcgggcaaacgcagtggtacttcctgtccgaaacagaggagatcggacatgaagtaccacaacctggcggcagcgcaaaagatg

SEQ ID NO: 4804 - DNA, 103 bp, Artificial Sequence
  Synthetic Polynucleotide
taatacgactcactatagggcttaatagttgctttgaagtttcctttcggaacagaggagaccgaaaatgaacttcaaaaacctggcggcagcgcaaaagatg

SEQ ID NO: 4805 - DNA, 103 bp, Artificial Sequence
  Synthetic Polynucleotide
taatacgactcactatagggcactccttaatagttgctttgaagtttcctaacagaggagaaggaaaatgcaaagcaacaacctggcggcagcgcaaaagatg

SEQ ID NO: 4806 - DNA, 103 bp, Artificial Sequence
  Synthetic Polynucleotide
taatacgactcactatagggcctcccactccttaatagttgctttgaagtaacagaggagaacttcaatgcaactattaaacctggcggcagcgcaaaagatg

SEQ ID NO: 4807 - DNA, 103 bp, Artificial Sequence
  Synthetic Polynucleotide
taatacgactcactatagggctccacctcccactccttaatagttgctttaacagaggagaaaagcaatgattaaggagaacctggcggcagcgcaaaagatg

SEQ ID NO: 4808 - DNA, 103 bp, Artificial Sequence
  Synthetic Polynucleotide
taatacgactcactataggggcatgctccacctcccactccttaatagttaacagaggagaaactatatgggagtgggaaacctggcggcagcgcaaaagatg

SEQ ID NO: 4809 - DNA, 103 bp, Artificial Sequence
  Synthetic Polynucleotide
taatacgactcactatagggttgatgcatgctccacctcccactccttaaaacagaggagattaaggatggggaggtggaacctggcggcagcgcaaaagatg

SEQ ID NO: 4810 - DNA, 103 bp, Artificial Sequence
  Synthetic Polynucleotide
taatacgactcactatagggcattattgatgcatgctccacctcccactcaacagaggagagagtggatggtggagcataacctggcggcagcgcaaaagatg

SEQ ID NO: 4811 - DNA, 103 bp, Artificial Sequence
  Synthetic Polynucleotide
taatacgactcactatagggcccgccattattgatgcatgctccacctccaacagaggagaggaggtatggcatgcatcaacctggcggcagcgcaaaagatg

SEQ ID NO: 4812 - DNA, 103 bp, Artificial Sequence
  Synthetic Polynucleotide
taatacgactcactatagggagatgcccgccattattgatgcatgctccaaacagaggagatggagcatgcatcaataaaacctggcggcagcgcaaaagatg

SEQ ID NO: 4813 - DNA, 103 bp, Artificial Sequence
  Synthetic Polynucleotide
taatacgactcactatagggactgcagatgcccgccattattgatgcatgaacagaggagacatgcaatgataatggcgaacctggcggcagcgcaaaagatg

SEQ ID NO: 4814 - DNA, 103 bp, Artificial Sequence
  Synthetic Polynucleotide
taatacgactcactatagggcgcatcgggcaaacgcagtggtacttcctgaacagaggagacaggaaatgccactgcgtaacctggcggcagcgcaaaagatg

SEQ ID NO: 4815 - DNA, 103 bp, Artificial Sequence
  Synthetic Polynucleotide
taatacgactcactatagggtggtgactgcagatgcccgccattattgataacagaggagaatcaatatgggcgggcataacctggcggcagcgcaaaagatg

SEQ ID NO: 4816 - DNA, 103 bp, Artificial Sequence
  Synthetic Polynucleotide
taatacgactcactatagggtcatttggtgactgcagatgcccgccattaaacagaggagataatggatggcatctgcaaacctggcggcagcgcaaaagatg

SEQ ID NO: 4817 - DNA, 103 bp, Artificial Sequence
  Synthetic Polynucleotide
taatacgactcactatagggaaaggtcatttggtgactgcagatgcccgcaacagaggagagcgggcatgtgcagtcacaacctggcggcagcgcaaaagatg

SEQ ID NO: 4818 - DNA, 103 bp, Artificial Sequence
  Synthetic Polynucleotide
taatacgactcactataggggtatcaaaggtcatttggtgactgcagatgaacagaggagacatctgatgtcaccaaataacctggcggcagcgcaaaagatg

SEQ ID NO: 4819 - DNA, 103 bp, Artificial Sequence
  Synthetic Polynucleotide
taatacgactcactatagggggaatgtatcaaaggtcatttggtgactgcaacagaggagagcagtcatgaaatgacctaacctggcggcagcgcaaaagatg

SEQ ID NO: 4820 - DNA, 103 bp, Artificial Sequence
  Synthetic Polynucleotide
taatacgactcactataggggttttggaatgtatcaaaggtcatttggtgaacagaggagacaccaaatgacctttgataacctggcggcagcgcaaaagatg

SEQ ID NO: 4821 - DNA, 103 bp, Artificial Sequence
  Synthetic Polynucleotide
taatacgactcactataggggctttgttttggaatgtatcaaaggtcattaacagaggagaaatgacatgtgatacattaacctggcggcagcgcaaaagatg

SEQ ID NO: 4822 - DNA, 103 bp, Artificial Sequence
  Synthetic Polynucleotide
taatacgactcactatagggcgttggctttgttttggaatgtatcaaaggaacagaggagacctttgatgcattccaaaaacctggcggcagcgcaaaagatg

SEQ ID NO: 4823 - DNA, 103 bp, Artificial Sequence
  Synthetic Polynucleotide
taatacgactcactatagggacaaacgttggctttgttttggaatgtatcaacagaggagagatacaatgcaaaacaaaaacctggcggcagcgcaaaagatg

SEQ ID NO: 4824 - DNA, 103 bp, Artificial Sequence
  Synthetic Polynucleotide
taatacgactcactataggggcccaacaaacgttggctttgttttggaataacagaggagaattccaatgcaaagccaaaacctggcggcagcgcaaaagatg

SEQ ID NO: 4825 - DNA, 103 bp, Artificial Sequence
  Synthetic Polynucleotide
taatacgactcactatagggcactgcgcatcgggcaaacgcagtggtactaacagaggagaagtaccatggcgtttgccaacctggcggcagcgcaaaagatg

SEQ ID NO: 4826 - DNA, 103 bp, Artificial Sequence
  Synthetic Polynucleotide
taatacgactcactatagggtcttagcccaacaaacgttggctttgttttaacagaggagaaaaacaatgccaacgtttaacctggcggcagcgcaaaagatg

SEQ ID NO: 4827 - DNA, 103 bp, Artificial Sequence
  Synthetic Polynucleotide
taatacgactcactatagggcaaactcttagcccaacaaacgttggctttaacagaggagaaaagccatggtttgttggaacctggcggcagcgcaaaagatg

SEQ ID NO: 4828 - DNA, 103 bp, Artificial Sequence
  Synthetic Polynucleotide
taatacgactcactataggggggaccaaactcttagcccaacaaacgttgaacagaggagacaacgtatgttgggctaaaacctggcggcagcgcaaaagatg

SEQ ID NO: 4829 - DNA, 103 bp, Artificial Sequence
  Synthetic Polynucleotide
taatacgactcactatagggggatagggaccaaactcttagcccaacaaaaacagaggagatttgttatgctaagagttaacctggcggcagcgcaaaagatg

SEQ ID NO: 4830 - DNA, 103 bp, Artificial Sequence
  Synthetic Polynucleotide
taatacgactcactatagggttcgaggatagggaccaaactcttagcccaaacagaggagatgggctatgagtttggtcaacctggcggcagcgcaaaagatg

SEQ ID NO: 4831 - DNA, 103 bp, Artificial Sequence
  Synthetic Polynucleotide
taatacgactcactataggggctgtttcgaggatagggaccaaactcttaaacagaggagataagagatgggtccctataacctggcggcagcgcaaaagatg

SEQ ID NO: 4832 - DNA, 103 bp, Artificial Sequence
  Synthetic Polynucleotide
taatacgactcactatagggtccccgctgtttcgaggatagggaccaaacaacagaggagagtttggatgctatcctcgaacctggcggcagcgcaaaagatg

SEQ ID NO: 4833 - DNA, 103 bp, Artificial Sequence
  Synthetic Polynucleotide
taatacgactcactatagggttttatccccgctgtttcgaggatagggacaacagaggagagtccctatgctcgaaacaaacctggcggcagcgcaaaagatg

SEQ ID NO: 4834 - DNA, 103 bp, Artificial Sequence
  Synthetic Polynucleotide
taatacgactcactatagggtttagttttatccccgctgtttcgaggataaacagaggagatatcctatgaacagcgggaacctggcggcagcgcaaaagatg

SEQ ID NO: 4835 - DNA, 103 bp, Artificial Sequence
  Synthetic Polynucleotide
taatacgactcactatagggtgtcgtttagttttatccccgctgtttcgaaacagaggagatcgaaaatgcggggataaaacctggcggcagcgcaaaagatg

SEQ ID NO: 4836 - DNA, 103 bp, Artificial Sequence
  Synthetic Polynucleotide
taatacgactcactatagggttctgcactgcgcatcgggcaaacgcagtgaacagaggagacactgcatgtgcccgatgaacctggcggcagcgcaaaagatg

SEQ ID NO: 4837 - DNA, 103 bp, Artificial Sequence
  Synthetic Polynucleotide
taatacgactcactatagggctgcctgtcgtttagttttatccccgctgtaacagaggagaacagcgatgataaaactaaacctggcggcagcgcaaaagatg

SEQ ID NO: 4838 - DNA, 103 bp, Artificial Sequence
  Synthetic Polynucleotide
taatacgactcactataggggaccactgcctgtcgtttagttttatccccaacagaggagaggggatatgactaaacgaaacctggcggcagcgcaaaagatg

SEQ ID NO: 4839 - DNA, 103 bp, Artificial Sequence
  Synthetic Polynucleotide
taatacgactcactatagggtctgggaccactgcctgtcgtttagttttaaacagaggagataaaacatgacgacaggcaacctggcggcagcgcaaaagatg

SEQ ID NO: 4840 - DNA, 103 bp, Artificial Sequence
  Synthetic Polynucleotide
taatacgactcactatagggaattatctgggaccactgcctgtcgtttagaacagaggagactaaacatgaggcagtggaacctggcggcagcgcaaaagatg

SEQ ID NO: 4841 - DNA, 103 bp, Artificial Sequence
  Synthetic Polynucleotide
taatacgactcactataggggcttgaattatctgggaccactgcctgtcgaacagaggagacgacagatggtggtcccaaacctggcggcagcgcaaaagatg

SEQ ID NO: 4842 - DNA, 103 bp, Artificial Sequence
  Synthetic Polynucleotide
taatacgactcactatagggtgaaggcttgaattatctgggaccactgccaacagaggagaggcagtatgcccagataaaacctggcggcagcgcaaaagatg

SEQ ID NO: 4843 - DNA, 103 bp, Artificial Sequence
  Synthetic Polynucleotide
taatacgactcactatagggttctttgaaggcttgaattatctgggaccaaacagaggagatggtccatgataattcaaaacctggcggcagcgcaaaagatg

SEQ ID NO: 4844 - DNA, 103 bp, Artificial Sequence
  Synthetic Polynucleotide
taatacgactcactatagggttgtcttctttgaaggcttgaattatctggaacagaggagaccagatatgtcaagccttaacctggcggcagcgcaaaagatg

SEQ ID NO: 4845 - DNA, 103 bp, Artificial Sequence
  Synthetic Polynucleotide
taatacgactcactatagggatgctttgtcttctttgaaggcttgaattaaacagaggagataattcatgccttcaaagaacctggcggcagcgcaaaagatg

SEQ ID NO: 4846 - DNA, 103 bp, Artificial Sequence
  Synthetic Polynucleotide
taatacgactcactatagggtgaatatgctttgtcttctttgaaggcttgaacagaggagacaagccatgaaagaagacaacctggcggcagcgcaaaagatg

SEQ ID NO: 4847 - DNA, 103 bp, Artificial Sequence
  Synthetic Polynucleotide
taatacgactcactatagggggatcttctgcactgcgcatcgggcaaacgaacagaggagacgtttgatggatgcgcagaacctggcggcagcgcaaaagatg

SEQ ID NO: 4848 - DNA, 103 bp, Artificial Sequence
  Synthetic Polynucleotide
taatacgactcactatagggtcgggtgaatatgctttgtcttctttgaagaacagaggagacttcaaatgagacaaagcaacctggcggcagcgcaaaagatg

SEQ ID NO: 4849 - DNA, 103 bp, Artificial Sequence
  Synthetic Polynucleotide
taatacgactcactatagggctacttcgggtgaatatgctttgtcttcttaacagaggagaaagaagatgaagcatattaacctggcggcagcgcaaaagatg

SEQ ID NO: 4850 - DNA, 103 bp, Artificial Sequence
  Synthetic Polynucleotide
taatacgactcactatagggcagggctacttcgggtgaatatgctttgtcaacagaggagagacaaaatgtattcacccaacctggcggcagcgcaaaagatg

SEQ ID NO: 4851 - DNA, 103 bp, Artificial Sequence
  Synthetic Polynucleotide
taatacgactcactatagggtcattcagggctacttcgggtgaatatgctaacagaggagaagcataatgacccgaagtaacctggcggcagcgcaaaagatg

SEQ ID NO: 4852 - DNA, 103 bp, Artificial Sequence
  Synthetic Polynucleotide
taatacgactcactatagggatatttcattcagggctacttcgggtgaataacagaggagaattcacatgaagtagcccaacctggcggcagcgcaaaagatg

SEQ ID NO: 4853 - DNA, 103 bp, Artificial Sequence
  Synthetic Polynucleotide
taatacgactcactatagggcgtgcatatttcattcagggctacttcgggaacagaggagacccgaaatggccctgaataacctggcggcagcgcaaaagatg

SEQ ID NO: 4854 - DNA, 103 bp, Artificial Sequence
  Synthetic Polynucleotide
taatacgactcactatagggatgcgcgtgcatatttcattcagggctactaacagaggagaagtagcatggaatgaaataacctggcggcagcgcaaaagatg

SEQ ID NO: 4855 - DNA, 103 bp, Artificial Sequence
  Synthetic Polynucleotide
taatacgactcactatagggcatacatgcgcgtgcatatttcattcagggaacagaggagaccctgaatgaaatatgcaaacctggcggcagcgcaaaagatg

SEQ ID NO: 4856 - DNA, 103 bp, Artificial Sequence
  Synthetic Polynucleotide
taatacgactcactatagggcaccccatacatgcgcgtgcatatttcattaacagaggagaaatgaaatgtgcacgcgcaacctggcggcagcgcaaaagatg

SEQ ID NO: 4857 - DNA, 103 bp, Artificial Sequence
  Synthetic Polynucleotide
taatacgactcactatagggagatccaccccatacatgcgcgtgcatattaacagaggagaaatatgatggcgcatgtaaacctggcggcagcgcaaaagatg

SEQ ID NO: 4858 - DNA, 103 bp, Artificial Sequence
  Synthetic Polynucleotide
taatacgactcactatagggtctcgggatcttctgcactgcgcatcgggcaacagaggagagcccgaatggcagtgcagaacctggcggcagcgcaaaagatg

SEQ ID NO: 4859 - DNA, 103 bp, Artificial Sequence
  Synthetic Polynucleotide
taatacgactcactatagggtgtctagatccaccccatacatgcgcgtgcaacagaggagagcacgcatgtgtatggggaacctggcggcagcgcaaaagatg

SEQ ID NO: 4860 - DNA, 103 bp, Artificial Sequence
  Synthetic Polynucleotide
taatacgactcactatagggcccgctgtctagatccaccccatacatgcgaacagaggagacgcatgatgggggtggataacctggcggcagcgcaaaagatg

SEQ ID NO: 4861 - DNA, 103 bp, Artificial Sequence
  Synthetic Polynucleotide
taatacgactcactatagggaatagcccgctgtctagatccaccccatacaacagaggagagtatggatgggatctagaaacctggcggcagcgcaaaagatg

SEQ ID NO: 4862 - DNA, 103 bp, Artificial Sequence
  Synthetic Polynucleotide
taatacgactcactatagggtagaaaatagcccgctgtctagatccacccaacagaggagagggtggatgtagacagcgaacctggcggcagcgcaaaagatg

SEQ ID NO: 4863 - DNA, 103 bp, Artificial Sequence
  Synthetic Polynucleotide
taatacgactcactatagggcggtttagaaaatagcccgctgtctagatcaacagaggagagatctaatgagcgggctaaacctggcggcagcgcaaaagatg

SEQ ID NO: 4864 - DNA, 103 bp, Artificial Sequence
  Synthetic Polynucleotide
taatacgactcactatagggaccaacggtttagaaaatagcccgctgtctaacagaggagaagacagatggctattttcaacctggcggcagcgcaaaagatg

SEQ ID NO: 4865 - DNA, 103 bp, Artificial Sequence
  Synthetic Polynucleotide
taatacgactcactatagggcagacaccaacggtttagaaaatagcccgcaacagaggagagcgggcatgtttctaaacaacctggcggcagcgcaaaagatg

SEQ ID NO: 4866 - DNA, 103 bp, Artificial Sequence
  Synthetic Polynucleotide
taatacgactcactatagggatacacagacaccaacggtttagaaaatagaacagaggagactatttatgaaaccgttgaacctggcggcagcgcaaaagatg

SEQ ID NO: 4867 - DNA, 103 bp, Artificial Sequence
  Synthetic Polynucleotide
taatacgactcactataggggcgtaatacacagacaccaacggtttagaaaacagaggagattctaaatggttggtgtcaacctggcggcagcgcaaaagatg

SEQ ID NO: 4868 - DNA, 103 bp, Artificial Sequence
  Synthetic Polynucleotide
taatacgactcactatagggtatccgcgtaatacacagacaccaacggttaacagaggagaaaccgtatgtgtctgtgtaacctggcggcagcgcaaaagatg

SEQ ID NO: 4869 - DNA, 103 bp, Artificial Sequence
  Synthetic Polynucleotide
taatacgactcactataggggagtctctcgggatcttctgcactgcgcataacagaggagaatgcgcatggcagaagataacctggcggcagcgcaaaagatg

SEQ ID NO: 4870 - DNA, 103 bp, Artificial Sequence
  Synthetic Polynucleotide
taatacgactcactataggggtggttatccgcgtaatacacagacaccaaaacagaggagattggtgatggtgtattacaacctggcggcagcgcaaaagatg

SEQ ID NO: 4871 - DNA, 103 bp, Artificial Sequence
  Synthetic Polynucleotide
taatacgactcactatagggtcccagtggttatccgcgtaatacacagacaacagaggagagtctgtatgttacgcggaaacctggcggcagcgcaaaagatg

SEQ ID NO: 4872 - DNA, 103 bp, Artificial Sequence
  Synthetic Polynucleotide
taatacgactcactatagggtattatcccagtggttatccgcgtaatacaaacagaggagatgtattatgcggataaccaacctggcggcagcgcaaaagatg

SEQ ID NO: 4873 - DNA, 103 bp, Artificial Sequence
  Synthetic Polynucleotide
taatacgactcactatagggaggcctattatcccagtggttatccgcgtaaacagaggagatacgcgatgaaccactggaacctggcggcagcgcaaaagatg

SEQ ID NO: 4874 - DNA, 103 bp, Artificial Sequence
  Synthetic Polynucleotide
taatacgactcactatagggcctccaggcctattatcccagtggttatccaacagaggagaggataaatgctgggataaaacctggcggcagcgcaaaagatg

SEQ ID NO: 4875 - DNA, 103 bp, Artificial Sequence
  Synthetic Polynucleotide
taatacgactcactatagggtcttccctccaggcctattatcccagtggtaacagaggagaaccactatgataataggcaacctggcggcagcgcaaaagatg

SEQ ID NO: 4876 - DNA, 103 bp, Artificial Sequence
  Synthetic Polynucleotide
taatacgactcactataggggaacatcttccctccaggcctattatcccaaacagaggagatgggatatgaggcctggaaacctggcggcagcgcaaaagatg

SEQ ID NO: 4877 - DNA, 103 bp, Artificial Sequence
  Synthetic Polynucleotide
taatacgactcactatagggaatccgaacatcttccctccaggcctattaaacagaggagataatagatgtggagggaaaacctggcggcagcgcaaaagatg

SEQ ID NO: 4878 - DNA, 103 bp, Artificial Sequence
  Synthetic Polynucleotide
taatacgactcactatagggggttgaatccgaacatcttccctccaggccaacagaggagaggcctgatgggaagatgtaacctggcggcagcgcaaaagatg

SEQ ID NO: 4879 - DNA, 103 bp, Artificial Sequence
  Synthetic Polynucleotide
taatacgactcactatagggctcggggttgaatccgaacatcttccctccaacagaggagaggagggatgatgttcggaaacctggcggcagcgcaaaagatg

SEQ ID NO: 4880 - DNA, 103 bp, Artificial Sequence
  Synthetic Polynucleotide
taatacgactcactatagggttggcgagtctctcgggatcttctgcactgaacagaggagacagtgcatgagatcccgaaacctggcggcagcgcaaaagatg

SEQ ID NO: 4881 - DNA, 103 bp, Artificial Sequence
  Synthetic Polynucleotide
taatacgactcactataggggctgcctcggggttgaatccgaacatcttcaacagaggagagaagatatgcggattcaaaacctggcggcagcgcaaaagatg

SEQ ID NO: 4882 - DNA, 103 bp, Artificial Sequence
  Synthetic Polynucleotide
taatacgactcactatagggtggatgctgcctcggggttgaatccgaacaaacagaggagatgttcgatgtcaaccccgaacctggcggcagcgcaaaagatg

SEQ ID NO: 4883 - DNA, 103 bp, Artificial Sequence
  Synthetic Polynucleotide
taatacgactcactatagggtagaatggatgctgcctcggggttgaatccaacagaggagaggattcatgcccgaggcaaacctggcggcagcgcaaaagatg

SEQ ID NO: 4884 - DNA, 103 bp, Artificial Sequence
  Synthetic Polynucleotide
taatacgactcactatagggctttctagaatggatgctgcctcggggttgaacagaggagacaacccatgggcagcatcaacctggcggcagcgcaaaagatg

SEQ ID NO: 4885 - DNA, 103 bp, Artificial Sequence
  Synthetic Polynucleotide
taatacgactcactatagggactttctttctagaatggatgctgcctcggaacagaggagaccgaggatgcatccattcaacctggcggcagcgcaaaagatg

SEQ ID NO: 4886 - DNA, 103 bp, Artificial Sequence
  Synthetic Polynucleotide
taatacgactcactatagggtggatactttctttctagaatggatgctgcaacagaggagagcagcaatgattctagaaaacctggcggcagcgcaaaagatg

SEQ ID NO: 4887 - DNA, 103 bp, Artificial Sequence
  Synthetic Polynucleotide
taatacgactcactataggggtaaatggatactttctttctagaatggataacagaggagaatccatatgagaaagaaaaacctggcggcagcgcaaaagatg

SEQ ID NO: 4888 - DNA, 103 bp, Artificial Sequence
  Synthetic Polynucleotide
taatacgactcactatagggcttttgtaaatggatactttctttctagaaaacagaggagattctagatggaaagtatcaacctggcggcagcgcaaaagatg

SEQ ID NO: 4889 - DNA, 103 bp, Artificial Sequence
  Synthetic Polynucleotide
taatacgactcactatagggcttcccttttgtaaatggatactttctttcaacagaggagagaaagaatgtatccatttaacctggcggcagcgcaaaagatg

SEQ ID NO: 4890 - DNA, 103 bp, Artificial Sequence
  Synthetic Polynucleotide
taatacgactcactatagggttccacttcccttttgtaaatggatactttaacagaggagaaaagtaatgatttacaaaaacctggcggcagcgcaaaagatg

SEQ ID NO: 4891 - DNA, 103 bp, Artificial Sequence
  Synthetic Polynucleotide
taatacgactcactatagggcataattggcgagtctctcgggatcttctgaacagaggagacagaagatgccgagagacaacctggcggcagcgcaaaagatg

SEQ ID NO: 4892 - DNA, 103 bp, Artificial Sequence
  Synthetic Polynucleotide
taatacgactcactatagggtgatgttccacttcccttttgtaaatggataacagaggagaatccatatgcaaaagggaaacctggcggcagcgcaaaagatg

SEQ ID NO: 4893 - DNA, 103 bp, Artificial Sequence
  Synthetic Polynucleotide
taatacgactcactatagggcttgttgatgttccacttcccttttgtaaaaacagaggagatttacaatggggaagtggaacctggcggcagcgcaaaagatg

SEQ ID NO: 4894 - DNA, 103 bp, Artificial Sequence
  Synthetic Polynucleotide
taatacgactcactatagggatctgcttgttgatgttccacttcccttttaacagaggagaaaaaggatggtggaacataacctggcggcagcgcaaaagatg

SEQ ID NO: 4895 - DNA, 103 bp, Artificial Sequence
  Synthetic Polynucleotide
taatacgactcactatagggcgcagatctgcttgttgatgttccacttccaacagaggagaggaagtatgacatcaacaaacctggcggcagcgcaaaagatg

SEQ ID NO: 4896 - DNA, 103 bp, Artificial Sequence
  Synthetic Polynucleotide
taatacgactcactatagggagtcacgcagatctgcttgttgatgttccaaacagaggagatggaacatgaacaagcagaacctggcggcagcgcaaaagatg

SEQ ID NO: 4897 - DNA, 103 bp, Artificial Sequence
  Synthetic Polynucleotide
taatacgactcactatagggctggtagtcacgcagatctgcttgttgatgaacagaggagacatcaaatggcagatctgaacctggcggcagcgcaaaagatg

SEQ ID NO: 4898 - DNA, 103 bp, Artificial Sequence
  Synthetic Polynucleotide
taatacgactcactatagggtcctcctggtagtcacgcagatctgcttgtaacagaggagaacaagcatgtctgcgtgaaacctggcggcagcgcaaaagatg

SEQ ID NO: 4899 - DNA, 103 bp, Artificial Sequence
  Synthetic Polynucleotide
taatacgactcactatagggttctatcctcctggtagtcacgcagatctgaacagaggagacagatcatggtgactaccaacctggcggcagcgcaaaagatg

SEQ ID NO: 4900 - DNA, 103 bp, Artificial Sequence
  Synthetic Polynucleotide
taatacgactcactatagggaagtcttctatcctcctggtagtcacgcagaacagaggagactgcgtatgtaccaggagaacctggcggcagcgcaaaagatg

SEQ ID NO: 4901 - DNA, 103 bp, Artificial Sequence
  Synthetic Polynucleotide
taatacgactcactatagggggttgaagtcttctatcctcctggtagtcaaacagaggagatgactaatgggaggatagaacctggcggcagcgcaaaagatg

SEQ ID NO: 4902 - DNA, 103 bp, Artificial Sequence
  Synthetic Polynucleotide
taatacgactcactatagggtctcgcataattggcgagtctctcgggatcaacagaggagagatcccatgagactcgccaacctggcggcagcgcaaaagatg

SEQ ID NO: 4903 - DNA, 103 bp, Artificial Sequence
  Synthetic Polynucleotide
taatacgactcactatagggggtagggttgaagtcttctatcctcctggtaacagaggagaaccaggatgatagaagacaacctggcggcagcgcaaaagatg

SEQ ID NO: 4904 - DNA, 103 bp, Artificial Sequence
  Synthetic Polynucleotide
taatacgactcactatagggttggtggtagggttgaagtcttctatcctcaacagaggagagaggatatgagacttcaaaacctggcggcagcgcaaaagatg

SEQ ID NO: 4905 - DNA, 103 bp, Artificial Sequence
  Synthetic Polynucleotide
taatacgactcactatagggtaatgttggtggtagggttgaagtcttctaaacagaggagatagaagatgtcaaccctaaacctggcggcagcgcaaaagatg

SEQ ID NO: 4906 - DNA, 103 bp, Artificial Sequence
  Synthetic Polynucleotide
taatacgactcactatagggcggtataatgttggtggtagggttgaagtcaacagaggagagacttcatgcctaccaccaacctggcggcagcgcaaaagatg

SEQ ID NO: 4907 - DNA, 103 bp, Artificial Sequence
  Synthetic Polynucleotide
taatacgactcactatagggttggccggtataatgttggtggtagggttgaacagaggagacaacccatgcaccaacataacctggcggcagcgcaaaagatg

SEQ ID NO: 4908 - DNA, 103 bp, Artificial Sequence
  Synthetic Polynucleotide
taatacgactcactatagggtcctgttggccggtataatgttggtggtagaacagaggagactaccaatgacattatacaacctggcggcagcgcaaaagatg

SEQ ID NO: 4909 - DNA, 103 bp, Artificial Sequence
  Synthetic Polynucleotide
taatacgactcactatagggtagtctcctgttggccggtataatgttggtaacagaggagaaccaacatgataccggccaacctggcggcagcgcaaaagatg

SEQ ID NO: 4910 - DNA, 103 bp, Artificial Sequence
  Synthetic Polynucleotide
taatacgactcactatagggtgtggtagtctcctgttggccggtataatgaacagaggagacattatatgggccaacagaacctggcggcagcgcaaaagatg

SEQ ID NO: 4911 - DNA, 103 bp, Artificial Sequence
  Synthetic Polynucleotide
taatacgactcactatagggatgagtgtggtagtctcctgttggccggtaaacagaggagataccggatgacaggagacaacctggcggcagcgcaaaagatg

SEQ ID NO: 4912 - DNA, 103 bp, Artificial Sequence
  Synthetic Polynucleotide
taatacgactcactatagggcactaatgagtgtggtagtctcctgttggcaacagaggagagccaacatgagactaccaaacctggcggcagcgcaaaagatg

SEQ ID NO: 4913 - DNA, 103 bp, Artificial Sequence
  Synthetic Polynucleotide
taatacgactcactatagggcttgctttgcagagtagagcagtaagaaacaacagaggagagtttctatgtgctctactaacctggcggcagcgcaaaagatg

SEQ ID NO: 4914 - DNA, 103 bp, Artificial Sequence
  Synthetic Polynucleotide
taatacgactcactatagggagctttctcgcataattggcgagtctctcgaacagaggagacgagagatgcgccaattaaacctggcggcagcgcaaaagatg

SEQ ID NO: 4915 - DNA, 103 bp, Artificial Sequence
  Synthetic Polynucleotide
taatacgactcactatagggtcggccactaatgagtgtggtagtctcctgaacagaggagacaggagatgaccacactcaacctggcggcagcgcaaaagatg

SEQ ID NO: 4916 - DNA, 103 bp, Artificial Sequence
  Synthetic Polynucleotide
taatacgactcactatagggggtgttcggccactaatgagtgtggtagtcaacagaggagagactacatgactcattagaacctggcggcagcgcaaaagatg

SEQ ID NO: 4917 - DNA, 103 bp, Artificial Sequence
  Synthetic Polynucleotide
taatacgactcactatagggtgggcggtgttcggccactaatgagtgtggaacagaggagaccacacatgttagtggccaacctggcggcagcgcaaaagatg

SEQ ID NO: 4918 - DNA, 103 bp, Artificial Sequence
  Synthetic Polynucleotide
taatacgactcactatagggtttactgggcggtgttcggccactaatgagaacagaggagactcattatgggccgaacaaacctggcggcagcgcaaaagatg

SEQ ID NO: 4919 - DNA, 103 bp, Artificial Sequence
  Synthetic Polynucleotide
taatacgactcactatagggccccttttactgggcggtgttcggccactaaacagaggagatagtggatgaacaccgccaacctggcggcagcgcaaaagatg

SEQ ID NO: 4920 - DNA, 103 bp, Artificial Sequence
  Synthetic Polynucleotide
taatacgactcactatagggtctttccccttttactgggcggtgttcggcaacagaggagagccgaaatgcgcccagtaaacctggcggcagcgcaaaagatg

SEQ ID NO: 4921 - DNA, 103 bp, Artificial Sequence
  Synthetic Polynucleotide
taatacgactcactatagggtccattctttccccttttactgggcggtgtaacagaggagaacaccgatgagtaaaaggaacctggcggcagcgcaaaagatg

SEQ ID NO: 4922 - DNA, 103 bp, Artificial Sequence
  Synthetic Polynucleotide
taatacgactcactataggggccattccattctttccccttttactgggcaacagaggagagcccagatgaaggggaaaaacctggcggcagcgcaaaagatg

SEQ ID NO: 4923 - DNA, 103 bp, Artificial Sequence
  Synthetic Polynucleotide
taatacgactcactatagggaaccagccattccattctttccccttttacaacagaggagagtaaaaatggaaagaatgaacctggcggcagcgcaaaagatg

SEQ ID NO: 4924 - DNA, 103 bp, Artificial Sequence
  Synthetic Polynucleotide
taatacgactcactatagggttgttaaccagccattccattctttcccctaacagaggagaaggggaatgaatggaatgaacctggcggcagcgcaaaagatg

SEQ ID NO: 4925 - DNA, 103 bp, Artificial Sequence
  Synthetic Polynucleotide
taatacgactcactatagggatgctagctttctcgcataattggcgagtcaacagaggagagactcgatgattatgcgaaacctggcggcagcgcaaaagatg

SEQ ID NO: 4926 - DNA, 103 bp, Artificial Sequence
  Synthetic Polynucleotide
taatacgactcactatagggttatcttgttaaccagccattccattctttaacagaggagaaaagaaatgaatggctggaacctggcggcagcgcaaaagatg

SEQ ID NO: 4927 - DNA, 103 bp, Artificial Sequence
  Synthetic Polynucleotide
taatacgactcactataggggccgtttatcttgttaaccagccattccataacagaggagaatggaaatgctggttaacaacctggcggcagcgcaaaagatg

SEQ ID NO: 4928 - DNA, 103 bp, Artificial Sequence
  Synthetic Polynucleotide
taatacgactcactatagggtggtggccgtttatcttgttaaccagccataacagaggagaatggctatgtaacaagataacctggcggcagcgcaaaagatg

SEQ ID NO: 4929 - DNA, 103 bp, Artificial Sequence
  Synthetic Polynucleotide
taatacgactcactataggggcacgtggtggccgtttatcttgttaaccaaacagaggagatggttaatgagataaacgaacctggcggcagcgcaaaagatg

SEQ ID NO: 4930 - DNA, 103 bp, Artificial Sequence
  Synthetic Polynucleotide
taatacgactcactatagggcaggagcacgtggtggccgtttatcttgttaacagaggagaaacaagatgaacggccacaacctggcggcagcgcaaaagatg

SEQ ID NO: 4931 - DNA, 103 bp, Artificial Sequence
  Synthetic Polynucleotide
taatacgactcactatagggctgaccaggagcacgtggtggccgtttatcaacagaggagagataaaatgccaccacgtaacctggcggcagcgcaaaagatg

SEQ ID NO: 4932 - DNA, 103 bp, Artificial Sequence
  Synthetic Polynucleotide
taatacgactcactatagggagccactgaccaggagcacgtggtggccgtaacagaggagaacggccatgacgtgctccaacctggcggcagcgcaaaagatg

SEQ ID NO: 4933 - DNA, 103 bp, Artificial Sequence
  Synthetic Polynucleotide
taatacgactcactataggggctacagccactgaccaggagcacgtggtgaacagaggagacaccacatgctcctggtcaacctggcggcagcgcaaaagatg

SEQ ID NO: 4934 - DNA, 103 bp, Artificial Sequence
  Synthetic Polynucleotide
taatacgactcactataggggcaaggctacagccactgaccaggagcacgaacagaggagacgtgctatgggtcagtggaacctggcggcagcgcaaaagatg

SEQ ID NO: 4935 - DNA, 103 bp, Artificial Sequence
  Synthetic Polynucleotide
taatacgactcactataggggcagtgcaaggctacagccactgaccaggaaacagaggagatcctggatggtggctgtaaacctggcggcagcgcaaaagatg

SEQ ID NO: 4936 - DNA, 103 bp, Artificial Sequence
  Synthetic Polynucleotide
taatacgactcactatagggggcagatgctagctttctcgcataattggcaacagaggagagccaatatggcgagaaagaacctggcggcagcgcaaaagatg

SEQ ID NO: 4937 - DNA, 103 bp, Artificial Sequence
  Synthetic Polynucleotide
taatacgactcactatagggagtaggcagtgcaaggctacagccactgacaacagaggagagtcagtatgtgtagccttaacctggcggcagcgcaaaagatg

SEQ ID NO: 4938 - DNA, 103 bp, Artificial Sequence
  Synthetic Polynucleotide
taatacgactcactatagggctcttagtaggcagtgcaaggctacagccaaacagaggagatggctgatgccttgcactaacctggcggcagcgcaaaagatg

SEQ ID NO: 4939 - DNA, 103 bp, Artificial Sequence
  Synthetic Polynucleotide
taatacgactcactatagggtgactctcttagtaggcagtgcaaggctacaacagaggagagtagccatgcactgcctaaacctggcggcagcgcaaaagatg

SEQ ID NO: 4940 - DNA, 103 bp, Artificial Sequence
  Synthetic Polynucleotide
taatacgactcactatagggccaagtgactctcttagtaggcagtgcaagaacagaggagacttgcaatgcctactaagaacctggcggcagcgcaaaagatg

SEQ ID NO: 4941 - DNA, 103 bp, Artificial Sequence
  Synthetic Polynucleotide
taatacgactcactataggggctacccaagtgactctcttagtaggcagtaacagaggagaactgccatgtaagagagtaacctggcggcagcgcaaaagatg

SEQ ID NO: 4942 - DNA, 103 bp, Artificial Sequence
  Synthetic Polynucleotide
taatacgactcactataggggtggcgctacccaagtgactctcttagtagaacagaggagactactaatggagtcacttaacctggcggcagcgcaaaagatg

SEQ ID NO: 4943 - DNA, 103 bp, Artificial Sequence
  Synthetic Polynucleotide
taatacgactcactatagggacctagtggcgctacccaagtgactctcttaacagaggagaaagagaatgacttgggtaaacctggcggcagcgcaaaagatg

SEQ ID NO: 4944 - DNA, 103 bp, Artificial Sequence
  Synthetic Polynucleotide
taatacgactcactatagggcggacacctagtggcgctacccaagtgactaacagaggagaagtcacatgggtagcgccaacctggcggcagcgcaaaagatg

SEQ ID NO: 4945 - DNA, 103 bp, Artificial Sequence
  Synthetic Polynucleotide
taatacgactcactatagggctccgcggacacctagtggcgctacccaagaacagaggagacttgggatgcgccactagaacctggcggcagcgcaaaagatg

SEQ ID NO: 4946 - DNA, 103 bp, Artificial Sequence
  Synthetic Polynucleotide
taatacgactcactataggggtccgctccgcggacacctagtggcgctacaacagaggagagtagcgatgctaggtgtcaacctggcggcagcgcaaaagatg

SEQ ID NO: 4947 - DNA, 103 bp, Artificial Sequence
  Synthetic Polynucleotide
taatacgactcactatagggcctgcggcagatgctagctttctcgcataaaacagaggagattatgcatgaaagctagcaacctggcggcagcgcaaaagatg

SEQ ID NO: 4948 - DNA, 103 bp, Artificial Sequence
  Synthetic Polynucleotide
taatacgactcactataggggtatagtccgctccgcggacacctagtggcaacagaggagagccactatgtgtccgcggaacctggcggcagcgcaaaagatg

SEQ ID NO: 4949 - DNA, 103 bp, Artificial Sequence
  Synthetic Polynucleotide
taatacgactcactatagggtgtatgtatagtccgctccgcggacacctaaacagaggagataggtgatggcggagcggaacctggcggcagcgcaaaagatg

SEQ ID NO: 4950 - DNA, 103 bp, Artificial Sequence
  Synthetic Polynucleotide
taatacgactcactatagggtaggttgtatgtatagtccgctccgcggacaacagaggagagtccgcatggcggactataacctggcggcagcgcaaaagatg

SEQ ID NO: 4951 - DNA, 103 bp, Artificial Sequence
  Synthetic Polynucleotide
taatacgactcactatagggaactctaggttgtatgtatagtccgctccgaacagaggagacggagcatgctatacataaacctggcggcagcgcaaaagatg

SEQ ID NO: 4952 - DNA, 103 bp, Artificial Sequence
  Synthetic Polynucleotide
taatacgactcactataggggacccaactctaggttgtatgtatagtccgaacagaggagacggactatgcatacaaccaacctggcggcagcgcaaaagatg

SEQ ID NO: 4953 - DNA, 103 bp, Artificial Sequence
  Synthetic Polynucleotide
taatacgactcactatagggtggcagacccaactctaggttgtatgtataaacagaggagatatacaatgaacctagagaacctggcggcagcgcaaaagatg

SEQ ID NO: 4954 - DNA, 103 bp, Artificial Sequence
  Synthetic Polynucleotide
taatacgactcactataggggttgctggcagacccaactctaggttgtataacagaggagaatacaaatgagagttgggaacctggcggcagcgcaaaagatg

SEQ ID NO: 4955 - DNA, 103 bp, Artificial Sequence
  Synthetic Polynucleotide
taatacgactcactatagggcaagcgttgctggcagacccaactctaggtaacagaggagaacctagatgtgggtctgcaacctggcggcagcgcaaaagatg

SEQ ID NO: 4956 - DNA, 103 bp, Artificial Sequence
  Synthetic Polynucleotide
taatacgactcactatagggcctaccaagcgttgctggcagacccaactcaacagaggagagagttgatgctgccagcaaacctggcggcagcgcaaaagatg

SEQ ID NO: 4957 - DNA, 103 bp, Artificial Sequence
  Synthetic Polynucleotide
taatacgactcactatagggtcatacctaccaagcgttgctggcagacccaacagaggagagggtctatgagcaacgctaacctggcggcagcgcaaaagatg

SEQ ID NO: 4958 - DNA, 103 bp, Artificial Sequence
  Synthetic Polynucleotide
taatacgactcactatagggcttttcctgcggcagatgctagctttctcgaacagaggagacgagaaatgtagcatctgaacctggcggcagcgcaaaagatg

SEQ ID NO: 4959 - DNA, 103 bp, Artificial Sequence
  Synthetic Polynucleotide
taatacgactcactatagggctaggtcatacctaccaagcgttgctggcaaacagaggagatgccagatgcgcttggtaaacctggcggcagcgcaaaagatg

SEQ ID NO: 4960 - DNA, 103 bp, Artificial Sequence
  Synthetic Polynucleotide
taatacgactcactataggggaccactaggtcatacctaccaagcgttgcaacagaggagagcaacgatgggtaggtataacctggcggcagcgcaaaagatg

SEQ ID NO: 4961 - DNA, 103 bp, Artificial Sequence
  Synthetic Polynucleotide
taatacgactcactatagggtttatgaccactaggtcatacctaccaagcaacagaggagagcttggatggtatgacctaacctggcggcagcgcaaaagatg

SEQ ID NO: 4962 - DNA, 103 bp, Artificial Sequence
  Synthetic Polynucleotide
taatacgactcactatagggggatgtttatgaccactaggtcatacctacaacagaggagagtaggtatgacctagtggaacctggcggcagcgcaaaagatg

SEQ ID NO: 4963 - DNA, 103 bp, Artificial Sequence
  Synthetic Polynucleotide
taatacgactcactatagggtgtgtggatgtttatgaccactaggtcataaacagaggagatatgacatggtggtcataaacctggcggcagcgcaaaagatg

SEQ ID NO: 4964 - DNA, 103 bp, Artificial Sequence
  Synthetic Polynucleotide
taatacgactcactatagggaaaggtgtgtggatgtttatgaccactaggaacagaggagacctagtatgcataaacataacctggcggcagcgcaaaagatg

SEQ ID NO: 4965 - DNA, 103 bp, Artificial Sequence
  Synthetic Polynucleotide
taatacgactcactatagggtgcgaaaaggtgtgtggatgtttatgaccaaacagaggagatggtcaatgacatccacaaacctggcggcagcgcaaaagatg

SEQ ID NO: 4966 - DNA, 103 bp, Artificial Sequence
  Synthetic Polynucleotide
taatacgactcactataggggtgtatgcgaaaaggtgtgtggatgtttataacagaggagaataaacatgcacacacctaacctggcggcagcgcaaaagatg

SEQ ID NO: 4967 - DNA, 103 bp, Artificial Sequence
  Synthetic Polynucleotide
taatacgactcactatagggtaatggtgtatgcgaaaaggtgtgtggatgaacagaggagacatccaatgaccttttcgaacctggcggcagcgcaaaagatg

SEQ ID NO: 4968 - DNA, 103 bp, Artificial Sequence
  Synthetic Polynucleotide
taatacgactcactataggggttgataatggtgtatgcgaaaaggtgtgtaacagaggagaacacacatgttcgcatacaacctggcggcagcgcaaaagatg

SEQ ID NO: 4969 - DNA, 103 bp, Artificial Sequence
  Synthetic Polynucleotide
taatacgactcactatagggcaggacttttcctgcggcagatgctagcttaacagaggagaaagctaatgtctgccgcaaacctggcggcagcgcaaaagatg

SEQ ID NO: 4970 - DNA, 103 bp, Artificial Sequence
  Synthetic Polynucleotide
taatacgactcactataggggcactgttgataatggtgtatgcgaaaaggaacagaggagaccttttatgatacaccataacctggcggcagcgcaaaagatg

SEQ ID NO: 4971 - DNA, 103 bp, Artificial Sequence
  Synthetic Polynucleotide
taatacgactcactatagggtctacgcactgttgataatggtgtatgcgaaacagaggagatcgcatatgccattatcaaacctggcggcagcgcaaaagatg

SEQ ID NO: 4972 - DNA, 103 bp, Artificial Sequence
  Synthetic Polynucleotide
taatacgactcactatagggcgtggtctacgcactgttgataatggtgtaaacagaggagatacaccatgatcaacagtaacctggcggcagcgcaaaagatg

SEQ ID NO: 4973 - DNA, 103 bp, Artificial Sequence
  Synthetic Polynucleotide
taatacgactcactatagggcattgcgtggtctacgcactgttgataatgaacagaggagacattatatgcagtgcgtaaacctggcggcagcgcaaaagatg

SEQ ID NO: 4974 - DNA, 103 bp, Artificial Sequence
  Synthetic Polynucleotide
taatacgactcactatagggagtttcattgcgtggtctacgcactgttgaaacagaggagatcaacaatgcgtagaccaaacctggcggcagcgcaaaagatg

SEQ ID NO: 4975 - DNA, 103 bp, Artificial Sequence
  Synthetic Polynucleotide
taatacgactcactatagggtttgcagtttcattgcgtggtctacgcactaacagaggagaagtgcgatgaccacgcaaaacctggcggcagcgcaaaagatg

SEQ ID NO: 4976 - DNA, 103 bp, Artificial Sequence
  Synthetic Polynucleotide
taatacgactcactataggggagcatttgcagtttcattgcgtggtctacaacagaggagagtagacatggcaatgaaaaacctggcggcagcgcaaaagatg

SEQ ID NO: 4977 - DNA, 103 bp, Artificial Sequence
  Synthetic Polynucleotide
taatacgactcactatagggcccccgagcatttgcagtttcattgcgtggaacagaggagaccacgcatggaaactgcaaacctggcggcagcgcaaaagatg

SEQ ID NO: 4978 - DNA, 103 bp, Artificial Sequence
  Synthetic Polynucleotide
taatacgactcactatagggagtcacccccgagcatttgcagtttcattgaacagaggagacaatgaatgtgcaaatgcaacctggcggcagcgcaaaagatg

SEQ ID NO: 4979 - DNA, 103 bp, Artificial Sequence
  Synthetic Polynucleotide
taatacgactcactatagggcaatgagtcacccccgagcatttgcagtttaacagaggagaaaactgatgatgctcgggaacctggcggcagcgcaaaagatg

SEQ ID NO: 4980 - DNA, 103 bp, Artificial Sequence
  Synthetic Polynucleotide
taatacgactcactatagggctgtccaggacttttcctgcggcagatgctaacagaggagaagcatcatgcgcaggaaaaacctggcggcagcgcaaaagatg

SEQ ID NO: 4981 - DNA, 103 bp, Artificial Sequence
  Synthetic Polynucleotide
taatacgactcactatagggagtctcaatgagtcacccccgagcatttgcaacagaggagagcaaatatgcgggggtgaaacctggcggcagcgcaaaagatg

SEQ ID NO: 4982 - DNA, 103 bp, Artificial Sequence
  Synthetic Polynucleotide
taatacgactcactatagggtgagcagtctcaatgagtcacccccgagcaaacagaggagatgctcgatggtgactcataacctggcggcagcgcaaaagatg

SEQ ID NO: 4983 - DNA, 103 bp, Artificial Sequence
  Synthetic Polynucleotide
taatacgactcactatagggcggtttgagcagtctcaatgagtcacccccaacagaggagagggggtatgtcattgagaaacctggcggcagcgcaaaagatg

SEQ ID NO: 4984 - DNA, 103 bp, Artificial Sequence
  Synthetic Polynucleotide
taatacgactcactatagggccacccggtttgagcagtctcaatgagtcaaacagaggagatgactcatggagactgctaacctggcggcagcgcaaaagatg

SEQ ID NO: 4985 - DNA, 103 bp, Artificial Sequence
  Synthetic Polynucleotide
taatacgactcactataggggagagccacccggtttgagcagtctcaatgaacagaggagacattgaatgtgctcaaacaacctggcggcagcgcaaaagatg

SEQ ID NO: 4986 - DNA, 103 bp, Artificial Sequence
  Synthetic Polynucleotide
taatacgactcactatagggcaatagagagccacccggtttgagcagtctaacagaggagaagactgatgaaaccgggtaacctggcggcagcgcaaaagatg

SEQ ID NO: 4987 - DNA, 103 bp, Artificial Sequence
  Synthetic Polynucleotide
taatacgactcactatagggctgatcaatagagagccacccggtttgagcaacagaggagagctcaaatggggtggctcaacctggcggcagcgcaaaagatg

SEQ ID NO: 4988 - DNA, 103 bp, Artificial Sequence
  Synthetic Polynucleotide
taatacgactcactatagggatgctctgatcaatagagagccacccggttaacagaggagaaaccggatggctctctataacctggcggcagcgcaaaagatg

SEQ ID NO: 4989 - DNA, 103 bp, Artificial Sequence
  Synthetic Polynucleotide
taatacgactcactatagggaccatatgctctgatcaatagagagccaccaacagaggagaggtggcatgctattgatcaacctggcggcagcgcaaaagatg

SEQ ID NO: 4990 - DNA, 103 bp, Artificial Sequence
  Synthetic Polynucleotide
taatacgactcactataggggcgtaaccatatgctctgatcaatagagagaacagaggagactctctatggatcagagcaacctggcggcagcgcaaaagatg

SEQ ID NO: 4991 - DNA, 103 bp, Artificial Sequence
  Synthetic Polynucleotide
taatacgactcactatagggtgtttctgtccaggacttttcctgcggcagaacagaggagactgccgatggaaaagtccaacctggcggcagcgcaaaagatg

SEQ ID NO: 4992 - DNA, 103 bp, Artificial Sequence
  Synthetic Polynucleotide
taatacgactcactatagggtatctgcgtaaccatatgctctgatcaataaacagaggagatattgaatggagcatatgaacctggcggcagcgcaaaagatg

SEQ ID NO: 4993 - DNA, 103 bp, Artificial Sequence
  Synthetic Polynucleotide
taatacgactcactatagggggttctatctgcgtaaccatatgctctgataacagaggagaatcagaatgtatggttacaacctggcggcagcgcaaaagatg

SEQ ID NO: 4994 - DNA, 103 bp, Artificial Sequence
  Synthetic Polynucleotide
taatacgactcactatagggtcactggttctatctgcgtaaccatatgctaacagaggagaagcataatgttacgcagaaacctggcggcagcgcaaaagatg

SEQ ID NO: 4995 - DNA, 103 bp, Artificial Sequence
  Synthetic Polynucleotide
taatacgactcactatagggctcgttcactggttctatctgcgtaaccataacagaggagaatggttatgcagatagaaaacctggcggcagcgcaaaagatg

SEQ ID NO: 4996 - DNA, 103 bp, Artificial Sequence
  Synthetic Polynucleotide
taatacgactcactataggggatgactcgttcactggttctatctgcgtaaacagaggagatacgcaatgagaaccagtaacctggcggcagcgcaaaagatg

SEQ ID NO: 4997 - DNA, 103 bp, Artificial Sequence
  Synthetic Polynucleotide
taatacgactcactatagggacgcagatgactcgttcactggttctatctaacagaggagaagatagatgcagtgaacgaacctggcggcagcgcaaaagatg

SEQ ID NO: 4998 - DNA, 103 bp, Artificial Sequence
  Synthetic Polynucleotide
taatacgactcactatagggccaatacgcagatgactcgttcactggttcaacagaggagagaaccaatgaacgagtcaaacctggcggcagcgcaaaagatg

SEQ ID NO: 4999 - DNA, 103 bp, Artificial Sequence
  Synthetic Polynucleotide
taatacgactcactataggggcgtcccaatacgcagatgactcgttcactaacagaggagaagtgaaatggtcatctgcaacctggcggcagcgcaaaagatg

SEQ ID NO: 5000 - DNA, 103 bp, Artificial Sequence
  Synthetic Polynucleotide
taatacgactcactatagggaacttgcgtcccaatacgcagatgactcgtaacagaggagaacgagtatgctgcgtattaacctggcggcagcgcaaaagatg

SEQ ID NO: 5001 - DNA, 103 bp, Artificial Sequence
  Synthetic Polynucleotide
taatacgactcactatagggatctaaacttgcgtcccaatacgcagatgaaacagaggagatcatctatgtattgggacaacctggcggcagcgcaaaagatg

SEQ ID NO: 5002 - DNA, 103 bp, Artificial Sequence
  Synthetic Polynucleotide
taatacgactcactatagggagagatgtttctgtccaggacttttcctgcaacagaggagagcaggaatggtcctggacaacctggcggcagcgcaaaagatg

SEQ ID NO: 5003 - DNA, 103 bp, Artificial Sequence
  Synthetic Polynucleotide
taatacgactcactatagggagatgatctaaacttgcgtcccaatacgcaaacagaggagatgcgtaatgggacgcaagaacctggcggcagcgcaaaagatg

SEQ ID NO: 5004 - DNA, 103 bp, Artificial Sequence
  Synthetic Polynucleotide
taatacgactcactataggggctctagatgatctaaacttgcgtcccaataacagaggagaattgggatgcaagtttagaacctggcggcagcgcaaaagatg

SEQ ID NO: 5005 - DNA, 103 bp, Artificial Sequence
  Synthetic Polynucleotide
taatacgactcactatagggtcaacgctctagatgatctaaacttgcgtcaacagaggagagacgcaatgttagatcataacctggcggcagcgcaaaagatg

SEQ ID NO: 5006 - DNA, 103 bp, Artificial Sequence
  Synthetic Polynucleotide
taatacgactcactatagggtggtttcaacgctctagatgatctaaacttaacagaggagaaagtttatgtcatctagaaacctggcggcagcgcaaaagatg

SEQ ID NO: 5007 - DNA, 103 bp, Artificial Sequence
  Synthetic Polynucleotide
taatacgactcactatagggcatggtggtttcaacgctctagatgatctaaacagaggagatagatcatgtagagcgttaacctggcggcagcgcaaaagatg

SEQ ID NO: 5008 - DNA, 103 bp, Artificial Sequence
  Synthetic Polynucleotide
taatacgactcactatagggtgacacatggtggtttcaacgctctagatgaacagaggagacatctaatgcgttgaaacaacctggcggcagcgcaaaagatg

SEQ ID NO: 5009 - DNA, 103 bp, Artificial Sequence
  Synthetic Polynucleotide
taatacgactcactataggggctggtgacacatggtggtttcaacgctctaacagaggagaagagcgatgaaaccaccaaacctggcggcagcgcaaaagatg

SEQ ID NO: 5010 - DNA, 103 bp, Artificial Sequence
  Synthetic Polynucleotide
taatacgactcactataggggtgttgctggtgacacatggtggtttcaacaacagaggagagttgaaatgaccatgtgtaacctggcggcagcgcaaaagatg

SEQ ID NO: 5011 - DNA, 103 bp, Artificial Sequence
  Synthetic Polynucleotide
taatacgactcactatagggtctcagtgttgctggtgacacatggtggttaacagaggagaaaccacatggtgtcaccaaacctggcggcagcgcaaaagatg

SEQ ID NO: 5012 - DNA, 103 bp, Artificial Sequence
  Synthetic Polynucleotide
taatacgactcactatagggaaacatctcagtgttgctggtgacacatggaacagaggagaccatgtatgaccagcaacaacctggcggcagcgcaaaagatg

SEQ ID NO: 5013 - DNA, 103 bp, Artificial Sequence
  Synthetic Polynucleotide
taatacgactcactatagggtttccagagatgtttctgtccaggacttttaacagaggagaaaaagtatgggacagaaaaacctggcggcagcgcaaaagatg

SEQ ID NO: 5014 - DNA, 103 bp, Artificial Sequence
  Synthetic Polynucleotide
taatacgactcactatagggagaaaaaacatctcagtgttgctggtgacaaacagaggagatgtcacatgcaacactgaaacctggcggcagcgcaaaagatg

SEQ ID NO: 5015 - DNA, 103 bp, Artificial Sequence
  Synthetic Polynucleotide
taatacgactcactatagggtgaatagaaaaaacatctcagtgttgctggaacagaggagaccagcaatgctgagatgtaacctggcggcagcgcaaaagatg

SEQ ID NO: 5016 - DNA, 103 bp, Artificial Sequence
  Synthetic Polynucleotide
taatacgactcactataggggttgctgaatagaaaaaacatctcagtgttaacagaggagaaacactatgatgttttttaacctggcggcagcgcaaaagatg

SEQ ID NO: 5017 - DNA, 103 bp, Artificial Sequence
  Synthetic Polynucleotide
taatacgactcactatagggtcaaagttgctgaatagaaaaaacatctcaaacagaggagatgagatatgttttctattaacctggcggcagcgcaaaagatg

SEQ ID NO: 5018 - DNA, 103 bp, Artificial Sequence
  Synthetic Polynucleotide
taatacgactcactatagggcattgtcaaagttgctgaatagaaaaaacaaacagaggagatgttttatgtattcagcaaacctggcggcagcgcaaaagatg

SEQ ID NO: 5019 - DNA, 103 bp, Artificial Sequence
  Synthetic Polynucleotide
taatacgactcactatagggtctgccattgtcaaagttgctgaatagaaaaacagaggagatttctaatgagcaactttaacctggcggcagcgcaaaagatg

SEQ ID NO: 5020 - DNA, 103 bp, Artificial Sequence
  Synthetic Polynucleotide
taatacgactcactatagggttccttctgccattgtcaaagttgctgaataacagaggagaattcagatgctttgacaaaacctggcggcagcgcaaaagatg

SEQ ID NO: 5021 - DNA, 103 bp, Artificial Sequence
  Synthetic Polynucleotide
taatacgactcactatagggtgaaattccttctgccattgtcaaagttgcaacagaggagagcaactatgacaatggcaaacctggcggcagcgcaaaagatg

SEQ ID NO: 5022 - DNA, 103 bp, Artificial Sequence
  Synthetic Polynucleotide
taatacgactcactatagggagttgtgaaattccttctgccattgtcaaaaacagaggagatttgacatgggcagaaggaacctggcggcagcgcaaaagatg

SEQ ID NO: 5023 - DNA, 103 bp, Artificial Sequence
  Synthetic Polynucleotide
taatacgactcactatagggacatgagttgtgaaattccttctgccattgaacagaggagacaatggatgaaggaatttaacctggcggcagcgcaaaagatg

SEQ ID NO: 5024 - DNA, 103 bp, Artificial Sequence
  Synthetic Polynucleotide
taatacgactcactatagggaatctcttgctttgcagagtagagcagtaaaacagaggagattactgatgtactctgcaaacctggcggcagcgcaaaagatg

SEQ ID NO: 5025 - DNA, 103 bp, Artificial Sequence
  Synthetic Polynucleotide
taatacgactcactatagggcgatctttccagagatgtttctgtccaggaaacagaggagatcctggatggaaacatctaacctggcggcagcgcaaaagatg

SEQ ID NO: 5026 - DNA, 103 bp, Artificial Sequence
  Synthetic Polynucleotide
taatacgactcactatagggtcatgacatgagttgtgaaattccttctgcaacagaggagagcagaaatgatttcacaaaacctggcggcagcgcaaaagatg

SEQ ID NO: 5027 - DNA, 103 bp, Artificial Sequence
  Synthetic Polynucleotide
taatacgactcactatagggattgttcatgacatgagttgtgaaattcctaacagaggagaaggaatatgacaactcataacctggcggcagcgcaaaagatg

SEQ ID NO: 5028 - DNA, 103 bp, Artificial Sequence
  Synthetic Polynucleotide
taatacgactcactatagggagttgattgttcatgacatgagttgtgaaaaacagaggagatttcacatgtcatgtcataacctggcggcagcgcaaaagatg

SEQ ID NO: 5029 - DNA, 103 bp, Artificial Sequence
  Synthetic Polynucleotide
taatacgactcactatagggcattcagttgattgttcatgacatgagttgaacagaggagacaactcatgtcatgaacaaacctggcggcagcgcaaaagatg

SEQ ID NO: 5030 - DNA, 103 bp, Artificial Sequence
  Synthetic Polynucleotide
taatacgactcactatagggggctgcattcagttgattgttcatgacatgaacagaggagacatgtcatgaacaatcaaaacctggcggcagcgcaaaagatg

SEQ ID NO: 5031 - DNA, 103 bp, Artificial Sequence
  Synthetic Polynucleotide
taatacgactcactatagggacaaaggctgcattcagttgattgttcatgaacagaggagacatgaaatgtcaactgaaaacctggcggcagcgcaaaagatg

SEQ ID NO: 5032 - DNA, 103 bp, Artificial Sequence
  Synthetic Polynucleotide
taatacgactcactataggggtcctacaaaggctgcattcagttgattgtaacagaggagaacaatcatgtgaatgcagaacctggcggcagcgcaaaagatg

SEQ ID NO: 5033 - DNA, 103 bp, Artificial Sequence
  Synthetic Polynucleotide
taatacgactcactatagggggcctgtcctacaaaggctgcattcagttgaacagaggagacaactgatggcagcctttaacctggcggcagcgcaaaagatg

SEQ ID NO: 5034 - DNA, 103 bp, Artificial Sequence
  Synthetic Polynucleotide
taatacgactcactatagggcgggtggcctgtcctacaaaggctgcattcaacagaggagagaatgcatgctttgtaggaacctggcggcagcgcaaaagatg

SEQ ID NO: 5035 - DNA, 103 bp, Artificial Sequence
  Synthetic Polynucleotide
taatacgactcactatagggctgctcgggtggcctgtcctacaaaggctgaacagaggagacagcctatgtaggacaggaacctggcggcagcgcaaaagatg

SEQ ID NO: 5036 - DNA, 103 bp, Artificial Sequence
  Synthetic Polynucleotide
taatacgactcactataggggtccccgatctttccagagatgtttctgtcaacagaggagagacagaatgatctctggaaacctggcggcagcgcaaaagatg

SEQ ID NO: 5037 - DNA, 103 bp, Artificial Sequence
  Synthetic Polynucleotide
taatacgactcactatagggacatcctgctcgggtggcctgtcctacaaaaacagaggagatttgtaatgcaggccaccaacctggcggcagcgcaaaagatg

SEQ ID NO: 5038 - DNA, 103 bp, Artificial Sequence
  Synthetic Polynucleotide
taatacgactcactatagggggtgcacatcctgctcgggtggcctgtcctaacagaggagaaggacaatgcacccgagcaacctggcggcagcgcaaaagatg

SEQ ID NO: 5039 - DNA, 103 bp, Artificial Sequence
  Synthetic Polynucleotide
taatacgactcactatagggacgacggtgcacatcctgctcgggtggcctaacagaggagaaggccaatggagcaggataacctggcggcagcgcaaaagatg

SEQ ID NO: 5040 - DNA, 103 bp, Artificial Sequence
  Synthetic Polynucleotide
taatacgactcactatagggccggtacgacggtgcacatcctgctcgggtaacagaggagaacccgaatgggatgtgcaaacctggcggcagcgcaaaagatg

SEQ ID NO: 5041 - DNA, 103 bp, Artificial Sequence
  Synthetic Polynucleotide
taatacgactcactatagggtttacccggtacgacggtgcacatcctgctaacagaggagaagcaggatgtgcaccgtcaacctggcggcagcgcaaaagatg

SEQ ID NO: 5042 - DNA, 103 bp, Artificial Sequence
  Synthetic Polynucleotide
taatacgactcactatagggtgcgttttacccggtacgacggtgcacatcaacagaggagagatgtgatgcgtcgtaccaacctggcggcagcgcaaaagatg

SEQ ID NO: 5043 - DNA, 103 bp, Artificial Sequence
  Synthetic Polynucleotide
taatacgactcactatagggatccatgcgttttacccggtacgacggtgcaacagaggagagcaccgatgtaccgggtaaacctggcggcagcgcaaaagatg

SEQ ID NO: 5044 - DNA, 103 bp, Artificial Sequence
  Synthetic Polynucleotide
taatacgactcactataggggcgatatccatgcgttttacccggtacgacaacagaggagagtcgtaatgggtaaaacgaacctggcggcagcgcaaaagatg

SEQ ID NO: 5045 - DNA, 103 bp, Artificial Sequence
  Synthetic Polynucleotide
taatacgactcactatagggtcttcgcgatatccatgcgttttacccggtaacagaggagaaccgggatgaacgcatggaacctggcggcagcgcaaaagatg

SEQ ID NO: 5046 - DNA, 103 bp, Artificial Sequence
  Synthetic Polynucleotide
taatacgactcactatagggatcgttcttcgcgatatccatgcgttttacaacagaggagagtaaaaatgatggatatcaacctggcggcagcgcaaaagatg

SEQ ID NO: 5047 - DNA, 103 bp, Artificial Sequence
  Synthetic Polynucleotide
taatacgactcactatagggtgtaagtccccgatctttccagagatgtttaacagaggagaaaacatatgtggaaagataacctggcggcagcgcaaaagatg

SEQ ID NO: 5048 - DNA, 103 bp, Artificial Sequence
  Synthetic Polynucleotide
taatacgactcactatagggtcttcatcgttcttcgcgatatccatgcgtaacagaggagaacgcatatgtatcgcgaaaacctggcggcagcgcaaaagatg

SEQ ID NO: 5049 - DNA, 103 bp, Artificial Sequence
  Synthetic Polynucleotide
taatacgactcactatagggcgcactcttcatcgttcttcgcgatatccaaacagaggagatggataatgcgaagaacgaacctggcggcagcgcaaaagatg

SEQ ID NO: 5050 - DNA, 103 bp, Artificial Sequence
  Synthetic Polynucleotide
taatacgactcactataggggactacgcactcttcatcgttcttcgcgataacagaggagaatcgcgatgaacgatgaaaacctggcggcagcgcaaaagatg

SEQ ID NO: 5051 - DNA, 103 bp, Artificial Sequence
  Synthetic Polynucleotide
taatacgactcactataggggcgttgactacgcactcttcatcgttcttcaacagaggagagaagaaatgtgaagagtgaacctggcggcagcgcaaaagatg

SEQ ID NO: 5052 - DNA, 103 bp, Artificial Sequence
  Synthetic Polynucleotide
taatacgactcactatagggtggcggcgttgactacgcactcttcatcgtaacagaggagaacgatgatgagtgcgtagaacctggcggcagcgcaaaagatg

SEQ ID NO: 5053 - DNA, 103 bp, Artificial Sequence
  Synthetic Polynucleotide
taatacgactcactatagggagggttggcggcgttgactacgcactcttcaacagaggagagaagagatggtagtcaacaacctggcggcagcgcaaaagatg

SEQ ID NO: 5054 - DNA, 103 bp, Artificial Sequence
  Synthetic Polynucleotide
taatacgactcactatagggccgcgagggttggcggcgttgactacgcacaacagaggagagtgcgtatgcaacgccgcaacctggcggcagcgcaaaagatg

SEQ ID NO: 5055 - DNA, 103 bp, Artificial Sequence
  Synthetic Polynucleotide
taatacgactcactataggggtaacccgcgagggttggcggcgttgactaaacagaggagatagtcaatgccgccaaccaacctggcggcagcgcaaaagatg

SEQ ID NO: 5056 - DNA, 103 bp, Artificial Sequence
  Synthetic Polynucleotide
taatacgactcactatagggacctggtaacccgcgagggttggcggcgttaacagaggagaaacgccatgaaccctcgcaacctggcggcagcgcaaaagatg

SEQ ID NO: 5057 - DNA, 103 bp, Artificial Sequence
  Synthetic Polynucleotide
taatacgactcactatagggccgtcacctggtaacccgcgagggttggcgaacagaggagacgccaaatgtcgcgggttaacctggcggcagcgcaaaagatg

SEQ ID NO: 5058 - DNA, 103 bp, Artificial Sequence
  Synthetic Polynucleotide
taatacgactcactatagggctgcttgtaagtccccgatctttccagagaaacagaggagatctctgatgagatcggggaacctggcggcagcgcaaaagatg

SEQ ID NO: 5059 - DNA, 103 bp, Artificial Sequence
  Synthetic Polynucleotide
taatacgactcactatagggaaacaccgtcacctggtaacccgcgagggtaacagaggagaaccctcatgggttaccagaacctggcggcagcgcaaaagatg

SEQ ID NO: 5060 - DNA, 103 bp, Artificial Sequence
  Synthetic Polynucleotide
taatacgactcactatagggcttgcaaacaccgtcacctggtaacccgcgaacagaggagacgcgggatgccaggtgacaacctggcggcagcgcaaaagatg

SEQ ID NO: 5061 - DNA, 103 bp, Artificial Sequence
  Synthetic Polynucleotide
taatacgactcactatagggactgccttgcaaacaccgtcacctggtaacaacagaggagagttaccatgtgacggtgtaacctggcggcagcgcaaaagatg

SEQ ID NO: 5062 - DNA, 103 bp, Artificial Sequence
  Synthetic Polynucleotide
taatacgactcactatagggtgtatactgccttgcaaacaccgtcacctgaacagaggagacaggtgatggtgtttgcaaacctggcggcagcgcaaaagatg

SEQ ID NO: 5063 - DNA, 103 bp, Artificial Sequence
  Synthetic Polynucleotide
taatacgactcactatagggttttttgtatactgccttgcaaacaccgtcaacagaggagagacggtatgtgcaaggcaaacctggcggcagcgcaaaagatg

SEQ ID NO: 5064 - DNA, 103 bp, Artificial Sequence
  Synthetic Polynucleotide
taatacgactcactatagggggccattttttgtatactgccttgcaaacaaacagaggagatgtttgatgggcagtataaacctggcggcagcgcaaaagatg

SEQ ID NO: 5065 - DNA, 103 bp, Artificial Sequence
  Synthetic Polynucleotide
taatacgactcactatagggactccggccattttttgtatactgccttgcaacagaggagagcaaggatgtatacaaaaaacctggcggcagcgcaaaagatg

SEQ ID NO: 5066 - DNA, 103 bp, Artificial Sequence
  Synthetic Polynucleotide
taatacgactcactatagggaaaggactccggccattttttgtatactgcaacagaggagagcagtaatgaaaaaatggaacctggcggcagcgcaaaagatg

SEQ ID NO: 5067 - DNA, 103 bp, Artificial Sequence
  Synthetic Polynucleotide
taatacgactcactatagggttcttaaaggactccggccattttttgtataacagaggagaatacaaatgatggccggaaacctggcggcagcgcaaaagatg

SEQ ID NO: 5068 - DNA, 103 bp, Artificial Sequence
  Synthetic Polynucleotide
taatacgactcactatagggcactgttcttaaaggactccggccatttttaacagaggagaaaaaatatgcggagtcctaacctggcggcagcgcaaaagatg

SEQ ID NO: 5069 - DNA, 103 bp, Artificial Sequence
  Synthetic Polynucleotide
taatacgactcactatagggcattactgcttgtaagtccccgatctttccaacagaggagaggaaagatgggggacttaaacctggcggcagcgcaaaagatg

SEQ ID NO: 5070 - DNA, 103 bp, Artificial Sequence
  Synthetic Polynucleotide
taatacgactcactatagggtgttgcactgttcttaaaggactccggccaaacagaggagatggccgatgtcctttaagaacctggcggcagcgcaaaagatg

SEQ ID NO: 5071 - DNA, 103 bp, Artificial Sequence
  Synthetic Polynucleotide
taatacgactcactatagggactggtgttgcactgttcttaaaggactccaacagaggagaggagtcatgtaagaacagaacctggcggcagcgcaaaagatg

SEQ ID NO: 5072 - DNA, 103 bp, Artificial Sequence
  Synthetic Polynucleotide
taatacgactcactatagggttcccactggtgttgcactgttcttaaaggaacagaggagacctttaatgacagtgcaaaacctggcggcagcgcaaaagatg

SEQ ID NO: 5073 - DNA, 103 bp, Artificial Sequence
  Synthetic Polynucleotide
taatacgactcactatagggtgcggttcccactggtgttgcactgttcttaacagaggagaaagaacatggcaacaccaaacctggcggcagcgcaaaagatg

SEQ ID NO: 5074 - DNA, 103 bp, Artificial Sequence
  Synthetic Polynucleotide
taatacgactcactataggggtttttgcggttcccactggtgttgcactgaacagaggagacagtgcatgaccagtgggaacctggcggcagcgcaaaagatg

SEQ ID NO: 5075 - DNA, 103 bp, Artificial Sequence
  Synthetic Polynucleotide
taatacgactcactatagggtgactgtttttgcggttcccactggtgttgaacagaggagacaacacatgtgggaaccgaacctggcggcagcgcaaaagatg

SEQ ID NO: 5076 - DNA, 103 bp, Artificial Sequence
  Synthetic Polynucleotide
taatacgactcactataggggcacatgactgtttttgcggttcccactggaacagaggagaccagtgatgaccgcaaaaaacctggcggcagcgcaaaagatg

SEQ ID NO: 5077 - DNA, 103 bp, Artificial Sequence
  Synthetic Polynucleotide
taatacgactcactataggggtaccgcacatgactgtttttgcggttcccaacagaggagagggaacatgaaaaacagtaacctggcggcagcgcaaaagatg

SEQ ID NO: 5078 - DNA, 103 bp, Artificial Sequence
  Synthetic Polynucleotide
taatacgactcactataggggatacgtaccgcacatgactgtttttgcggaacagaggagaccgcaaatgcagtcatgtaacctggcggcagcgcaaaagatg

SEQ ID NO: 5079 - DNA, 103 bp, Artificial Sequence
  Synthetic Polynucleotide
taatacgactcactatagggtactggatacgtaccgcacatgactgttttaacagaggagaaaaacaatgatgtgcggtaacctggcggcagcgcaaaagatg

SEQ ID NO: 5080 - DNA, 103 bp, Artificial Sequence
  Synthetic Polynucleotide
taatacgactcactatagggacggccattactgcttgtaagtccccgatcaacagaggagagatcggatgcttacaagcaacctggcggcagcgcaaaagatg

SEQ ID NO: 5081 - DNA, 103 bp, Artificial Sequence
  Synthetic Polynucleotide
taatacgactcactatagggtggattactggatacgtaccgcacatgactaacagaggagaagtcatatgcggtacgtaaacctggcggcagcgcaaaagatg

SEQ ID NO: 5082 - DNA, 103 bp, Artificial Sequence
  Synthetic Polynucleotide
taatacgactcactatagggcggcgtggattactggatacgtaccgcacaaacagaggagatgtgcgatgcgtatccagaacctggcggcagcgcaaaagatg

SEQ ID NO: 5083 - DNA, 103 bp, Artificial Sequence
  Synthetic Polynucleotide
taatacgactcactatagggtccaacggcgtggattactggatacgtaccaacagaggagaggtacgatgccagtaatcaacctggcggcagcgcaaaagatg

SEQ ID NO: 5084 - DNA, 103 bp, Artificial Sequence
  Synthetic Polynucleotide
taatacgactcactatagggtttggtccaacggcgtggattactggatacaacagaggagagtatccatgaatccacgcaacctggcggcagcgcaaaagatg

SEQ ID NO: 5085 - DNA, 103 bp, Artificial Sequence
  Synthetic Polynucleotide
taatacgactcactatagggagaagtttggtccaacggcgtggattactgaacagaggagacagtaaatgacgccgttgaacctggcggcagcgcaaaagatg

SEQ ID NO: 5086 - DNA, 103 bp, Artificial Sequence
  Synthetic Polynucleotide
taatacgactcactatagggattagagaagtttggtccaacggcgtggataacagaggagaatccacatggttggaccaaacctggcggcagcgcaaaagatg

SEQ ID NO: 5087 - DNA, 103 bp, Artificial Sequence
  Synthetic Polynucleotide
taatacgactcactataggggaataattagagaagtttggtccaacggcgaacagaggagacgccgtatgaccaaacttaacctggcggcagcgcaaaagatg

SEQ ID NO: 5088 - DNA, 103 bp, Artificial Sequence
  Synthetic Polynucleotide
taatacgactcactatagggactccgaataattagagaagtttggtccaaaacagaggagattggacatgacttctctaaacctggcggcagcgcaaaagatg

SEQ ID NO: 5089 - DNA, 103 bp, Artificial Sequence
  Synthetic Polynucleotide
taatacgactcactatagggttcagactccgaataattagagaagtttggaacagaggagaccaaacatgtctaattataacctggcggcagcgcaaaagatg

SEQ ID NO: 5090 - DNA, 103 bp, Artificial Sequence
  Synthetic Polynucleotide
taatacgactcactatagggtccccttcagactccgaataattagagaagaacagaggagacttctcatgttattcggaaacctggcggcagcgcaaaagatg

SEQ ID NO: 5091 - DNA, 103 bp, Artificial Sequence
  Synthetic Polynucleotide
taatacgactcactatagggctggcacggccattactgcttgtaagtcccaacagaggagagggactatgaagcagtaaaacctggcggcagcgcaaaagatg

SEQ ID NO: 5092 - DNA, 103 bp, Artificial Sequence
  Synthetic Polynucleotide
taatacgactcactatagggctcggtccccttcagactccgaataattagaacagaggagactaattatgcggagtctgaacctggcggcagcgcaaaagatg

SEQ ID NO: 5093 - DNA, 103 bp, Artificial Sequence
  Synthetic Polynucleotide
taatacgactcactatagggcaattctcggtccccttcagactccgaataaacagaggagatattcgatgtctgaagggaacctggcggcagcgcaaaagatg

SEQ ID NO: 5094 - DNA, 103 bp, Artificial Sequence
  Synthetic Polynucleotide
taatacgactcactataggggccgccaattctcggtccccttcagactccaacagaggagaggagtcatgaggggaccgaacctggcggcagcgcaaaagatg

SEQ ID NO: 5095 - DNA, 103 bp, Artificial Sequence
  Synthetic Polynucleotide
taatacgactcactatagggaggcagccgccaattctcggtccccttcagaacagaggagactgaagatgaccgagaataacctggcggcagcgcaaaagatg

SEQ ID NO: 5096 - DNA, 103 bp, Artificial Sequence
  Synthetic Polynucleotide
taatacgactcactatagggtcgataggcagccgccaattctcggtccccaacagaggagaggggacatggaattggcgaacctggcggcagcgcaaaagatg

SEQ ID NO: 5097 - DNA, 103 bp, Artificial Sequence
  Synthetic Polynucleotide
taatacgactcactatagggacttctcgataggcagccgccaattctcggaacagaggagaccgagaatgggcggctgcaacctggcggcagcgcaaaagatg

SEQ ID NO: 5098 - DNA, 103 bp, Artificial Sequence
  Synthetic Polynucleotide
taatacgactcactatagggttgcgacttctcgataggcagccgccaattaacagaggagaaattggatgctgcctatcaacctggcggcagcgcaaaagatg

SEQ ID NO: 5099 - DNA, 103 bp, Artificial Sequence
  Synthetic Polynucleotide
taatacgactcactatagggctcctttgcgacttctcgataggcagccgcaacagaggagagcggctatgtatcgagaaaacctggcggcagcgcaaaagatg

SEQ ID NO: 5100 - DNA, 103 bp, Artificial Sequence
  Synthetic Polynucleotide
taatacgactcactataggggttacctcctttgcgacttctcgataggcaaacagaggagatgcctaatgagaagtcgcaacctggcggcagcgcaaaagatg

SEQ ID NO: 5101 - DNA, 103 bp, Artificial Sequence
  Synthetic Polynucleotide
taatacgactcactataggggtctagttacctcctttgcgacttctcgataacagaggagaatcgagatgtcgcaaaggaacctggcggcagcgcaaaagatg

SEQ ID NO: 5102 - DNA, 103 bp, Artificial Sequence
  Synthetic Polynucleotide
taatacgactcactatagggcgtgtctggcacggccattactgcttgtaaaacagaggagattacaaatggtaatggccaacctggcggcagcgcaaaagatg

SEQ ID NO: 5103 - DNA, 103 bp, Artificial Sequence
  Synthetic Polynucleotide
taatacgactcactatagggtcccagtctagttacctcctttgcgacttcaacagaggagagaagtcatgaaggaggtaaacctggcggcagcgcaaaagatg

SEQ ID NO: 5104 - DNA, 103 bp, Artificial Sequence
  Synthetic Polynucleotide
taatacgactcactatagggtttactcccagtctagttacctcctttgcgaacagaggagacgcaaaatgggtaactagaacctggcggcagcgcaaaagatg

SEQ ID NO: 5105 - DNA, 103 bp, Artificial Sequence
  Synthetic Polynucleotide
taatacgactcactatagggcactatttactcccagtctagttacctcctaacagaggagaaggaggatgctagactggaacctggcggcagcgcaaaagatg

SEQ ID NO: 5106 - DNA, 103 bp, Artificial Sequence
  Synthetic Polynucleotide
taatacgactcactatagggagctacactatttactcccagtctagttacaacagaggagagtaactatgctgggagtaaacctggcggcagcgcaaaagatg

SEQ ID NO: 5107 - DNA, 103 bp, Artificial Sequence
  Synthetic Polynucleotide
taatacgactcactatagggggtatagctacactatttactcccagtctaaacagaggagatagactatgagtaaatagaacctggcggcagcgcaaaagatg

SEQ ID NO: 5108 - DNA, 103 bp, Artificial Sequence
  Synthetic Polynucleotide
taatacgactcactatagggggagaggtatagctacactatttactcccaaacagaggagatgggagatgatagtgtagaacctggcggcagcgcaaaagatg

SEQ ID NO: 5109 - DNA, 103 bp, Artificial Sequence
  Synthetic Polynucleotide
taatacgactcactatagggggagaggagaggtatagctacactatttacaacagaggagagtaaatatggtagctataaacctggcggcagcgcaaaagatg

SEQ ID NO: 5110 - DNA, 103 bp, Artificial Sequence
  Synthetic Polynucleotide
taatacgactcactatagggcctgtggagaggagaggtatagctacactaaacagaggagatagtgtatgtatacctctaacctggcggcagcgcaaaagatg

SEQ ID NO: 5111 - DNA, 103 bp, Artificial Sequence
  Synthetic Polynucleotide
taatacgactcactatagggatacacctgtggagaggagaggtatagctaaacagaggagatagctaatgctctcctctaacctggcggcagcgcaaaagatg

SEQ ID NO: 5112 - DNA, 103 bp, Artificial Sequence
  Synthetic Polynucleotide
taatacgactcactatagggtgagtatacacctgtggagaggagaggtataacagaggagaatacctatgctctccacaaacctggcggcagcgcaaaagatg

SEQ ID NO: 5113 - DNA, 103 bp, Artificial Sequence
  Synthetic Polynucleotide
taatacgactcactataggggtctccgtgtctggcacggccattactgctaacagaggagaagcagtatgggccgtgccaacctggcggcagcgcaaaagatg

SEQ ID NO: 5114 - DNA, 103 bp, Artificial Sequence
  Synthetic Polynucleotide
taatacgactcactatagggcctcctgagtatacacctgtggagaggagaaacagaggagatctcctatgcacaggtgtaacctggcggcagcgcaaaagatg

SEQ ID NO: 5115 - DNA, 103 bp, Artificial Sequence
  Synthetic Polynucleotide
taatacgactcactatagggctttccctcctgagtatacacctgtggagaaacagaggagatctccaatggtgtatactaacctggcggcagcgcaaaagatg

SEQ ID NO: 5116 - DNA, 103 bp, Artificial Sequence
  Synthetic Polynucleotide
taatacgactcactatagggcctgtctttccctcctgagtatacacctgtaacagaggagaacaggtatgtactcaggaaacctggcggcagcgcaaaagatg

SEQ ID NO: 5117 - DNA, 103 bp, Artificial Sequence
  Synthetic Polynucleotide
taatacgactcactataggggtcagcctgtctttccctcctgagtatacaaacagaggagatgtataatgaggagggaaaacctggcggcagcgcaaaagatg

SEQ ID NO: 5118 - DNA, 103 bp, Artificial Sequence
  Synthetic Polynucleotide
taatacgactcactatagggactgggtcagcctgtctttccctcctgagtaacagaggagaactcagatgggaaagacaaacctggcggcagcgcaaaagatg

SEQ ID NO: 5119 - DNA, 103 bp, Artificial Sequence
  Synthetic Polynucleotide
taatacgactcactatagggcagtgactgggtcagcctgtctttccctccaacagaggagaggagggatggacaggctgaacctggcggcagcgcaaaagatg

SEQ ID NO: 5120 - DNA, 103 bp, Artificial Sequence
  Synthetic Polynucleotide
taatacgactcactatagggtggttcagtgactgggtcagcctgtctttcaacagaggagagaaagaatggctgacccaaacctggcggcagcgcaaaagatg

SEQ ID NO: 5121 - DNA, 103 bp, Artificial Sequence
  Synthetic Polynucleotide
taatacgactcactatagggagaggtggttcagtgactgggtcagcctgtaacagaggagaacaggcatgcccagtcacaacctggcggcagcgcaaaagatg

SEQ ID NO: 5122 - DNA, 103 bp, Artificial Sequence
  Synthetic Polynucleotide
taatacgactcactatagggtgtaaagaggtggttcagtgactgggtcagaacagaggagactgaccatgtcactgaacaacctggcggcagcgcaaaagatg

SEQ ID NO: 5123 - DNA, 103 bp, Artificial Sequence
  Synthetic Polynucleotide
taatacgactcactatagggatggctgtaaagaggtggttcagtgactggaacagaggagaccagtcatggaaccacctaacctggcggcagcgcaaaagatg

SEQ ID NO: 5124 - DNA, 103 bp, Artificial Sequence
  Synthetic Polynucleotide
taatacgactcactatagggttggcgtctccgtgtctggcacggccattaaacagaggagataatggatgtgccagacaaacctggcggcagcgcaaaagatg

SEQ ID NO: 5125 - DNA, 103 bp, Artificial Sequence
  Synthetic Polynucleotide
taatacgactcactatagggagtccatggctgtaaagaggtggttcagtgaacagaggagacactgaatgacctctttaaacctggcggcagcgcaaaagatg

SEQ ID NO: 5126 - DNA, 103 bp, Artificial Sequence
  Synthetic Polynucleotide
taatacgactcactatagggcgtcgagtccatggctgtaaagaggtggttaacagaggagaaaccacatgtttacagccaacctggcggcagcgcaaaagatg

SEQ ID NO: 5127 - DNA, 103 bp, Artificial Sequence
  Synthetic Polynucleotide
taatacgactcactataggggcatccgtcgagtccatggctgtaaagaggaacagaggagacctcttatgagccatggaaacctggcggcagcgcaaaagatg

SEQ ID NO: 5128 - DNA, 103 bp, Artificial Sequence
  Synthetic Polynucleotide
taatacgactcactatagggcgtctgcatccgtcgagtccatggctgtaaaacagaggagattacagatgtggactcgaaacctggcggcagcgcaaaagatg

SEQ ID NO: 5129 - DNA, 103 bp, Artificial Sequence
  Synthetic Polynucleotide
taatacgactcactataggggaccacgtctgcatccgtcgagtccatggcaacagaggagagccatgatgtcgacggataacctggcggcagcgcaaaagatg

SEQ ID NO: 5130 - DNA, 103 bp, Artificial Sequence
  Synthetic Polynucleotide
taatacgactcactatagggtagatgaccacgtctgcatccgtcgagtccaacagaggagaggactcatgggatgcagaaacctggcggcagcgcaaaagatg

SEQ ID NO: 5131 - DNA, 103 bp, Artificial Sequence
  Synthetic Polynucleotide
taatacgactcactatagggggcagtagatgaccacgtctgcatccgtcgaacagaggagacgacggatgcagacgtggaacctggcggcagcgcaaaagatg

SEQ ID NO: 5132 - DNA, 103 bp, Artificial Sequence
  Synthetic Polynucleotide
taatacgactcactataggggtcgcggcagtagatgaccacgtctgcatcaacagaggagagatgcaatggtggtcatcaacctggcggcagcgcaaaagatg

SEQ ID NO: 5133 - DNA, 103 bp, Artificial Sequence
  Synthetic Polynucleotide
taatacgactcactatagggtctttgtcgcggcagtagatgaccacgtctaacagaggagaagacgtatgcatctactgaacctggcggcagcgcaaaagatg

SEQ ID NO: 5134 - DNA, 103 bp, Artificial Sequence
  Synthetic Polynucleotide
taatacgactcactatagggcccattctttgtcgcggcagtagatgaccaaacagaggagatggtcaatgactgccgcgaacctggcggcagcgcaaaagatg

SEQ ID NO: 5135 - DNA, 103 bp, Artificial Sequence
  Synthetic Polynucleotide
taatacgactcactatagggttcttaatctcttgctttgcagagtagagcaacagaggagagctctaatgtgcaaagcaaacctggcggcagcgcaaaagatg

SEQ ID NO: 5136 - DNA, 103 bp, Artificial Sequence
  Synthetic Polynucleotide
taatacgactcactataggggaatgttggcgtctccgtgtctggcacggcaacagaggagagccgtgatggacacggagaacctggcggcagcgcaaaagatg

SEQ ID NO: 5137 - DNA, 103 bp, Artificial Sequence
  Synthetic Polynucleotide
taatacgactcactatagggcttctcccattctttgtcgcggcagtagataacagaggagaatctacatgcgcgacaaaaacctggcggcagcgcaaaagatg

SEQ ID NO: 5138 - DNA, 103 bp, Artificial Sequence
  Synthetic Polynucleotide
taatacgactcactatagggattttcttctcccattctttgtcgcggcagaacagaggagactgccgatgcaaagaatgaacctggcggcagcgcaaaagatg

SEQ ID NO: 5139 - DNA, 103 bp, Artificial Sequence
  Synthetic Polynucleotide
taatacgactcactatagggcagatattttcttctcccattctttgtcgcaacagaggagagcgacaatgaatgggagaaacctggcggcagcgcaaaagatg

SEQ ID NO: 5140 - DNA, 103 bp, Artificial Sequence
  Synthetic Polynucleotide
taatacgactcactatagggggcctcagatattttcttctcccattctttaacagaggagaaaagaaatggagaagaaaaacctggcggcagcgcaaaagatg

SEQ ID NO: 5141 - DNA, 103 bp, Artificial Sequence
  Synthetic Polynucleotide
taatacgactcactatagggtgtatggcctcagatattttcttctcccataacagaggagaatgggaatggaaaatatcaacctggcggcagcgcaaaagatg

SEQ ID NO: 5142 - DNA, 103 bp, Artificial Sequence
  Synthetic Polynucleotide
taatacgactcactataggggcatctgtatggcctcagatattttcttctaacagaggagaagaagaatgtatctgaggaacctggcggcagcgcaaaagatg

SEQ ID NO: 5143 - DNA, 103 bp, Artificial Sequence
  Synthetic Polynucleotide
taatacgactcactatagggggtccgcatctgtatggcctcagatattttaacagaggagaaaaataatggaggccataaacctggcggcagcgcaaaagatg

SEQ ID NO: 5144 - DNA, 103 bp, Artificial Sequence
  Synthetic Polynucleotide
taatacgactcactatagggacttgggtccgcatctgtatggcctcagataacagaggagaatctgaatgcatacagataacctggcggcagcgcaaaagatg

SEQ ID NO: 5145 - DNA, 103 bp, Artificial Sequence
  Synthetic Polynucleotide
taatacgactcactataggggctccacttgggtccgcatctgtatggcctaacagaggagaaggccaatgagatgcggaaacctggcggcagcgcaaaagatg

SEQ ID NO: 5146 - DNA, 103 bp, Artificial Sequence
  Synthetic Polynucleotide
taatacgactcactatagggcagcagctccacttgggtccgcatctgtataacagaggagaatacagatgcggacccaaaacctggcggcagcgcaaaagatg

SEQ ID NO: 5147 - DNA, 103 bp, Artificial Sequence
  Synthetic Polynucleotide
taatacgactcactatagggaagcagaatgttggcgtctccgtgtctggcaacagaggagagccagaatgggagacgccaacctggcggcagcgcaaaagatg

SEQ ID NO: 5148 - DNA, 103 bp, Artificial Sequence
  Synthetic Polynucleotide
taatacgactcactatagggtcatccagcagctccacttgggtccgcatcaacagaggagagatgcgatgccaagtggaaacctggcggcagcgcaaaagatg

SEQ ID NO: 5149 - DNA, 103 bp, Artificial Sequence
  Synthetic Polynucleotide
taatacgactcactatagggtgtgctcatccagcagctccacttgggtccaacagaggagaggacccatgtggagctgcaacctggcggcagcgcaaaagatg

SEQ ID NO: 5150 - DNA, 103 bp, Artificial Sequence
  Synthetic Polynucleotide
taatacgactcactatagggggagatgtgctcatccagcagctccacttgaacagaggagacaagtgatgctgctggataacctggcggcagcgcaaaagatg

SEQ ID NO: 5151 - DNA, 103 bp, Artificial Sequence
  Synthetic Polynucleotide
taatacgactcactatagggtctatggagatgtgctcatccagcagctccaacagaggagaggagctatgggatgagcaaacctggcggcagcgcaaaagatg

SEQ ID NO: 5152 - DNA, 103 bp, Artificial Sequence
  Synthetic Polynucleotide
taatacgactcactatagggcgcagtctatggagatgtgctcatccagcaaacagaggagatgctggatgagcacatctaacctggcggcagcgcaaaagatg

SEQ ID NO: 5153 - DNA, 103 bp, Artificial Sequence
  Synthetic Polynucleotide
taatacgactcactatagggaacatcgcagtctatggagatgtgctcatcaacagaggagagatgagatgatctccataaacctggcggcagcgcaaaagatg

SEQ ID NO: 5154 - DNA, 103 bp, Artificial Sequence
  Synthetic Polynucleotide
taatacgactcactatagggcgaacaacatcgcagtctatggagatgtgcaacagaggagagcacatatgcatagactgaacctggcggcagcgcaaaagatg

SEQ ID NO: 5155 - DNA, 103 bp, Artificial Sequence
  Synthetic Polynucleotide
taatacgactcactataggggcacgcgaacaacatcgcagtctatggagaaacagaggagatctccaatgactgcgatgaacctggcggcagcgcaaaagatg

SEQ ID NO: 5156 - DNA, 103 bp, Artificial Sequence
  Synthetic Polynucleotide
taatacgactcactatagggagggtgcacgcgaacaacatcgcagtctataacagaggagaatagacatggatgttgttaacctggcggcagcgcaaaagatg

SEQ ID NO: 5157 - DNA, 103 bp, Artificial Sequence
  Synthetic Polynucleotide
taatacgactcactatagggctgtcagggtgcacgcgaacaacatcgcagaacagaggagactgcgaatgtgttcgcgtaacctggcggcagcgcaaaagatg

SEQ ID NO: 5158 - DNA, 103 bp, Artificial Sequence
  Synthetic Polynucleotide
taatacgactcactatagggtgtgtaagcagaatgttggcgtctccgtgtaacagaggagaacacggatgcgccaacataacctggcggcagcgcaaaagatg

SEQ ID NO: 5159 - DNA, 103 bp, Artificial Sequence
  Synthetic Polynucleotide
taatacgactcactatagggagctgctgtcagggtgcacgcgaacaacataacagaggagaatgttgatggcgtgcaccaacctggcggcagcgcaaaagatg

SEQ ID NO: 5160 - DNA, 103 bp, Artificial Sequence
  Synthetic Polynucleotide
taatacgactcactatagggtgccaagctgctgtcagggtgcacgcgaacaacagaggagagttcgcatgcaccctgacaacctggcggcagcgcaaaagatg

SEQ ID NO: 5161 - DNA, 103 bp, Artificial Sequence
  Synthetic Polynucleotide
taatacgactcactatagggctgcctgccaagctgctgtcagggtgcacgaacagaggagacgtgcaatgtgacagcagaacctggcggcagcgcaaaagatg

SEQ ID NO: 5162 - DNA, 103 bp, Artificial Sequence
  Synthetic Polynucleotide
taatacgactcactatagggcttttctgcctgccaagctgctgtcagggtaacagaggagaaccctgatggcagcttggaacctggcggcagcgcaaaagatg

SEQ ID NO: 5163 - DNA, 103 bp, Artificial Sequence
  Synthetic Polynucleotide
taatacgactcactataggggtatccttttctgcctgccaagctgctgtcaacagaggagagacagcatgttggcaggcaacctggcggcagcgcaaaagatg

SEQ ID NO: 5164 - DNA, 103 bp, Artificial Sequence
  Synthetic Polynucleotide
taatacgactcactataggggtgctgtatccttttctgcctgccaagctgaacagaggagacagcttatgaggcagaaaaacctggcggcagcgcaaaagatg

SEQ ID NO: 5165 - DNA, 103 bp, Artificial Sequence
  Synthetic Polynucleotide
taatacgactcactatagggccgtggtgctgtatccttttctgcctgccaaacagaggagatggcagatggaaaaggataacctggcggcagcgcaaaagatg

SEQ ID NO: 5166 - DNA, 103 bp, Artificial Sequence
  Synthetic Polynucleotide
taatacgactcactataggggccttccgtggtgctgtatccttttctgccaacagaggagaggcagaatgggatacagcaacctggcggcagcgcaaaagatg

SEQ ID NO: 5167 - DNA, 103 bp, Artificial Sequence
  Synthetic Polynucleotide
taatacgactcactatagggagtgcgccttccgtggtgctgtatccttttaacagaggagaaaaaggatgcagcaccacaacctggcggcagcgcaaaagatg

SEQ ID NO: 5168 - DNA, 103 bp, Artificial Sequence
  Synthetic Polynucleotide
taatacgactcactatagggagtacagtgcgccttccgtggtgctgtatcaacagaggagagatacaatgccacggaagaacctggcggcagcgcaaaagatg

SEQ ID NO: 5169 - DNA, 103 bp, Artificial Sequence
  Synthetic Polynucleotide
taatacgactcactatagggatctgtgtgtaagcagaatgttggcgtctcaacagaggagagagacgatgacattctgcaacctggcggcagcgcaaaagatg

SEQ ID NO: 5170 - DNA, 103 bp, Artificial Sequence
  Synthetic Polynucleotide
taatacgactcactatagggatatgagtacagtgcgccttccgtggtgctaacagaggagaagcaccatggaaggcgcaaacctggcggcagcgcaaaagatg

SEQ ID NO: 5171 - DNA, 103 bp, Artificial Sequence
  Synthetic Polynucleotide
taatacgactcactatagggtctagatatgagtacagtgcgccttccgtgaacagaggagacacggaatgcgcactgtaaacctggcggcagcgcaaaagatg

SEQ ID NO: 5172 - DNA, 103 bp, Artificial Sequence
  Synthetic Polynucleotide
taatacgactcactatagggtcccttctagatatgagtacagtgcgccttaacagaggagaaaggcgatgtgtactcataacctggcggcagcgcaaaagatg

SEQ ID NO: 5173 - DNA, 103 bp, Artificial Sequence
  Synthetic Polynucleotide
taatacgactcactatagggacgggtcccttctagatatgagtacagtgcaacagaggagagcactgatgtcatatctaaacctggcggcagcgcaaaagatg

SEQ ID NO: 5174 - DNA, 103 bp, Artificial Sequence
  Synthetic Polynucleotide
taatacgactcactatagggtgaaaacgggtcccttctagatatgagtacaacagaggagagtactcatgtctagaaggaacctggcggcagcgcaaaagatg

SEQ ID NO: 5175 - DNA, 103 bp, Artificial Sequence
  Synthetic Polynucleotide
taatacgactcactatagggtttggtgaaaacgggtcccttctagatatgaacagaggagacatatcatgaagggacccaacctggcggcagcgcaaaagatg

SEQ ID NO: 5176 - DNA, 103 bp, Artificial Sequence
  Synthetic Polynucleotide
taatacgactcactatagggtgccgtttggtgaaaacgggtcccttctagaacagaggagactagaaatgacccgttttaacctggcggcagcgcaaaagatg

SEQ ID NO: 5177 - DNA, 103 bp, Artificial Sequence
  Synthetic Polynucleotide
taatacgactcactatagggtccactgccgtttggtgaaaacgggtccctaacagaggagaagggacatgttttcaccaaacctggcggcagcgcaaaagatg

SEQ ID NO: 5178 - DNA, 103 bp, Artificial Sequence
  Synthetic Polynucleotide
taatacgactcactatagggccatatccactgccgtttggtgaaaacgggaacagaggagacccgttatgaccaaacggaacctggcggcagcgcaaaagatg

SEQ ID NO: 5179 - DNA, 103 bp, Artificial Sequence
  Synthetic Polynucleotide
taatacgactcactatagggctctgccatatccactgccgtttggtgaaaaacagaggagatttcacatgacggcagtgaacctggcggcagcgcaaaagatg

SEQ ID NO: 5180 - DNA, 103 bp, Artificial Sequence
  Synthetic Polynucleotide
taatacgactcactataggggatacatctgtgtgtaagcagaatgttggcaacagaggagagccaacatgctgcttacaaacctggcggcagcgcaaaagatg

SEQ ID NO: 5181 - DNA, 103 bp, Artificial Sequence
  Synthetic Polynucleotide
taatacgactcactatagggtatatctctgccatatccactgccgtttggaacagaggagaccaaacatgagtggatataacctggcggcagcgcaaaagatg

SEQ ID NO: 5182 - DNA, 103 bp, Artificial Sequence
  Synthetic Polynucleotide
taatacgactcactatagggtagtatatatctctgccatatccactgccgaacagaggagacggcagatgatatggcagaacctggcggcagcgcaaaagatg

SEQ ID NO: 5183 - DNA, 103 bp, Artificial Sequence
  Synthetic Polynucleotide
taatacgactcactatagggccacatagtatatatctctgccatatccacaacagaggagagtggatatggcagagataaacctggcggcagcgcaaaagatg

SEQ ID NO: 5184 - DNA, 103 bp, Artificial Sequence
  Synthetic Polynucleotide
taatacgactcactatagggtttggccacatagtatatatctctgccataaacagaggagatatggcatggatatatacaacctggcggcagcgcaaaagatg

SEQ ID NO: 5185 - DNA, 103 bp, Artificial Sequence
  Synthetic Polynucleotide
taatacgactcactatagggtttgctttggccacatagtatatatctctgaacagaggagacagagaatgatactatgtaacctggcggcagcgcaaaagatg

SEQ ID NO: 5186 - DNA, 103 bp, Artificial Sequence
  Synthetic Polynucleotide
taatacgactcactatagggctctgtttgctttggccacatagtatatataacagaggagaatatatatgatgtggccaaacctggcggcagcgcaaaagatg

SEQ ID NO: 5187 - DNA, 103 bp, Artificial Sequence
  Synthetic Polynucleotide
taatacgactcactatagggttggcctctgtttgctttggccacatagtaaacagaggagatactatatggccaaagcaaacctggcggcagcgcaaaagatg

SEQ ID NO: 5188 - DNA, 103 bp, Artificial Sequence
  Synthetic Polynucleotide
taatacgactcactataggggctcgttggcctctgtttgctttggccacaaacagaggagatgtggcatgagcaaacagaacctggcggcagcgcaaaagatg

SEQ ID NO: 5189 - DNA, 103 bp, Artificial Sequence
  Synthetic Polynucleotide
taatacgactcactatagggaacttgctcgttggcctctgtttgctttggaacagaggagaccaaagatgacagaggccaacctggcggcagcgcaaaagatg

SEQ ID NO: 5190 - DNA, 103 bp, Artificial Sequence
  Synthetic Polynucleotide
taatacgactcactatagggaggcaaacttgctcgttggcctctgtttgcaacagaggagagcaaacatgggccaacgaaacctggcggcagcgcaaaagatg

SEQ ID NO: 5191 - DNA, 103 bp, Artificial Sequence
  Synthetic Polynucleotide
taatacgactcactatagggtacatgatacatctgtgtgtaagcagaatgaacagaggagacattctatgtacacacagaacctggcggcagcgcaaaagatg

SEQ ID NO: 5192 - DNA, 103 bp, Artificial Sequence
  Synthetic Polynucleotide
taatacgactcactatagggcatataggcaaacttgctcgttggcctctgaacagaggagacagaggatgacgagcaagaacctggcggcagcgcaaaagatg

SEQ ID NO: 5193 - DNA, 103 bp, Artificial Sequence
  Synthetic Polynucleotide
taatacgactcactatagggcagggcatataggcaaacttgctcgttggcaacagaggagagccaacatgcaagtttgcaacctggcggcagcgcaaaagatg

SEQ ID NO: 5194 - DNA, 103 bp, Artificial Sequence
  Synthetic Polynucleotide
taatacgactcactatagggtcccccagggcatataggcaaacttgctcgaacagaggagacgagcaatgttgcctataaacctggcggcagcgcaaaagatg

SEQ ID NO: 5195 - DNA, 103 bp, Artificial Sequence
  Synthetic Polynucleotide
taatacgactcactatagggtactttcccccagggcatataggcaaacttaacagaggagaaagtttatgtatatgcccaacctggcggcagcgcaaaagatg

SEQ ID NO: 5196 - DNA, 103 bp, Artificial Sequence
  Synthetic Polynucleotide
taatacgactcactatagggttcaatactttcccccagggcatataggcaaacagaggagatgcctaatggccctggggaacctggcggcagcgcaaaagatg

SEQ ID NO: 5197 - DNA, 103 bp, Artificial Sequence
  Synthetic Polynucleotide
taatacgactcactatagggatcgattcaatactttcccccagggcatataacagaggagaatatgcatggggggaaagaacctggcggcagcgcaaaagatg

SEQ ID NO: 5198 - DNA, 103 bp, Artificial Sequence
  Synthetic Polynucleotide
taatacgactcactataggggcctgatcgattcaatactttcccccagggaacagaggagaccctggatgaaagtattgaacctggcggcagcgcaaaagatg

SEQ ID NO: 5199 - DNA, 103 bp, Artificial Sequence
  Synthetic Polynucleotide
taatacgactcactatagggtttctgcctgatcgattcaatactttccccaacagaggagaggggaaatgattgaatcgaacctggcggcagcgcaaaagatg

SEQ ID NO: 5200 - DNA, 103 bp, Artificial Sequence
  Synthetic Polynucleotide
taatacgactcactataggggggcatttctgcctgatcgattcaatacttaacagaggagaaagtatatgatcgatcagaacctggcggcagcgcaaaagatg

SEQ ID NO: 5201 - DNA, 103 bp, Artificial Sequence
  Synthetic Polynucleotide
taatacgactcactatagggccaccgggcatttctgcctgatcgattcaaaacagaggagattgaatatgtcaggcagaaacctggcggcagcgcaaaagatg

SEQ ID NO: 5202 - DNA, 103 bp, Artificial Sequence
  Synthetic Polynucleotide
taatacgactcactatagggctgtctacatgatacatctgtgtgtaagcaaacagaggagatgcttaatgacagatgtaaacctggcggcagcgcaaaagatg

SEQ ID NO: 5203 - DNA, 103 bp, Artificial Sequence
  Synthetic Polynucleotide
taatacgactcactatagggatcatccaccgggcatttctgcctgatcgaaacagaggagatcgatcatgcagaaatgcaacctggcggcagcgcaaaagatg

SEQ ID NO: 5204 - DNA, 103 bp, Artificial Sequence
  Synthetic Polynucleotide
taatacgactcactatagggtctgcatcatccaccgggcatttctgcctgaacagaggagacaggcaatgatgcccggtaacctggcggcagcgcaaaagatg

SEQ ID NO: 5205 - DNA, 103 bp, Artificial Sequence
  Synthetic Polynucleotide
taatacgactcactatagggatgcatctgcatcatccaccgggcatttctaacagaggagaagaaatatgcggtggatgaacctggcggcagcgcaaaagatg

SEQ ID NO: 5206 - DNA, 103 bp, Artificial Sequence
  Synthetic Polynucleotide
taatacgactcactatagggagatgatgcatctgcatcatccaccgggcaaacagaggagatgcccgatggatgatgcaaacctggcggcagcgcaaaagatg

SEQ ID NO: 5207 - DNA, 103 bp, Artificial Sequence
  Synthetic Polynucleotide
taatacgactcactataggggggggagatgatgcatctgcatcatccaccaacagaggagaggtggaatgtgcagatgcaacctggcggcagcgcaaaagatg

SEQ ID NO: 5208 - DNA, 103 bp, Artificial Sequence
  Synthetic Polynucleotide
taatacgactcactatagggttttcgggggagatgatgcatctgcatcataacagaggagaatgatgatgatgcatcataacctggcggcagcgcaaaagatg

SEQ ID NO: 5209 - DNA, 103 bp, Artificial Sequence
  Synthetic Polynucleotide
taatacgactcactataggggacagttttcgggggagatgatgcatctgcaacagaggagagcagatatgtcatctcccaacctggcggcagcgcaaaagatg

SEQ ID NO: 5210 - DNA, 103 bp, Artificial Sequence
  Synthetic Polynucleotide
taatacgactcactatagggcacgggacagttttcgggggagatgatgcaaacagaggagatgcatcatgtcccccgaaaacctggcggcagcgcaaaagatg

SEQ ID NO: 5211 - DNA, 103 bp, Artificial Sequence
  Synthetic Polynucleotide
taatacgactcactatagggagaggcacgggacagttttcgggggagatgaacagaggagacatctcatgcgaaaactgaacctggcggcagcgcaaaagatg

SEQ ID NO: 5212 - DNA, 103 bp, Artificial Sequence
  Synthetic Polynucleotide
taatacgactcactatagggacggcagaggcacgggacagttttcgggggaacagaggagacccccgatgactgtcccgaacctggcggcagcgcaaaagatg

SEQ ID NO: 5213 - DNA, 103 bp, Artificial Sequence
  Synthetic Polynucleotide
taatacgactcactataggggctctctgtctacatgatacatctgtgtgtaacagaggagaacacacatgtgtatcatgaacctggcggcagcgcaaaagatg

SEQ ID NO: 5214 - DNA, 103 bp, Artificial Sequence
  Synthetic Polynucleotide
taatacgactcactataggggcgtaacggcagaggcacgggacagttttcaacagaggagagaaaacatgcccgtgcctaacctggcggcagcgcaaaagatg

SEQ ID NO: 5215 - DNA, 103 bp, Artificial Sequence
  Synthetic Polynucleotide
taatacgactcactatagggtcatggcgtaacggcagaggcacgggacagaacagaggagactgtccatggcctctgccaacctggcggcagcgcaaaagatg

SEQ ID NO: 5216 - DNA, 103 bp, Artificial Sequence
  Synthetic Polynucleotide
taatacgactcactatagggtggtgtcatggcgtaacggcagaggcacggaacagaggagaccgtgcatgtgccgttacaacctggcggcagcgcaaaagatg

SEQ ID NO: 5217 - DNA, 103 bp, Artificial Sequence
  Synthetic Polynucleotide
taatacgactcactatagggcgttctggtgtcatggcgtaacggcagaggaacagaggagacctctgatgttacgccataacctggcggcagcgcaaaagatg

SEQ ID NO: 5218 - DNA, 103 bp, Artificial Sequence
  Synthetic Polynucleotide
taatacgactcactatagggtaacgcgttctggtgtcatggcgtaacggcaacagaggagagccgttatgccatgacacaacctggcggcagcgcaaaagatg

SEQ ID NO: 5219 - DNA, 103 bp, Artificial Sequence
  Synthetic Polynucleotide
taatacgactcactatagggtcgggtaacgcgttctggtgtcatggcgtaaacagaggagatacgccatgacaccagaaaacctggcggcagcgcaaaagatg

SEQ ID NO: 5220 - DNA, 103 bp, Artificial Sequence
  Synthetic Polynucleotide
taatacgactcactatagggcgaagtcgggtaacgcgttctggtgtcatgaacagaggagacatgacatgagaacgcgtaacctggcggcagcgcaaaagatg

SEQ ID NO: 5221 - DNA, 103 bp, Artificial Sequence
  Synthetic Polynucleotide
taatacgactcactatagggtcatgcgaagtcgggtaacgcgttctggtgaacagaggagacaccagatggcgttacccaacctggcggcagcgcaaaagatg

SEQ ID NO: 5222 - DNA, 103 bp, Artificial Sequence
  Synthetic Polynucleotide
taatacgactcactatagggatggttcatgcgaagtcgggtaacgcgttcaacagaggagagaacgcatgacccgacttaacctggcggcagcgcaaaagatg

SEQ ID NO: 5223 - DNA, 103 bp, Artificial Sequence
  Synthetic Polynucleotide
taatacgactcactataggggtgacatggttcatgcgaagtcgggtaacgaacagaggagacgttacatgacttcgcataacctggcggcagcgcaaaagatg

SEQ ID NO: 5224 - DNA, 103 bp, Artificial Sequence
  Synthetic Polynucleotide
taatacgactcactatagggcgtctgctctctgtctacatgatacatctgaacagaggagacagatgatgcatgtagacaacctggcggcagcgcaaaagatg

SEQ ID NO: 5225 - DNA, 103 bp, Artificial Sequence
  Synthetic Polynucleotide
taatacgactcactatagggtgcttgtgacatggttcatgcgaagtcgggaacagaggagacccgacatggcatgaaccaacctggcggcagcgcaaaagatg

SEQ ID NO: 5226 - DNA, 103 bp, Artificial Sequence
  Synthetic Polynucleotide
taatacgactcactatagggaattatgcttgtgacatggttcatgcgaagaacagaggagacttcgcatgaaccatgtcaacctggcggcagcgcaaaagatg

SEQ ID NO: 5227 - DNA, 103 bp, Artificial Sequence
  Synthetic Polynucleotide
taatacgactcactatagggcacacaattatgcttgtgacatggttcatgaacagaggagacatgaaatgtgtcacaagaacctggcggcagcgcaaaagatg

SEQ ID NO: 5228 - DNA, 103 bp, Artificial Sequence
  Synthetic Polynucleotide
taatacgactcactatagggaagaacacacaattatgcttgtgacatggtaacagaggagaaccatgatgcaagcataaaacctggcggcagcgcaaaagatg

SEQ ID NO: 5229 - DNA, 103 bp, Artificial Sequence
  Synthetic Polynucleotide
taatacgactcactatagggaaacgaagaacacacaattatgcttgtgacaacagaggagagtcacaatgataattgtgaacctggcggcagcgcaaaagatg

SEQ ID NO: 5230 - DNA, 103 bp, Artificial Sequence
  Synthetic Polynucleotide
taatacgactcactatagggaggggaaacgaagaacacacaattatgcttaacagaggagaaagcatatgtgtgtgttcaacctggcggcagcgcaaaagatg

SEQ ID NO: 5231 - DNA, 103 bp, Artificial Sequence
  Synthetic Polynucleotide
taatacgactcactatagggttggaaggggaaacgaagaacacacaattaaacagaggagataattgatggttcttcgtaacctggcggcagcgcaaaagatg

SEQ ID NO: 5232 - DNA, 103 bp, Artificial Sequence
  Synthetic Polynucleotide
taatacgactcactataggggtactttggaaggggaaacgaagaacacacaacagaggagagtgtgtatgtcgtttcccaacctggcggcagcgcaaaagatg

SEQ ID NO: 5233 - DNA, 103 bp, Artificial Sequence
  Synthetic Polynucleotide
taatacgactcactatagggattttgtactttggaaggggaaacgaagaaaacagaggagattcttcatgtccccttccaacctggcggcagcgcaaaagatg

SEQ ID NO: 5234 - DNA, 103 bp, Artificial Sequence
  Synthetic Polynucleotide
taatacgactcactatagggcttctattttgtactttggaaggggaaacgaacagaggagacgtttcatgttccaaagtaacctggcggcagcgcaaaagatg

SEQ ID NO: 5235 - DNA, 103 bp, Artificial Sequence
  Synthetic Polynucleotide
taatacgactcactatagggcgcgacgtctgctctctgtctacatgatacaacagaggagagtatcaatgagacagagaaacctggcggcagcgcaaaagatg

SEQ ID NO: 5236 - DNA, 103 bp, Artificial Sequence
  Synthetic Polynucleotide
taatacgactcactatagggcactccttctattttgtactttggaaggggaacagaggagaccccttatgaagtacaaaaacctggcggcagcgcaaaagatg

SEQ ID NO: 5237 - DNA, 103 bp, Artificial Sequence
  Synthetic Polynucleotide
taatacgactcactatagggttttgcactccttctattttgtactttggaaacagaggagatccaaaatgcaaaatagaaacctggcggcagcgcaaaagatg

SEQ ID NO: 5238 - DNA, 103 bp, Artificial Sequence
  Synthetic Polynucleotide
taatacgactcactatagggtgactttttgcactccttctattttgtactaacagaggagaagtacaatgtagaaggagaacctggcggcagcgcaaaagatg

SEQ ID NO: 5239 - DNA, 103 bp, Artificial Sequence
  Synthetic Polynucleotide
taatacgactcactataggggcatttgactttttgcactccttctattttaacagaggagaaaaataatgggagtgcaaaacctggcggcagcgcaaaagatg

SEQ ID NO: 5240 - DNA, 103 bp, Artificial Sequence
  Synthetic Polynucleotide
taatacgactcactatagggttggagcatttgactttttgcactccttctaacagaggagaagaaggatggcaaaaagtaacctggcggcagcgcaaaagatg

SEQ ID NO: 5241 - DNA, 103 bp, Artificial Sequence
  Synthetic Polynucleotide
taatacgactcactatagggttaccttggagcatttgactttttgcactcaacagaggagagagtgcatgaagtcaaataacctggcggcagcgcaaaagatg

SEQ ID NO: 5242 - DNA, 103 bp, Artificial Sequence
  Synthetic Polynucleotide
taatacgactcactatagggtagcattaccttggagcatttgactttttgaacagaggagacaaaaaatgaaatgctccaacctggcggcagcgcaaaagatg

SEQ ID NO: 5243 - DNA, 103 bp, Artificial Sequence
  Synthetic Polynucleotide
taatacgactcactatagggtcaaatagcattaccttggagcatttgactaacagaggagaagtcaaatgctccaaggtaacctggcggcagcgcaaaagatg

SEQ ID NO: 5244 - DNA, 103 bp, Artificial Sequence
  Synthetic Polynucleotide
taatacgactcactatagggtgtggtcaaatagcattaccttggagcattaacagaggagaaatgctatgaggtaatgcaacctggcggcagcgcaaaagatg

SEQ ID NO: 5245 - DNA, 103 bp, Artificial Sequence
  Synthetic Polynucleotide
taatacgactcactatagggcacgttgtggtcaaatagcattaccttggaaacagaggagatccaagatgatgctatttaacctggcggcagcgcaaaagatg

SEQ ID NO: 5246 - DNA, 103 bp, Artificial Sequence
  Synthetic Polynucleotide
taatacgactcactatagggcaagactgccacatgcagtctcccccatgtaacagaggagaacatggatgagactgcataacctggcggcagcgcaaaagatg

SEQ ID NO: 5247 - DNA, 103 bp, Artificial Sequence
  Synthetic Polynucleotide
taatacgactcactatagggtactccacccactgccatataaggtagacgaacagaggagacgtctaatgtatatggcaaacctggcggcagcgcaaaagatg

SEQ ID NO: 5248 - DNA, 103 bp, Artificial Sequence
  Synthetic Polynucleotide
taatacgactcactatagggtcaggacatctttggggcctgatgtgatagaacagaggagactatcaatgcaggccccaaacctggcggcagcgcaaaagatg

SEQ ID NO: 5249 - DNA, 103 bp, Artificial Sequence
  Synthetic Polynucleotide
taatacgactcactatagggttcttcctctggttgtttttccttggagaaaacagaggagattctccatggaaaaacaaaacctggcggcagcgcaaaagatg

SEQ ID NO: 5250 - DNA, 103 bp, Artificial Sequence
  Synthetic Polynucleotide
taatacgactcactatagggtcctcttcttcctctggttgtttttccttgaacagaggagacaaggaatgacaaccagaaacctggcggcagcgcaaaagatg

SEQ ID NO: 5251 - DNA, 103 bp, Artificial Sequence
  Synthetic Polynucleotide
taatacgactcactatagggatttctcctcttcttcctctggttgtttttaacagaggagaaaaaacatgcagaggaagaacctggcggcagcgcaaaagatg

SEQ ID NO: 5252 - DNA, 103 bp, Artificial Sequence
  Synthetic Polynucleotide
taatacgactcactatagggtactgatttctcctcttcttcctctggttgaacagaggagacaaccaatggaagaagagaacctggcggcagcgcaaaagatg

SEQ ID NO: 5253 - DNA, 103 bp, Artificial Sequence
  Synthetic Polynucleotide
taatacgactcactatagggtcatctactgatttctcctcttcttcctctaacagaggagaagaggaatgagaggagaaaacctggcggcagcgcaaaagatg

SEQ ID NO: 5254 - DNA, 103 bp, Artificial Sequence
  Synthetic Polynucleotide
taatacgactcactatagggctggttcatctactgatttctcctcttcttaacagaggagaaagaagatgagaaatcagaacctggcggcagcgcaaaagatg

SEQ ID NO: 5255 - DNA, 103 bp, Artificial Sequence
  Synthetic Polynucleotide
taatacgactcactataggggttgtctggttcatctactgatttctcctcaacagaggagagaggagatgtcagtagataacctggcggcagcgcaaaagatg

SEQ ID NO: 5256 - DNA, 103 bp, Artificial Sequence
  Synthetic Polynucleotide
taatacgactcactatagggttgttgttgtctggttcatctactgatttcaacagaggagagaaatcatgagatgaaccaacctggcggcagcgcaaaagatg

SEQ ID NO: 5257 - DNA, 103 bp, Artificial Sequence
  Synthetic Polynucleotide
taatacgactcactatagggcaactttgttgttgtctggttcatctactgaacagaggagacagtagatgaaccagacaaacctggcggcagcgcaaaagatg

SEQ ID NO: 5258 - DNA, 103 bp, Artificial Sequence
  Synthetic Polynucleotide
taatacgactcactatagggtccctcaactttgttgttgtctggttcatcaacagaggagagatgaaatggacaacaacaacctggcggcagcgcaaaagatg

SEQ ID NO: 5259 - DNA, 103 bp, Artificial Sequence
  Synthetic Polynucleotide
taatacgactcactatagggtaccttcaggacatctttggggcctgatgtaacagaggagaacatcaatgcccaaagataacctggcggcagcgcaaaagatg

SEQ ID NO: 5260 - DNA, 103 bp, Artificial Sequence
  Synthetic Polynucleotide
taatacgactcactatagggtagggtccctcaactttgttgttgtctggtaacagaggagaaccagaatgcaacaaagtaacctggcggcagcgcaaaagatg

SEQ ID NO: 5261 - DNA, 103 bp, Artificial Sequence
  Synthetic Polynucleotide
taatacgactcactatagggtgttgtagggtccctcaactttgttgttgtaacagaggagaacaacaatgaagttgaggaacctggcggcagcgcaaaagatg

SEQ ID NO: 5262 - DNA, 103 bp, Artificial Sequence
  Synthetic Polynucleotide
taatacgactcactatagggaatattgttgtagggtccctcaactttgttaacagaggagaaacaaaatggagggacccaacctggcggcagcgcaaaagatg

SEQ ID NO: 5263 - DNA, 103 bp, Artificial Sequence
  Synthetic Polynucleotide
taatacgactcactatagggtttgaaatattgttgtagggtccctcaactaacagaggagaagttgaatgaccctacaaaacctggcggcagcgcaaaagatg

SEQ ID NO: 5264 - DNA, 103 bp, Artificial Sequence
  Synthetic Polynucleotide
taatacgactcactatagggggtcctttgaaatattgttgtagggtccctaacagaggagaagggacatgacaacaataaacctggcggcagcgcaaaagatg

SEQ ID NO: 5265 - DNA, 103 bp, Artificial Sequence
  Synthetic Polynucleotide
taatacgactcactatagggcttaaggtcctttgaaatattgttgtagggaacagaggagaccctacatgaatatttcaaacctggcggcagcgcaaaagatg

SEQ ID NO: 5266 - DNA, 103 bp, Artificial Sequence
  Synthetic Polynucleotide
taatacgactcactatagggaacttcttaaggtcctttgaaatattgttgaacagaggagacaacaaatgttcaaaggaaacctggcggcagcgcaaaagatg

SEQ ID NO: 5267 - DNA, 103 bp, Artificial Sequence
  Synthetic Polynucleotide
taatacgactcactataggggttttaacttcttaaggtcctttgaaatataacagaggagaatatttatgaggaccttaaacctggcggcagcgcaaaagatg

SEQ ID NO: 5268 - DNA, 103 bp, Artificial Sequence
  Synthetic Polynucleotide
taatacgactcactatagggtctaagttttaacttcttaaggtcctttgaaacagaggagatcaaagatgcttaagaagaacctggcggcagcgcaaaagatg

SEQ ID NO: 5269 - DNA, 103 bp, Artificial Sequence
  Synthetic Polynucleotide
taatacgactcactatagggtgtactctaagttttaacttcttaaggtccaacagaggagaggacctatggaagttaaaaacctggcggcagcgcaaaagatg

SEQ ID NO: 5270 - DNA, 103 bp, Artificial Sequence
  Synthetic Polynucleotide
taatacgactcactatagggcagggtaccttcaggacatctttggggcctaacagaggagaaggcccatgagatgtcctaacctggcggcagcgcaaaagatg

SEQ ID NO: 5271 - DNA, 103 bp, Artificial Sequence
  Synthetic Polynucleotide
taatacgactcactataggggagtttgtactctaagttttaacttcttaaaacagaggagattaagaatgtaaaacttaaacctggcggcagcgcaaaagatg

SEQ ID NO: 5272 - DNA, 103 bp, Artificial Sequence
  Synthetic Polynucleotide
taatacgactcactatagggtataggagtttgtactctaagttttaacttaacagaggagaaagttaatgcttagagtaaacctggcggcagcgcaaaagatg

SEQ ID NO: 5273 - DNA, 103 bp, Artificial Sequence
  Synthetic Polynucleotide
taatacgactcactatagggtccattataggagtttgtactctaagttttaacagaggagaaaaactatgagtacaaacaacctggcggcagcgcaaaagatg

SEQ ID NO: 5274 - DNA, 103 bp, Artificial Sequence
  Synthetic Polynucleotide
taatacgactcactatagggcaaggtccattataggagtttgtactctaaaacagaggagattagagatgaaactcctaaacctggcggcagcgcaaaagatg

SEQ ID NO: 5275 - DNA, 103 bp, Artificial Sequence
  Synthetic Polynucleotide
taatacgactcactatagggcttctcaaggtccattataggagtttgtacaacagaggagagtacaaatgcctataatgaacctggcggcagcgcaaaagatg

SEQ ID NO: 5276 - DNA, 103 bp, Artificial Sequence
  Synthetic Polynucleotide
taatacgactcactatagggattttcttctcaaggtccattataggagttaacagaggagaaactccatgaatggacctaacctggcggcagcgcaaaagatg

SEQ ID NO: 5277 - DNA, 103 bp, Artificial Sequence
  Synthetic Polynucleotide
taatacgactcactatagggttgaaattttcttctcaaggtccattatagaacagaggagactataaatgaccttgagaaacctggcggcagcgcaaaagatg

SEQ ID NO: 5278 - DNA, 103 bp, Artificial Sequence
  Synthetic Polynucleotide
taatacgactcactatagggattctttgaaattttcttctcaaggtccataacagaggagaatggacatggagaagaaaaacctggcggcagcgcaaaagatg

SEQ ID NO: 5279 - DNA, 103 bp, Artificial Sequence
  Synthetic Polynucleotide
taatacgactcactatagggaacacattctttgaaattttcttctcaaggaacagaggagaccttgaatggaaaatttcaacctggcggcagcgcaaaagatg

SEQ ID NO: 5280 - DNA, 103 bp, Artificial Sequence
  Synthetic Polynucleotide
taatacgactcactatagggagggtaacacattctttgaaattttcttctaacagaggagaagaagaatgtttcaaagaaacctggcggcagcgcaaaagatg

SEQ ID NO: 5281 - DNA, 103 bp, Artificial Sequence
  Synthetic Polynucleotide
taatacgactcactatagggatacacagggtaccttcaggacatctttggaacagaggagaccaaagatgtcctgaaggaacctggcggcagcgcaaaagatg

SEQ ID NO: 5282 - DNA, 103 bp, Artificial Sequence
  Synthetic Polynucleotide
taatacgactcactatagggcttaaagggtaacacattctttgaaattttaacagaggagaaaaattatgaagaatgtgaacctggcggcagcgcaaaagatg

SEQ ID NO: 5283 - DNA, 103 bp, Artificial Sequence
  Synthetic Polynucleotide
taatacgactcactatagggtttaacttaaagggtaacacattctttgaaaacagaggagattcaaaatgtgtgttaccaacctggcggcagcgcaaaagatg

SEQ ID NO: 5284 - DNA, 103 bp, Artificial Sequence
  Synthetic Polynucleotide
taatacgactcactatagggatatatttaacttaaagggtaacacattctaacagaggagaagaatgatgtaccctttaaacctggcggcagcgcaaaagatg

SEQ ID NO: 5285 - DNA, 103 bp, Artificial Sequence
  Synthetic Polynucleotide
taatacgactcactataggggcctaatatatttaacttaaagggtaacacaacagaggagagtgttaatgtttaagttaaacctggcggcagcgcaaaagatg

SEQ ID NO: 5286 - DNA, 103 bp, Artificial Sequence
  Synthetic Polynucleotide
taatacgactcactatagggttcttgcctaatatatttaacttaaagggtaacagaggagaacccttatggttaaatataacctggcggcagcgcaaaagatg

SEQ ID NO: 5287 - DNA, 103 bp, Artificial Sequence
  Synthetic Polynucleotide
taatacgactcactatagggtgtagttcttgcctaatatatttaacttaaaacagaggagattaagtatgatatattagaacctggcggcagcgcaaaagatg

SEQ ID NO: 5288 - DNA, 103 bp, Artificial Sequence
  Synthetic Polynucleotide
taatacgactcactatagggttgtgtgtagttcttgcctaatatatttaaaacagaggagattaaatatgttaggcaagaacctggcggcagcgcaaaagatg

SEQ ID NO: 5289 - DNA, 103 bp, Artificial Sequence
  Synthetic Polynucleotide
taatacgactcactatagggcatgattgtgtgtagttcttgcctaatataaacagaggagatatattatgcaagaactaaacctggcggcagcgcaaaagatg

SEQ ID NO: 5290 - DNA, 103 bp, Artificial Sequence
  Synthetic Polynucleotide
taatacgactcactatagggctacacatgattgtgtgtagttcttgcctaaacagaggagataggcaatgactacacacaacctggcggcagcgcaaaagatg

SEQ ID NO: 5291 - DNA, 103 bp, Artificial Sequence
  Synthetic Polynucleotide
taatacgactcactatagggtattgctacacatgattgtgtgtagttcttaacagaggagaaagaacatgacacaatcaaacctggcggcagcgcaaaagatg

SEQ ID NO: 5292 - DNA, 103 bp, Artificial Sequence
  Synthetic Polynucleotide
taatacgactcactatagggctcagatacacagggtaccttcaggacatcaacagaggagagatgtcatgaaggtacccaacctggcggcagcgcaaaagatg

SEQ ID NO: 5293 - DNA, 103 bp, Artificial Sequence
  Synthetic Polynucleotide
taatacgactcactatagggttccctattgctacacatgattgtgtgtagaacagaggagactacacatgatcatgtgtaacctggcggcagcgcaaaagatg

SEQ ID NO: 5294 - DNA, 103 bp, Artificial Sequence
  Synthetic Polynucleotide
taatacgactcactatagggctcttttccctattgctacacatgattgtgaacagaggagacacaatatggtgtagcaaaacctggcggcagcgcaaaagatg

SEQ ID NO: 5295 - DNA, 103 bp, Artificial Sequence
  Synthetic Polynucleotide
taatacgactcactatagggaatcactcttttccctattgctacacatgaaacagaggagatcatgtatggcaatagggaacctggcggcagcgcaaaagatg

SEQ ID NO: 5296 - DNA, 103 bp, Artificial Sequence
  Synthetic Polynucleotide
taatacgactcactatagggacaataatcactcttttccctattgctacaaacagaggagatgtagcatgagggaaaagaacctggcggcagcgcaaaagatg

SEQ ID NO: 5297 - DNA, 103 bp, Artificial Sequence
  Synthetic Polynucleotide
taatacgactcactatagggtattgacaataatcactcttttccctattgaacagaggagacaatagatgaaagagtgaaacctggcggcagcgcaaaagatg

SEQ ID NO: 5298 - DNA, 103 bp, Artificial Sequence
  Synthetic Polynucleotide
taatacgactcactatagggatgcttattgacaataatcactcttttcccaacagaggagagggaaaatggtgattattaacctggcggcagcgcaaaagatg

SEQ ID NO: 5299 - DNA, 103 bp, Artificial Sequence
  Synthetic Polynucleotide
taatacgactcactatagggacagcatgcttattgacaataatcactcttaacagaggagaaagagtatgtattgtcaaaacctggcggcagcgcaaaagatg

SEQ ID NO: 5300 - DNA, 103 bp, Artificial Sequence
  Synthetic Polynucleotide
taatacgactcactatagggattctacagcatgcttattgacaataatcaaacagaggagatgattaatgtcaataagcaacctggcggcagcgcaaaagatg

SEQ ID NO: 5301 - DNA, 103 bp, Artificial Sequence
  Synthetic Polynucleotide
taatacgactcactatagggtagacattctacagcatgcttattgacaataacagaggagaattgtcatgaagcatgctaacctggcggcagcgcaaaagatg

SEQ ID NO: 5302 - DNA, 103 bp, Artificial Sequence
  Synthetic Polynucleotide
taatacgactcactatagggtcatctagacattctacagcatgcttattgaacagaggagacaataaatgtgctgtagaaacctggcggcagcgcaaaagatg

SEQ ID NO: 5303 - DNA, 103 bp, Artificial Sequence
  Synthetic Polynucleotide
taatacgactcactatagggtcatcctcagatacacagggtaccttcaggaacagaggagacctgaaatgaccctgtgtaacctggcggcagcgcaaaagatg

SEQ ID NO: 5304 - DNA, 103 bp, Artificial Sequence
  Synthetic Polynucleotide
taatacgactcactatagggacacttcatctagacattctacagcatgctaacagaggagaagcatgatgtagaatgtcaacctggcggcagcgcaaaagatg

SEQ ID NO: 5305 - DNA, 103 bp, Artificial Sequence
  Synthetic Polynucleotide
taatacgactcactatagggataaaacacttcatctagacattctacagcaacagaggagagctgtaatgtgtctagataacctggcggcagcgcaaaagatg

SEQ ID NO: 5306 - DNA, 103 bp, Artificial Sequence
  Synthetic Polynucleotide
taatacgactcactatagggcccacataaaacacttcatctagacattctaacagaggagaagaatgatgagatgaagtaacctggcggcagcgcaaaagatg

SEQ ID NO: 5307 - DNA, 103 bp, Artificial Sequence
  Synthetic Polynucleotide
taatacgactcactatagggtctcacccacataaaacacttcatctagacaacagaggagagtctagatgaagtgttttaacctggcggcagcgcaaaagatg

SEQ ID NO: 5308 - DNA, 103 bp, Artificial Sequence
  Synthetic Polynucleotide
taatacgactcactatagggttgtttctcacccacataaaacacttcatcaacagaggagagatgaaatgttttatgtgaacctggcggcagcgcaaaagatg

SEQ ID NO: 5309 - DNA, 103 bp, Artificial Sequence
  Synthetic Polynucleotide
taatacgactcactatagggctatattgtttctcacccacataaaacactaacagaggagaagtgttatgtgtgggtgaaacctggcggcagcgcaaaagatg

SEQ ID NO: 5310 - DNA, 103 bp, Artificial Sequence
  Synthetic Polynucleotide
taatacgactcactatagggaaagcctatattgtttctcacccacataaaaacagaggagatttatgatggtgagaaacaacctggcggcagcgcaaaagatg

SEQ ID NO: 5311 - DNA, 103 bp, Artificial Sequence
  Synthetic Polynucleotide
taatacgactcactatagggctctgaaagcctatattgtttctcacccacaacagaggagagtgggtatgaaacaatataacctggcggcagcgcaaaagatg

SEQ ID NO: 5312 - DNA, 103 bp, Artificial Sequence
  Synthetic Polynucleotide
taatacgactcactatagggtcacactctgaaagcctatattgtttctcaaacagaggagatgagaaatgatataggctaacctggcggcagcgcaaaagatg

SEQ ID NO: 5313 - DNA, 103 bp, Artificial Sequence
  Synthetic Polynucleotide
taatacgactcactatagggaaaattcacactctgaaagcctatattgttaacagaggagaaacaatatgggctttcagaacctggcggcagcgcaaaagatg

SEQ ID NO: 5314 - DNA, 103 bp, Artificial Sequence
  Synthetic Polynucleotide
taatacgactcactatagggggtgctcatcctcagatacacagggtacctaacagaggagaaggtacatggtgtatctgaacctggcggcagcgcaaaagatg

SEQ ID NO: 5315 - DNA, 103 bp, Artificial Sequence
  Synthetic Polynucleotide
taatacgactcactatagggggcacaaaattcacactctgaaagcctataaacagaggagatataggatgtcagagtgtaacctggcggcagcgcaaaagatg

SEQ ID NO: 5316 - DNA, 103 bp, Artificial Sequence
  Synthetic Polynucleotide
taatacgactcactatagggtcaagggcacaaaattcacactctgaaagcaacagaggagagctttcatggtgtgaattaacctggcggcagcgcaaaagatg

SEQ ID NO: 5317 - DNA, 103 bp, Artificial Sequence
  Synthetic Polynucleotide
taatacgactcactatagggctgtttcaagggcacaaaattcacactctgaacagaggagacagagtatgaattttgtgaacctggcggcagcgcaaaagatg

SEQ ID NO: 5318 - DNA, 103 bp, Artificial Sequence
  Synthetic Polynucleotide
taatacgactcactatagggtttgtctgtttcaagggcacaaaattcacaaacagaggagatgtgaaatgtgtgcccttaacctggcggcagcgcaaaagatg

SEQ ID NO: 5319 - DNA, 103 bp, Artificial Sequence
  Synthetic Polynucleotide
taatacgactcactatagggactcctttgtctgtttcaagggcacaaaataacagaggagaattttgatgccttgaaacaacctggcggcagcgcaaaagatg

SEQ ID NO: 5320 - DNA, 103 bp, Artificial Sequence
  Synthetic Polynucleotide
taatacgactcactatagggcacacactcctttgtctgtttcaagggcacaacagaggagagtgcccatgaaacagacaaacctggcggcagcgcaaaagatg

SEQ ID NO: 5321 - DNA, 103 bp, Artificial Sequence
  Synthetic Polynucleotide
taatacgactcactatagggcacatcacacactcctttgtctgtttcaagaacagaggagacttgaaatggacaaaggaaacctggcggcagcgcaaaagatg

SEQ ID NO: 5322 - DNA, 103 bp, Artificial Sequence
  Synthetic Polynucleotide
taatacgactcactataggggcagccacatcacacactcctttgtctgttaacagaggagaaacagaatgaggagtgtgaacctggcggcagcgcaaaagatg

SEQ ID NO: 5323 - DNA, 103 bp, Artificial Sequence
  Synthetic Polynucleotide
taatacgactcactatagggtaatagcagccacatcacacactcctttgtaacagaggagaacaaagatgtgtgtgatgaacctggcggcagcgcaaaagatg

SEQ ID NO: 5324 - DNA, 103 bp, Artificial Sequence
  Synthetic Polynucleotide
taatacgactcactataggggagtttaatagcagccacatcacacactccaacagaggagaggagtgatggatgtggctaacctggcggcagcgcaaaagatg

SEQ ID NO: 5325 - DNA, 103 bp, Artificial Sequence
  Synthetic Polynucleotide
taatacgactcactatagggtcggtggtgctcatcctcagatacacagggaacagaggagaccctgtatgtctgaggataacctggcggcagcgcaaaagatg

SEQ ID NO: 5326 - DNA, 103 bp, Artificial Sequence
  Synthetic Polynucleotide
taatacgactcactatagggttggggagtttaatagcagccacatcacacaacagaggagagtgtgaatgggctgctataacctggcggcagcgcaaaagatg

SEQ ID NO: 5327 - DNA, 103 bp, Artificial Sequence
  Synthetic Polynucleotide
taatacgactcactatagggggccattggggagtttaatagcagccacataacagaggagaatgtggatgctattaaacaacctggcggcagcgcaaaagatg

SEQ ID NO: 5328 - DNA, 103 bp, Artificial Sequence
  Synthetic Polynucleotide
taatacgactcactatagggctctgggccattggggagtttaatagcagcaacagaggagagctgctatgaaactccccaacctggcggcagcgcaaaagatg

SEQ ID NO: 5329 - DNA, 103 bp, Artificial Sequence
  Synthetic Polynucleotide
taatacgactcactatagggttaaactctgggccattggggagtttaataaacagaggagatattaaatgccccaatggaacctggcggcagcgcaaaagatg

SEQ ID NO: 5330 - DNA, 103 bp, Artificial Sequence
  Synthetic Polynucleotide
taatacgactcactatagggtatttttaaactctgggccattggggagttaacagaggagaaactccatgatggcccagaacctggcggcagcgcaaaagatg

SEQ ID NO: 5331 - DNA, 103 bp, Artificial Sequence
  Synthetic Polynucleotide
taatacgactcactataggggacaatatttttaaactctgggccattgggaacagaggagacccaatatgccagagtttaacctggcggcagcgcaaaagatg

SEQ ID NO: 5332 - DNA, 103 bp, Artificial Sequence
  Synthetic Polynucleotide
taatacgactcactatagggaaattgacaatatttttaaactctgggccaaacagaggagatggcccatggtttaaaaaaacctggcggcagcgcaaaagatg

SEQ ID NO: 5333 - DNA, 103 bp, Artificial Sequence
  Synthetic Polynucleotide
taatacgactcactatagggcaaacaaattgacaatatttttaaactctgaacagaggagacagagtatgaaaatattgaacctggcggcagcgcaaaagatg

SEQ ID NO: 5334 - DNA, 103 bp, Artificial Sequence
  Synthetic Polynucleotide
taatacgactcactatagggagggacaaacaaattgacaatatttttaaaaacagaggagatttaaaatgattgtcaataacctggcggcagcgcaaaagatg

SEQ ID NO: 5335 - DNA, 103 bp, Artificial Sequence
  Synthetic Polynucleotide
taatacgactcactataggggagtaagggacaaacaaattgacaatatttaacagaggagaaaatatatgcaatttgttaacctggcggcagcgcaaaagatg

SEQ ID NO: 5336 - DNA, 103 bp, Artificial Sequence
  Synthetic Polynucleotide
taatacgactcactatagggggtagtcggtggtgctcatcctcagatacaaacagaggagatgtatcatgggatgagcaaacctggcggcagcgcaaaagatg

SEQ ID NO: 5337 - DNA, 103 bp, Artificial Sequence
  Synthetic Polynucleotide
taatacgactcactatagggatgcagagtaagggacaaacaaattgacaaaacagaggagattgtcaatgtgtttgtccaacctggcggcagcgcaaaagatg

SEQ ID NO: 5338 - DNA, 103 bp, Artificial Sequence
  Synthetic Polynucleotide
taatacgactcactatagggcaaagatgcagagtaagggacaaacaaattaacagaggagaaatttgatggtcccttacaacctggcggcagcgcaaaagatg

SEQ ID NO: 5339 - DNA, 103 bp, Artificial Sequence
  Synthetic Polynucleotide
taatacgactcactataggggcgtgcaaagatgcagagtaagggacaaacaacagaggagagtttgtatgttactctgcaacctggcggcagcgcaaaagatg

SEQ ID NO: 5340 - DNA, 103 bp, Artificial Sequence
  Synthetic Polynucleotide
taatacgactcactatagggttccagcgtgcaaagatgcagagtaagggaaacagaggagatcccttatgctgcatcttaacctggcggcagcgcaaaagatg

SEQ ID NO: 5341 - DNA, 103 bp, Artificial Sequence
  Synthetic Polynucleotide
taatacgactcactatagggtctggttccagcgtgcaaagatgcagagtaaacagaggagatactctatgtctttgcacaacctggcggcagcgcaaaagatg

SEQ ID NO: 5342 - DNA, 103 bp, Artificial Sequence
  Synthetic Polynucleotide
taatacgactcactatagggacaagtctggttccagcgtgcaaagatgcaaacagaggagatgcatcatggcacgctggaacctggcggcagcgcaaaagatg

SEQ ID NO: 5343 - DNA, 103 bp, Artificial Sequence
  Synthetic Polynucleotide
taatacgactcactataggggaatcacaagtctggttccagcgtgcaaagaacagaggagactttgcatgctggaaccaaacctggcggcagcgcaaaagatg

SEQ ID NO: 5344 - DNA, 103 bp, Artificial Sequence
  Synthetic Polynucleotide
taatacgactcactatagggagaaagaatcacaagtctggttccagcgtgaacagaggagacacgctatgaccagacttaacctggcggcagcgcaaaagatg

SEQ ID NO: 5345 - DNA, 103 bp, Artificial Sequence
  Synthetic Polynucleotide
taatacgactcactatagggtcattagaaagaatcacaagtctggttccaaacagaggagatggaacatgacttgtgataacctggcggcagcgcaaaagatg

SEQ ID NO: 5346 - DNA, 103 bp, Artificial Sequence
  Synthetic Polynucleotide
taatacgactcactatagggtgtcatcattagaaagaatcacaagtctggaacagaggagaccagacatgtgattctttaacctggcggcagcgcaaaagatg

SEQ ID NO: 5347 - DNA, 103 bp, Artificial Sequence
  Synthetic Polynucleotide
taatacgactcactataggggtccgggtagtcggtggtgctcatcctcagaacagaggagactgaggatgagcaccaccaacctggcggcagcgcaaaagatg

SEQ ID NO: 5348 - DNA, 103 bp, Artificial Sequence
  Synthetic Polynucleotide
taatacgactcactatagggctgaatgtcatcattagaaagaatcacaagaacagaggagacttgtgatgctttctaataacctggcggcagcgcaaaagatg

SEQ ID NO: 5349 - DNA, 103 bp, Artificial Sequence
  Synthetic Polynucleotide
taatacgactcactatagggaccatctgaatgtcatcattagaaagaatcaacagaggagagattctatgtaatgatgaaacctggcggcagcgcaaaagatg

SEQ ID NO: 5350 - DNA, 103 bp, Artificial Sequence
  Synthetic Polynucleotide
taatacgactcactatagggcacgtaccatctgaatgtcatcattagaaaaacagaggagatttctaatgatgacattcaacctggcggcagcgcaaaagatg

SEQ ID NO: 5351 - DNA, 103 bp, Artificial Sequence
  Synthetic Polynucleotide
taatacgactcactatagggaccctcacgtaccatctgaatgtcatcattaacagaggagaaatgatatgattcagatgaacctggcggcagcgcaaaagatg

SEQ ID NO: 5352 - DNA, 103 bp, Artificial Sequence
  Synthetic Polynucleotide
taatacgactcactatagggaaagaaccctcacgtaccatctgaatgtcaaacagaggagatgacatatggatggtacgaacctggcggcagcgcaaaagatg

SEQ ID NO: 5353 - DNA, 103 bp, Artificial Sequence
  Synthetic Polynucleotide
taatacgactcactatagggtaagaaaagaaccctcacgtaccatctgaaaacagaggagattcagaatgtacgtgaggaacctggcggcagcgcaaaagatg

SEQ ID NO: 5354 - DNA, 103 bp, Artificial Sequence
  Synthetic Polynucleotide
taatacgactcactatagggatttctaagaaaagaaccctcacgtaccataacagaggagaatggtaatggagggttctaacctggcggcagcgcaaaagatg

SEQ ID NO: 5355 - DNA, 103 bp, Artificial Sequence
  Synthetic Polynucleotide
taatacgactcactatagggtcttcatttctaagaaaagaaccctcacgtaacagaggagaacgtgaatgttcttttctaacctggcggcagcgcaaaagatg

SEQ ID NO: 5356 - DNA, 103 bp, Artificial Sequence
  Synthetic Polynucleotide
taatacgactcactatagggcgtaatcttcatttctaagaaaagaaccctaacagaggagaagggttatgttcttagaaaacctggcggcagcgcaaaagatg

SEQ ID NO: 5357 - DNA, 103 bp, Artificial Sequence
  Synthetic Polynucleotide
taatacgactcactatagggagggacgtaatcttcatttctaagaaaagaaacagaggagatcttttatgagaaatgaaaacctggcggcagcgcaaaagatg

SEQ ID NO: 5358 - DNA, 103 bp, Artificial Sequence
  Synthetic Polynucleotide
taatacgactcactatagggtgcagtactccacccactgccatataaggtaacagaggagaaccttaatgggcagtgggaacctggcggcagcgcaaaagatg

SEQ ID NO: 5359 - DNA, 103 bp, Artificial Sequence
  Synthetic Polynucleotide
taatacgactcactatagggtgcaagtccgggtagtcggtggtgctcatcaacagaggagagatgagatgcaccgactaaacctggcggcagcgcaaaagatg

SEQ ID NO: 5360 - DNA, 103 bp, Artificial Sequence
  Synthetic Polynucleotide
taatacgactcactatagggttagtagggacgtaatcttcatttctaagaaacagaggagatcttagatgtgaagattaaacctggcggcagcgcaaaagatg

SEQ ID NO: 5361 - DNA, 103 bp, Artificial Sequence
  Synthetic Polynucleotide
taatacgactcactatagggctatattagtagggacgtaatcttcatttcaacagaggagagaaatgatgattacgtccaacctggcggcagcgcaaaagatg

SEQ ID NO: 5362 - DNA, 103 bp, Artificial Sequence
  Synthetic Polynucleotide
taatacgactcactataggggtcacctatattagtagggacgtaatcttcaacagaggagagaagatatggtccctactaacctggcggcagcgcaaaagatg

SEQ ID NO: 5363 - DNA, 103 bp, Artificial Sequence
  Synthetic Polynucleotide
taatacgactcactataggggggatgtcacctatattagtagggacgtaaaacagaggagattacgtatgtactaatataacctggcggcagcgcaaaagatg

SEQ ID NO: 5364 - DNA, 103 bp, Artificial Sequence
  Synthetic Polynucleotide
taatacgactcactatagggcacaagggatgtcacctatattagtagggaaacagaggagatccctaatgatataggtgaacctggcggcagcgcaaaagatg

SEQ ID NO: 5365 - DNA, 103 bp, Artificial Sequence
  Synthetic Polynucleotide
taatacgactcactatagggaaacacacaagggatgtcacctatattagtaacagaggagaactaatatgggtgacatcaacctggcggcagcgcaaaagatg

SEQ ID NO: 5366 - DNA, 103 bp, Artificial Sequence
  Synthetic Polynucleotide
taatacgactcactatagggtacaaaaacacacaagggatgtcacctataaacagaggagatataggatgcatcccttgaacctggcggcagcgcaaaagatg

SEQ ID NO: 5367 - DNA, 103 bp, Artificial Sequence
  Synthetic Polynucleotide
taatacgactcactatagggctttgtacaaaaacacacaagggatgtcacaacagaggagagtgacaatgcttgtgtgtaacctggcggcagcgcaaaagatg

SEQ ID NO: 5368 - DNA, 103 bp, Artificial Sequence
  Synthetic Polynucleotide
taatacgactcactatagggtgaagctttgtacaaaaacacacaagggataacagaggagaatccctatggtgtttttgaacctggcggcagcgcaaaagatg

SEQ ID NO: 5369 - DNA, 103 bp, Artificial Sequence
  Synthetic Polynucleotide
taatacgactcactatagggtaggatgaagctttgtacaaaaacacacaaaacagaggagattgtgtatgtttgtacaaaacctggcggcagcgcaaaagatg

SEQ ID NO: 5370 - DNA, 103 bp, Artificial Sequence
  Synthetic Polynucleotide
taatacgactcactataggggctaatgcaagtccgggtagtcggtggtgcaacagaggagagcaccaatgactacccggaacctggcggcagcgcaaaagatg

SEQ ID NO: 5371 - DNA, 103 bp, Artificial Sequence
  Synthetic Polynucleotide
taatacgactcactatagggcaaagtaggatgaagctttgtacaaaaacaaacagaggagatgttttatgacaaagcttaacctggcggcagcgcaaaagatg

SEQ ID NO: 5372 - DNA, 103 bp, Artificial Sequence
  Synthetic Polynucleotide
taatacgactcactatagggcataccaaagtaggatgaagctttgtacaaaacagaggagattgtacatggcttcatccaacctggcggcagcgcaaaagatg

SEQ ID NO: 5373 - DNA, 103 bp, Artificial Sequence
  Synthetic Polynucleotide
taatacgactcactatagggccacacataccaaagtaggatgaagctttgaacagaggagacaaagcatgatcctacttaacctggcggcagcgcaaaagatg

SEQ ID NO: 5374 - DNA, 103 bp, Artificial Sequence
  Synthetic Polynucleotide
taatacgactcactatagggctgaaccacacataccaaagtaggatgaagaacagaggagacttcatatgactttggtaaacctggcggcagcgcaaaagatg

SEQ ID NO: 5375 - DNA, 103 bp, Artificial Sequence
  Synthetic Polynucleotide
taatacgactcactatagggaactactgaaccacacataccaaagtaggaaacagaggagatcctacatgggtatgtgtaacctggcggcagcgcaaaagatg

SEQ ID NO: 5376 - DNA, 103 bp, Artificial Sequence
  Synthetic Polynucleotide
taatacgactcactataggggttgaaactactgaaccacacataccaaagaacagaggagactttggatggtgtggttcaacctggcggcagcgcaaaagatg

SEQ ID NO: 5377 - DNA, 103 bp, Artificial Sequence
  Synthetic Polynucleotide
taatacgactcactatagggatcttgttgaaactactgaaccacacatacaacagaggagagtatgtatggttcagtagaacctggcggcagcgcaaaagatg

SEQ ID NO: 5378 - DNA, 103 bp, Artificial Sequence
  Synthetic Polynucleotide
taatacgactcactatagggtgaaaatcttgttgaaactactgaaccacaaacagaggagatgtggtatggtagtttcaaacctggcggcagcgcaaaagatg

SEQ ID NO: 5379 - DNA, 103 bp, Artificial Sequence
  Synthetic Polynucleotide
taatacgactcactatagggttatctgaaaatcttgttgaaactactgaaaacagaggagattcagtatgttcaacaagaacctggcggcagcgcaaaagatg

SEQ ID NO: 5380 - DNA, 103 bp, Artificial Sequence
  Synthetic Polynucleotide
taatacgactcactatagggcagggttatctgaaaatcttgttgaaactaaacagaggagatagtttatgcaagattttaacctggcggcagcgcaaaagatg

SEQ ID NO: 5381 - DNA, 103 bp, Artificial Sequence
  Synthetic Polynucleotide
taatacgactcactatagggtgtctgctaatgcaagtccgggtagtcggtaacagaggagaaccgacatgccggacttgaacctggcggcagcgcaaaagatg

SEQ ID NO: 5382 - DNA, 103 bp, Artificial Sequence
  Synthetic Polynucleotide
taatacgactcactatagggaataccagggttatctgaaaatcttgttgaaacagaggagatcaacaatgttttcagataacctggcggcagcgcaaaagatg

SEQ ID NO: 5383 - DNA, 103 bp, Artificial Sequence
  Synthetic Polynucleotide
taatacgactcactatagggccaagaataccagggttatctgaaaatcttaacagaggagaaagattatgagataacccaacctggcggcagcgcaaaagatg

SEQ ID NO: 5384 - DNA, 103 bp, Artificial Sequence
  Synthetic Polynucleotide
taatacgactcactatagggggatgccaagaataccagggttatctgaaaaacagaggagatttcagatgaccctggtaaacctggcggcagcgcaaaagatg

SEQ ID NO: 5385 - DNA, 103 bp, Artificial Sequence
  Synthetic Polynucleotide
taatacgactcactatagggacaatggatgccaagaataccagggttatcaacagaggagagataacatgggtattcttaacctggcggcagcgcaaaagatg

SEQ ID NO: 5386 - DNA, 103 bp, Artificial Sequence
  Synthetic Polynucleotide
taatacgactcactatagggccggcacaatggatgccaagaataccagggaacagaggagaccctggatgtcttggcataacctggcggcagcgcaaaagatg

SEQ ID NO: 5387 - DNA, 103 bp, Artificial Sequence
  Synthetic Polynucleotide
taatacgactcactatagggcgccaccggcacaatggatgccaagaatacaacagaggagagtattcatggcatccattaacctggcggcagcgcaaaagatg

SEQ ID NO: 5388 - DNA, 103 bp, Artificial Sequence
  Synthetic Polynucleotide
taatacgactcactatagggacctccgccaccggcacaatggatgccaagaacagaggagacttggcatgcattgtgccaacctggcggcagcgcaaaagatg

SEQ ID NO: 5389 - DNA, 103 bp, Artificial Sequence
  Synthetic Polynucleotide
taatacgactcactatagggcacacacctccgccaccggcacaatggatgaacagaggagacatccaatgtgccggtggaacctggcggcagcgcaaaagatg

SEQ ID NO: 5390 - DNA, 103 bp, Artificial Sequence
  Synthetic Polynucleotide
taatacgactcactatagggccacacacacacctccgccaccggcacaataacagaggagaattgtgatggtggcggagaacctggcggcagcgcaaaagatg

SEQ ID NO: 5391 - DNA, 103 bp, Artificial Sequence
  Synthetic Polynucleotide
taatacgactcactatagggcgctgccacacacacacctccgccaccggcaacagaggagagccggtatgggaggtgtgaacctggcggcagcgcaaaagatg

SEQ ID NO: 5392 - DNA, 103 bp, Artificial Sequence
  Synthetic Polynucleotide
taatacgactcactatagggacatgtgtctgctaatgcaagtccgggtagaacagaggagactacccatgcttgcattaaacctggcggcagcgcaaaagatg

SEQ ID NO: 5393 - DNA, 103 bp, Artificial Sequence
  Synthetic Polynucleotide
taatacgactcactatagggacacgcgctgccacacacacacctccgccaaacagaggagatggcggatgtgtgtgtgtaacctggcggcagcgcaaaagatg

SEQ ID NO: 5394 - DNA, 103 bp, Artificial Sequence
  Synthetic Polynucleotide
taatacgactcactatagggtggagacacgcgctgccacacacacacctcaacagaggagagaggtgatggtgtggcagaacctggcggcagcgcaaaagatg

SEQ ID NO: 5395 - DNA, 103 bp, Artificial Sequence
  Synthetic Polynucleotide
taatacgactcactataggggcgcctggagacacgcgctgccacacacacaacagaggagagtgtgtatggcagcgcgtaacctggcggcagcgcaaaagatg

SEQ ID NO: 5396 - DNA, 103 bp, Artificial Sequence
  Synthetic Polynucleotide
taatacgactcactatagggaacatgcgcctggagacacgcgctgccacaaacagaggagatgtggcatggcgtgtctcaacctggcggcagcgcaaaagatg

SEQ ID NO: 5397 - DNA, 103 bp, Artificial Sequence
  Synthetic Polynucleotide
taatacgactcactatagggcttccaacatgcgcctggagacacgcgctgaacagaggagacagcgcatgtctccaggcaacctggcggcagcgcaaaagatg

SEQ ID NO: 5398 - DNA, 103 bp, Artificial Sequence
  Synthetic Polynucleotide
taatacgactcactatagggtagttcttccaacatgcgcctggagacacgaacagaggagacgtgtcatgaggcgcatgaacctggcggcagcgcaaaagatg

SEQ ID NO: 5399 - DNA, 103 bp, Artificial Sequence
  Synthetic Polynucleotide
taatacgactcactatagggaacattagttcttccaacatgcgcctggagaacagaggagactccagatgcatgttggaaacctggcggcagcgcaaaagatg

SEQ ID NO: 5400 - DNA, 103 bp, Artificial Sequence
  Synthetic Polynucleotide
taatacgactcactatagggagtgcaacattagttcttccaacatgcgccaacagaggagaggcgcaatgtggaagaacaacctggcggcagcgcaaaagatg

SEQ ID NO: 5401 - DNA, 103 bp, Artificial Sequence
  Synthetic Polynucleotide
taatacgactcactataggggtaaaagtgcaacattagttcttccaacataacagaggagaatgttgatggaactaatgaacctggcggcagcgcaaaagatg

SEQ ID NO: 5402 - DNA, 103 bp, Artificial Sequence
  Synthetic Polynucleotide
taatacgactcactatagggagggggtaaaagtgcaacattagttcttccaacagaggagaggaagaatgaatgttgcaaacctggcggcagcgcaaaagatg

SEQ ID NO: 5403 - DNA, 103 bp, Artificial Sequence
  Synthetic Polynucleotide
taatacgactcactatagggcaaccacatgtgtctgctaatgcaagtccgaacagaggagacggactatgattagcagaaacctggcggcagcgcaaaagatg

SEQ ID NO: 5404 - DNA, 103 bp, Artificial Sequence
  Synthetic Polynucleotide
taatacgactcactatagggcctgaagggggtaaaagtgcaacattagttaacagaggagaaactaaatgtgcacttttaacctggcggcagcgcaaaagatg

SEQ ID NO: 5405 - DNA, 103 bp, Artificial Sequence
  Synthetic Polynucleotide
taatacgactcactatagggttgtgcctgaagggggtaaaagtgcaacataacagaggagaatgttgatgttttaccccaacctggcggcagcgcaaaagatg

SEQ ID NO: 5406 - DNA, 103 bp, Artificial Sequence
  Synthetic Polynucleotide
taatacgactcactatagggctaccttgtgcctgaagggggtaaaagtgcaacagaggagagcacttatgcccccttcaaacctggcggcagcgcaaaagatg

SEQ ID NO: 5407 - DNA, 103 bp, Artificial Sequence
  Synthetic Polynucleotide
taatacgactcactatagggccaaactaccttgtgcctgaagggggtaaaaacagaggagatttaccatgttcaggcacaacctggcggcagcgcaaaagatg

SEQ ID NO: 5408 - DNA, 103 bp, Artificial Sequence
  Synthetic Polynucleotide
taatacgactcactatagggttctaccaaactaccttgtgcctgaaggggaacagaggagaccccttatggcacaaggtaacctggcggcagcgcaaaagatg

SEQ ID NO: 5409 - DNA, 103 bp, Artificial Sequence
  Synthetic Polynucleotide
taatacgactcactataggggccaattctaccaaactaccttgtgcctgaaacagaggagatcaggcatgaggtagtttaacctggcggcagcgcaaaagatg

SEQ ID NO: 5410 - DNA, 103 bp, Artificial Sequence
  Synthetic Polynucleotide
taatacgactcactatagggcatctgccaattctaccaaactaccttgtgaacagaggagacacaagatggtttggtagaacctggcggcagcgcaaaagatg

SEQ ID NO: 5411 - DNA, 103 bp, Artificial Sequence
  Synthetic Polynucleotide
taatacgactcactatagggaggaccatctgccaattctaccaaactaccaacagaggagaggtagtatggtagaattgaacctggcggcagcgcaaaagatg

SEQ ID NO: 5412 - DNA, 103 bp, Artificial Sequence
  Synthetic Polynucleotide
taatacgactcactatagggacccgaggaccatctgccaattctaccaaaaacagaggagatttggtatgattggcagaaacctggcggcagcgcaaaagatg

SEQ ID NO: 5413 - DNA, 103 bp, Artificial Sequence
  Synthetic Polynucleotide
taatacgactcactatagggcatgtacccgaggaccatctgccaattctaaacagaggagatagaatatgcagatggtcaacctggcggcagcgcaaaagatg

SEQ ID NO: 5414 - DNA, 103 bp, Artificial Sequence
  Synthetic Polynucleotide
taatacgactcactatagggctgggcaaccacatgtgtctgctaatgcaaaacagaggagattgcatatgcagacacataacctggcggcagcgcaaaagatg

SEQ ID NO: 5415 - DNA, 103 bp, Artificial Sequence
  Synthetic Polynucleotide
taatacgactcactatagggaggtacatgtacccgaggaccatctgccaaaacagaggagattggcaatgggtcctcggaacctggcggcagcgcaaaagatg

SEQ ID NO: 5416 - DNA, 103 bp, Artificial Sequence
  Synthetic Polynucleotide
taatacgactcactataggggtcctaggtacatgtacccgaggaccatctaacagaggagaagatggatgtcgggtacaaacctggcggcagcgcaaaagatg

SEQ ID NO: 5417 - DNA, 103 bp, Artificial Sequence
  Synthetic Polynucleotide
taatacgactcactatagggtggttgtcctaggtacatgtacccgaggacaacagaggagagtcctcatgtacatgtacaacctggcggcagcgcaaaagatg

SEQ ID NO: 5418 - DNA, 103 bp, Artificial Sequence
  Synthetic Polynucleotide
taatacgactcactatagggaaatttggttgtcctaggtacatgtacccgaacagaggagacgggtaatggtacctaggaacctggcggcagcgcaaaagatg

SEQ ID NO: 5419 - DNA, 103 bp, Artificial Sequence
  Synthetic Polynucleotide
taatacgactcactatagggctcttaaatttggttgtcctaggtacatgtaacagaggagaacatgtatgtaggacaacaacctggcggcagcgcaaaagatg

SEQ ID NO: 5420 - DNA, 103 bp, Artificial Sequence
  Synthetic Polynucleotide
taatacgactcactatagggttgtcctcttaaatttggttgtcctaggtaaacagaggagatacctaatgcaaccaaataacctggcggcagcgcaaaagatg

SEQ ID NO: 5421 - DNA, 103 bp, Artificial Sequence
  Synthetic Polynucleotide
taatacgactcactatagggagcatttgtcctcttaaatttggttgtcctaacagaggagaaggacaatgaaatttaagaacctggcggcagcgcaaaagatg

SEQ ID NO: 5422 - DNA, 103 bp, Artificial Sequence
  Synthetic Polynucleotide
taatacgactcactatagggtaaacagcatttgtcctcttaaatttggttaacagaggagaaaccaaatgtaagaggacaacctggcggcagcgcaaaagatg

SEQ ID NO: 5423 - DNA, 103 bp, Artificial Sequence
  Synthetic Polynucleotide
taatacgactcactatagggcagggtaaacagcatttgtcctcttaaattaacagaggagaaatttaatgggacaaatgaacctggcggcagcgcaaaagatg

SEQ ID NO: 5424 - DNA, 103 bp, Artificial Sequence
  Synthetic Polynucleotide
taatacgactcactatagggtgttgcagggtaaacagcatttgtcctcttaacagaggagaaagaggatgaatgctgttaacctggcggcagcgcaaaagatg

SEQ ID NO: 5425 - DNA, 103 bp, Artificial Sequence
  Synthetic Polynucleotide
taatacgactcactatagggtggggctgggcaaccacatgtgtctgctaaaacagaggagattagcaatgacatgtggtaacctggcggcagcgcaaaagatg

SEQ ID NO: 5426 - DNA, 103 bp, Artificial Sequence
  Synthetic Polynucleotide
taatacgactcactatagggttagatgttgcagggtaaacagcatttgtcaacagaggagagacaaaatgtgtttacccaacctggcggcagcgcaaaagatg

SEQ ID NO: 5427 - DNA, 103 bp, Artificial Sequence
  Synthetic Polynucleotide
taatacgactcactatagggcacatttagatgttgcagggtaaacagcataacagaggagaatgctgatgaccctgcaaaacctggcggcagcgcaaaagatg

SEQ ID NO: 5428 - DNA, 103 bp, Artificial Sequence
  Synthetic Polynucleotide
taatacgactcactatagggggggccacatttagatgttgcagggtaaacaacagaggagagtttacatggcaacatctaacctggcggcagcgcaaaagatg

SEQ ID NO: 5429 - DNA, 103 bp, Artificial Sequence
  Synthetic Polynucleotide
taatacgactcactatagggacagcggggccacatttagatgttgcagggaacagaggagaccctgcatgatctaaatgaacctggcggcagcgcaaaagatg

SEQ ID NO: 5430 - DNA, 103 bp, Artificial Sequence
  Synthetic Polynucleotide
taatacgactcactatagggacaaaacagcggggccacatttagatgttgaacagaggagacaacatatgaatgtggccaacctggcggcagcgcaaaagatg

SEQ ID NO: 5431 - DNA, 103 bp, Artificial Sequence
  Synthetic Polynucleotide
taatacgactcactatagggacgtgacaaaacagcggggccacatttagaaacagaggagatctaaaatgggccccgctaacctggcggcagcgcaaaagatg

SEQ ID NO: 5432 - DNA, 103 bp, Artificial Sequence
  Synthetic Polynucleotide
taatacgactcactatagggtcattacgtgacaaaacagcggggccacataacagaggagaatgtggatgcgctgttttaacctggcggcagcgcaaaagatg

SEQ ID NO: 5433 - DNA, 103 bp, Artificial Sequence
  Synthetic Polynucleotide
taatacgactcactatagggttggatcattacgtgacaaaacagcggggcaacagaggagagccccgatgttttgtcacaacctggcggcagcgcaaaagatg

SEQ ID NO: 5434 - DNA, 103 bp, Artificial Sequence
  Synthetic Polynucleotide
taatacgactcactatagggtagtcttggatcattacgtgacaaaacagcaacagaggagagctgttatgtcacgtaataacctggcggcagcgcaaaagatg

SEQ ID NO: 5435 - DNA, 103 bp, Artificial Sequence
  Synthetic Polynucleotide
taatacgactcactataggggggtctagtcttggatcattacgtgacaaaaacagaggagatttgtcatgtaatgatccaacctggcggcagcgcaaaagatg

SEQ ID NO: 5436 - DNA, 103 bp, Artificial Sequence
  Synthetic Polynucleotide
taatacgactcactatagggagaggtggggctgggcaaccacatgtgtctaacagaggagaagacacatgtggttgcccaacctggcggcagcgcaaaagatg

SEQ ID NO: 5437 - DNA, 103 bp, Artificial Sequence
  Synthetic Polynucleotide
taatacgactcactatagggtgtctgggtctagtcttggatcattacgtgaacagaggagacacgtaatgatccaagacaacctggcggcagcgcaaaagatg

SEQ ID NO: 5438 - DNA, 103 bp, Artificial Sequence
  Synthetic Polynucleotide
taatacgactcactatagggatcaatgtctgggtctagtcttggatcattaacagaggagaaatgatatgagactagacaacctggcggcagcgcaaaagatg

SEQ ID NO: 5439 - DNA, 103 bp, Artificial Sequence
  Synthetic Polynucleotide
taatacgactcactatagggtcaaaatcaatgtctgggtctagtcttggaaacagaggagatccaagatgagacccagaaacctggcggcagcgcaaaagatg

SEQ ID NO: 5440 - DNA, 103 bp, Artificial Sequence
  Synthetic Polynucleotide
taatacgactcactataggggtttgtcaaaatcaatgtctgggtctagtcaacagaggagagactagatgcagacattgaacctggcggcagcgcaaaagatg

SEQ ID NO: 5441 - DNA, 103 bp, Artificial Sequence
  Synthetic Polynucleotide
taatacgactcactataggggatttgtttgtcaaaatcaatgtctgggtcaacagaggagagacccaatgattgattttaacctggcggcagcgcaaaagatg

SEQ ID NO: 5442 - DNA, 103 bp, Artificial Sequence
  Synthetic Polynucleotide
taatacgactcactataggggaaaagatttgtttgtcaaaatcaatgtctaacagaggagaagacatatgttttgacaaaacctggcggcagcgcaaaagatg

SEQ ID NO: 5443 - DNA, 103 bp, Artificial Sequence
  Synthetic Polynucleotide
taatacgactcactataggggtttggaaaagatttgtttgtcaaaatcaaaacagaggagattgattatgacaaacaaaaacctggcggcagcgcaaaagatg

SEQ ID NO: 5444 - DNA, 103 bp, Artificial Sequence
  Synthetic Polynucleotide
taatacgactcactataggggttatgtttggaaaagatttgtttgtcaaaaacagaggagatttgacatgcaaatctttaacctggcggcagcgcaaaagatg

SEQ ID NO: 5445 - DNA, 103 bp, Artificial Sequence
  Synthetic Polynucleotide
taatacgactcactatagggtttttgttatgtttggaaaagatttgtttgaacagaggagacaaacaatgcttttccaaaacctggcggcagcgcaaaagatg

SEQ ID NO: 5446 - DNA, 103 bp, Artificial Sequence
  Synthetic Polynucleotide
taatacgactcactatagggtgacatttttgttatgtttggaaaagatttaacagaggagaaaatctatgccaaacataaacctggcggcagcgcaaaagatg

SEQ ID NO: 5447 - DNA, 103 bp, Artificial Sequence
  Synthetic Polynucleotide
taatacgactcactatagggtctgaagaggtggggctgggcaaccacatgaacagaggagacatgtgatggcccagcccaacctggcggcagcgcaaaagatg

SEQ ID NO: 5448 - DNA, 103 bp, Artificial Sequence
  Synthetic Polynucleotide
taatacgactcactatagggataattgacatttttgttatgtttggaaaaaacagaggagattttccatgcataacaaaaacctggcggcagcgcaaaagatg

SEQ ID NO: 5449 - DNA, 103 bp, Artificial Sequence
  Synthetic Polynucleotide
taatacgactcactataggggtagcataattgacatttttgttatgtttgaacagaggagacaaacaatgcaaaaatgtaacctggcggcagcgcaaaagatg

SEQ ID NO: 5450 - DNA, 103 bp, Artificial Sequence
  Synthetic Polynucleotide
taatacgactcactatagggaatcagtagcataattgacatttttgttataacagaggagaataacaatgatgtcaattaacctggcggcagcgcaaaagatg

SEQ ID NO: 5451 - DNA, 103 bp, Artificial Sequence
  Synthetic Polynucleotide
taatacgactcactatagggtgatgaatcagtagcataattgacatttttaacagaggagaaaaaatatgaattatgctaacctggcggcagcgcaaaagatg

SEQ ID NO: 5452 - DNA, 103 bp, Artificial Sequence
  Synthetic Polynucleotide
taatacgactcactatagggcagattgatgaatcagtagcataattgacaaacagaggagatgtcaaatgtgctactgaaacctggcggcagcgcaaaagatg

SEQ ID NO: 5453 - DNA, 103 bp, Artificial Sequence
  Synthetic Polynucleotide
taatacgactcactatagggtattccagattgatgaatcagtagcataataacagaggagaattatgatgctgattcataacctggcggcagcgcaaaagatg

SEQ ID NO: 5454 - DNA, 103 bp, Artificial Sequence
  Synthetic Polynucleotide
taatacgactcactatagggcattgtattccagattgatgaatcagtagcaacagaggagagctactatgtcatcaatcaacctggcggcagcgcaaaagatg

SEQ ID NO: 5455 - DNA, 103 bp, Artificial Sequence
  Synthetic Polynucleotide
taatacgactcactatagggttagtcattgtattccagattgatgaatcaaacagaggagatgattcatgaatctggaaaacctggcggcagcgcaaaagatg

SEQ ID NO: 5456 - DNA, 103 bp, Artificial Sequence
  Synthetic Polynucleotide
taatacgactcactatagggtaactttagtcattgtattccagattgatgaacagaggagacatcaaatgggaatacaaaacctggcggcagcgcaaaagatg

SEQ ID NO: 5457 - DNA, 103 bp, Artificial Sequence
  Synthetic Polynucleotide
taatacgactcactatagggctgagtaactttagtcattgtattccagataacagaggagaatctggatgacaatgactaacctggcggcagcgcaaaagatg

SEQ ID NO: 5458 - DNA, 103 bp, Artificial Sequence
  Synthetic Polynucleotide
taatacgactcactatagggccacctctgaagaggtggggctgggcaaccaacagaggagaggttgcatggccccacctaacctggcggcagcgcaaaagatg

SEQ ID NO: 5459 - DNA, 103 bp, Artificial Sequence
  Synthetic Polynucleotide
taatacgactcactatagggtaaatctgagtaactttagtcattgtattcaacagaggagagaatacatggactaaagtaacctggcggcagcgcaaaagatg

SEQ ID NO: 5460 - DNA, 103 bp, Artificial Sequence
  Synthetic Polynucleotide
taatacgactcactatagggcgaaataaatctgagtaactttagtcattgaacagaggagacaatgaatgaagttactcaacctggcggcagcgcaaaagatg

SEQ ID NO: 5461 - DNA, 103 bp, Artificial Sequence
  Synthetic Polynucleotide
taatacgactcactatagggtttttcgaaataaatctgagtaactttagtaacagaggagaactaaaatgactcagattaacctggcggcagcgcaaaagatg

SEQ ID NO: 5462 - DNA, 103 bp, Artificial Sequence
  Synthetic Polynucleotide
taatacgactcactatagggccaaatttttcgaaataaatctgagtaactaacagaggagaagttacatggatttatttaacctggcggcagcgcaaaagatg

SEQ ID NO: 5463 - DNA, 103 bp, Artificial Sequence
  Synthetic Polynucleotide
taatacgactcactataggggttttccaaatttttcgaaataaatctgagaacagaggagactcagaatgatttcgaaaaacctggcggcagcgcaaaagatg

SEQ ID NO: 5464 - DNA, 103 bp, Artificial Sequence
  Synthetic Polynucleotide
taatacgactcactatagggatcgtgttttccaaatttttcgaaataaataacagaggagaatttatatggaaaaatttaacctggcggcagcgcaaaagatg

SEQ ID NO: 5465 - DNA, 103 bp, Artificial Sequence
  Synthetic Polynucleotide
taatacgactcactatagggctccaatcgtgttttccaaatttttcgaaaaacagaggagatttcgaatgatttggaaaaacctggcggcagcgcaaaagatg

SEQ ID NO: 5466 - DNA, 103 bp, Artificial Sequence
  Synthetic Polynucleotide
taatacgactcactataggggagggctccaatcgtgttttccaaatttttaacagaggagaaaaaatatggaaaacacgaacctggcggcagcgcaaaagatg

SEQ ID NO: 5467 - DNA, 103 bp, Artificial Sequence
  Synthetic Polynucleotide
taatacgactcactatagggagtgagagggctccaatcgtgttttccaaaaacagaggagatttggaatgcacgattggaacctggcggcagcgcaaaagatg

SEQ ID NO: 5468 - DNA, 103 bp, Artificial Sequence
  Synthetic Polynucleotide
taatacgactcactatagggttcaaagtgagagggctccaatcgtgttttaacagaggagaaaaacaatgttggagcccaacctggcggcagcgcaaaagatg

SEQ ID NO: 5469 - DNA, 103 bp, Artificial Sequence
  Synthetic Polynucleotide
taatacgactcactatagggatctttgcagtactccacccactgccatataacagaggagaatatggatgtgggtggagaacctggcggcagcgcaaaagatg

SEQ ID NO: 5470 - DNA, 103 bp, Artificial Sequence
  Synthetic Polynucleotide
taatacgactcactatagggaagccccacctctgaagaggtggggctgggaacagaggagacccagcatgacctcttcaaacctggcggcagcgcaaaagatg

SEQ ID NO: 5471 - DNA, 103 bp, Artificial Sequence
  Synthetic Polynucleotide
taatacgactcactatagggcttctttcaaagtgagagggctccaatcgtaacagaggagaacgattatggccctctcaaacctggcggcagcgcaaaagatg

SEQ ID NO: 5472 - DNA, 103 bp, Artificial Sequence
  Synthetic Polynucleotide
taatacgactcactatagggtatggcttctttcaaagtgagagggctccaaacagaggagatggagcatgctcactttgaacctggcggcagcgcaaaagatg

SEQ ID NO: 5473 - DNA, 103 bp, Artificial Sequence
  Synthetic Polynucleotide
taatacgactcactatagggccctctatggcttctttcaaagtgagagggaacagaggagaccctctatgtttgaaagaaacctggcggcagcgcaaaagatg

SEQ ID NO: 5474 - DNA, 103 bp, Artificial Sequence
  Synthetic Polynucleotide
taatacgactcactataggggtataccctctatggcttctttcaaagtgaaacagaggagatcacttatgaagaagccaaacctggcggcagcgcaaaagatg

SEQ ID NO: 5475 - DNA, 103 bp, Artificial Sequence
  Synthetic Polynucleotide
taatacgactcactatagggtcctggtataccctctatggcttctttcaaaacagaggagattgaaaatggccatagagaacctggcggcagcgcaaaagatg

SEQ ID NO: 5476 - DNA, 103 bp, Artificial Sequence
  Synthetic Polynucleotide
taatacgactcactatagggtccagtcctggtataccctctatggcttctaacagaggagaagaagcatgagagggtataacctggcggcagcgcaaaagatg

SEQ ID NO: 5477 - DNA, 103 bp, Artificial Sequence
  Synthetic Polynucleotide
taatacgactcactatagggatttgtccagtcctggtataccctctatggaacagaggagaccatagatggtataccagaacctggcggcagcgcaaaagatg

SEQ ID NO: 5478 - DNA, 103 bp, Artificial Sequence
  Synthetic Polynucleotide
taatacgactcactatagggatctaatttgtccagtcctggtataccctcaacagaggagagagggtatgccaggactgaacctggcggcagcgcaaaagatg

SEQ ID NO: 5479 - DNA, 103 bp, Artificial Sequence
  Synthetic Polynucleotide
taatacgactcactatagggttgggatctaatttgtccagtcctggtataaacagaggagatataccatgactggacaaaacctggcggcagcgcaaaagatg

SEQ ID NO: 5480 - DNA, 103 bp, Artificial Sequence
  Synthetic Polynucleotide
taatacgactcactatagggcagtgttgggatctaatttgtccagtcctgaacagaggagacaggacatgacaaattagaacctggcggcagcgcaaaagatg

SEQ ID NO: 5481 - DNA, 103 bp, Artificial Sequence
  Synthetic Polynucleotide
taatacgactcactataggggagcaaagccccacctctgaagaggtggggaacagaggagaccccacatgttcagaggtaacctggcggcagcgcaaaagatg

SEQ ID NO: 5482 - DNA, 103 bp, Artificial Sequence
  Synthetic Polynucleotide
taatacgactcactatagggtgaagcagtgttgggatctaatttgtccagaacagaggagactggacatgttagatcccaacctggcggcagcgcaaaagatg

SEQ ID NO: 5483 - DNA, 103 bp, Artificial Sequence
  Synthetic Polynucleotide
taatacgactcactatagggagacctgaagcagtgttgggatctaatttgaacagaggagacaaattatgtcccaacacaacctggcggcagcgcaaaagatg

SEQ ID NO: 5484 - DNA, 103 bp, Artificial Sequence
  Synthetic Polynucleotide
taatacgactcactatagggaaggaagacctgaagcagtgttgggatctaaacagaggagatagatcatgacactgcttaacctggcggcagcgcaaaagatg

SEQ ID NO: 5485 - DNA, 103 bp, Artificial Sequence
  Synthetic Polynucleotide
taatacgactcactatagggtgtgtaaggaagacctgaagcagtgttgggaacagaggagacccaacatggcttcaggtaacctggcggcagcgcaaaagatg

SEQ ID NO: 5486 - DNA, 103 bp, Artificial Sequence
  Synthetic Polynucleotide
taatacgactcactataggggtctttgtgtaaggaagacctgaagcagtgaacagaggagacactgcatgaggtcttccaacctggcggcagcgcaaaagatg

SEQ ID NO: 5487 - DNA, 103 bp, Artificial Sequence
  Synthetic Polynucleotide
taatacgactcactatagggtgcgagtctttgtgtaaggaagacctgaagaacagaggagacttcagatgttccttacaaacctggcggcagcgcaaaagatg

SEQ ID NO: 5488 - DNA, 103 bp, Artificial Sequence
  Synthetic Polynucleotide
taatacgactcactatagggttgtttgcgagtctttgtgtaaggaagaccaacagaggagaggtcttatgtacacaaagaacctggcggcagcgcaaaagatg

SEQ ID NO: 5489 - DNA, 103 bp, Artificial Sequence
  Synthetic Polynucleotide
taatacgactcactatagggattaattgtttgcgagtctttgtgtaaggaaacagaggagatccttaatgaaagactcgaacctggcggcagcgcaaaagatg

SEQ ID NO: 5490 - DNA, 103 bp, Artificial Sequence
  Synthetic Polynucleotide
taatacgactcactatagggaatctattaattgtttgcgagtctttgtgtaacagaggagaacacaaatgctcgcaaacaacctggcggcagcgcaaaagatg

SEQ ID NO: 5491 - DNA, 103 bp, Artificial Sequence
  Synthetic Polynucleotide
taatacgactcactatagggagtaaaatctattaattgtttgcgagtcttaacagaggagaaagactatgaaacaattaaacctggcggcagcgcaaaagatg

SEQ ID NO: 5492 - DNA, 103 bp, Artificial Sequence
  Synthetic Polynucleotide
taatacgactcactatagggtgagtgagcaaagccccacctctgaagaggaacagaggagacctcttatgaggtggggcaacctggcggcagcgcaaaagatg

SEQ ID NO: 5493 - DNA, 103 bp, Artificial Sequence
  Synthetic Polynucleotide
taatacgactcactatagggcaagtagtaaaatctattaattgtttgcgaaacagaggagatcgcaaatgattaatagaaacctggcggcagcgcaaaagatg

SEQ ID NO: 5494 - DNA, 103 bp, Artificial Sequence
  Synthetic Polynucleotide
taatacgactcactatagggtctcgcaagtagtaaaatctattaattgttaacagaggagaaacaatatgtagattttaaacctggcggcagcgcaaaagatg

SEQ ID NO: 5495 - DNA, 103 bp, Artificial Sequence
  Synthetic Polynucleotide
taatacgactcactatagggtttgatctcgcaagtagtaaaatctattaaaacagaggagattaataatgtttactactaacctggcggcagcgcaaaagatg

SEQ ID NO: 5496 - DNA, 103 bp, Artificial Sequence
  Synthetic Polynucleotide
taatacgactcactataggggagtctttgatctcgcaagtagtaaaatctaacagaggagaagatttatgtacttgcgaaacctggcggcagcgcaaaagatg

SEQ ID NO: 5497 - DNA, 103 bp, Artificial Sequence
  Synthetic Polynucleotide
taatacgactcactataggggttctgagtctttgatctcgcaagtagtaaaacagaggagattactaatggcgagatcaaacctggcggcagcgcaaaagatg

SEQ ID NO: 5498 - DNA, 103 bp, Artificial Sequence
  Synthetic Polynucleotide
taatacgactcactatagggttgcagttctgagtctttgatctcgcaagtaacagaggagaacttgcatgatcaaagacaacctggcggcagcgcaaaagatg

SEQ ID NO: 5499 - DNA, 103 bp, Artificial Sequence
  Synthetic Polynucleotide
taatacgactcactatagggctggcttgcagttctgagtctttgatctcgaacagaggagacgagatatgagactcagaaacctggcggcagcgcaaaagatg

SEQ ID NO: 5500 - DNA, 103 bp, Artificial Sequence
  Synthetic Polynucleotide
taatacgactcactatagggccagtctggcttgcagttctgagtctttgaaacagaggagatcaaagatgcagaactgcaacctggcggcagcgcaaaagatg

SEQ ID NO: 5501 - DNA, 103 bp, Artificial Sequence
  Synthetic Polynucleotide
taatacgactcactatagggtttgtccagtctggcttgcagttctgagtcaacagaggagagactcaatgctgcaagccaacctggcggcagcgcaaaagatg

SEQ ID NO: 5502 - DNA, 103 bp, Artificial Sequence
  Synthetic Polynucleotide
taatacgactcactatagggagccatttgtccagtctggcttgcagttctaacagaggagaagaactatgagccagactaacctggcggcagcgcaaaagatg

SEQ ID NO: 5503 - DNA, 103 bp, Artificial Sequence
  Synthetic Polynucleotide
taatacgactcactatagggtgtgctgagtgagcaaagccccacctctgaaacagaggagatcagagatggggctttgcaacctggcggcagcgcaaaagatg

SEQ ID NO: 5504 - DNA, 103 bp, Artificial Sequence
  Synthetic Polynucleotide
taatacgactcactatagggcctttagccatttgtccagtctggcttgcaaacagaggagatgcaagatggactggacaaacctggcggcagcgcaaaagatg

SEQ ID NO: 5505 - DNA, 103 bp, Artificial Sequence
  Synthetic Polynucleotide
taatacgactcactatagggttctccctttagccatttgtccagtctggcaacagaggagagccagaatggacaaatggaacctggcggcagcgcaaaagatg

SEQ ID NO: 5506 - DNA, 103 bp, Artificial Sequence
  Synthetic Polynucleotide
taatacgactcactatagggggtttttctccctttagccatttgtccagtaacagaggagaactggaatgatggctaaaaacctggcggcagcgcaaaagatg

SEQ ID NO: 5507 - DNA, 103 bp, Artificial Sequence
  Synthetic Polynucleotide
taatacgactcactataggggttctggtttttctccctttagccatttgtaacagaggagaacaaatatgtaaagggagaacctggcggcagcgcaaaagatg

SEQ ID NO: 5508 - DNA, 103 bp, Artificial Sequence
  Synthetic Polynucleotide
taatacgactcactatagggaatgagttctggtttttctccctttagccaaacagaggagatggctaatgggagaaaaaaacctggcggcagcgcaaaagatg

SEQ ID NO: 5509 - DNA, 103 bp, Artificial Sequence
  Synthetic Polynucleotide
taatacgactcactatagggtggtaaatgagttctggtttttctccctttaacagaggagaaaagggatgaaaaccagaaacctggcggcagcgcaaaagatg

SEQ ID NO: 5510 - DNA, 103 bp, Artificial Sequence
  Synthetic Polynucleotide
taatacgactcactatagggaagtttggtaaatgagttctggtttttctcaacagaggagagagaaaatgcagaactcaaacctggcggcagcgcaaaagatg

SEQ ID NO: 5511 - DNA, 103 bp, Artificial Sequence
  Synthetic Polynucleotide
taatacgactcactatagggtagaaaagtttggtaaatgagttctggtttaacagaggagaaaaccaatgctcatttacaacctggcggcagcgcaaaagatg

SEQ ID NO: 5512 - DNA, 103 bp, Artificial Sequence
  Synthetic Polynucleotide
taatacgactcactatagggtcttttagaaaagtttggtaaatgagttctaacagaggagaagaactatgttaccaaacaacctggcggcagcgcaaaagatg

SEQ ID NO: 5513 - DNA, 103 bp, Artificial Sequence
  Synthetic Polynucleotide
taatacgactcactatagggtttcatcttttagaaaagtttggtaaatgaaacagaggagatcatttatgaaacttttcaacctggcggcagcgcaaaagatg

SEQ ID NO: 5514 - DNA, 103 bp, Artificial Sequence
  Synthetic Polynucleotide
taatacgactcactataggggatcctgtgctgagtgagcaaagccccaccaacagaggagaggtgggatgttgctcactaacctggcggcagcgcaaaagatg

SEQ ID NO: 5515 - DNA, 103 bp, Artificial Sequence
  Synthetic Polynucleotide
taatacgactcactatagggtctgatttcatcttttagaaaagtttggtaaacagaggagataccaaatgtttctaaaaaacctggcggcagcgcaaaagatg

SEQ ID NO: 5516 - DNA, 103 bp, Artificial Sequence
  Synthetic Polynucleotide
taatacgactcactatagggattgatctgatttcatcttttagaaaagttaacagaggagaaactttatgaaaagatgaaacctggcggcagcgcaaaagatg

SEQ ID NO: 5517 - DNA, 103 bp, Artificial Sequence
  Synthetic Polynucleotide
taatacgactcactatagggtttcaattgatctgatttcatcttttagaaaacagaggagattctaaatgatgaaatcaaacctggcggcagcgcaaaagatg

SEQ ID NO: 5518 - DNA, 103 bp, Artificial Sequence
  Synthetic Polynucleotide
taatacgactcactatagggtattttttcaattgatctgatttcatctttaacagaggagaaaagatatgatcagatcaaacctggcggcagcgcaaaagatg

SEQ ID NO: 5519 - DNA, 103 bp, Artificial Sequence
  Synthetic Polynucleotide
taatacgactcactatagggttctttattttttcaattgatctgatttcaaacagaggagatgaaatatgatcaattgaaacctggcggcagcgcaaaagatg

SEQ ID NO: 5520 - DNA, 103 bp, Artificial Sequence
  Synthetic Polynucleotide
taatacgactcactatagggtccctttctttattttttcaattgatctgaaacagaggagatcagatatgttgaaaaaaaacctggcggcagcgcaaaagatg

SEQ ID NO: 5521 - DNA, 103 bp, Artificial Sequence
  Synthetic Polynucleotide
taatacgactcactatagggagttttccctttctttattttttcaattgaaacagaggagatcaattatgaaaataaagaacctggcggcagcgcaaaagatg

SEQ ID NO: 5522 - DNA, 103 bp, Artificial Sequence
  Synthetic Polynucleotide
taatacgactcactatagggattctagttttccctttctttattttttcaaacagaggagatgaaaaatgaaagaaaggaacctggcggcagcgcaaaagatg

SEQ ID NO: 5523 - DNA, 103 bp, Artificial Sequence
  Synthetic Polynucleotide
taatacgactcactatagggcaattattctagttttccctttctttatttaacagaggagaaaataaatgaagggaaaaaacctggcggcagcgcaaaagatg

SEQ ID NO: 5524 - DNA, 103 bp, Artificial Sequence
  Synthetic Polynucleotide
taatacgactcactatagggaacatcaattattctagttttccctttcttaacagaggagaaagaaaatgaaaactagaaacctggcggcagcgcaaaagatg

SEQ ID NO: 5525 - DNA, 103 bp, Artificial Sequence
  Synthetic Polynucleotide
taatacgactcactataggggatcagatcctgtgctgagtgagcaaagccaacagaggagaggctttatgcactcagcaaacctggcggcagcgcaaaagatg

SEQ ID NO: 5526 - DNA, 103 bp, Artificial Sequence
  Synthetic Polynucleotide
taatacgactcactatagggggagtaacatcaattattctagttttccctaacagaggagaagggaaatgtagaataataacctggcggcagcgcaaaagatg

SEQ ID NO: 5527 - DNA, 103 bp, Artificial Sequence
  Synthetic Polynucleotide
taatacgactcactatagggcaagaggagtaacatcaattattctagtttaacagaggagaaaactaatgtaattgatgaacctggcggcagcgcaaaagatg

SEQ ID NO: 5528 - DNA, 103 bp, Artificial Sequence
  Synthetic Polynucleotide
taatacgactcactatagggatggtcaagaggagtaacatcaattattctaacagaggagaagaataatggatgttactaacctggcggcagcgcaaaagatg

SEQ ID NO: 5529 - DNA, 103 bp, Artificial Sequence
  Synthetic Polynucleotide
taatacgactcactatagggagaacatggtcaagaggagtaacatcaattaacagaggagaaattgaatgtactcctctaacctggcggcagcgcaaaagatg

SEQ ID NO: 5530 - DNA, 103 bp, Artificial Sequence
  Synthetic Polynucleotide
taatacgactcactatagggaggctagaacatggtcaagaggagtaacataacagaggagaatgttaatgctcttgaccaacctggcggcagcgcaaaagatg

SEQ ID NO: 5531 - DNA, 103 bp, Artificial Sequence
  Synthetic Polynucleotide
taatacgactcactatagggacgaaaggctagaacatggtcaagaggagtaacagaggagaactcctatggaccatgttaacctggcggcagcgcaaaagatg

SEQ ID NO: 5532 - DNA, 103 bp, Artificial Sequence
  Synthetic Polynucleotide
taatacgactcactatagggagaatacgaaaggctagaacatggtcaagaaacagaggagatcttgaatgtgttctagcaacctggcggcagcgcaaaagatg

SEQ ID NO: 5533 - DNA, 103 bp, Artificial Sequence
  Synthetic Polynucleotide
taatacgactcactatagggcaaagagaatacgaaaggctagaacatggtaacagaggagaaccatgatgtagcctttcaacctggcggcagcgcaaaagatg

SEQ ID NO: 5534 - DNA, 103 bp, Artificial Sequence
  Synthetic Polynucleotide
taatacgactcactatagggtcgcccaaagagaatacgaaaggctagaacaacagaggagagttctaatgtttcgtattaacctggcggcagcgcaaaagatg

SEQ ID NO: 5535 - DNA, 103 bp, Artificial Sequence
  Synthetic Polynucleotide
taatacgactcactatagggaagaatcgcccaaagagaatacgaaaggctaacagaggagaagccttatgtattctcttaacctggcggcagcgcaaaagatg

SEQ ID NO: 5536 - DNA, 103 bp, Artificial Sequence
  Synthetic Polynucleotide
taatacgactcactatagggctcctgatcagatcctgtgctgagtgagcaaacagaggagatgctcaatgagcacaggaaacctggcggcagcgcaaaagatg

SEQ ID NO: 5537 - DNA, 103 bp, Artificial Sequence
  Synthetic Polynucleotide
taatacgactcactataggggggcaaagaatcgcccaaagagaatacgaaaacagaggagattcgtaatgtctttgggcaacctggcggcagcgcaaaagatg

SEQ ID NO: 5538 - DNA, 103 bp, Artificial Sequence
  Synthetic Polynucleotide
taatacgactcactatagggaaagtgggcaaagaatcgcccaaagagaataacagaggagaattctcatggggcgattcaacctggcggcagcgcaaaagatg

SEQ ID NO: 5539 - DNA, 103 bp, Artificial Sequence
  Synthetic Polynucleotide
taatacgactcactatagggtgatgaaagtgggcaaagaatcgcccaaagaacagaggagactttggatgattctttgcaacctggcggcagcgcaaaagatg

SEQ ID NO: 5540 - DNA, 103 bp, Artificial Sequence
  Synthetic Polynucleotide
taatacgactcactatagggagtgttgatgaaagtgggcaaagaatcgccaacagaggagaggcgatatgttgcccactaacctggcggcagcgcaaaagatg

SEQ ID NO: 5541 - DNA, 103 bp, Artificial Sequence
  Synthetic Polynucleotide
taatacgactcactatagggaccaaagtgttgatgaaagtgggcaaagaaaacagaggagattctttatgcactttcataacctggcggcagcgcaaaagatg

SEQ ID NO: 5542 - DNA, 103 bp, Artificial Sequence
  Synthetic Polynucleotide
taatacgactcactatagggccgaaaccaaagtgttgatgaaagtgggcaaacagaggagatgcccaatgtcatcaacaaacctggcggcagcgcaaaagatg

SEQ ID NO: 5543 - DNA, 103 bp, Artificial Sequence
  Synthetic Polynucleotide
taatacgactcactatagggcaataccgaaaccaaagtgttgatgaaagtaacagaggagaactttcatgaacactttgaacctggcggcagcgcaaaagatg

SEQ ID NO: 5544 - DNA, 103 bp, Artificial Sequence
  Synthetic Polynucleotide
taatacgactcactatagggcgagccaataccgaaaccaaagtgttgatgaacagaggagacatcaaatgtttggtttcaacctggcggcagcgcaaaagatg

SEQ ID NO: 5545 - DNA, 103 bp, Artificial Sequence
  Synthetic Polynucleotide
taatacgactcactatagggacagccgagccaataccgaaaccaaagtgtaacagaggagaacacttatgtttcggtataacctggcggcagcgcaaaagatg

SEQ ID NO: 5546 - DNA, 103 bp, Artificial Sequence
  Synthetic Polynucleotide
taatacgactcactatagggaaccaacagccgagccaataccgaaaccaaaacagaggagattggttatggtattggctaacctggcggcagcgcaaaagatg

SEQ ID NO: 5547 - DNA, 103 bp, Artificial Sequence
  Synthetic Polynucleotide
taatacgactcactatagggcggggctcctgatcagatcctgtgctgagtaacagaggagaactcagatgaggatctgaaacctggcggcagcgcaaaagatg

SEQ ID NO: 5548 - DNA, 103 bp, Artificial Sequence
  Synthetic Polynucleotide
taatacgactcactataggggtcacaaccaacagccgagccaataccgaaaacagaggagattcggtatgggctcggctaacctggcggcagcgcaaaagatg

SEQ ID NO: 5549 - DNA, 103 bp, Artificial Sequence
  Synthetic Polynucleotide
taatacgactcactatagggtctgggtcacaaccaacagccgagccaataaacagaggagatattggatgggctgttggaacctggcggcagcgcaaaagatg

SEQ ID NO: 5550 - DNA, 103 bp, Artificial Sequence
  Synthetic Polynucleotide
taatacgactcactatagggctgtgtctgggtcacaaccaacagccgagcaacagaggagagctcggatgttggttgtgaacctggcggcagcgcaaaagatg

SEQ ID NO: 5551 - DNA, 103 bp, Artificial Sequence
  Synthetic Polynucleotide
taatacgactcactatagggccaagctgtgtctgggtcacaaccaacagcaacagaggagagctgttatgtgtgacccaaacctggcggcagcgcaaaagatg

SEQ ID NO: 5552 - DNA, 103 bp, Artificial Sequence
  Synthetic Polynucleotide
taatacgactcactataggggcaggccaagctgtgtctgggtcacaaccaaacagaggagatggttgatgcccagacacaacctggcggcagcgcaaaagatg

SEQ ID NO: 5553 - DNA, 103 bp, Artificial Sequence
  Synthetic Polynucleotide
taatacgactcactatagggcgaatgcaggccaagctgtgtctgggtcacaacagaggagagtgaccatgacacagcttaacctggcggcagcgcaaaagatg

SEQ ID NO: 5554 - DNA, 103 bp, Artificial Sequence
  Synthetic Polynucleotide
taatacgactcactatagggggccccgaatgcaggccaagctgtgtctggaacagaggagaccagacatggcttggcctaacctggcggcagcgcaaaagatg

SEQ ID NO: 5555 - DNA, 103 bp, Artificial Sequence
  Synthetic Polynucleotide
taatacgactcactatagggaatttggccccgaatgcaggccaagctgtgaacagaggagacacagcatggcctgcattaacctggcggcagcgcaaaagatg

SEQ ID NO: 5556 - DNA, 103 bp, Artificial Sequence
  Synthetic Polynucleotide
taatacgactcactatagggatgccaatttggccccgaatgcaggccaagaacagaggagacttggcatgcattcggggaacctggcggcagcgcaaaagatg

SEQ ID NO: 5557 - DNA, 103 bp, Artificial Sequence
  Synthetic Polynucleotide
taatacgactcactataggggtaggatgccaatttggccccgaatgcaggaacagaggagacctgcaatgggggccaaaaacctggcggcagcgcaaaagatg

SEQ ID NO: 5558 - DNA, 103 bp, Artificial Sequence
  Synthetic Polynucleotide
taatacgactcactatagggacgagcggggctcctgatcagatcctgtgcaacagaggagagcacagatgctgatcaggaacctggcggcagcgcaaaagatg

SEQ ID NO: 5559 - DNA, 103 bp, Artificial Sequence
  Synthetic Polynucleotide
taatacgactcactatagggttcttgtaggatgccaatttggccccgaataacagaggagaattcggatgcaaattggcaacctggcggcagcgcaaaagatg

SEQ ID NO: 5560 - DNA, 103 bp, Artificial Sequence
  Synthetic Polynucleotide
taatacgactcactatagggactgattcttgtaggatgccaatttggcccaacagaggagagggccaatgtggcatcctaacctggcggcagcgcaaaagatg

SEQ ID NO: 5561 - DNA, 103 bp, Artificial Sequence
  Synthetic Polynucleotide
taatacgactcactatagggatcatactgattcttgtaggatgccaatttaacagaggagaaaattgatgtcctacaagaacctggcggcagcgcaaaagatg

SEQ ID NO: 5562 - DNA, 103 bp, Artificial Sequence
  Synthetic Polynucleotide
taatacgactcactatagggtcaaaatcatactgattcttgtaggatgccaacagaggagaggcatcatgcaagaatcaaacctggcggcagcgcaaaagatg

SEQ ID NO: 5563 - DNA, 103 bp, Artificial Sequence
  Synthetic Polynucleotide
taatacgactcactatagggagtaatcaaaatcatactgattcttgtaggaacagaggagacctacaatgatcagtatgaacctggcggcagcgcaaaagatg

SEQ ID NO: 5564 - DNA, 103 bp, Artificial Sequence
  Synthetic Polynucleotide
taatacgactcactataggggtttgagtaatcaaaatcatactgattcttaacagaggagaaagaatatgtatgattttaacctggcggcagcgcaaaagatg

SEQ ID NO: 5565 - DNA, 103 bp, Artificial Sequence
  Synthetic Polynucleotide
taatacgactcactatagggtcaaagtttgagtaatcaaaatcatactgaaacagaggagatcagtaatgttttgattaaacctggcggcagcgcaaaagatg

SEQ ID NO: 5566 - DNA, 103 bp, Artificial Sequence
  Synthetic Polynucleotide
taatacgactcactatagggaagcatcaaagtttgagtaatcaaaatcataacagaggagaatgattatgattactcaaaacctggcggcagcgcaaaagatg

SEQ ID NO: 5567 - DNA, 103 bp, Artificial Sequence
  Synthetic Polynucleotide
taatacgactcactataggggtgggaagcatcaaagtttgagtaatcaaaaacagaggagatttgatatgtcaaactttaacctggcggcagcgcaaaagatg

SEQ ID NO: 5568 - DNA, 103 bp, Artificial Sequence
  Synthetic Polynucleotide
taatacgactcactataggggtggagtgggaagcatcaaagtttgagtaaaacagaggagattactcatgctttgatgcaacctggcggcagcgcaaaagatg

SEQ ID NO: 5569 - DNA, 103 bp, Artificial Sequence
  Synthetic Polynucleotide
taatacgactcactatagggagcacacgagcggggctcctgatcagatccaacagaggagaggatctatgcaggagcccaacctggcggcagcgcaaaagatg

SEQ ID NO: 5570 - DNA, 103 bp, Artificial Sequence
  Synthetic Polynucleotide
taatacgactcactatagggtgtccgtggagtgggaagcatcaaagtttgaacagaggagacaaactatgatgcttcccaacctggcggcagcgcaaaagatg

SEQ ID NO: 5571 - DNA, 103 bp, Artificial Sequence
  Synthetic Polynucleotide
taatacgactcactatagggaaagctgtccgtggagtgggaagcatcaaaaacagaggagatttgatatgtcccactccaacctggcggcagcgcaaaagatg

SEQ ID NO: 5572 - DNA, 103 bp, Artificial Sequence
  Synthetic Polynucleotide
taatacgactcactatagggagtgcaaagctgtccgtggagtgggaagcaaacagaggagatgcttcatgctccacggaaacctggcggcagcgcaaaagatg

SEQ ID NO: 5573 - DNA, 103 bp, Artificial Sequence
  Synthetic Polynucleotide
taatacgactcactataggggtaacagtgcaaagctgtccgtggagtgggaacagaggagacccactatgcggacagctaacctggcggcagcgcaaaagatg

SEQ ID NO: 5574 - DNA, 103 bp, Artificial Sequence
  Synthetic Polynucleotide
taatacgactcactataggggtcacgtaacagtgcaaagctgtccgtggaaacagaggagatccacgatgagctttgcaaacctggcggcagcgcaaaagatg

SEQ ID NO: 5575 - DNA, 103 bp, Artificial Sequence
  Synthetic Polynucleotide
taatacgactcactatagggaaaaagtcacgtaacagtgcaaagctgtccaacagaggagaggacagatgtgcactgttaacctggcggcagcgcaaaagatg

SEQ ID NO: 5576 - DNA, 103 bp, Artificial Sequence
  Synthetic Polynucleotide
taatacgactcactatagggtgaagaaaaagtcacgtaacagtgcaaagcaacagaggagagctttgatgtgttacgtgaacctggcggcagcgcaaaagatg

SEQ ID NO: 5577 - DNA, 103 bp, Artificial Sequence
  Synthetic Polynucleotide
taatacgactcactatagggtggtgtgaagaaaaagtcacgtaacagtgcaacagaggagagcactgatgcgtgactttaacctggcggcagcgcaaaagatg

SEQ ID NO: 5578 - DNA, 103 bp, Artificial Sequence
  Synthetic Polynucleotide
taatacgactcactatagggttttctggtgtgaagaaaaagtcacgtaacaacagaggagagttacgatgctttttcttaacctggcggcagcgcaaaagatg

SEQ ID NO: 5579 - DNA, 103 bp, Artificial Sequence
  Synthetic Polynucleotide
taatacgactcactatagggaaccattttctggtgtgaagaaaaagtcacaacagaggagagtgactatgtcttcacacaacctggcggcagcgcaaaagatg

SEQ ID NO: 5580 - DNA, 103 bp, Artificial Sequence
  Synthetic Polynucleotide
taatacgactcactataggggtgacatctttgcagtactccacccactgcaacagaggagagcagtgatgggagtactgaacctggcggcagcgcaaaagatg

SEQ ID NO: 5581 - DNA, 103 bp, Artificial Sequence
  Synthetic Polynucleotide
taatacgactcactatagggtgtaaagcacacgagcggggctcctgatcaaacagaggagatgatcaatggccccgctcaacctggcggcagcgcaaaagatg

SEQ ID NO: 5582 - DNA, 103 bp, Artificial Sequence
  Synthetic Polynucleotide
taatacgactcactatagggatcaaaaccattttctggtgtgaagaaaaaaacagaggagatttttcatgacaccagaaaacctggcggcagcgcaaaagatg

SEQ ID NO: 5583 - DNA, 103 bp, Artificial Sequence
  Synthetic Polynucleotide
taatacgactcactatagggcttgaatcaaaaccattttctggtgtgaagaacagaggagacttcacatgagaaaatggaacctggcggcagcgcaaaagatg

SEQ ID NO: 5584 - DNA, 103 bp, Artificial Sequence
  Synthetic Polynucleotide
taatacgactcactatagggagcatcttgaatcaaaaccattttctggtgaacagaggagacaccagatgatggttttgaacctggcggcagcgcaaaagatg

SEQ ID NO: 5585 - DNA, 103 bp, Artificial Sequence
  Synthetic Polynucleotide
taatacgactcactatagggaagagagcatcttgaatcaaaaccattttcaacagaggagagaaaatatgtttgattcaaacctggcggcagcgcaaaagatg

SEQ ID NO: 5586 - DNA, 103 bp, Artificial Sequence
  Synthetic Polynucleotide
taatacgactcactatagggaacataagagagcatcttgaatcaaaaccaaacagaggagatggtttatgttcaagatgaacctggcggcagcgcaaaagatg

SEQ ID NO: 5587 - DNA, 103 bp, Artificial Sequence
  Synthetic Polynucleotide
taatacgactcactatagggaatctaacataagagagcatcttgaatcaaaacagaggagattgattatggatgctctcaacctggcggcagcgcaaaagatg

SEQ ID NO: 5588 - DNA, 103 bp, Artificial Sequence
  Synthetic Polynucleotide
taatacgactcactatagggaagagaatctaacataagagagcatcttgaaacagaggagatcaagaatgtctcttatgaacctggcggcagcgcaaaagatg

SEQ ID NO: 5589 - DNA, 103 bp, Artificial Sequence
  Synthetic Polynucleotide
taatacgactcactatagggacagcaagagaatctaacataagagagcataacagaggagaatgctcatgtatgttagaaacctggcggcagcgcaaaagatg

SEQ ID NO: 5590 - DNA, 103 bp, Artificial Sequence
  Synthetic Polynucleotide
taatacgactcactatagggtagacacagcaagagaatctaacataagagaacagaggagactcttaatgtagattctcaacctggcggcagcgcaaaagatg

SEQ ID NO: 5591 - DNA, 103 bp, Artificial Sequence
  Synthetic Polynucleotide
taatacgactcactatagggatggatagacacagcaagagaatctaacataacagaggagaatgttaatgtctcttgctaacctggcggcagcgcaaaagatg

SEQ ID NO: 5592 - DNA, 103 bp, Artificial Sequence
  Synthetic Polynucleotide
taatacgactcactatagggtcgagtgtaaagcacacgagcggggctcctaacagaggagaaggagcatggctcgtgtgaacctggcggcagcgcaaaagatg

SEQ ID NO: 5593 - DNA, 103 bp, Artificial Sequence
  Synthetic Polynucleotide
taatacgactcactatagggtaagaatggatagacacagcaagagaatctaacagaggagaagattcatgtgctgtgtcaacctggcggcagcgcaaaagatg

SEQ ID NO: 5594 - DNA, 103 bp, Artificial Sequence
  Synthetic Polynucleotide
taatacgactcactatagggcctcataagaatggatagacacagcaagagaacagaggagactcttgatgtgtctatccaacctggcggcagcgcaaaagatg

SEQ ID NO: 5595 - DNA, 103 bp, Artificial Sequence
  Synthetic Polynucleotide
taatacgactcactatagggcttatcctcataagaatggatagacacagcaacagaggagagctgtgatgatccattctaacctggcggcagcgcaaaagatg

SEQ ID NO: 5596 - DNA, 103 bp, Artificial Sequence
  Synthetic Polynucleotide
taatacgactcactatagggtagcgcttatcctcataagaatggatagacaacagaggagagtctatatgttcttatgaaacctggcggcagcgcaaaagatg

SEQ ID NO: 5597 - DNA, 103 bp, Artificial Sequence
  Synthetic Polynucleotide
taatacgactcactatagggtagagtagcgcttatcctcataagaatggaaacagaggagatccattatgatgaggataaacctggcggcagcgcaaaagatg

SEQ ID NO: 5598 - DNA, 103 bp, Artificial Sequence
  Synthetic Polynucleotide
taatacgactcactatagggcgtaatagagtagcgcttatcctcataagaaacagaggagatcttatatggataagcgcaacctggcggcagcgcaaaagatg

SEQ ID NO: 5599 - DNA, 103 bp, Artificial Sequence
  Synthetic Polynucleotide
taatacgactcactatagggccacccgtaatagagtagcgcttatcctcaaacagaggagatgaggaatggcgctactcaacctggcggcagcgcaaaagatg

SEQ ID NO: 5600 - DNA, 103 bp, Artificial Sequence
  Synthetic Polynucleotide
taatacgactcactataggggaagaccacccgtaatagagtagcgcttataacagaggagaataagcatgactctattaaacctggcggcagcgcaaaagatg

SEQ ID NO: 5601 - DNA, 103 bp, Artificial Sequence
  Synthetic Polynucleotide
taatacgactcactatagggggagggaagaccacccgtaatagagtagcgaacagaggagacgctacatgattacgggtaacctggcggcagcgcaaaagatg

SEQ ID NO: 5602 - DNA, 103 bp, Artificial Sequence
  Synthetic Polynucleotide
taatacgactcactataggggtgccggagggaagaccacccgtaatagagaacagaggagactctatatggggtggtctaacctggcggcagcgcaaaagatg

SEQ ID NO: 5603 - DNA, 103 bp, Artificial Sequence
  Synthetic Polynucleotide
taatacgactcactatagggccgcgtcgagtgtaaagcacacgagcggggaacagaggagaccccgcatgtgtgctttaaacctggcggcagcgcaaaagatg

SEQ ID NO: 5604 - DNA, 103 bp, Artificial Sequence
  Synthetic Polynucleotide
taatacgactcactatagggctgcagtgccggagggaagaccacccgtaaaacagaggagattacggatggtcttccctaacctggcggcagcgcaaaagatg

SEQ ID NO: 5605 - DNA, 103 bp, Artificial Sequence
  Synthetic Polynucleotide
taatacgactcactatagggagtgcctgcagtgccggagggaagaccaccaacagaggagaggtggtatgccctccggcaacctggcggcagcgcaaaagatg

SEQ ID NO: 5606 - DNA, 103 bp, Artificial Sequence
  Synthetic Polynucleotide
taatacgactcactatagggactgaagtgcctgcagtgccggagggaagaaacagaggagatcttccatgcggcactgcaacctggcggcagcgcaaaagatg

SEQ ID NO: 5607 - DNA, 103 bp, Artificial Sequence
  Synthetic Polynucleotide
taatacgactcactatagggtgattactgaagtgcctgcagtgccggaggaacagaggagacctccgatgctgcaggcaaacctggcggcagcgcaaaagatg

SEQ ID NO: 5608 - DNA, 103 bp, Artificial Sequence
  Synthetic Polynucleotide
taatacgactcactatagggagtattgattactgaagtgcctgcagtgccaacagaggagaggcactatgggcacttcaaacctggcggcagcgcaaaagatg

SEQ ID NO: 5609 - DNA, 103 bp, Artificial Sequence
  Synthetic Polynucleotide
taatacgactcactatagggattaaagtattgattactgaagtgcctgcaaacagaggagatgcaggatgttcagtaataacctggcggcagcgcaaaagatg

SEQ ID NO: 5610 - DNA, 103 bp, Artificial Sequence
  Synthetic Polynucleotide
taatacgactcactatagggtgttaattaaagtattgattactgaagtgcaacagaggagagcacttatgtaatcaataaacctggcggcagcgcaaaagatg

SEQ ID NO: 5611 - DNA, 103 bp, Artificial Sequence
  Synthetic Polynucleotide
taatacgactcactatagggcacattgttaattaaagtattgattactgaaacagaggagatcagtaatgaatactttaaacctggcggcagcgcaaaagatg

SEQ ID NO: 5612 - DNA, 103 bp, Artificial Sequence
  Synthetic Polynucleotide
taatacgactcactatagggaatatcacattgttaattaaagtattgattaacagaggagaaatcaaatgtttaattaaaacctggcggcagcgcaaaagatg

SEQ ID NO: 5613 - DNA, 103 bp, Artificial Sequence
  Synthetic Polynucleotide
taatacgactcactatagggatctaaatatcacattgttaattaaagtataacagaggagaatacttatgttaacaatgaacctggcggcagcgcaaaagatg

SEQ ID NO: 5614 - DNA, 103 bp, Artificial Sequence
  Synthetic Polynucleotide
taatacgactcactatagggtaaccccgcgtcgagtgtaaagcacacgagaacagaggagactcgtgatgtttacactcaacctggcggcagcgcaaaagatg

SEQ ID NO: 5615 - DNA, 103 bp, Artificial Sequence
  Synthetic Polynucleotide
taatacgactcactatagggagcagatctaaatatcacattgttaattaaaacagaggagattaattatgaatgtgataaacctggcggcagcgcaaaagatg

SEQ ID NO: 5616 - DNA, 103 bp, Artificial Sequence
  Synthetic Polynucleotide
taatacgactcactatagggtacagagcagatctaaatatcacattgttaaacagaggagataacaaatggatatttagaacctggcggcagcgcaaaagatg

SEQ ID NO: 5617 - DNA, 103 bp, Artificial Sequence
  Synthetic Polynucleotide
taatacgactcactatagggtatggtacagagcagatctaaatatcacataacagaggagaatgtgaatgttagatctgaacctggcggcagcgcaaaagatg

SEQ ID NO: 5618 - DNA, 103 bp, Artificial Sequence
  Synthetic Polynucleotide
taatacgactcactataggggtaagtatggtacagagcagatctaaatataacagaggagaatatttatgtctgctctgaacctggcggcagcgcaaaagatg

SEQ ID NO: 5619 - DNA, 103 bp, Artificial Sequence
  Synthetic Polynucleotide
taatacgactcactatagggttagagtaagtatggtacagagcagatctaaacagaggagatagatcatgtctgtaccaaacctggcggcagcgcaaaagatg

SEQ ID NO: 5620 - DNA, 103 bp, Artificial Sequence
  Synthetic Polynucleotide
taatacgactcactatagggcaaagttagagtaagtatggtacagagcagaacagaggagactgctcatgaccatacttaacctggcggcagcgcaaaagatg

SEQ ID NO: 5621 - DNA, 103 bp, Artificial Sequence
  Synthetic Polynucleotide
taatacgactcactatagggccattcaaagttagagtaagtatggtacagaacagaggagactgtacatgacttactctaacctggcggcagcgcaaaagatg

SEQ ID NO: 5622 - DNA, 103 bp, Artificial Sequence
  Synthetic Polynucleotide
taatacgactcactatagggtcatcccattcaaagttagagtaagtatggaacagaggagaccatacatgctctaacttaacctggcggcagcgcaaaagatg

SEQ ID NO: 5623 - DNA, 103 bp, Artificial Sequence
  Synthetic Polynucleotide
taatacgactcactatagggttacatcatcccattcaaagttagagtaagaacagaggagacttactatgactttgaataacctggcggcagcgcaaaagatg

SEQ ID NO: 5624 - DNA, 103 bp, Artificial Sequence
  Synthetic Polynucleotide
taatacgactcactatagggtaagattacatcatcccattcaaagttagaaacagaggagatctaacatggaatgggataacctggcggcagcgcaaaagatg

SEQ ID NO: 5625 - DNA, 103 bp, Artificial Sequence
  Synthetic Polynucleotide
taatacgactcactatagggatttttaaccccgcgtcgagtgtaaagcacaacagaggagagtgcttatgactcgacgcaacctggcggcagcgcaaaagatg

SEQ ID NO: 5626 - DNA, 103 bp, Artificial Sequence
  Synthetic Polynucleotide
taatacgactcactataggggccattaagattacatcatcccattcaaagaacagaggagactttgaatgggatgatgtaacctggcggcagcgcaaaagatg

SEQ ID NO: 5627 - DNA, 103 bp, Artificial Sequence
  Synthetic Polynucleotide
taatacgactcactatagggcataagccattaagattacatcatcccattaacagaggagaaatgggatgatgtaatctaacctggcggcagcgcaaaagatg

SEQ ID NO: 5628 - DNA, 103 bp, Artificial Sequence
  Synthetic Polynucleotide
taatacgactcactatagggatctccataagccattaagattacatcatcaacagaggagagatgatatgatcttaatgaacctggcggcagcgcaaaagatg

SEQ ID NO: 5629 - DNA, 103 bp, Artificial Sequence
  Synthetic Polynucleotide
taatacgactcactatagggatgtcatctccataagccattaagattacaaacagaggagatgtaatatgaatggcttaaacctggcggcagcgcaaaagatg

SEQ ID NO: 5630 - DNA, 103 bp, Artificial Sequence
  Synthetic Polynucleotide
taatacgactcactatagggcaacaatgtcatctccataagccattaagaaacagaggagatcttaaatgcttatggagaacctggcggcagcgcaaaagatg

SEQ ID NO: 5631 - DNA, 103 bp, Artificial Sequence
  Synthetic Polynucleotide
taatacgactcactatagggagcagcaacaatgtcatctccataagccataacagaggagaatggctatgggagatgacaacctggcggcagcgcaaaagatg

SEQ ID NO: 5632 - DNA, 103 bp, Artificial Sequence
  Synthetic Polynucleotide
taatacgactcactatagggtctgaagcagcaacaatgtcatctccataaaacagaggagattatggatgtgacattgtaacctggcggcagcgcaaaagatg

SEQ ID NO: 5633 - DNA, 103 bp, Artificial Sequence
  Synthetic Polynucleotide
taatacgactcactatagggcatagtctgaagcagcaacaatgtcatctcaacagaggagagagatgatgttgttgctgaacctggcggcagcgcaaaagatg

SEQ ID NO: 5634 - DNA, 103 bp, Artificial Sequence
  Synthetic Polynucleotide
taatacgactcactatagggcaaatcatagtctgaagcagcaacaatgtcaacagaggagagacattatggctgcttcaaacctggcggcagcgcaaaagatg

SEQ ID NO: 5635 - DNA, 103 bp, Artificial Sequence
  Synthetic Polynucleotide
taatacgactcactatagggaggtccaaatcatagtctgaagcagcaacaaacagaggagatgttgcatgttcagactaaacctggcggcagcgcaaaagatg

SEQ ID NO: 5636 - DNA, 103 bp, Artificial Sequence
  Synthetic Polynucleotide
taatacgactcactataggggggcaatttttaaccccgcgtcgagtgtaaaacagaggagattacacatgacgcggggtaacctggcggcagcgcaaaagatg

SEQ ID NO: 5637 - DNA, 103 bp, Artificial Sequence
  Synthetic Polynucleotide
taatacgactcactatagggtggagaggtccaaatcatagtctgaagcagaacagaggagactgcttatgactatgattaacctggcggcagcgcaaaagatg

SEQ ID NO: 5638 - DNA, 103 bp, Artificial Sequence
  Synthetic Polynucleotide
taatacgactcactatagggtaccctggagaggtccaaatcatagtctgaaacagaggagatcagacatggatttggacaacctggcggcagcgcaaaagatg

SEQ ID NO: 5639 - DNA, 103 bp, Artificial Sequence
  Synthetic Polynucleotide
taatacgactcactatagggtcttttaccctggagaggtccaaatcatagaacagaggagactatgaatgggacctctcaacctggcggcagcgcaaaagatg

SEQ ID NO: 5640 - DNA, 103 bp, Artificial Sequence
  Synthetic Polynucleotide
taatacgactcactatagggtgaattcttttaccctggagaggtccaaataacagaggagaatttggatgtctccagggaacctggcggcagcgcaaaagatg

SEQ ID NO: 5641 - DNA, 103 bp, Artificial Sequence
  Synthetic Polynucleotide
taatacgactcactatagggtgccatgaattcttttaccctggagaggtcaacagaggagagacctcatgagggtaaaaaacctggcggcagcgcaaaagatg

SEQ ID NO: 5642 - DNA, 103 bp, Artificial Sequence
  Synthetic Polynucleotide
taatacgactcactatagggatctttgccatgaattcttttaccctggagaacagaggagactccagatgaaaagaattaacctggcggcagcgcaaaagatg

SEQ ID NO: 5643 - DNA, 103 bp, Artificial Sequence
  Synthetic Polynucleotide
taatacgactcactatagggatccaatctttgccatgaattcttttacccaacagaggagagggtaaatgaattcatggaacctggcggcagcgcaaaagatg

SEQ ID NO: 5644 - DNA, 103 bp, Artificial Sequence
  Synthetic Polynucleotide
taatacgactcactatagggggtatatccaatctttgccatgaattctttaacagaggagaaaagaaatgatggcaaagaacctggcggcagcgcaaaagatg

SEQ ID NO: 5645 - DNA, 103 bp, Artificial Sequence
  Synthetic Polynucleotide
taatacgactcactataggggttatggtatatccaatctttgccatgaataacagaggagaattcatatgaaagattggaacctggcggcagcgcaaaagatg

SEQ ID NO: 5646 - DNA, 103 bp, Artificial Sequence
  Synthetic Polynucleotide
taatacgactcactatagggctggtgttatggtatatccaatctttgccaaacagaggagatggcaaatgttggatataaacctggcggcagcgcaaaagatg

SEQ ID NO: 5647 - DNA, 103 bp, Artificial Sequence
  Synthetic Polynucleotide
taatacgactcactataggggccttgggcaatttttaaccccgcgtcgagaacagaggagactcgacatggggttaaaaaacctggcggcagcgcaaaagatg

SEQ ID NO: 5648 - DNA, 103 bp, Artificial Sequence
  Synthetic Polynucleotide
taatacgactcactatagggatttgctggtgttatggtatatccaatcttaacagaggagaaagattatgtataccataaacctggcggcagcgcaaaagatg

SEQ ID NO: 5649 - DNA, 103 bp, Artificial Sequence
  Synthetic Polynucleotide
taatacgactcactatagggcccttatttgctggtgttatggtatatccaaacagaggagatggataatgcataacaccaacctggcggcagcgcaaaagatg

SEQ ID NO: 5650 - DNA, 103 bp, Artificial Sequence
  Synthetic Polynucleotide
taatacgactcactatagggtttctcccttatttgctggtgttatggtataacagaggagaataccaatgcaccagcaaaacctggcggcagcgcaaaagatg

SEQ ID NO: 5651 - DNA, 103 bp, Artificial Sequence
  Synthetic Polynucleotide
taatacgactcactataggggaagttttctcccttatttgctggtgttataacagaggagaataacaatggcaaataagaacctggcggcagcgcaaaagatg

SEQ ID NO: 5652 - DNA, 103 bp, Artificial Sequence
  Synthetic Polynucleotide
taatacgactcactatagggtgagtgaagttttctcccttatttgctggtaacagaggagaaccagcatgtaagggagaaacctggcggcagcgcaaaagatg

SEQ ID NO: 5653 - DNA, 103 bp, Artificial Sequence
  Synthetic Polynucleotide
taatacgactcactataggggtctttgagtgaagttttctcccttatttgaacagaggagacaaataatggagaaaactaacctggcggcagcgcaaaagatg

SEQ ID NO: 5654 - DNA, 103 bp, Artificial Sequence
  Synthetic Polynucleotide
taatacgactcactataggggagtggtctttgagtgaagttttctcccttaacagaggagaaagggaatgaacttcactaacctggcggcagcgcaaaagatg

SEQ ID NO: 5655 - DNA, 103 bp, Artificial Sequence
  Synthetic Polynucleotide
taatacgactcactatagggtcagtgagtggtctttgagtgaagttttctaacagaggagaagaaaaatgcactcaaagaacctggcggcagcgcaaaagatg

SEQ ID NO: 5656 - DNA, 103 bp, Artificial Sequence
  Synthetic Polynucleotide
taatacgactcactataggggaatttcagtgagtggtctttgagtgaagtaacagaggagaacttcaatgaaagaccacaacctggcggcagcgcaaaagatg

SEQ ID NO: 5657 - DNA, 103 bp, Artificial Sequence
  Synthetic Polynucleotide
taatacgactcactatagggaaactgaatttcagtgagtggtctttgagtaacagaggagaactcaaatgccactcactaacctggcggcagcgcaaaagatg

SEQ ID NO: 5658 - DNA, 103 bp, Artificial Sequence
  Synthetic Polynucleotide
taatacgactcactataggggccaggccttgggcaatttttaaccccgcgaacagaggagacgcgggatgaaaaattgcaacctggcggcagcgcaaaagatg

SEQ ID NO: 5659 - DNA, 103 bp, Artificial Sequence
  Synthetic Polynucleotide
taatacgactcactatagggttcaaaaactgaatttcagtgagtggtcttaacagaggagaaagaccatgcactgaaataacctggcggcagcgcaaaagatg

SEQ ID NO: 5660 - DNA, 103 bp, Artificial Sequence
  Synthetic Polynucleotide
taatacgactcactatagggatctcttcaaaaactgaatttcagtgagtgaacagaggagacactcaatgaaattcagtaacctggcggcagcgcaaaagatg

SEQ ID NO: 5661 - DNA, 103 bp, Artificial Sequence
  Synthetic Polynucleotide
taatacgactcactataggggaaatatctcttcaaaaactgaatttcagtaacagaggagaactgaaatgcagtttttgaacctggcggcagcgcaaaagatg

SEQ ID NO: 5662 - DNA, 103 bp, Artificial Sequence
  Synthetic Polynucleotide
taatacgactcactatagggtttccgaaatatctcttcaaaaactgaattaacagaggagaaattcaatgtttgaagagaacctggcggcagcgcaaaagatg

SEQ ID NO: 5663 - DNA, 103 bp, Artificial Sequence
  Synthetic Polynucleotide
taatacgactcactatagggtctgttttccgaaatatctcttcaaaaactaacagaggagaagttttatgagagatattaacctggcggcagcgcaaaagatg

SEQ ID NO: 5664 - DNA, 103 bp, Artificial Sequence
  Synthetic Polynucleotide
taatacgactcactataggggccattctgttttccgaaatatctcttcaaaacagaggagattgaagatgtatttcggaaacctggcggcagcgcaaaagatg

SEQ ID NO: 5665 - DNA, 103 bp, Artificial Sequence
  Synthetic Polynucleotide
taatacgactcactatagggcacatgccattctgttttccgaaatatctcaacagaggagagagataatgcggaaaacaaacctggcggcagcgcaaaagatg

SEQ ID NO: 5666 - DNA, 103 bp, Artificial Sequence
  Synthetic Polynucleotide
taatacgactcactataggggtacccacatgccattctgttttccgaaataacagaggagaatttcgatgaacagaatgaacctggcggcagcgcaaaagatg

SEQ ID NO: 5667 - DNA, 103 bp, Artificial Sequence
  Synthetic Polynucleotide
taatacgactcactatagggtatgggtacccacatgccattctgttttccaacagaggagaggaaaaatgaatggcatgaacctggcggcagcgcaaaagatg

SEQ ID NO: 5668 - DNA, 103 bp, Artificial Sequence
  Synthetic Polynucleotide
taatacgactcactatagggtgcattatgggtacccacatgccattctgtaacagaggagaacagaaatgcatgtgggtaacctggcggcagcgcaaaagatg

SEQ ID NO: 5669 - DNA, 103 bp, Artificial Sequence
  Synthetic Polynucleotide
taatacgactcactataggggttgtgccaggccttgggcaatttttaaccaacagaggagaggttaaatgttgcccaagaacctggcggcagcgcaaaagatg

SEQ ID NO: 5670 - DNA, 103 bp, Artificial Sequence
  Synthetic Polynucleotide
taatacgactcactatagggccttctgcattatgggtacccacatgccataacagaggagaatggcaatggggtacccaaacctggcggcagcgcaaaagatg

SEQ ID NO: 5671 - DNA, 103 bp, Artificial Sequence
  Synthetic Polynucleotide
taatacgactcactatagggattttccttctgcattatgggtacccacataacagaggagaatgtggatgcccataatgaacctggcggcagcgcaaaagatg

SEQ ID NO: 5672 - DNA, 103 bp, Artificial Sequence
  Synthetic Polynucleotide
taatacgactcactatagggtccagattttccttctgcattatgggtaccaacagaggagaggtaccatgaatgcagaaaacctggcggcagcgcaaaagatg

SEQ ID NO: 5673 - DNA, 103 bp, Artificial Sequence
  Synthetic Polynucleotide
taatacgactcactatagggtcatttccagattttccttctgcattatggaacagaggagaccataaatgagaaggaaaaacctggcggcagcgcaaaagatg

SEQ ID NO: 5674 - DNA, 103 bp, Artificial Sequence
  Synthetic Polynucleotide
taatacgactcactatagggaagcatcatttccagattttccttctgcataacagaggagaatgcagatggaaaatctgaacctggcggcagcgcaaaagatg

SEQ ID NO: 5675 - DNA, 103 bp, Artificial Sequence
  Synthetic Polynucleotide
taatacgactcactatagggcaggaaagcatcatttccagattttccttcaacagaggagagaaggaatgtctggaaataacctggcggcagcgcaaaagatg

SEQ ID NO: 5676 - DNA, 103 bp, Artificial Sequence
  Synthetic Polynucleotide
taatacgactcactatagggtgtaccaggaaagcatcatttccagattttaacagaggagaaaaatcatgaaatgatgcaacctggcggcagcgcaaaagatg

SEQ ID NO: 5677 - DNA, 103 bp, Artificial Sequence
  Synthetic Polynucleotide
taatacgactcactatagggtggtttgtaccaggaaagcatcatttccagaacagaggagactggaaatgatgctttccaacctggcggcagcgcaaaagatg

SEQ ID NO: 5678 - DNA, 103 bp, Artificial Sequence
  Synthetic Polynucleotide
taatacgactcactataggggtgcctggtttgtaccaggaaagcatcattaacagaggagaaatgatatgttcctggtaaacctggcggcagcgcaaaagatg

SEQ ID NO: 5679 - DNA, 103 bp, Artificial Sequence
  Synthetic Polynucleotide
taatacgactcactataggggcaatgtgcctggtttgtaccaggaaagcaaacagaggagatgctttatgggtacaaacaacctggcggcagcgcaaaagatg

SEQ ID NO: 5680 - DNA, 103 bp, Artificial Sequence
  Synthetic Polynucleotide
taatacgactcactatagggaggttgttgtgccaggccttgggcaattttaacagaggagaaaaattatgcaaggcctgaacctggcggcagcgcaaaagatg

SEQ ID NO: 5681 - DNA, 103 bp, Artificial Sequence
  Synthetic Polynucleotide
taatacgactcactatagggttcttgcaatgtgcctggtttgtaccaggaaacagaggagatcctggatgaaaccaggcaacctggcggcagcgcaaaagatg

SEQ ID NO: 5682 - DNA, 103 bp, Artificial Sequence
  Synthetic Polynucleotide
taatacgactcactatagggagtttttcttgcaatgtgcctggtttgtacaacagaggagagtacaaatgaggcacattaacctggcggcagcgcaaaagatg

SEQ ID NO: 5683 - DNA, 103 bp, Artificial Sequence
  Synthetic Polynucleotide
taatacgactcactatagggtatccagtttttcttgcaatgtgcctggttaacagaggagaaaccagatgcattgcaagaacctggcggcagcgcaaaagatg

SEQ ID NO: 5684 - DNA, 103 bp, Artificial Sequence
  Synthetic Polynucleotide
taatacgactcactatagggcacactatccagtttttcttgcaatgtgccaacagaggagaggcacaatgcaagaaaaaaacctggcggcagcgcaaaagatg

SEQ ID NO: 5685 - DNA, 103 bp, Artificial Sequence
  Synthetic Polynucleotide
taatacgactcactatagggtgagccacactatccagtttttcttgcaataacagaggagaattgcaatgaaaactggaaacctggcggcagcgcaaaagatg

SEQ ID NO: 5686 - DNA, 103 bp, Artificial Sequence
  Synthetic Polynucleotide
taatacgactcactatagggccagctgagccacactatccagtttttcttaacagaggagaaagaaaatgtggatagtgaacctggcggcagcgcaaaagatg

SEQ ID NO: 5687 - DNA, 103 bp, Artificial Sequence
  Synthetic Polynucleotide
taatacgactcactataggggtgtgccagctgagccacactatccagtttaacagaggagaaaactgatgagtgtggctaacctggcggcagcgcaaaagatg

SEQ ID NO: 5688 - DNA, 103 bp, Artificial Sequence
  Synthetic Polynucleotide
taatacgactcactataggggaaaagtgtgccagctgagccacactatccaacagaggagaggatagatgggctcagctaacctggcggcagcgcaaaagatg

SEQ ID NO: 5689 - DNA, 103 bp, Artificial Sequence
  Synthetic Polynucleotide
taatacgactcactatagggctcctgaaaagtgtgccagctgagccacacaacagaggagagtgtggatgagctggcacaacctggcggcagcgcaaaagatg

SEQ ID NO: 5690 - DNA, 103 bp, Artificial Sequence
  Synthetic Polynucleotide
taatacgactcactatagggatcttctcctgaaaagtgtgccagctgagcaacagaggagagctcagatggcacactttaacctggcggcagcgcaaaagatg

SEQ ID NO: 5691 - DNA, 103 bp, Artificial Sequence
  Synthetic Polynucleotide
taatacgactcactataggggcacggtgacatctttgcagtactccacccaacagaggagagggtggatgactgcaaagaacctggcggcagcgcaaaagatg

SEQ ID NO: 5692 - DNA, 103 bp, Artificial Sequence
  Synthetic Polynucleotide
taatacgactcactatagggcccctaggttgttgtgccaggccttgggcaaacagaggagatgcccaatgcctggcacaaacctggcggcagcgcaaaagatg

SEQ ID NO: 5693 - DNA, 103 bp, Artificial Sequence
  Synthetic Polynucleotide
taatacgactcactatagggtaagtatcttctcctgaaaagtgtgccagcaacagaggagagctggcatgcttttcaggaacctggcggcagcgcaaaagatg

SEQ ID NO: 5694 - DNA, 103 bp, Artificial Sequence
  Synthetic Polynucleotide
taatacgactcactatagggtcttgtaagtatcttctcctgaaaagtgtgaacagaggagacacactatgcaggagaagaacctggcggcagcgcaaaagatg

SEQ ID NO: 5695 - DNA, 103 bp, Artificial Sequence
  Synthetic Polynucleotide
taatacgactcactatagggcaatgtcttgtaagtatcttctcctgaaaaaacagaggagattttcaatggaagatactaacctggcggcagcgcaaaagatg

SEQ ID NO: 5696 - DNA, 103 bp, Artificial Sequence
  Synthetic Polynucleotide
taatacgactcactatagggtggaacaatgtcttgtaagtatcttctcctaacagaggagaaggagaatgtacttacaaaacctggcggcagcgcaaaagatg

SEQ ID NO: 5697 - DNA, 103 bp, Artificial Sequence
  Synthetic Polynucleotide
taatacgactcactatagggaaggctggaacaatgtcttgtaagtatcttaacagaggagaaagataatgacaagacataacctggcggcagcgcaaaagatg

SEQ ID NO: 5698 - DNA, 103 bp, Artificial Sequence
  Synthetic Polynucleotide
taatacgactcactatagggaatgaaaggctggaacaatgtcttgtaagtaacagaggagaacttacatgacattgttcaacctggcggcagcgcaaaagatg

SEQ ID NO: 5699 - DNA, 103 bp, Artificial Sequence
  Synthetic Polynucleotide
taatacgactcactatagggtcattaatgaaaggctggaacaatgtcttgaacagaggagacaagacatggttccagccaacctggcggcagcgcaaaagatg

SEQ ID NO: 5700 - DNA, 103 bp, Artificial Sequence
  Synthetic Polynucleotide
taatacgactcactatagggacccatcattaatgaaaggctggaacaatgaacagaggagacattgtatgagcctttcaaacctggcggcagcgcaaaagatg

SEQ ID NO: 5701 - DNA, 103 bp, Artificial Sequence
  Synthetic Polynucleotide
taatacgactcactatagggtttaaacccatcattaatgaaaggctggaaaacagaggagattccagatgttcattaataacctggcggcagcgcaaaagatg

SEQ ID NO: 5702 - DNA, 103 bp, Artificial Sequence
  Synthetic Polynucleotide
taatacgactcactatagggtttattttaaacccatcattaatgaaaggcaacagaggagagcctttatgtaatgatggaacctggcggcagcgcaaaagatg

SEQ ID NO: 5703 - DNA, 103 bp, Artificial Sequence
  Synthetic Polynucleotide
taatacgactcactatagggctagtcccctaggttgttgtgccaggccttaacagaggagaaaggccatgcacaacaacaacctggcggcagcgcaaaagatg

SEQ ID NO: 5704 - DNA, 103 bp, Artificial Sequence
  Synthetic Polynucleotide
taatacgactcactatagggatggttttattttaaacccatcattaatgaaacagaggagatcattaatgatgggtttaaacctggcggcagcgcaaaagatg

SEQ ID NO: 5705 - DNA, 103 bp, Artificial Sequence
  Synthetic Polynucleotide
taatacgactcactatagggtttccatggttttattttaaacccatcattaacagaggagaaatgatatgtttaaaataaacctggcggcagcgcaaaagatg

SEQ ID NO: 5706 - DNA, 103 bp, Artificial Sequence
  Synthetic Polynucleotide
taatacgactcactatagggagctgtttccatggttttattttaaacccaaacagaggagatgggttatgaataaaaccaacctggcggcagcgcaaaagatg

SEQ ID NO: 5707 - DNA, 103 bp, Artificial Sequence
  Synthetic Polynucleotide
taatacgactcactatagggaatgcagctgtttccatggttttattttaaaacagaggagattaaaaatgaaccatggaaacctggcggcagcgcaaaagatg

SEQ ID NO: 5708 - DNA, 103 bp, Artificial Sequence
  Synthetic Polynucleotide
taatacgactcactatagggctcaaaatgcagctgtttccatggttttataacagaggagaataaaaatgtggaaacagaacctggcggcagcgcaaaagatg

SEQ ID NO: 5709 - DNA, 103 bp, Artificial Sequence
  Synthetic Polynucleotide
taatacgactcactatagggagccactcaaaatgcagctgtttccatggtaacagaggagaaccatgatgacagctgcaaacctggcggcagcgcaaaagatg

SEQ ID NO: 5710 - DNA, 103 bp, Artificial Sequence
  Synthetic Polynucleotide
taatacgactcactatagggtattgagccactcaaaatgcagctgtttccaacagaggagaggaaacatgtgcattttgaacctggcggcagcgcaaaagatg

SEQ ID NO: 5711 - DNA, 103 bp, Artificial Sequence
  Synthetic Polynucleotide
taatacgactcactataggggaatttattgagccactcaaaatgcagctgaacagaggagacagctgatgtttgagtggaacctggcggcagcgcaaaagatg

SEQ ID NO: 5712 - DNA, 103 bp, Artificial Sequence
  Synthetic Polynucleotide
taatacgactcactatagggaacttgaatttattgagccactcaaaatgcaacagaggagagcatttatggtggctcaaaacctggcggcagcgcaaaagatg

SEQ ID NO: 5713 - DNA, 103 bp, Artificial Sequence
  Synthetic Polynucleotide
taatacgactcactatagggtttaaaacttgaatttattgagccactcaaaacagaggagattgagtatgtcaataaataacctggcggcagcgcaaaagatg

SEQ ID NO: 5714 - DNA, 103 bp, Artificial Sequence
  Synthetic Polynucleotide
taatacgactcactatagggaaaacctagtcccctaggttgttgtgccagaacagaggagactggcaatgcaacctaggaacctggcggcagcgcaaaagatg

SEQ ID NO: 5715 - DNA, 103 bp, Artificial Sequence
  Synthetic Polynucleotide
taatacgactcactatagggctgactttaaaacttgaatttattgagccaaacagaggagatggctcatgaaattcaagaacctggcggcagcgcaaaagatg

SEQ ID NO: 5716 - DNA, 103 bp, Artificial Sequence
  Synthetic Polynucleotide
taatacgactcactatagggaatttctgactttaaaacttgaatttattgaacagaggagacaataaatgcaagttttaaacctggcggcagcgcaaaagatg

SEQ ID NO: 5717 - DNA, 103 bp, Artificial Sequence
  Synthetic Polynucleotide
taatacgactcactatagggatattaatttctgactttaaaacttgaattaacagaggagaaattcaatgtttaaagtcaacctggcggcagcgcaaaagatg

SEQ ID NO: 5718 - DNA, 103 bp, Artificial Sequence
  Synthetic Polynucleotide
taatacgactcactatagggaaatcatattaatttctgactttaaaacttaacagaggagaaagtttatgagtcagaaaaacctggcggcagcgcaaaagatg

SEQ ID NO: 5719 - DNA, 103 bp, Artificial Sequence
  Synthetic Polynucleotide
taatacgactcactatagggatttcaaatcatattaatttctgactttaaaacagaggagattaaagatggaaattaataacctggcggcagcgcaaaagatg

SEQ ID NO: 5720 - DNA, 103 bp, Artificial Sequence
  Synthetic Polynucleotide
taatacgactcactatagggtattaatttcaaatcatattaatttctgacaacagaggagagtcagaatgtaatatgataacctggcggcagcgcaaaagatg

SEQ ID NO: 5721 - DNA, 103 bp, Artificial Sequence
  Synthetic Polynucleotide
taatacgactcactatagggaataatattaatttcaaatcatattaatttaacagaggagaaaattaatgtgatttgaaaacctggcggcagcgcaaaagatg

SEQ ID NO: 5722 - DNA, 103 bp, Artificial Sequence
  Synthetic Polynucleotide
taatacgactcactatagggaattgaataatattaatttcaaatcatattaacagaggagaaatatgatgtgaaattaaaacctggcggcagcgcaaaagatg

SEQ ID NO: 5723 - DNA, 103 bp, Artificial Sequence
  Synthetic Polynucleotide
taatacgactcactatagggaatcaaattgaataatattaatttcaaatcaacagaggagagatttgatgttaatattaaacctggcggcagcgcaaaagatg

SEQ ID NO: 5724 - DNA, 103 bp, Artificial Sequence
  Synthetic Polynucleotide
taatacgactcactatagggaattaaatcaaattgaataatattaatttcaacagaggagagaaattatgattattcaaaacctggcggcagcgcaaaagatg

SEQ ID NO: 5725 - DNA, 103 bp, Artificial Sequence
  Synthetic Polynucleotide
taatacgactcactatagggataggaaaacctagtcccctaggttgttgtaacagaggagaacaacaatgtaggggactaacctggcggcagcgcaaaagatg

SEQ ID NO: 5726 - DNA, 103 bp, Artificial Sequence
  Synthetic Polynucleotide
taatacgactcactatagggagccgaattaaatcaaattgaataatattaaacagaggagataatatatgtcaatttgaaacctggcggcagcgcaaaagatg

SEQ ID NO: 5727 - DNA, 103 bp, Artificial Sequence
  Synthetic Polynucleotide
taatacgactcactatagggaattaagccgaattaaatcaaattgaataaaacagaggagattattcatgttgatttaaaacctggcggcagcgcaaaagatg

SEQ ID NO: 5728 - DNA, 103 bp, Artificial Sequence
  Synthetic Polynucleotide
taatacgactcactataggggtccaaattaagccgaattaaatcaaattgaacagaggagacaatttatgttaattcggaacctggcggcagcgcaaaagatg

SEQ ID NO: 5729 - DNA, 103 bp, Artificial Sequence
  Synthetic Polynucleotide
taatacgactcactatagggcaatagtccaaattaagccgaattaaatcaaacagaggagatgatttatgtcggcttaaaacctggcggcagcgcaaaagatg

SEQ ID NO: 5730 - DNA, 103 bp, Artificial Sequence
  Synthetic Polynucleotide
taatacgactcactatagggacacccaatagtccaaattaagccgaattaaacagaggagataattcatgttaatttggaacctggcggcagcgcaaaagatg

SEQ ID NO: 5731 - DNA, 103 bp, Artificial Sequence
  Synthetic Polynucleotide
taatacgactcactataggggaaacacacccaatagtccaaattaagccgaacagaggagacggcttatgttggactataacctggcggcagcgcaaaagatg

SEQ ID NO: 5732 - DNA, 103 bp, Artificial Sequence
  Synthetic Polynucleotide
taatacgactcactatagggaatttgaaacacacccaatagtccaaattaaacagaggagataatttatgctattgggtaacctggcggcagcgcaaaagatg

SEQ ID NO: 5733 - DNA, 103 bp, Artificial Sequence
  Synthetic Polynucleotide
taatacgactcactatagggaacaaaatttgaaacacacccaatagtccaaacagaggagatggactatggggtgtgttaacctggcggcagcgcaaaagatg

SEQ ID NO: 5734 - DNA, 103 bp, Artificial Sequence
  Synthetic Polynucleotide
taatacgactcactatagggcaaaaataggaaaacctagtcccctaggttaacagaggagaaacctaatggactaggttaacctggcggcagcgcaaaagatg

SEQ ID NO: 5735 - DNA, 103 bp, Artificial Sequence
  Synthetic Polynucleotide
taatacgactcactatagggatttacaaaaataggaaaacctagtcccctaacagaggagaaggggaatgggttttcctaacctggcggcagcgcaaaagatg

SEQ ID NO: 5736 - DNA, 103 bp, Artificial Sequence
  Synthetic Polynucleotide
taatacgactcactatagggacataatttacaaaaataggaaaacctagtaacagaggagaactaggatgtcctattttaacctggcggcagcgcaaaagatg

SEQ ID NO: 5737 - DNA, 103 bp, Artificial Sequence
  Synthetic Polynucleotide
taatacgactcactatagggtattgacataatttacaaaaataggaaaacaacagaggagagttttcatgtttttgtaaaacctggcggcagcgcaaaagatg

SEQ ID NO: 5738 - DNA, 103 bp, Artificial Sequence
  Synthetic Polynucleotide
taatacgactcactatagggacccatattgacataatttacaaaaataggaacagaggagacctattatggtaaattataacctggcggcagcgcaaaagatg

SEQ ID NO: 5739 - DNA, 103 bp, Artificial Sequence
  Synthetic Polynucleotide
taatacgactcactatagggtttgcacccatattgacataatttacaaaaaacagaggagattttgtatgttatgtcaaaacctggcggcagcgcaaaagatg

SEQ ID NO: 5740 - DNA, 103 bp, Artificial Sequence
  Synthetic Polynucleotide
taatacgactcactataggggtaaagcacggtgacatctttgcagtactcaacagaggagagagtacatgaaagatgtcaacctggcggcagcgcaaaagatg

SEQ ID NO: 5741 - DNA, 103 bp, Artificial Sequence
  Synthetic Polynucleotide
taatacgactcactatagggtattatttgcacccatattgacataatttaaacagaggagataaattatgtcaatatggaacctggcggcagcgcaaaagatg

SEQ ID NO: 5742 - DNA, 103 bp, Artificial Sequence
  Synthetic Polynucleotide
taatacgactcactatagggtttgctattatttgcacccatattgacataaacagaggagatatgtcatgatgggtgcaaacctggcggcagcgcaaaagatg

SEQ ID NO: 5743 - DNA, 103 bp, Artificial Sequence
  Synthetic Polynucleotide
taatacgactcactataggggattctttgctattatttgcacccatattgaacagaggagacaatatatgtgcaaataaaacctggcggcagcgcaaaagatg

SEQ ID NO: 5744 - DNA, 103 bp, Artificial Sequence
  Synthetic Polynucleotide
taatacgactcactatagggaagcagattctttgctattatttgcacccaaacagaggagatgggtgatgataatagcaaacctggcggcagcgcaaaagatg

SEQ ID NO: 5745 - DNA, 103 bp, Artificial Sequence
  Synthetic Polynucleotide
taatacgactcactatagggggtagaagcagattctttgctattatttgcaacagaggagagcaaatatgagcaaagaaaacctggcggcagcgcaaaagatg

SEQ ID NO: 5746 - DNA, 103 bp, Artificial Sequence
  Synthetic Polynucleotide
taatacgactcactatagggccagtggtagaagcagattctttgctattaaacagaggagataatagatgagaatctgcaacctggcggcagcgcaaaagatg

SEQ ID NO: 5747 - DNA, 103 bp, Artificial Sequence
  Synthetic Polynucleotide
taatacgactcactatagggcatttccagtggtagaagcagattctttgcaacagaggagagcaaagatgctgcttctaaacctggcggcagcgcaaaagatg

SEQ ID NO: 5748 - DNA, 103 bp, Artificial Sequence
  Synthetic Polynucleotide
taatacgactcactataggggccctcatttccagtggtagaagcagattcaacagaggagagaatctatgtctaccactaacctggcggcagcgcaaaagatg

SEQ ID NO: 5749 - DNA, 103 bp, Artificial Sequence
  Synthetic Polynucleotide
taatacgactcactatagggacagtgccctcatttccagtggtagaagcaaacagaggagatgcttcatgcactggaaaaacctggcggcagcgcaaaagatg

SEQ ID NO: 5750 - DNA, 103 bp, Artificial Sequence
  Synthetic Polynucleotide
taatacgactcactatagggtaaccacagtgccctcatttccagtggtagaacagaggagactaccaatggaaatgaggaacctggcggcagcgcaaaagatg

SEQ ID NO: 5751 - DNA, 103 bp, Artificial Sequence
  Synthetic Polynucleotide
taatacgactcactatagggaccgtgtaaagcacggtgacatctttgcagaacagaggagactgcaaatgtgtcaccgtaacctggcggcagcgcaaaagatg

SEQ ID NO: 5752 - DNA, 103 bp, Artificial Sequence
  Synthetic Polynucleotide
taatacgactcactatagggattgttaaccacagtgccctcatttccagtaacagaggagaactggaatggagggcactaacctggcggcagcgcaaaagatg

SEQ ID NO: 5753 - DNA, 103 bp, Artificial Sequence
  Synthetic Polynucleotide
taatacgactcactatagggtaaaaattgttaaccacagtgccctcatttaacagaggagaaaatgaatgcactgtggtaacctggcggcagcgcaaaagatg

SEQ ID NO: 5754 - DNA, 103 bp, Artificial Sequence
  Synthetic Polynucleotide
taatacgactcactatagggttgcataaaaattgttaaccacagtgccctaacagaggagaagggcaatgtggttaacaaacctggcggcagcgcaaaagatg

SEQ ID NO: 5755 - DNA, 103 bp, Artificial Sequence
  Synthetic Polynucleotide
taatacgactcactatagggattgtttgcataaaaattgttaaccacagtaacagaggagaactgtgatgaacaattttaacctggcggcagcgcaaaagatg

SEQ ID NO: 5756 - DNA, 103 bp, Artificial Sequence
  Synthetic Polynucleotide
taatacgactcactatagggtaataattgtttgcataaaaattgttaaccaacagaggagaggttaaatgtttttatgcaacctggcggcagcgcaaaagatg

SEQ ID NO: 5757 - DNA, 103 bp, Artificial Sequence
  Synthetic Polynucleotide
taatacgactcactatagggagccataataattgtttgcataaaaattgtaacagaggagaacaattatgatgcaaacaaacctggcggcagcgcaaaagatg

SEQ ID NO: 5758 - DNA, 103 bp, Artificial Sequence
  Synthetic Polynucleotide
taatacgactcactatagggaatagagccataataattgtttgcataaaaaacagaggagattttatatgaacaattataacctggcggcagcgcaaaagatg

SEQ ID NO: 5759 - DNA, 103 bp, Artificial Sequence
  Synthetic Polynucleotide
taatacgactcactataggggcatcaatagagccataataattgtttgcaaacagaggagatgcaaaatgttattatggaacctggcggcagcgcaaaagatg

SEQ ID NO: 5760 - DNA, 103 bp, Artificial Sequence
  Synthetic Polynucleotide
taatacgactcactatagggaagaagcatcaatagagccataataattgtaacagaggagaacaattatgatggctctaaacctggcggcagcgcaaaagatg

SEQ ID NO: 5761 - DNA, 103 bp, Artificial Sequence
  Synthetic Polynucleotide
taatacgactcactatagggctgggaagaagcatcaatagagccataataaacagaggagatattatatgtctattgataacctggcggcagcgcaaaagatg

SEQ ID NO: 5762 - DNA, 103 bp, Artificial Sequence
  Synthetic Polynucleotide
taatacgactcactatagggcaaaaaccgtgtaaagcacggtgacatcttaacagaggagaaagatgatgccgtgctttaacctggcggcagcgcaaaagatg

SEQ ID NO: 5763 - DNA, 103 bp, Artificial Sequence
  Synthetic Polynucleotide
taatacgactcactatagggactccctgggaagaagcatcaatagagccaaacagaggagatggctcatgtgatgcttcaacctggcggcagcgcaaaagatg

SEQ ID NO: 5764 - DNA, 103 bp, Artificial Sequence
  Synthetic Polynucleotide
taatacgactcactatagggtcccaactccctgggaagaagcatcaatagaacagaggagactattgatgcttcttcccaacctggcggcagcgcaaaagatg

SEQ ID NO: 5765 - DNA, 103 bp, Artificial Sequence
  Synthetic Polynucleotide
taatacgactcactatagggagaggtcccaactccctgggaagaagcatcaacagaggagagatgctatgtcccagggaaacctggcggcagcgcaaaagatg

SEQ ID NO: 5766 - DNA, 103 bp, Artificial Sequence
  Synthetic Polynucleotide
taatacgactcactataggggtagtagaggtcccaactccctgggaagaaaacagaggagattcttcatggggagttggaacctggcggcagcgcaaaagatg

SEQ ID NO: 5767 - DNA, 103 bp, Artificial Sequence
  Synthetic Polynucleotide
taatacgactcactatagggcgggagtagtagaggtcccaactccctgggaacagaggagacccaggatgttgggacctaacctggcggcagcgcaaaagatg

SEQ ID NO: 5768 - DNA, 103 bp, Artificial Sequence
  Synthetic Polynucleotide
taatacgactcactatagggattttcgggagtagtagaggtcccaactccaacagaggagaggagttatgacctctactaacctggcggcagcgcaaaagatg

SEQ ID NO: 5769 - DNA, 103 bp, Artificial Sequence
  Synthetic Polynucleotide
taatacgactcactatagggttaccattttcgggagtagtagaggtcccaaacagaggagatgggacatgtactactccaacctggcggcagcgcaaaagatg

SEQ ID NO: 5770 - DNA, 103 bp, Artificial Sequence
  Synthetic Polynucleotide
taatacgactcactatagggaaacattaccattttcgggagtagtagaggaacagaggagacctctaatgctcccgaaaaacctggcggcagcgcaaaagatg

SEQ ID NO: 5771 - DNA, 103 bp, Artificial Sequence
  Synthetic Polynucleotide
taatacgactcactataggggccagaaacattaccattttcgggagtagtaacagaggagaactactatggaaaatggtaacctggcggcagcgcaaaagatg

SEQ ID NO: 5772 - DNA, 103 bp, Artificial Sequence
  Synthetic Polynucleotide
taatacgactcactatagggagaaagccagaaacattaccattttcgggaaacagaggagatcccgaatgtggtaatgtaacctggcggcagcgcaaaagatg

SEQ ID NO: 5773 - DNA, 103 bp, Artificial Sequence
  Synthetic Polynucleotide
taatacgactcactataggggggttcaaaaaccgtgtaaagcacggtgacaacagaggagagtcaccatgctttacacgaacctggcggcagcgcaaaagatg

SEQ ID NO: 5774 - DNA, 103 bp, Artificial Sequence
  Synthetic Polynucleotide
taatacgactcactataggggtccgagaaagccagaaacattaccattttaacagaggagaaaaatgatgatgtttctgaacctggcggcagcgcaaaagatg

SEQ ID NO: 5775 - DNA, 103 bp, Artificial Sequence
  Synthetic Polynucleotide
taatacgactcactatagggtgcaagtccgagaaagccagaaacattaccaacagaggagaggtaatatgtctggctttaacctggcggcagcgcaaaagatg

SEQ ID NO: 5776 - DNA, 103 bp, Artificial Sequence
  Synthetic Polynucleotide
taatacgactcactatagggctacttgcaagtccgagaaagccagaaacaaacagaggagatgtttcatgctttctcggaacctggcggcagcgcaaaagatg

SEQ ID NO: 5777 - DNA, 103 bp, Artificial Sequence
  Synthetic Polynucleotide
taatacgactcactatagggaagcactacttgcaagtccgagaaagccagaacagaggagactggctatgtcggacttgaacctggcggcagcgcaaaagatg

SEQ ID NO: 5778 - DNA, 103 bp, Artificial Sequence
  Synthetic Polynucleotide
taatacgactcactatagggattaaaagcactacttgcaagtccgagaaaaacagaggagatttctcatgcttgcaagtaacctggcggcagcgcaaaagatg

SEQ ID NO: 5779 - DNA, 103 bp, Artificial Sequence
  Synthetic Polynucleotide
taatacgactcactatagggaaagcattaaaagcactacttgcaagtccgaacagaggagacggactatgaagtagtgcaacctggcggcagcgcaaaagatg

SEQ ID NO: 5780 - DNA, 103 bp, Artificial Sequence
  Synthetic Polynucleotide
taatacgactcactatagggaagataaagcattaaaagcactacttgcaaaacagaggagattgcaaatggtgcttttaaacctggcggcagcgcaaaagatg

SEQ ID NO: 5781 - DNA, 103 bp, Artificial Sequence
  Synthetic Polynucleotide
taatacgactcactatagggtagaaaagataaagcattaaaagcactactaacagaggagaagtagtatgtttaatgctaacctggcggcagcgcaaaagatg

SEQ ID NO: 5782 - DNA, 103 bp, Artificial Sequence
  Synthetic Polynucleotide
taatacgactcactatagggtcagctagaaaagataaagcattaaaagcaaacagaggagatgctttatgtgctttatcaacctggcggcagcgcaaaagatg

SEQ ID NO: 5783 - DNA, 103 bp, Artificial Sequence
  Synthetic Polynucleotide
taatacgactcactatagggtgggatcagctagaaaagataaagcattaaaacagaggagattaatgatgtatcttttcaacctggcggcagcgcaaaagatg

SEQ ID NO: 5784 - DNA, 103 bp, Artificial Sequence
  Synthetic Polynucleotide
taatacgactcactataggggtgtggggttcaaaaaccgtgtaaagcacgaacagaggagacgtgctatgcacggttttaacctggcggcagcgcaaaagatg

SEQ ID NO: 5785 - DNA, 103 bp, Artificial Sequence
  Synthetic Polynucleotide
taatacgactcactatagggagtcttgggatcagctagaaaagataaagcaacagaggagagctttaatgtttctagctaacctggcggcagcgcaaaagatg

SEQ ID NO: 5786 - DNA, 103 bp, Artificial Sequence
  Synthetic Polynucleotide
taatacgactcactataggggtttcagtcttgggatcagctagaaaagataacagaggagaatctttatgagctgatccaacctggcggcagcgcaaaagatg

SEQ ID NO: 5787 - DNA, 103 bp, Artificial Sequence
  Synthetic Polynucleotide
taatacgactcactatagggtctctgtttcagtcttgggatcagctagaaaacagaggagattctagatgatcccaagaaacctggcggcagcgcaaaagatg

SEQ ID NO: 5788 - DNA, 103 bp, Artificial Sequence
  Synthetic Polynucleotide
taatacgactcactataggggttagtctctgtttcagtcttgggatcagcaacagaggagagctgatatgaagactgaaaacctggcggcagcgcaaaagatg

SEQ ID NO: 5789 - DNA, 103 bp, Artificial Sequence
  Synthetic Polynucleotide
taatacgactcactatagggtccatgttagtctctgtttcagtcttgggaaacagaggagatcccaaatgtgaaacagaaacctggcggcagcgcaaaagatg

SEQ ID NO: 5790 - DNA, 103 bp, Artificial Sequence
  Synthetic Polynucleotide
taatacgactcactatagggtgtcttccatgttagtctctgtttcagtctaacagaggagaagactgatgcagagactaaacctggcggcagcgcaaaagatg

SEQ ID NO: 5791 - DNA, 103 bp, Artificial Sequence
  Synthetic Polynucleotide
taatacgactcactatagggaatcctgtcttccatgttagtctctgtttcaacagaggagagaaacaatgactaacatgaacctggcggcagcgcaaaagatg

SEQ ID NO: 5792 - DNA, 103 bp, Artificial Sequence
  Synthetic Polynucleotide
taatacgactcactataggggtcaaaatcctgtcttccatgttagtctctaacagaggagaagagacatgcatggaagaaacctggcggcagcgcaaaagatg

SEQ ID NO: 5793 - DNA, 103 bp, Artificial Sequence
  Synthetic Polynucleotide
taatacgactcactatagggtccgagtcaaaatcctgtcttccatgttagaacagaggagactaacaatgaagacaggaaacctggcggcagcgcaaaagatg

SEQ ID NO: 5794 - DNA, 103 bp, Artificial Sequence
  Synthetic Polynucleotide
taatacgactcactatagggagcagtccgagtcaaaatcctgtcttccataacagaggagaatggaaatgaggattttgaacctggcggcagcgcaaaagatg

SEQ ID NO: 5795 - DNA, 103 bp, Artificial Sequence
  Synthetic Polynucleotide
taatacgactcactatagggcgtttcaagactgccacatgcagtctccccaacagaggagaggggagatggcatgtggcaacctggcggcagcgcaaaagatg

SEQ ID NO: 5796 - DNA, 103 bp, Artificial Sequence
  Synthetic Polynucleotide
taatacgactcactatagggagccggtgtggggttcaaaaaccgtgtaaaaacagaggagatttacaatgtttttgaacaacctggcggcagcgcaaaagatg

SEQ ID NO: 5797 - DNA, 103 bp, Artificial Sequence
  Synthetic Polynucleotide
taatacgactcactatagggttgccagcagtccgagtcaaaatcctgtctaacagaggagaagacagatgtttgactcgaacctggcggcagcgcaaaagatg

SEQ ID NO: 5798 - DNA, 103 bp, Artificial Sequence
  Synthetic Polynucleotide
taatacgactcactatagggacgtgttgccagcagtccgagtcaaaatccaacagaggagaggatttatgctcggactgaacctggcggcagcgcaaaagatg

SEQ ID NO: 5799 - DNA, 103 bp, Artificial Sequence
  Synthetic Polynucleotide
taatacgactcactatagggtatagacgtgttgccagcagtccgagtcaaaacagaggagattgactatgactgctggcaacctggcggcagcgcaaaagatg

SEQ ID NO: 5800 - DNA, 103 bp, Artificial Sequence
  Synthetic Polynucleotide
taatacgactcactataggggagtttatagacgtgttgccagcagtccgaaacagaggagatcggacatgtggcaacacaacctggcggcagcgcaaaagatg

SEQ ID NO: 5801 - DNA, 103 bp, Artificial Sequence
  Synthetic Polynucleotide
taatacgactcactatagggcttgagagtttatagacgtgttgccagcagaacagaggagactgctgatgacacgtctaaacctggcggcagcgcaaaagatg

SEQ ID NO: 5802 - DNA, 103 bp, Artificial Sequence
  Synthetic Polynucleotide
taatacgactcactatagggcgaagcttgagagtttatagacgtgttgccaacagaggagaggcaacatgtctataaacaacctggcggcagcgcaaaagatg

SEQ ID NO: 5803 - DNA, 103 bp, Artificial Sequence
  Synthetic Polynucleotide
taatacgactcactatagggccttccgaagcttgagagtttatagacgtgaacagaggagacacgtcatgaaactctcaaacctggcggcagcgcaaaagatg

SEQ ID NO: 5804 - DNA, 103 bp, Artificial Sequence
  Synthetic Polynucleotide
taatacgactcactatagggacacgccttccgaagcttgagagtttatagaacagaggagactataaatgctcaagcttaacctggcggcagcgcaaaagatg

SEQ ID NO: 5805 - DNA, 103 bp, Artificial Sequence
  Synthetic Polynucleotide
taatacgactcactatagggaaacaacacgccttccgaagcttgagagttaacagaggagaaactctatggcttcggaaaacctggcggcagcgcaaaagatg

SEQ ID NO: 5806 - DNA, 103 bp, Artificial Sequence
  Synthetic Polynucleotide
taatacgactcactatagggtatccaaacaacacgccttccgaagcttgaaacagaggagatcaagcatgggaaggcgtaacctggcggcagcgcaaaagatg

SEQ ID NO: 5807 - DNA, 103 bp, Artificial Sequence
  Synthetic Polynucleotide
taatacgactcactatagggcaaacagccggtgtggggttcaaaaaccgtaacagaggagaacggttatggaaccccacaacctggcggcagcgcaaaagatg

SEQ ID NO: 5808 - DNA, 103 bp, Artificial Sequence
  Synthetic Polynucleotide
taatacgactcactatagggtaccgtatccaaacaacacgccttccgaagaacagaggagacttcggatggcgtgttgtaacctggcggcagcgcaaaagatg

SEQ ID NO: 5809 - DNA, 103 bp, Artificial Sequence
  Synthetic Polynucleotide
taatacgactcactatagggtcttctaccgtatccaaacaacacgccttcaacagaggagagaaggcatgttgtttggaaacctggcggcagcgcaaaagatg

SEQ ID NO: 5810 - DNA, 103 bp, Artificial Sequence
  Synthetic Polynucleotide
taatacgactcactatagggtcagatcttctaccgtatccaaacaacacgaacagaggagacgtgttatgtggatacggaacctggcggcagcgcaaaagatg

SEQ ID NO: 5811 - DNA, 103 bp, Artificial Sequence
  Synthetic Polynucleotide
taatacgactcactatagggaagagtcagatcttctaccgtatccaaacaaacagaggagatgtttgatgacggtagaaaacctggcggcagcgcaaaagatg

SEQ ID NO: 5812 - DNA, 103 bp, Artificial Sequence
  Synthetic Polynucleotide
taatacgactcactataggggcatgaagagtcagatcttctaccgtatccaacagaggagaggatacatgagaagatctaacctggcggcagcgcaaaagatg

SEQ ID NO: 5813 - DNA, 103 bp, Artificial Sequence
  Synthetic Polynucleotide
taatacgactcactataggggtggggcatgaagagtcagatcttctaccgaacagaggagacggtagatgatctgactcaacctggcggcagcgcaaaagatg

SEQ ID NO: 5814 - DNA, 103 bp, Artificial Sequence
  Synthetic Polynucleotide
taatacgactcactatagggaagacgtggggcatgaagagtcagatcttcaacagaggagagaagatatgactcttcataacctggcggcagcgcaaaagatg

SEQ ID NO: 5815 - DNA, 103 bp, Artificial Sequence
  Synthetic Polynucleotide
taatacgactcactatagggcccacaagacgtggggcatgaagagtcagaaacagaggagatctgacatgtcatgccccaacctggcggcagcgcaaaagatg

SEQ ID NO: 5816 - DNA, 103 bp, Artificial Sequence
  Synthetic Polynucleotide
taatacgactcactatagggcgatccccacaagacgtggggcatgaagagaacagaggagactcttcatgccccacgtcaacctggcggcagcgcaaaagatg

SEQ ID NO: 5817 - DNA, 103 bp, Artificial Sequence
  Synthetic Polynucleotide
taatacgactcactatagggtaggacgatccccacaagacgtggggcatgaacagaggagacatgccatgcgtcttgtgaacctggcggcagcgcaaaagatg

SEQ ID NO: 5818 - DNA, 103 bp, Artificial Sequence
  Synthetic Polynucleotide
taatacgactcactatagggagcgtcaaacagccggtgtggggttcaaaaaacagaggagattttgaatgccacaccggaacctggcggcagcgcaaaagatg

SEQ ID NO: 5819 - DNA, 103 bp, Artificial Sequence
  Synthetic Polynucleotide
taatacgactcactatagggacgtgtaggacgatccccacaagacgtgggaacagaggagacccacgatgtgtggggataacctggcggcagcgcaaaagatg

SEQ ID NO: 5820 - DNA, 103 bp, Artificial Sequence
  Synthetic Polynucleotide
taatacgactcactataggggtgccacgtgtaggacgatccccacaagacaacagaggagagtcttgatgggatcgtccaacctggcggcagcgcaaaagatg

SEQ ID NO: 5821 - DNA, 103 bp, Artificial Sequence
  Synthetic Polynucleotide
taatacgactcactatagggcgggagtgccacgtgtaggacgatccccacaacagaggagagtggggatggtcctacacaacctggcggcagcgcaaaagatg

SEQ ID NO: 5822 - DNA, 103 bp, Artificial Sequence
  Synthetic Polynucleotide
taatacgactcactatagggggtggcgggagtgccacgtgtaggacgatcaacagaggagagatcgtatgacacgtggcaacctggcggcagcgcaaaagatg

SEQ ID NO: 5823 - DNA, 103 bp, Artificial Sequence
  Synthetic Polynucleotide
taatacgactcactatagggcgggaggtggcgggagtgccacgtgtaggaaacagaggagatcctacatgtggcactccaacctggcggcagcgcaaaagatg

SEQ ID NO: 5824 - DNA, 103 bp, Artificial Sequence
  Synthetic Polynucleotide
taatacgactcactatagggaagcacgggaggtggcgggagtgccacgtgaacagaggagacacgtgatgctcccgccaaacctggcggcagcgcaaaagatg

SEQ ID NO: 5825 - DNA, 103 bp, Artificial Sequence
  Synthetic Polynucleotide
taatacgactcactatagggcacaaaagcacgggaggtggcgggagtgccaacagaggagaggcactatggccacctccaacctggcggcagcgcaaaagatg

SEQ ID NO: 5826 - DNA, 103 bp, Artificial Sequence
  Synthetic Polynucleotide
taatacgactcactatagggggaaccacaaaagcacgggaggtggcgggaaacagaggagatcccgcatgctcccgtgcaacctggcggcagcgcaaaagatg

SEQ ID NO: 5827 - DNA, 103 bp, Artificial Sequence
  Synthetic Polynucleotide
taatacgactcactatagggccaagggaaccacaaaagcacgggaggtggaacagaggagaccacctatggtgcttttgaacctggcggcagcgcaaaagatg

SEQ ID NO: 5828 - DNA, 103 bp, Artificial Sequence
  Synthetic Polynucleotide
taatacgactcactataggggtcagccaagggaaccacaaaagcacgggaaacagaggagatcccgtatgtttgtggttaacctggcggcagcgcaaaagatg

SEQ ID NO: 5829 - DNA, 103 bp, Artificial Sequence
  Synthetic Polynucleotide
taatacgactcactatagggctacgagcgtcaaacagccggtgtggggttaacagaggagaaaccccatgccggctgttaacctggcggcagcgcaaaagatg

SEQ ID NO: 5830 - DNA, 103 bp, Artificial Sequence
  Synthetic Polynucleotide
taatacgactcactatagggttccagtcagccaagggaaccacaaaagcaaacagaggagatgctttatgggttcccttaacctggcggcagcgcaaaagatg

SEQ ID NO: 5831 - DNA, 103 bp, Artificial Sequence
  Synthetic Polynucleotide
taatacgactcactatagggtaatattccagtcagccaagggaaccacaaaacagaggagattgtggatgccttggctgaacctggcggcagcgcaaaagatg

SEQ ID NO: 5832 - DNA, 103 bp, Artificial Sequence
  Synthetic Polynucleotide
taatacgactcactatagggcacattaatattccagtcagccaagggaacaacagaggagagttcccatggctgactggaacctggcggcagcgcaaaagatg

SEQ ID NO: 5833 - DNA, 103 bp, Artificial Sequence
  Synthetic Polynucleotide
taatacgactcactataggggggggcacattaatattccagtcagccaagaacagaggagacttggcatgctggaatataacctggcggcagcgcaaaagatg

SEQ ID NO: 5834 - DNA, 103 bp, Artificial Sequence
  Synthetic Polynucleotide
taatacgactcactatagggaataagggggcacattaatattccagtcagaacagaggagactgactatgatattaatgaacctggcggcagcgcaaaagatg

SEQ ID NO: 5835 - DNA, 103 bp, Artificial Sequence
  Synthetic Polynucleotide
taatacgactcactatagggaaaataataagggggcacattaatattccaaacagaggagatggaatatgaatgtgcccaacctggcggcagcgcaaaagatg

SEQ ID NO: 5836 - DNA, 103 bp, Artificial Sequence
  Synthetic Polynucleotide
taatacgactcactataggggcctgaaaataataagggggcacattaataaacagaggagatattaaatggcccccttaaacctggcggcagcgcaaaagatg

SEQ ID NO: 5837 - DNA, 103 bp, Artificial Sequence
  Synthetic Polynucleotide
taatacgactcactatagggtgtaagcctgaaaataataagggggcacataacagaggagaatgtgcatgcttattattaacctggcggcagcgcaaaagatg

SEQ ID NO: 5838 - DNA, 103 bp, Artificial Sequence
  Synthetic Polynucleotide
taatacgactcactatagggcagtctgtaagcctgaaaataataagggggaacagaggagaccccctatgtattttcagaacctggcggcagcgcaaaagatg

SEQ ID NO: 5839 - DNA, 103 bp, Artificial Sequence
  Synthetic Polynucleotide
taatacgactcactatagggtgggtcagtctgtaagcctgaaaataataaaacagaggagattattaatgtcaggcttaaacctggcggcagcgcaaaagatg

SEQ ID NO: 5840 - DNA, 103 bp, Artificial Sequence
  Synthetic Polynucleotide
taatacgactcactatagggctgccctacgagcgtcaaacagccggtgtgaacagaggagacacaccatgtgtttgacgaacctggcggcagcgcaaaagatg

SEQ ID NO: 5841 - DNA, 103 bp, Artificial Sequence
  Synthetic Polynucleotide
taatacgactcactatagggtgtgttgggtcagtctgtaagcctgaaaataacagaggagaattttcatgcttacagacaacctggcggcagcgcaaaagatg

SEQ ID NO: 5842 - DNA, 103 bp, Artificial Sequence
  Synthetic Polynucleotide
taatacgactcactataggggtacatgtgttgggtcagtctgtaagcctgaacagaggagacaggctatgagactgaccaacctggcggcagcgcaaaagatg

SEQ ID NO: 5843 - DNA, 103 bp, Artificial Sequence
  Synthetic Polynucleotide
taatacgactcactatagggtcctggtacatgtgttgggtcagtctgtaaaacagaggagattacagatggacccaacaaacctggcggcagcgcaaaagatg

SEQ ID NO: 5844 - DNA, 103 bp, Artificial Sequence
  Synthetic Polynucleotide
taatacgactcactatagggcttcatcctggtacatgtgttgggtcagtcaacagaggagagactgaatgaacacatgtaacctggcggcagcgcaaaagatg

SEQ ID NO: 5845 - DNA, 103 bp, Artificial Sequence
  Synthetic Polynucleotide
taatacgactcactatagggtccgacttcatcctggtacatgtgttgggtaacagaggagaacccaaatgatgtaccagaacctggcggcagcgcaaaagatg

SEQ ID NO: 5846 - DNA, 103 bp, Artificial Sequence
  Synthetic Polynucleotide
taatacgactcactatagggatgtttccgacttcatcctggtacatgtgtaacagaggagaacacatatgccaggatgaaacctggcggcagcgcaaaagatg

SEQ ID NO: 5847 - DNA, 103 bp, Artificial Sequence
  Synthetic Polynucleotide
taatacgactcactatagggtaaacatgtttccgacttcatcctggtacaaacagaggagatgtaccatgatgaagtcgaacctggcggcagcgcaaaagatg

SEQ ID NO: 5848 - DNA, 103 bp, Artificial Sequence
  Synthetic Polynucleotide
taatacgactcactatagggctttgtaaacatgtttccgacttcatcctgaacagaggagacaggatatggtcggaaacaacctggcggcagcgcaaaagatg

SEQ ID NO: 5849 - DNA, 103 bp, Artificial Sequence
  Synthetic Polynucleotide
taatacgactcactatagggaggttctttgtaaacatgtttccgacttcaaacagaggagatgaagtatgaaacatgttaacctggcggcagcgcaaaagatg

SEQ ID NO: 5850 - DNA, 103 bp, Artificial Sequence
  Synthetic Polynucleotide
taatacgactcactatagggtccttaggttctttgtaaacatgtttccgaaacagaggagatcggaaatgtgtttacaaaacctggcggcagcgcaaaagatg

SEQ ID NO: 5851 - DNA, 103 bp, Artificial Sequence
  Synthetic Polynucleotide
taatacgactcactatagggacctgctgccctacgagcgtcaaacagccgaacagaggagacggctgatggacgctcgtaacctggcggcagcgcaaaagatg

SEQ ID NO: 5852 - DNA, 103 bp, Artificial Sequence
  Synthetic Polynucleotide
taatacgactcactatagggatgcgtccttaggttctttgtaaacatgttaacagaggagaaacatgatgacaaagaacaacctggcggcagcgcaaaagatg

SEQ ID NO: 5853 - DNA, 103 bp, Artificial Sequence
  Synthetic Polynucleotide
taatacgactcactatagggaaagcatgcgtccttaggttctttgtaaacaacagaggagagtttacatggaacctaagaacctggcggcagcgcaaaagatg

SEQ ID NO: 5854 - DNA, 103 bp, Artificial Sequence
  Synthetic Polynucleotide
taatacgactcactatagggtgcaaaaagcatgcgtccttaggttctttgaacagaggagacaaagaatgtaaggacgcaacctggcggcagcgcaaaagatg

SEQ ID NO: 5855 - DNA, 103 bp, Artificial Sequence
  Synthetic Polynucleotide
taatacgactcactatagggagtcttgcaaaaagcatgcgtccttaggttaacagaggagaaacctaatgacgcatgctaacctggcggcagcgcaaaagatg

SEQ ID NO: 5856 - DNA, 103 bp, Artificial Sequence
  Synthetic Polynucleotide
taatacgactcactatagggaaaccagtcttgcaaaaagcatgcgtccttaacagaggagaaaggacatgtgctttttgaacctggcggcagcgcaaaagatg

SEQ ID NO: 5857 - DNA, 103 bp, Artificial Sequence
  Synthetic Polynucleotide
taatacgactcactatagggcttcaaaaccagtcttgcaaaaagcatgcgaacagaggagacgcatgatgtttgcaagaaacctggcggcagcgcaaaagatg

SEQ ID NO: 5858 - DNA, 103 bp, Artificial Sequence
  Synthetic Polynucleotide
taatacgactcactatagggggtcacttcaaaaccagtcttgcaaaaagcaacagaggagagcttttatgaagactggtaacctggcggcagcgcaaaagatg

SEQ ID NO: 5859 - DNA, 103 bp, Artificial Sequence
  Synthetic Polynucleotide
taatacgactcactatagggtgaagggtcacttcaaaaccagtcttgcaaaacagaggagattgcaaatgtggttttgaaacctggcggcagcgcaaaagatg

SEQ ID NO: 5860 - DNA, 103 bp, Artificial Sequence
  Synthetic Polynucleotide
taatacgactcactatagggtaacctgaagggtcacttcaaaaccagtctaacagaggagaagactgatgttgaagtgaaacctggcggcagcgcaaaagatg

SEQ ID NO: 5861 - DNA, 103 bp, Artificial Sequence
  Synthetic Polynucleotide
taatacgactcactatagggtgtattaacctgaagggtcacttcaaaaccaacagaggagaggttttatggtgacccttaacctggcggcagcgcaaaagatg

SEQ ID NO: 5862 - DNA, 103 bp, Artificial Sequence
  Synthetic Polynucleotide
taatacgactcactatagggaataaacctgctgccctacgagcgtcaaacaacagaggagagtttgaatgtcgtagggcaacctggcggcagcgcaaaagatg

SEQ ID NO: 5863 - DNA, 103 bp, Artificial Sequence
  Synthetic Polynucleotide
taatacgactcactatagggggagatgtattaacctgaagggtcacttcaaacagaggagatgaagtatgccttcaggtaacctggcggcagcgcaaaagatg

SEQ ID NO: 5864 - DNA, 103 bp, Artificial Sequence
  Synthetic Polynucleotide
taatacgactcactatagggggaaaggagatgtattaacctgaagggtcaaacagaggagatgacccatgaggttaataaacctggcggcagcgcaaaagatg

SEQ ID NO: 5865 - DNA, 103 bp, Artificial Sequence
  Synthetic Polynucleotide
taatacgactcactatagggtgcatggaaaggagatgtattaacctgaagaacagaggagacttcagatgaatacatctaacctggcggcagcgcaaaagatg

SEQ ID NO: 5866 - DNA, 103 bp, Artificial Sequence
  Synthetic Polynucleotide
taatacgactcactatagggagccctgcatggaaaggagatgtattaaccaacagaggagaggttaaatgatctcctttaacctggcggcagcgcaaaagatg

SEQ ID NO: 5867 - DNA, 103 bp, Artificial Sequence
  Synthetic Polynucleotide
taatacgactcactatagggctagaagccctgcatggaaaggagatgtataacagaggagaatacatatgctttccatgaacctggcggcagcgcaaaagatg

SEQ ID NO: 5868 - DNA, 103 bp, Artificial Sequence
  Synthetic Polynucleotide
taatacgactcactataggggaggcctagaagccctgcatggaaaggagaaacagaggagatctcctatgcatgcagggaacctggcggcagcgcaaaagatg

SEQ ID NO: 5869 - DNA, 103 bp, Artificial Sequence
  Synthetic Polynucleotide
taatacgactcactatagggagaaagaggcctagaagccctgcatggaaaaacagaggagatttccaatgagggcttctaacctggcggcagcgcaaaagatg

SEQ ID NO: 5870 - DNA, 103 bp, Artificial Sequence
  Synthetic Polynucleotide
taatacgactcactataggggaaccagaaagaggcctagaagccctgcataacagaggagaatgcagatgttctaggccaacctggcggcagcgcaaaagatg

SEQ ID NO: 5871 - DNA, 103 bp, Artificial Sequence
  Synthetic Polynucleotide
taatacgactcactatagggttcgggaaccagaaagaggcctagaagcccaacagaggagagggcttatgggcctctttaacctggcggcagcgcaaaagatg

SEQ ID NO: 5872 - DNA, 103 bp, Artificial Sequence
  Synthetic Polynucleotide
taatacgactcactatagggacaaattcgggaaccagaaagaggcctagaaacagaggagatctaggatgctttctggtaacctggcggcagcgcaaaagatg

SEQ ID NO: 5873 - DNA, 103 bp, Artificial Sequence
  Synthetic Polynucleotide
taatacgactcactatagggatgaaaataaacctgctgccctacgagcgtaacagaggagaacgctcatggggcagcagaacctggcggcagcgcaaaagatg

SEQ ID NO: 5874 - DNA, 103 bp, Artificial Sequence
  Synthetic Polynucleotide
taatacgactcactatagggccttaacaaattcgggaaccagaaagaggcaacagaggagagcctctatgtggttcccgaacctggcggcagcgcaaaagatg

SEQ ID NO: 5875 - DNA, 103 bp, Artificial Sequence
  Synthetic Polynucleotide
taatacgactcactatagggtacatccttaacaaattcgggaaccagaaaaacagaggagatttctgatgcccgaatttaacctggcggcagcgcaaaagatg

SEQ ID NO: 5876 - DNA, 103 bp, Artificial Sequence
  Synthetic Polynucleotide
taatacgactcactataggggttcttacatccttaacaaattcgggaaccaacagaggagaggttccatgatttgttaaaacctggcggcagcgcaaaagatg

SEQ ID NO: 5877 - DNA, 103 bp, Artificial Sequence
  Synthetic Polynucleotide
taatacgactcactatagggaggtcgttcttacatccttaacaaattcggaacagaggagaccgaatatgttaaggatgaacctggcggcagcgcaaaagatg

SEQ ID NO: 5878 - DNA, 103 bp, Artificial Sequence
  Synthetic Polynucleotide
taatacgactcactatagggttgtaaggtcgttcttacatccttaacaaaaacagaggagatttgttatggatgtaagaaacctggcggcagcgcaaaagatg

SEQ ID NO: 5879 - DNA, 103 bp, Artificial Sequence
  Synthetic Polynucleotide
taatacgactcactatagggtcccattgtaaggtcgttcttacatccttaaacagaggagataaggaatgaagaacgacaacctggcggcagcgcaaaagatg

SEQ ID NO: 5880 - DNA, 103 bp, Artificial Sequence
  Synthetic Polynucleotide
taatacgactcactatagggtactgtcccattgtaaggtcgttcttacataacagaggagaatgtaaatgcgaccttacaacctggcggcagcgcaaaagatg

SEQ ID NO: 5881 - DNA, 103 bp, Artificial Sequence
  Synthetic Polynucleotide
taatacgactcactatagggtattatactgtcccattgtaaggtcgttctaacagaggagaagaacgatgttacaatggaacctggcggcagcgcaaaagatg

SEQ ID NO: 5882 - DNA, 103 bp, Artificial Sequence
  Synthetic Polynucleotide
taatacgactcactatagggttgtctattatactgtcccattgtaaggtcaacagaggagagaccttatgatgggacagaacctggcggcagcgcaaaagatg

SEQ ID NO: 5883 - DNA, 103 bp, Artificial Sequence
  Synthetic Polynucleotide
taatacgactcactatagggtgagtttgtctattatactgtcccattgtaaacagaggagatacaatatgacagtataaaacctggcggcagcgcaaaagatg

SEQ ID NO: 5884 - DNA, 103 bp, Artificial Sequence
  Synthetic Polynucleotide
taatacgactcactatagggttttaatgaaaataaacctgctgccctacgaacagaggagacgtaggatggcaggtttaaacctggcggcagcgcaaaagatg

SEQ ID NO: 5885 - DNA, 103 bp, Artificial Sequence
  Synthetic Polynucleotide
taatacgactcactatagggcatcatgagtttgtctattatactgtcccaaacagaggagatgggacatgataatagacaacctggcggcagcgcaaaagatg

SEQ ID NO: 5886 - DNA, 103 bp, Artificial Sequence
  Synthetic Polynucleotide
taatacgactcactatagggctgtacatcatgagtttgtctattatactgaacagaggagacagtatatgagacaaactaacctggcggcagcgcaaaagatg

SEQ ID NO: 5887 - DNA, 103 bp, Artificial Sequence
  Synthetic Polynucleotide
taatacgactcactataggggtgctctgtacatcatgagtttgtctattaaacagaggagataatagatgaactcatgaaacctggcggcagcgcaaaagatg

SEQ ID NO: 5888 - DNA, 103 bp, Artificial Sequence
  Synthetic Polynucleotide
taatacgactcactataggggtcttgtgctctgtacatcatgagtttgtcaacagaggagagacaaaatgatgatgtacaacctggcggcagcgcaaaagatg

SEQ ID NO: 5889 - DNA, 103 bp, Artificial Sequence
  Synthetic Polynucleotide
taatacgactcactataggggaagggtcttgtgctctgtacatcatgagtaacagaggagaactcatatggtacagagcaacctggcggcagcgcaaaagatg

SEQ ID NO: 5890 - DNA, 103 bp, Artificial Sequence
  Synthetic Polynucleotide
taatacgactcactataggggttctgaagggtcttgtgctctgtacatcaaacagaggagatgatgtatggagcacaagaacctggcggcagcgcaaaagatg

SEQ ID NO: 5891 - DNA, 103 bp, Artificial Sequence
  Synthetic Polynucleotide
taatacgactcactatagggataatgttctgaagggtcttgtgctctgtaaacagaggagatacagaatgcaagaccctaacctggcggcagcgcaaaagatg

SEQ ID NO: 5892 - DNA, 103 bp, Artificial Sequence
  Synthetic Polynucleotide
taatacgactcactatagggttttcataatgttctgaagggtcttgtgctaacagaggagaagcacaatgcccttcagaaacctggcggcagcgcaaaagatg

SEQ ID NO: 5893 - DNA, 103 bp, Artificial Sequence
  Synthetic Polynucleotide
taatacgactcactatagggtctggttttcataatgttctgaagggtcttaacagaggagaaagaccatgcagaacattaacctggcggcagcgcaaaagatg

SEQ ID NO: 5894 - DNA, 103 bp, Artificial Sequence
  Synthetic Polynucleotide
taatacgactcactatagggtaaggtctggttttcataatgttctgaaggaacagaggagaccttcaatgcattatgaaaacctggcggcagcgcaaaagatg

SEQ ID NO: 5895 - DNA, 103 bp, Artificial Sequence
  Synthetic Polynucleotide
taatacgactcactatagggaagaattttaatgaaaataaacctgctgccaacagaggagaggcagcatgtttattttcaacctggcggcagcgcaaaagatg

SEQ ID NO: 5896 - DNA, 103 bp, Artificial Sequence
  Synthetic Polynucleotide
taatacgactcactatagggggttttaaggtctggttttcataatgttctaacagaggagaagaacaatgtgaaaaccaaacctggcggcagcgcaaaagatg

SEQ ID NO: 5897 - DNA, 103 bp, Artificial Sequence
  Synthetic Polynucleotide
taatacgactcactatagggttactggttttaaggtctggttttcataataacagaggagaattatgatgaccagacctaacctggcggcagcgcaaaagatg

SEQ ID NO: 5898 - DNA, 103 bp, Artificial Sequence
  Synthetic Polynucleotide
taatacgactcactatagggagagtttactggttttaaggtctggttttcaacagaggagagaaaacatgaccttaaaaaacctggcggcagcgcaaaagatg

SEQ ID NO: 5899 - DNA, 103 bp, Artificial Sequence
  Synthetic Polynucleotide
taatacgactcactataggggacaaagagtttactggttttaaggtctggaacagaggagaccagacatgaaaaccagtaacctggcggcagcgcaaaagatg

SEQ ID NO: 5900 - DNA, 103 bp, Artificial Sequence
  Synthetic Polynucleotide
taatacgactcactatagggcaaaagacaaagagtttactggttttaaggaacagaggagaccttaaatgcagtaaactaacctggcggcagcgcaaaagatg

SEQ ID NO: 5901 - DNA, 103 bp, Artificial Sequence
  Synthetic Polynucleotide
taatacgactcactatagggcaaatcaaaagacaaagagtttactggtttaacagaggagaaaaccaatgaactctttgaacctggcggcagcgcaaaagatg

SEQ ID NO: 5902 - DNA, 103 bp, Artificial Sequence
  Synthetic Polynucleotide
taatacgactcactatagggtcagccaaatcaaaagacaaagagtttactaacagaggagaagtaaaatgtttgtctttaacctggcggcagcgcaaaagatg

SEQ ID NO: 5903 - DNA, 103 bp, Artificial Sequence
  Synthetic Polynucleotide
taatacgactcactatagggtaatatcagccaaatcaaaagacaaagagtaacagaggagaactcttatgcttttgattaacctggcggcagcgcaaaagatg

SEQ ID NO: 5904 - DNA, 103 bp, Artificial Sequence
  Synthetic Polynucleotide
taatacgactcactatagggtggagtaatatcagccaaatcaaaagacaaaacagaggagattgtctatggatttggctaacctggcggcagcgcaaaagatg

SEQ ID NO: 5905 - DNA, 103 bp, Artificial Sequence
  Synthetic Polynucleotide
taatacgactcactatagggtgttctggagtaatatcagccaaatcaaaaaacagaggagattttgaatgggctgatataacctggcggcagcgcaaaagatg

SEQ ID NO: 5906 - DNA, 103 bp, Artificial Sequence
  Synthetic Polynucleotide
taatacgactcactatagggccacacgtttcaagactgccacatgcagtcaacagaggagagactgcatgtggcagtctaacctggcggcagcgcaaaagatg

SEQ ID NO: 5907 - DNA, 103 bp, Artificial Sequence
  Synthetic Polynucleotide
taatacgactcactatagggaaagtaagaattttaatgaaaataaacctgaacagaggagacaggttatgtttcattaaaacctggcggcagcgcaaaagatg

SEQ ID NO: 5908 - DNA, 103 bp, Artificial Sequence
  Synthetic Polynucleotide
taatacgactcactatagggtcatttgttctggagtaatatcagccaaataacagaggagaatttggatgatattactcaacctggcggcagcgcaaaagatg

SEQ ID NO: 5909 - DNA, 103 bp, Artificial Sequence
  Synthetic Polynucleotide
taatacgactcactatagggtaacatcatttgttctggagtaatatcagcaacagaggagagctgatatgactccagaaaacctggcggcagcgcaaaagatg

SEQ ID NO: 5910 - DNA, 103 bp, Artificial Sequence
  Synthetic Polynucleotide
taatacgactcactataggggggaataacatcatttgttctggagtaataaacagaggagatattacatgagaacaaataacctggcggcagcgcaaaagatg

SEQ ID NO: 5911 - DNA, 103 bp, Artificial Sequence
  Synthetic Polynucleotide
taatacgactcactatagggggtgagggaataacatcatttgttctggagaacagaggagactccagatgaaatgatgtaacctggcggcagcgcaaaagatg

SEQ ID NO: 5912 - DNA, 103 bp, Artificial Sequence
  Synthetic Polynucleotide
taatacgactcactatagggtagttggtgagggaataacatcatttgttcaacagaggagagaacaaatgatgttattcaacctggcggcagcgcaaaagatg

SEQ ID NO: 5913 - DNA, 103 bp, Artificial Sequence
  Synthetic Polynucleotide
taatacgactcactatagggtttattagttggtgagggaataacatcattaacagaggagaaatgatatgattccctcaaacctggcggcagcgcaaaagatg

SEQ ID NO: 5914 - DNA, 103 bp, Artificial Sequence
  Synthetic Polynucleotide
taatacgactcactatagggttggatttattagttggtgagggaataacaaacagaggagatgttatatgctcaccaacaacctggcggcagcgcaaaagatg

SEQ ID NO: 5915 - DNA, 103 bp, Artificial Sequence
  Synthetic Polynucleotide
taatacgactcactatagggttcttttggatttattagttggtgagggaaaacagaggagattccctatgcaactaataaacctggcggcagcgcaaaagatg

SEQ ID NO: 5916 - DNA, 103 bp, Artificial Sequence
  Synthetic Polynucleotide
taatacgactcactatagggtttgtttcttttggatttattagttggtgaaacagaggagatcaccaatgaataaatccaacctggcggcagcgcaaaagatg

SEQ ID NO: 5917 - DNA, 103 bp, Artificial Sequence
  Synthetic Polynucleotide
taatacgactcactatagggcaatgtttgtttcttttggatttattagttaacagaggagaaactaaatgatccaaaagaacctggcggcagcgcaaaagatg

SEQ ID NO: 5918 - DNA, 103 bp, Artificial Sequence
  Synthetic Polynucleotide
taatacgactcactataggggctagaaagtaagaattttaatgaaaataaaacagaggagattatttatgttaaaattcaacctggcggcagcgcaaaagatg

SEQ ID NO: 5919 - DNA, 103 bp, Artificial Sequence
  Synthetic Polynucleotide
taatacgactcactatagggtgttgcaatgtttgtttcttttggatttataacagaggagaataaatatgaaagaaacaaacctggcggcagcgcaaaagatg

SEQ ID NO: 5920 - DNA, 103 bp, Artificial Sequence
  Synthetic Polynucleotide
taatacgactcactataggggatactgttgcaatgtttgtttcttttggaaacagaggagatccaaaatgaacaaacataacctggcggcagcgcaaaagatg

SEQ ID NO: 5921 - DNA, 103 bp, Artificial Sequence
  Synthetic Polynucleotide
taatacgactcactataggggtactgatactgttgcaatgtttgtttcttaacagaggagaaagaaaatgacattgcaaaacctggcggcagcgcaaaagatg

SEQ ID NO: 5922 - DNA, 103 bp, Artificial Sequence
  Synthetic Polynucleotide
taatacgactcactatagggataaggtactgatactgttgcaatgtttgtaacagaggagaacaaacatggcaacagtaaacctggcggcagcgcaaaagatg

SEQ ID NO: 5923 - DNA, 103 bp, Artificial Sequence
  Synthetic Polynucleotide
taatacgactcactatagggttgacataaggtactgatactgttgcaatgaacagaggagacattgcatgagtatcagtaacctggcggcagcgcaaaagatg

SEQ ID NO: 5924 - DNA, 103 bp, Artificial Sequence
  Synthetic Polynucleotide
taatacgactcactatagggcacaattgacataaggtactgatactgttgaacagaggagacaacagatgcagtaccttaacctggcggcagcgcaaaagatg

SEQ ID NO: 5925 - DNA, 103 bp, Artificial Sequence
  Synthetic Polynucleotide
taatacgactcactataggggggtgcacaattgacataaggtactgatacaacagaggagagtatcaatgccttatgtcaacctggcggcagcgcaaaagatg

SEQ ID NO: 5926 - DNA, 103 bp, Artificial Sequence
  Synthetic Polynucleotide
taatacgactcactatagggctagtgggtgcacaattgacataaggtactaacagaggagaagtaccatgtgtcaattgaacctggcggcagcgcaaaagatg

SEQ ID NO: 5927 - DNA, 103 bp, Artificial Sequence
  Synthetic Polynucleotide
taatacgactcactatagggcatcactagtgggtgcacaattgacataagaacagaggagacttatgatgattgtgcacaacctggcggcagcgcaaaagatg

SEQ ID NO: 5928 - DNA, 103 bp, Artificial Sequence
  Synthetic Polynucleotide
taatacgactcactatagggggtaacatcactagtgggtgcacaattgacaacagaggagagtcaatatggcacccactaacctggcggcagcgcaaaagatg

SEQ ID NO: 5929 - DNA, 103 bp, Artificial Sequence
  Synthetic Polynucleotide
taatacgactcactatagggatgcagctagaaagtaagaattttaatgaaaacagaggagattcattatgattcttactaacctggcggcagcgcaaaagatg

SEQ ID NO: 5930 - DNA, 103 bp, Artificial Sequence
  Synthetic Polynucleotide
taatacgactcactatagggtgaatggtaacatcactagtgggtgcacaaaacagaggagattgtgcatgcactagtgaaacctggcggcagcgcaaaagatg

SEQ ID NO: 5931 - DNA, 103 bp, Artificial Sequence
  Synthetic Polynucleotide
taatacgactcactatagggcattatgaatggtaacatcactagtgggtgaacagaggagacacccaatggtgatgttaaacctggcggcagcgcaaaagatg

SEQ ID NO: 5932 - DNA, 103 bp, Artificial Sequence
  Synthetic Polynucleotide
taatacgactcactatagggccaaacattatgaatggtaacatcactagtaacagaggagaactagtatggttaccattaacctggcggcagcgcaaaagatg

SEQ ID NO: 5933 - DNA, 103 bp, Artificial Sequence
  Synthetic Polynucleotide
taatacgactcactataggggcggtccaaacattatgaatggtaacatcaaacagaggagatgatgtatgcattcataaaacctggcggcagcgcaaaagatg

SEQ ID NO: 5934 - DNA, 103 bp, Artificial Sequence
  Synthetic Polynucleotide
taatacgactcactatagggccacggcggtccaaacattatgaatggtaaaacagaggagattaccaatgataatgtttaacctggcggcagcgcaaaagatg

SEQ ID NO: 5935 - DNA, 103 bp, Artificial Sequence
  Synthetic Polynucleotide
taatacgactcactatagggcataaccacggcggtccaaacattatgaataacagaggagaattcatatggtttggaccaacctggcggcagcgcaaaagatg

SEQ ID NO: 5936 - DNA, 103 bp, Artificial Sequence
  Synthetic Polynucleotide
taatacgactcactatagggaacaccataaccacggcggtccaaacattaaacagaggagataatgtatggaccgccgtaacctggcggcagcgcaaaagatg

SEQ ID NO: 5937 - DNA, 103 bp, Artificial Sequence
  Synthetic Polynucleotide
taatacgactcactatagggtggacaacaccataaccacggcggtccaaaaacagaggagatttggaatgccgtggttaaacctggcggcagcgcaaaagatg

SEQ ID NO: 5938 - DNA, 103 bp, Artificial Sequence
  Synthetic Polynucleotide
taatacgactcactatagggcaatctggacaacaccataaccacggcggtaacagaggagaaccgccatggttatggtgaacctggcggcagcgcaaaagatg

SEQ ID NO: 5939 - DNA, 103 bp, Artificial Sequence
  Synthetic Polynucleotide
taatacgactcactatagggtagttcaatctggacaacaccataaccacgaacagaggagacgtggtatgggtgttgtcaacctggcggcagcgcaaaagatg

SEQ ID NO: 5940 - DNA, 103 bp, Artificial Sequence
  Synthetic Polynucleotide
taatacgactcactatagggaactcatgcagctagaaagtaagaattttaaacagaggagataaaatatgtactttctaaacctggcggcagcgcaaaagatg

SEQ ID NO: 5941 - DNA, 103 bp, Artificial Sequence
  Synthetic Polynucleotide
taatacgactcactatagggctgcatagttcaatctggacaacaccataaaacagaggagattatggatgtgtccagataacctggcggcagcgcaaaagatg

SEQ ID NO: 5942 - DNA, 103 bp, Artificial Sequence
  Synthetic Polynucleotide
taatacgactcactatagggtccatctgcatagttcaatctggacaacacaacagaggagagtgttgatgagattgaacaacctggcggcagcgcaaaagatg

SEQ ID NO: 5943 - DNA, 103 bp, Artificial Sequence
  Synthetic Polynucleotide
taatacgactcactatagggcttgctccatctgcatagttcaatctggacaacagaggagagtccagatggaactatgcaacctggcggcagcgcaaaagatg

SEQ ID NO: 5944 - DNA, 103 bp, Artificial Sequence
  Synthetic Polynucleotide
taatacgactcactataggggtgggcttgctccatctgcatagttcaatcaacagaggagagattgaatgatgcagatgaacctggcggcagcgcaaaagatg

SEQ ID NO: 5945 - DNA, 103 bp, Artificial Sequence
  Synthetic Polynucleotide
taatacgactcactatagggaacaagtgggcttgctccatctgcatagttaacagaggagaaactatatggatggagcaaacctggcggcagcgcaaaagatg

SEQ ID NO: 5946 - DNA, 103 bp, Artificial Sequence
  Synthetic Polynucleotide
taatacgactcactatagggattgcaacaagtgggcttgctccatctgcaaacagaggagatgcagaatgagcaagcccaacctggcggcagcgcaaaagatg

SEQ ID NO: 5947 - DNA, 103 bp, Artificial Sequence
  Synthetic Polynucleotide
taatacgactcactataggggtgtcattgcaacaagtgggcttgctccataacagaggagaatggagatggcccacttgaacctggcggcagcgcaaaagatg

SEQ ID NO: 5948 - DNA, 103 bp, Artificial Sequence
  Synthetic Polynucleotide
taatacgactcactatagggtgtaagtgtcattgcaacaagtgggcttgcaacagaggagagcaagcatgcttgttgcaaacctggcggcagcgcaaaagatg

SEQ ID NO: 5949 - DNA, 103 bp, Artificial Sequence
  Synthetic Polynucleotide
taatacgactcactataggggtaactgtaagtgtcattgcaacaagtgggaacagaggagacccactatgtgcaatgacaacctggcggcagcgcaaaagatg

SEQ ID NO: 5950 - DNA, 103 bp, Artificial Sequence
  Synthetic Polynucleotide
taatacgactcactatagggctggagtaactgtaagtgtcattgcaacaaaacagaggagattgttgatgtgacacttaaacctggcggcagcgcaaaagatg

SEQ ID NO: 5951 - DNA, 103 bp, Artificial Sequence
  Synthetic Polynucleotide
taatacgactcactatagggaatagaactcatgcagctagaaagtaagaaaacagaggagattcttaatgtctagctgcaacctggcggcagcgcaaaagatg

SEQ ID NO: 5952 - DNA, 103 bp, Artificial Sequence
  Synthetic Polynucleotide
taatacgactcactataggggtctactggagtaactgtaagtgtcattgcaacagaggagagcaatgatgcttacagttaacctggcggcagcgcaaaagatg

SEQ ID NO: 5953 - DNA, 103 bp, Artificial Sequence
  Synthetic Polynucleotide
taatacgactcactatagggactgtgtctactggagtaactgtaagtgtcaacagaggagagacactatgagttactccaacctggcggcagcgcaaaagatg

SEQ ID NO: 5954 - DNA, 103 bp, Artificial Sequence
  Synthetic Polynucleotide
taatacgactcactatagggtaaacactgtgtctactggagtaactgtaaaacagaggagattacagatgctccagtagaacctggcggcagcgcaaaagatg

SEQ ID NO: 5955 - DNA, 103 bp, Artificial Sequence
  Synthetic Polynucleotide
taatacgactcactataggggccattaaacactgtgtctactggagtaacaacagaggagagttactatggtagacacaaacctggcggcagcgcaaaagatg

SEQ ID NO: 5956 - DNA, 103 bp, Artificial Sequence
  Synthetic Polynucleotide
taatacgactcactatagggtgcaagccattaaacactgtgtctactggaaacagaggagatccagtatgcacagtgttaacctggcggcagcgcaaaagatg

SEQ ID NO: 5957 - DNA, 103 bp, Artificial Sequence
  Synthetic Polynucleotide
taatacgactcactatagggagtggtgcaagccattaaacactgtgtctaaacagaggagatagacaatgtgtttaatgaacctggcggcagcgcaaaagatg

SEQ ID NO: 5958 - DNA, 103 bp, Artificial Sequence
  Synthetic Polynucleotide
taatacgactcactatagggtggagagtggtgcaagccattaaacactgtaacagaggagaacagtgatgaatggcttgaacctggcggcagcgcaaaagatg

SEQ ID NO: 5959 - DNA, 103 bp, Artificial Sequence
  Synthetic Polynucleotide
taatacgactcactatagggttagatggagagtggtgcaagccattaaacaacagaggagagtttaaatgcttgcaccaaacctggcggcagcgcaaaagatg

SEQ ID NO: 5960 - DNA, 103 bp, Artificial Sequence
  Synthetic Polynucleotide
taatacgactcactataggggaacattagatggagagtggtgcaagccataacagaggagaatggctatgaccactctcaacctggcggcagcgcaaaagatg

SEQ ID NO: 5961 - DNA, 103 bp, Artificial Sequence
  Synthetic Polynucleotide
taatacgactcactatagggactttgaacattagatggagagtggtgcaaaacagaggagattgcacatgtctccatctaacctggcggcagcgcaaaagatg

SEQ ID NO: 5962 - DNA, 103 bp, Artificial Sequence
  Synthetic Polynucleotide
taatacgactcactataggggcatgaatagaactcatgcagctagaaagtaacagaggagaactttcatgctgcatgagaacctggcggcagcgcaaaagatg

SEQ ID NO: 5963 - DNA, 103 bp, Artificial Sequence
  Synthetic Polynucleotide
taatacgactcactatagggaaaggactttgaacattagatggagagtggaacagaggagaccactcatgatctaatgtaacctggcggcagcgcaaaagatg

SEQ ID NO: 5964 - DNA, 103 bp, Artificial Sequence
  Synthetic Polynucleotide
taatacgactcactatagggttggaaaaggactttgaacattagatggagaacagaggagactccatatgatgttcaaaaacctggcggcagcgcaaaagatg

SEQ ID NO: 5965 - DNA, 103 bp, Artificial Sequence
  Synthetic Polynucleotide
taatacgactcactatagggccttgttggaaaaggactttgaacattagaaacagaggagatctaatatgcaaagtcctaacctggcggcagcgcaaaagatg

SEQ ID NO: 5966 - DNA, 103 bp, Artificial Sequence
  Synthetic Polynucleotide
taatacgactcactatagggaaaggccttgttggaaaaggactttgaacaaacagaggagatgttcaatgtccttttccaacctggcggcagcgcaaaagatg

SEQ ID NO: 5967 - DNA, 103 bp, Artificial Sequence
  Synthetic Polynucleotide
taatacgactcactataggggatgaaaaggccttgttggaaaaggactttaacagaggagaaaagtcatgttccaacaaaacctggcggcagcgcaaaagatg

SEQ ID NO: 5968 - DNA, 103 bp, Artificial Sequence
  Synthetic Polynucleotide
taatacgactcactatagggtgagtgatgaaaaggccttgttggaaaaggaacagaggagaccttttatgacaaggcctaacctggcggcagcgcaaaagatg

SEQ ID NO: 5969 - DNA, 103 bp, Artificial Sequence
  Synthetic Polynucleotide
taatacgactcactatagggtgaaatgagtgatgaaaaggccttgttggaaacagaggagatccaacatggccttttcaaacctggcggcagcgcaaaagatg

SEQ ID NO: 5970 - DNA, 103 bp, Artificial Sequence
  Synthetic Polynucleotide
taatacgactcactatagggtgaactgaaatgagtgatgaaaaggccttgaacagaggagacaaggcatgttcatcactaacctggcggcagcgcaaaagatg

SEQ ID NO: 5971 - DNA, 103 bp, Artificial Sequence
  Synthetic Polynucleotide
taatacgactcactatagggagaactgaactgaaatgagtgatgaaaaggaacagaggagaccttttatgcactcatttaacctggcggcagcgcaaaagatg

SEQ ID NO: 5972 - DNA, 103 bp, Artificial Sequence
  Synthetic Polynucleotide
taatacgactcactatagggactgtagaactgaactgaaatgagtgatgaaacagaggagatcatcaatgatttcagttaacctggcggcagcgcaaaagatg

SEQ ID NO: 5973 - DNA, 103 bp, Artificial Sequence
  Synthetic Polynucleotide
taatacgactcactatagggcgtctgcatgaatagaactcatgcagctagaacagaggagactagctatgtgagttctaaacctggcggcagcgcaaaagatg

SEQ ID NO: 5974 - DNA, 103 bp, Artificial Sequence
  Synthetic Polynucleotide
taatacgactcactatagggctggaactgtagaactgaactgaaatgagtaacagaggagaactcatatgagttcagttaacctggcggcagcgcaaaagatg

SEQ ID NO: 5975 - DNA, 103 bp, Artificial Sequence
  Synthetic Polynucleotide
taatacgactcactatagggaacatctggaactgtagaactgaactgaaaaacagaggagatttcagatgagttctacaaacctggcggcagcgcaaaagatg

SEQ ID NO: 5976 - DNA, 103 bp, Artificial Sequence
  Synthetic Polynucleotide
taatacgactcactatagggtctgtaacatctggaactgtagaactgaacaacagaggagagttcagatgtacagttccaacctggcggcagcgcaaaagatg

SEQ ID NO: 5977 - DNA, 103 bp, Artificial Sequence
  Synthetic Polynucleotide
taatacgactcactatagggagggttctgtaacatctggaactgtagaacaacagaggagagttctaatgttccagatgaacctggcggcagcgcaaaagatg

SEQ ID NO: 5978 - DNA, 103 bp, Artificial Sequence
  Synthetic Polynucleotide
taatacgactcactatagggataacagggttctgtaacatctggaactgtaacagaggagaacagttatggatgttacaaacctggcggcagcgcaaaagatg

SEQ ID NO: 5979 - DNA, 103 bp, Artificial Sequence
  Synthetic Polynucleotide
taatacgactcactatagggataccataacagggttctgtaacatctggaaacagaggagatccagaatgtacagaaccaacctggcggcagcgcaaaagatg

SEQ ID NO: 5980 - DNA, 103 bp, Artificial Sequence
  Synthetic Polynucleotide
taatacgactcactatagggctgtcataccataacagggttctgtaacataacagaggagaatgttaatgaaccctgttaacctggcggcagcgcaaaagatg

SEQ ID NO: 5981 - DNA, 103 bp, Artificial Sequence
  Synthetic Polynucleotide
taatacgactcactatagggtgtaactgtcataccataacagggttctgtaacagaggagaacagaaatgtgttatggtaacctggcggcagcgcaaaagatg

SEQ ID NO: 5982 - DNA, 103 bp, Artificial Sequence
  Synthetic Polynucleotide
taatacgactcactatagggggtcctgtaactgtcataccataacagggtaacagaggagaaccctgatgtggtatgacaacctggcggcagcgcaaaagatg

SEQ ID NO: 5983 - DNA, 103 bp, Artificial Sequence
  Synthetic Polynucleotide
taatacgactcactatagggctctgggtcctgtaactgtcataccataacaacagaggagagttatgatgtgacagttaaacctggcggcagcgcaaaagatg

SEQ ID NO: 5984 - DNA, 103 bp, Artificial Sequence
  Synthetic Polynucleotide
taatacgactcactatagggcactccgtctgcatgaatagaactcatgcaaacagaggagatgcatgatgtctattcataacctggcggcagcgcaaaagatg

SEQ ID NO: 5985 - DNA, 103 bp, Artificial Sequence
  Synthetic Polynucleotide
taatacgactcactatagggatagtctctgggtcctgtaactgtcataccaacagaggagaggtatgatggttacaggaaacctggcggcagcgcaaaagatg

SEQ ID NO: 5986 - DNA, 103 bp, Artificial Sequence
  Synthetic Polynucleotide
taatacgactcactatagggggcagatagtctctgggtcctgtaactgtcaacagaggagagacagtatgaggacccagaacctggcggcagcgcaaaagatg

SEQ ID NO: 5987 - DNA, 103 bp, Artificial Sequence
  Synthetic Polynucleotide
taatacgactcactatagggggggaggcagatagtctctgggtcctgtaaaacagaggagattacagatgccagagactaacctggcggcagcgcaaaagatg

SEQ ID NO: 5988 - DNA, 103 bp, Artificial Sequence
  Synthetic Polynucleotide
taatacgactcactatagggaatagggggaggcagatagtctctgggtccaacagaggagaggacccatggactatctgaacctggcggcagcgcaaaagatg

SEQ ID NO: 5989 - DNA, 103 bp, Artificial Sequence
  Synthetic Polynucleotide
taatacgactcactatagggtcagtaatagggggaggcagatagtctctgaacagaggagacagagaatgtctgcctccaacctggcggcagcgcaaaagatg

SEQ ID NO: 5990 - DNA, 103 bp, Artificial Sequence
  Synthetic Polynucleotide
taatacgactcactatagggatagatcagtaatagggggaggcagatagtaacagaggagaactatcatgctccccctaaacctggcggcagcgcaaaagatg

SEQ ID NO: 5991 - DNA, 103 bp, Artificial Sequence
  Synthetic Polynucleotide
taatacgactcactatagggagataatagatcagtaatagggggaggcagaacagaggagactgcctatgcctattactaacctggcggcagcgcaaaagatg

SEQ ID NO: 5992 - DNA, 103 bp, Artificial Sequence
  Synthetic Polynucleotide
taatacgactcactatagggacaagagataatagatcagtaatagggggaaacagaggagatcccccatgtactgatctaacctggcggcagcgcaaaagatg

SEQ ID NO: 5993 - DNA, 103 bp, Artificial Sequence
  Synthetic Polynucleotide
taatacgactcactatagggccttcacaagagataatagatcagtaatagaacagaggagactattaatgatctattataacctggcggcagcgcaaaagatg

SEQ ID NO: 5994 - DNA, 103 bp, Artificial Sequence
  Synthetic Polynucleotide
taatacgactcactatagggtggaaccttcacaagagataatagatcagtaacagaggagaactgatatgttatctcttaacctggcggcagcgcaaaagatg

SEQ ID NO: 5995 - DNA, 103 bp, Artificial Sequence
  Synthetic Polynucleotide
taatacgactcactatagggagtatcactccgtctgcatgaatagaactcaacagaggagagagttcatgtcatgcagaaacctggcggcagcgcaaaagatg

SEQ ID NO: 5996 - DNA, 103 bp, Artificial Sequence
  Synthetic Polynucleotide
taatacgactcactatagggaggcttggaaccttcacaagagataatagaaacagaggagatctattatgtcttgtgaaaacctggcggcagcgcaaaagatg

SEQ ID NO: 5997 - DNA, 103 bp, Artificial Sequence
  Synthetic Polynucleotide
taatacgactcactatagggtcattaggcttggaaccttcacaagagataaacagaggagatatctcatgtgaaggttcaacctggcggcagcgcaaaagatg

SEQ ID NO: 5998 - DNA, 103 bp, Artificial Sequence
  Synthetic Polynucleotide
taatacgactcactatagggaacagtcattaggcttggaaccttcacaagaacagaggagacttgtgatggttccaagcaacctggcggcagcgcaaaagatg

SEQ ID NO: 5999 - DNA, 103 bp, Artificial Sequence
  Synthetic Polynucleotide
taatacgactcactatagggtaagaaacagtcattaggcttggaaccttcaacagaggagagaaggtatgaagcctaataacctggcggcagcgcaaaagatg

SEQ ID NO: 6000 - DNA, 103 bp, Artificial Sequence
  Synthetic Polynucleotide
taatacgactcactatagggtaacgtaagaaacagtcattaggcttggaaaacagaggagattccaaatgtaatgactgaacctggcggcagcgcaaaagatg

SEQ ID NO: 6001 - DNA, 103 bp, Artificial Sequence
  Synthetic Polynucleotide
taatacgactcactatagggattactaacgtaagaaacagtcattaggctaacagaggagaagcctaatgactgtttctaacctggcggcagcgcaaaagatg

SEQ ID NO: 6002 - DNA, 103 bp, Artificial Sequence
  Synthetic Polynucleotide
taatacgactcactatagggtctgaattactaacgtaagaaacagtcattaacagaggagaaatgacatgttcttacgtaacctggcggcagcgcaaaagatg

SEQ ID NO: 6003 - DNA, 103 bp, Artificial Sequence
  Synthetic Polynucleotide
taatacgactcactataggggatcatctgaattactaacgtaagaaacagaacagaggagactgtttatgacgttagtaaacctggcggcagcgcaaaagatg

SEQ ID NO: 6004 - DNA, 103 bp, Artificial Sequence
  Synthetic Polynucleotide
taatacgactcactatagggatttggatcatctgaattactaacgtaagaaacagaggagatcttacatgagtaattcaaacctggcggcagcgcaaaagatg

SEQ ID NO: 6005 - DNA, 103 bp, Artificial Sequence
  Synthetic Polynucleotide
taatacgactcactatagggtccacatttggatcatctgaattactaacgaacagaggagacgttagatgttcagatgaaacctggcggcagcgcaaaagatg

SEQ ID NO: 6006 - DNA, 103 bp, Artificial Sequence
  Synthetic Polynucleotide
taatacgactcactatagggacgggagtatcactccgtctgcatgaatagaacagaggagactattcatgcagacggagaacctggcggcagcgcaaaagatg

SEQ ID NO: 6007 - DNA, 103 bp, Artificial Sequence
  Synthetic Polynucleotide
taatacgactcactatagggttatttccacatttggatcatctgaattacaacagaggagagtaattatgatgatccaaaacctggcggcagcgcaaaagatg

SEQ ID NO: 6008 - DNA, 103 bp, Artificial Sequence
  Synthetic Polynucleotide
taatacgactcactatagggattggttatttccacatttggatcatctgaaacagaggagatcagatatgccaaatgtgaacctggcggcagcgcaaaagatg

SEQ ID NO: 6009 - DNA, 103 bp, Artificial Sequence
  Synthetic Polynucleotide
taatacgactcactatagggtttgcattggttatttccacatttggatcaaacagaggagatgatccatgtgtggaaataacctggcggcagcgcaaaagatg

SEQ ID NO: 6010 - DNA, 103 bp, Artificial Sequence
  Synthetic Polynucleotide
taatacgactcactatagggacttctttgcattggttatttccacatttgaacagaggagacaaatgatgaaataaccaaacctggcggcagcgcaaaagatg

SEQ ID NO: 6011 - DNA, 103 bp, Artificial Sequence
  Synthetic Polynucleotide
taatacgactcactatagggctcagacttctttgcattggttatttccacaacagaggagagtggaaatgaccaatgcaaacctggcggcagcgcaaaagatg

SEQ ID NO: 6012 - DNA, 103 bp, Artificial Sequence
  Synthetic Polynucleotide
taatacgactcactatagggagaggctcagacttctttgcattggttattaacagaggagaaataacatgtgcaaagaaaacctggcggcagcgcaaaagatg

SEQ ID NO: 6013 - DNA, 103 bp, Artificial Sequence
  Synthetic Polynucleotide
taatacgactcactatagggtaaaaagaggctcagacttctttgcattggaacagaggagaccaatgatgagaagtctgaacctggcggcagcgcaaaagatg

SEQ ID NO: 6014 - DNA, 103 bp, Artificial Sequence
  Synthetic Polynucleotide
taatacgactcactatagggagcggtaaaaagaggctcagacttctttgcaacagaggagagcaaagatgtctgagcctaacctggcggcagcgcaaaagatg

SEQ ID NO: 6015 - DNA, 103 bp, Artificial Sequence
  Synthetic Polynucleotide
taatacgactcactatagggacgttagcggtaaaaagaggctcagacttcaacagaggagagaagtcatggcctcttttaacctggcggcagcgcaaaagatg

SEQ ID NO: 6016 - DNA, 103 bp, Artificial Sequence
  Synthetic Polynucleotide
taatacgactcactatagggtgacaacgttagcggtaaaaagaggctcagaacagaggagactgagcatgtttttaccgaacctggcggcagcgcaaaagatg

SEQ ID NO: 6017 - DNA, 103 bp, Artificial Sequence
  Synthetic Polynucleotide
taatacgactcactatagggtcaaaccacacgtttcaagactgccacatgaacagaggagacatgtgatggtcttgaaaaacctggcggcagcgcaaaagatg

SEQ ID NO: 6018 - DNA, 103 bp, Artificial Sequence
  Synthetic Polynucleotide
taatacgactcactatagggaaggaacgggagtatcactccgtctgcatgaacagaggagacatgcaatgggagtgataaacctggcggcagcgcaaaagatg

SEQ ID NO: 6019 - DNA, 103 bp, Artificial Sequence
  Synthetic Polynucleotide
taatacgactcactatagggtgaaatgacaacgttagcggtaaaaagaggaacagaggagacctcttatgaccgctaacaacctggcggcagcgcaaaagatg

SEQ ID NO: 6020 - DNA, 103 bp, Artificial Sequence
  Synthetic Polynucleotide
taatacgactcactatagggaggtctgaaatgacaacgttagcggtaaaaaacagaggagattttacatgtaacgttgtaacctggcggcagcgcaaaagatg

SEQ ID NO: 6021 - DNA, 103 bp, Artificial Sequence
  Synthetic Polynucleotide
taatacgactcactatagggaatgtaggtctgaaatgacaacgttagcggaacagaggagaccgctaatgttgtcatttaacctggcggcagcgcaaaagatg

SEQ ID NO: 6022 - DNA, 103 bp, Artificial Sequence
  Synthetic Polynucleotide
taatacgactcactatagggctggaaatgtaggtctgaaatgacaacgttaacagaggagaaacgttatgatttcagacaacctggcggcagcgcaaaagatg

SEQ ID NO: 6023 - DNA, 103 bp, Artificial Sequence
  Synthetic Polynucleotide
taatacgactcactataggggtatgctggaaatgtaggtctgaaatgacaaacagaggagatgtcatatgagacctacaaacctggcggcagcgcaaaagatg

SEQ ID NO: 6024 - DNA, 103 bp, Artificial Sequence
  Synthetic Polynucleotide
taatacgactcactatagggccagggtatgctggaaatgtaggtctgaaaaacagaggagatttcagatgtacatttccaacctggcggcagcgcaaaagatg

SEQ ID NO: 6025 - DNA, 103 bp, Artificial Sequence
  Synthetic Polynucleotide
taatacgactcactatagggtcctaccagggtatgctggaaatgtaggtcaacagaggagagacctaatgttccagcataacctggcggcagcgcaaaagatg

SEQ ID NO: 6026 - DNA, 103 bp, Artificial Sequence
  Synthetic Polynucleotide
taatacgactcactatagggagttgtcctaccagggtatgctggaaatgtaacagaggagaacatttatggcataccctaacctggcggcagcgcaaaagatg

SEQ ID NO: 6027 - DNA, 103 bp, Artificial Sequence
  Synthetic Polynucleotide
taatacgactcactatagggtagatagttgtcctaccagggtatgctggaaacagaggagatccagcatgccctggtagaacctggcggcagcgcaaaagatg

SEQ ID NO: 6028 - DNA, 103 bp, Artificial Sequence
  Synthetic Polynucleotide
taatacgactcactatagggatacttagatagttgtcctaccagggtatgaacagaggagacataccatggtaggacaaaacctggcggcagcgcaaaagatg

SEQ ID NO: 6029 - DNA, 103 bp, Artificial Sequence
  Synthetic Polynucleotide
taatacgactcactatagggccaagaaggaacgggagtatcactccgtctaacagaggagaagacggatggatactcccaacctggcggcagcgcaaaagatg

SEQ ID NO: 6030 - DNA, 103 bp, Artificial Sequence
  Synthetic Polynucleotide
taatacgactcactatagggcaaaaatacttagatagttgtcctaccaggaacagaggagacctggtatgacaactatcaacctggcggcagcgcaaaagatg

SEQ ID NO: 6031 - DNA, 103 bp, Artificial Sequence
  Synthetic Polynucleotide
taatacgactcactatagggaattacaaaaatacttagatagttgtcctaaacagaggagataggacatgtatctaagtaacctggcggcagcgcaaaagatg

SEQ ID NO: 6032 - DNA, 103 bp, Artificial Sequence
  Synthetic Polynucleotide
taatacgactcactatagggtctataattacaaaaatacttagatagttgaacagaggagacaactaatgaagtattttaacctggcggcagcgcaaaagatg

SEQ ID NO: 6033 - DNA, 103 bp, Artificial Sequence
  Synthetic Polynucleotide
taatacgactcactataggggagcctctataattacaaaaatacttagataacagaggagaatctaaatgtttttgtaaaacctggcggcagcgcaaaagatg

SEQ ID NO: 6034 - DNA, 103 bp, Artificial Sequence
  Synthetic Polynucleotide
taatacgactcactataggggaattgagcctctataattacaaaaatactaacagaggagaagtattatggtaattataaacctggcggcagcgcaaaagatg

SEQ ID NO: 6035 - DNA, 103 bp, Artificial Sequence
  Synthetic Polynucleotide
taatacgactcactataggggatctgaattgagcctctataattacaaaaaacagaggagattttgtatgtatagaggcaacctggcggcagcgcaaaagatg

SEQ ID NO: 6036 - DNA, 103 bp, Artificial Sequence
  Synthetic Polynucleotide
taatacgactcactataggggatgagatctgaattgagcctctataattaaacagaggagataattaatgaggctcaataacctggcggcagcgcaaaagatg

SEQ ID NO: 6037 - DNA, 103 bp, Artificial Sequence
  Synthetic Polynucleotide
taatacgactcactatagggaaatagatgagatctgaattgagcctctataacagaggagaatagagatgcaattcagaaacctggcggcagcgcaaaagatg

SEQ ID NO: 6038 - DNA, 103 bp, Artificial Sequence
  Synthetic Polynucleotide
taatacgactcactatagggagcagaaatagatgagatctgaattgagccaacagaggagaggctcaatgcagatctcaaacctggcggcagcgcaaaagatg

SEQ ID NO: 6039 - DNA, 103 bp, Artificial Sequence
  Synthetic Polynucleotide
taatacgactcactataggggtagtagcagaaatagatgagatctgaattaacagaggagaaattcaatgctcatctataacctggcggcagcgcaaaagatg

SEQ ID NO: 6040 - DNA, 103 bp, Artificial Sequence
  Synthetic Polynucleotide
taatacgactcactatagggcctgtccaagaaggaacgggagtatcactcaacagaggagagagtgaatgtcccgttccaacctggcggcagcgcaaaagatg

SEQ ID NO: 6041 - DNA, 103 bp, Artificial Sequence
  Synthetic Polynucleotide
taatacgactcactatagggtggcagtagtagcagaaatagatgagatctaacagaggagaagatctatgctatttctgaacctggcggcagcgcaaaagatg

SEQ ID NO: 6042 - DNA, 103 bp, Artificial Sequence
  Synthetic Polynucleotide
taatacgactcactatagggtgtcatggcagtagtagcagaaatagatgaaacagaggagatcatctatgtctgctactaacctggcggcagcgcaaaagatg

SEQ ID NO: 6043 - DNA, 103 bp, Artificial Sequence
  Synthetic Polynucleotide
taatacgactcactatagggccacgtgtcatggcagtagtagcagaaataaacagaggagatatttcatgtactactgcaacctggcggcagcgcaaaagatg

SEQ ID NO: 6044 - DNA, 103 bp, Artificial Sequence
  Synthetic Polynucleotide
taatacgactcactatagggatttaccacgtgtcatggcagtagtagcagaacagaggagactgctaatgctgccatgaaacctggcggcagcgcaaaagatg

SEQ ID NO: 6045 - DNA, 103 bp, Artificial Sequence
  Synthetic Polynucleotide
taatacgactcactatagggcagcaatttaccacgtgtcatggcagtagtaacagaggagaactactatgatgacacgtaacctggcggcagcgcaaaagatg

SEQ ID NO: 6046 - DNA, 103 bp, Artificial Sequence
  Synthetic Polynucleotide
taatacgactcactataggggagaacagcaatttaccacgtgtcatggcaaacagaggagatgccatatgacgtggtaaaacctggcggcagcgcaaaagatg

SEQ ID NO: 6047 - DNA, 103 bp, Artificial Sequence
  Synthetic Polynucleotide
taatacgactcactatagggtgtaagagaacagcaatttaccacgtgtcaaacagaggagatgacacatggtaaattgcaacctggcggcagcgcaaaagatg

SEQ ID NO: 6048 - DNA, 103 bp, Artificial Sequence
  Synthetic Polynucleotide
taatacgactcactatagggtggggtgtaagagaacagcaatttaccacgaacagaggagacgtggtatgttgctgttcaacctggcggcagcgcaaaagatg

SEQ ID NO: 6049 - DNA, 103 bp, Artificial Sequence
  Synthetic Polynucleotide
taatacgactcactatagggccgggtggggtgtaagagaacagcaatttaaacagaggagataaattatggttctcttaaacctggcggcagcgcaaaagatg

SEQ ID NO: 6050 - DNA, 103 bp, Artificial Sequence
  Synthetic Polynucleotide
taatacgactcactatagggcagctccgggtggggtgtaagagaacagcaaacagaggagatgctgtatgcttacacccaacctggcggcagcgcaaaagatg

SEQ ID NO: 6051 - DNA, 103 bp, Artificial Sequence
  Synthetic Polynucleotide
taatacgactcactatagggggcaacctgtccaagaaggaacgggagtataacagaggagaatactcatgttccttcttaacctggcggcagcgcaaaagatg

SEQ ID NO: 6052 - DNA, 103 bp, Artificial Sequence
  Synthetic Polynucleotide
taatacgactcactatagggtttaccagctccgggtggggtgtaagagaaaacagaggagattctctatgaccccacccaacctggcggcagcgcaaaagatg

SEQ ID NO: 6053 - DNA, 103 bp, Artificial Sequence
  Synthetic Polynucleotide
taatacgactcactatagggaggggtttaccagctccgggtggggtgtaaaacagaggagattacacatgacccggagcaacctggcggcagcgcaaaagatg

SEQ ID NO: 6054 - DNA, 103 bp, Artificial Sequence
  Synthetic Polynucleotide
taatacgactcactataggggggtgaggggtttaccagctccgggtggggaacagaggagaccccacatggagctggtaaacctggcggcagcgcaaaagatg

SEQ ID NO: 6055 - DNA, 103 bp, Artificial Sequence
  Synthetic Polynucleotide
taatacgactcactatagggttcaagggtgaggggtttaccagctccgggaacagaggagacccggaatgggtaaacccaacctggcggcagcgcaaaagatg

SEQ ID NO: 6056 - DNA, 103 bp, Artificial Sequence
  Synthetic Polynucleotide
taatacgactcactataggggcttgttcaagggtgaggggtttaccagctaacagaggagaagctggatgacccctcacaacctggcggcagcgcaaaagatg

SEQ ID NO: 6057 - DNA, 103 bp, Artificial Sequence
  Synthetic Polynucleotide
taatacgactcactataggggcatcgcttgttcaagggtgaggggtttacaacagaggagagtaaacatgtcacccttgaacctggcggcagcgcaaaagatg

SEQ ID NO: 6058 - DNA, 103 bp, Artificial Sequence
  Synthetic Polynucleotide
taatacgactcactataggggccctgcatcgcttgttcaagggtgaggggaacagaggagacccctcatgcttgaacaaaacctggcggcagcgcaaaagatg

SEQ ID NO: 6059 - DNA, 103 bp, Artificial Sequence
  Synthetic Polynucleotide
taatacgactcactatagggtaagtgccctgcatcgcttgttcaagggtgaacagaggagacaccctatgacaagcgataacctggcggcagcgcaaaagatg

SEQ ID NO: 6060 - DNA, 103 bp, Artificial Sequence
  Synthetic Polynucleotide
taatacgactcactatagggtggagtaagtgccctgcatcgcttgttcaaaacagaggagattgaacatgcgatgcaggaacctggcggcagcgcaaaagatg

SEQ ID NO: 6061 - DNA, 103 bp, Artificial Sequence
  Synthetic Polynucleotide
taatacgactcactatagggccatatggagtaagtgccctgcatcgcttgaacagaggagacaagcgatgcagggcactaacctggcggcagcgcaaaagatg

SEQ ID NO: 6062 - DNA, 103 bp, Artificial Sequence
  Synthetic Polynucleotide
taatacgactcactataggggtggaggcaacctgtccaagaaggaacgggaacagaggagacccgttatgtcttggacaaacctggcggcagcgcaaaagatg

SEQ ID NO: 6063 - DNA, 103 bp, Artificial Sequence
  Synthetic Polynucleotide
taatacgactcactatagggaggtcccatatggagtaagtgccctgcatcaacagaggagagatgcaatgcacttactcaacctggcggcagcgcaaaagatg

SEQ ID NO: 6064 - DNA, 103 bp, Artificial Sequence
  Synthetic Polynucleotide
taatacgactcactatagggatccaaggtcccatatggagtaagtgccctaacagaggagaagggcaatgactccatataacctggcggcagcgcaaaagatg

SEQ ID NO: 6065 - DNA, 103 bp, Artificial Sequence
  Synthetic Polynucleotide
taatacgactcactatagggctgcaatccaaggtcccatatggagtaagtaacagaggagaacttacatgatatgggacaacctggcggcagcgcaaaagatg

SEQ ID NO: 6066 - DNA, 103 bp, Artificial Sequence
  Synthetic Polynucleotide
taatacgactcactataggggatgactgcaatccaaggtcccatatggagaacagaggagactccatatgggaccttggaacctggcggcagcgcaaaagatg

SEQ ID NO: 6067 - DNA, 103 bp, Artificial Sequence
  Synthetic Polynucleotide
taatacgactcactatagggggaaagatgactgcaatccaaggtcccataaacagaggagatatgggatgttggattgcaacctggcggcagcgcaaaagatg

SEQ ID NO: 6068 - DNA, 103 bp, Artificial Sequence
  Synthetic Polynucleotide
taatacgactcactatagggaaaatggaaagatgactgcaatccaaggtcaacagaggagagaccttatgttgcagtcaaacctggcggcagcgcaaaagatg

SEQ ID NO: 6069 - DNA, 103 bp, Artificial Sequence
  Synthetic Polynucleotide
taatacgactcactatagggatggtaaaatggaaagatgactgcaatccaaacagaggagatggattatggtcatctttaacctggcggcagcgcaaaagatg

SEQ ID NO: 6070 - DNA, 103 bp, Artificial Sequence
  Synthetic Polynucleotide
taatacgactcactatagggaggggatggtaaaatggaaagatgactgcaaacagaggagatgcagtatgctttccattaacctggcggcagcgcaaaagatg

SEQ ID NO: 6071 - DNA, 103 bp, Artificial Sequence
  Synthetic Polynucleotide
taatacgactcactatagggaataaaggggatggtaaaatggaaagatgaaacagaggagatcatctatgcattttaccaacctggcggcagcgcaaaagatg

SEQ ID NO: 6072 - DNA, 103 bp, Artificial Sequence
  Synthetic Polynucleotide
taatacgactcactataggggcagaaataaaggggatggtaaaatggaaaaacagaggagatttccaatgtaccatcccaacctggcggcagcgcaaaagatg

SEQ ID NO: 6073 - DNA, 103 bp, Artificial Sequence
  Synthetic Polynucleotide
taatacgactcactatagggagggcgtggaggcaacctgtccaagaaggaaacagaggagatccttcatggacaggttgaacctggcggcagcgcaaaagatg

SEQ ID NO: 6074 - DNA, 103 bp, Artificial Sequence
  Synthetic Polynucleotide
taatacgactcactatagggctactgcagaaataaaggggatggtaaaataacagaggagaattttaatgtcccctttaaacctggcggcagcgcaaaagatg

SEQ ID NO: 6075 - DNA, 103 bp, Artificial Sequence
  Synthetic Polynucleotide
taatacgactcactatagggatagtctactgcagaaataaaggggatggtaacagaggagaaccatcatgtttatttctaacctggcggcagcgcaaaagatg

SEQ ID NO: 6076 - DNA, 103 bp, Artificial Sequence
  Synthetic Polynucleotide
taatacgactcactatagggatcctatagtctactgcagaaataaaggggaacagaggagaccccttatgttctgcagtaacctggcggcagcgcaaaagatg

SEQ ID NO: 6077 - DNA, 103 bp, Artificial Sequence
  Synthetic Polynucleotide
taatacgactcactatagggctgaaatcctatagtctactgcagaaataaaacagaggagattatttatgcagtagactaacctggcggcagcgcaaaagatg

SEQ ID NO: 6078 - DNA, 103 bp, Artificial Sequence
  Synthetic Polynucleotide
taatacgactcactatagggaactgctgaaatcctatagtctactgcagaaacagaggagatctgcaatggactataggaacctggcggcagcgcaaaagatg

SEQ ID NO: 6079 - DNA, 103 bp, Artificial Sequence
  Synthetic Polynucleotide
taatacgactcactataggggcagaaactgctgaaatcctatagtctactaacagaggagaagtagaatgtaggatttcaacctggcggcagcgcaaaagatg

SEQ ID NO: 6080 - DNA, 103 bp, Artificial Sequence
  Synthetic Polynucleotide
taatacgactcactatagggaagaagcagaaactgctgaaatcctatagtaacagaggagaactataatgtttcagcagaacctggcggcagcgcaaaagatg

SEQ ID NO: 6081 - DNA, 103 bp, Artificial Sequence
  Synthetic Polynucleotide
taatacgactcactatagggtgctgaagaagcagaaactgctgaaatcctaacagaggagaaggattatggcagtttctaacctggcggcagcgcaaaagatg

SEQ ID NO: 6082 - DNA, 103 bp, Artificial Sequence
  Synthetic Polynucleotide
taatacgactcactatagggttgactgctgaagaagcagaaactgctgaaaacagaggagattcagcatgttctgcttcaacctggcggcagcgcaaaagatg

SEQ ID NO: 6083 - DNA, 103 bp, Artificial Sequence
  Synthetic Polynucleotide
taatacgactcactatagggctgaattgactgctgaagaagcagaaactgaacagaggagacagtttatgcttcttcagaacctggcggcagcgcaaaagatg

SEQ ID NO: 6084 - DNA, 103 bp, Artificial Sequence
  Synthetic Polynucleotide
taatacgactcactatagggcacaaagggcgtggaggcaacctgtccaagaacagaggagacttggaatggttgcctccaacctggcggcagcgcaaaagatg

SEQ ID NO: 6085 - DNA, 103 bp, Artificial Sequence
  Synthetic Polynucleotide
taatacgactcactatagggaccatctgaattgactgctgaagaagcagaaacagaggagatctgctatgtcagcagtcaacctggcggcagcgcaaaagatg

SEQ ID NO: 6086 - DNA, 103 bp, Artificial Sequence
  Synthetic Polynucleotide
taatacgactcactatagggaaccaaccatctgaattgactgctgaagaaaacagaggagattcttcatgagtcaattcaacctggcggcagcgcaaaagatg

SEQ ID NO: 6087 - DNA, 103 bp, Artificial Sequence
  Synthetic Polynucleotide
taatacgactcactatagggttgtgaaccaaccatctgaattgactgctgaacagaggagacagcagatgattcagatgaacctggcggcagcgcaaaagatg

SEQ ID NO: 6088 - DNA, 103 bp, Artificial Sequence
  Synthetic Polynucleotide
taatacgactcactatagggccaaattgtgaaccaaccatctgaattgacaacagaggagagtcaatatggatggttggaacctggcggcagcgcaaaagatg

SEQ ID NO: 6089 - DNA, 103 bp, Artificial Sequence
  Synthetic Polynucleotide
taatacgactcactatagggaaaagccaaattgtgaaccaaccatctgaaaacagaggagattcagaatgttggttcacaacctggcggcagcgcaaaagatg

SEQ ID NO: 6090 - DNA, 103 bp, Artificial Sequence
  Synthetic Polynucleotide
taatacgactcactatagggggttcaaaagccaaattgtgaaccaaccataacagaggagaatggttatgtcacaatttaacctggcggcagcgcaaaagatg

SEQ ID NO: 6091 - DNA, 103 bp, Artificial Sequence
  Synthetic Polynucleotide
taatacgactcactatagggcaaggggttcaaaagccaaattgtgaaccaaacagaggagatggttcatgatttggcttaacctggcggcagcgcaaaagatg

SEQ ID NO: 6092 - DNA, 103 bp, Artificial Sequence
  Synthetic Polynucleotide
taatacgactcactatagggtatgtcaaggggttcaaaagccaaattgtgaacagaggagacacaatatggcttttgaaaacctggcggcagcgcaaaagatg

SEQ ID NO: 6093 - DNA, 103 bp, Artificial Sequence
  Synthetic Polynucleotide
taatacgactcactataggggagggtatgtcaaggggttcaaaagccaaaaacagaggagatttggcatgtgaacccctaacctggcggcagcgcaaaagatg

SEQ ID NO: 6094 - DNA, 103 bp, Artificial Sequence
  Synthetic Polynucleotide
taatacgactcactataggggccgggagggtatgtcaaggggttcaaaagaacagaggagacttttgatgcccttgacaaacctggcggcagcgcaaaagatg

SEQ ID NO: 6095 - DNA, 103 bp, Artificial Sequence
  Synthetic Polynucleotide
taatacgactcactatagggagatccacaaagggcgtggaggcaacctgtaacagaggagaacaggtatgctccacgccaacctggcggcagcgcaaaagatg

SEQ ID NO: 6096 - DNA, 103 bp, Artificial Sequence
  Synthetic Polynucleotide
taatacgactcactatagggggtgagccgggagggtatgtcaaggggttcaacagaggagagaacccatggacatacccaacctggcggcagcgcaaaagatg

SEQ ID NO: 6097 - DNA, 103 bp, Artificial Sequence
  Synthetic Polynucleotide
taatacgactcactatagggttggtggtgagccgggagggtatgtcaaggaacagaggagaccttgaatgaccctcccgaacctggcggcagcgcaaaagatg

SEQ ID NO: 6098 - DNA, 103 bp, Artificial Sequence
  Synthetic Polynucleotide
taatacgactcactatagggctgggttggtggtgagccgggagggtatgtaacagaggagaacatacatgcccggctcaaacctggcggcagcgcaaaagatg

SEQ ID NO: 6099 - DNA, 103 bp, Artificial Sequence
  Synthetic Polynucleotide
taatacgactcactatagggatcctctgggttggtggtgagccgggagggaacagaggagaccctccatgctcaccaccaacctggcggcagcgcaaaagatg

SEQ ID NO: 6100 - DNA, 103 bp, Artificial Sequence
  Synthetic Polynucleotide
taatacgactcactatagggagacaatcctctgggttggtggtgagccggaacagaggagaccggctatgcaccaacccaacctggcggcagcgcaaaagatg

SEQ ID NO: 6101 - DNA, 103 bp, Artificial Sequence
  Synthetic Polynucleotide
taatacgactcactatagggaaacaagacaatcctctgggttggtggtgaaacagaggagatcaccaatgacccagaggaacctggcggcagcgcaaaagatg

SEQ ID NO: 6102 - DNA, 103 bp, Artificial Sequence
  Synthetic Polynucleotide
taatacgactcactataggggagcaaaacaagacaatcctctgggttggtaacagaggagaaccaacatggaggattgtaacctggcggcagcgcaaaagatg

SEQ ID NO: 6103 - DNA, 103 bp, Artificial Sequence
  Synthetic Polynucleotide
taatacgactcactatagggcagctgagcaaaacaagacaatcctctgggaacagaggagacccagaatgttgtcttgtaacctggcggcagcgcaaaagatg

SEQ ID NO: 6104 - DNA, 103 bp, Artificial Sequence
  Synthetic Polynucleotide
taatacgactcactatagggatcaccagctgagcaaaacaagacaatcctaacagaggagaaggattatgttgttttgcaacctggcggcagcgcaaaagatg

SEQ ID NO: 6105 - DNA, 103 bp, Artificial Sequence
  Synthetic Polynucleotide
taatacgactcactatagggaagtcatcaccagctgagcaaaacaagacaaacagaggagatgtcttatgttgctcagcaacctggcggcagcgcaaaagatg

SEQ ID NO: 6106 - DNA, 103 bp, Artificial Sequence
  Synthetic Polynucleotide
taatacgactcactatagggccttaagatccacaaagggcgtggaggcaaaacagaggagattgcctatgcgccctttgaacctggcggcagcgcaaaagatg

SEQ ID NO: 6107 - DNA, 103 bp, Artificial Sequence
  Synthetic Polynucleotide
taatacgactcactatagggaggaaaagtcatcaccagctgagcaaaacaaacagaggagatgttttatgcagctggtgaacctggcggcagcgcaaaagatg

SEQ ID NO: 6108 - DNA, 103 bp, Artificial Sequence
  Synthetic Polynucleotide
taatacgactcactataggggcggtaggaaaagtcatcaccagctgagcaaacagaggagatgctcaatgggtgatgacaacctggcggcagcgcaaaagatg

SEQ ID NO: 6109 - DNA, 103 bp, Artificial Sequence
  Synthetic Polynucleotide
taatacgactcactataggggggttgcggtaggaaaagtcatcaccagctaacagaggagaagctggatgtgacttttcaacctggcggcagcgcaaaagatg

SEQ ID NO: 6110 - DNA, 103 bp, Artificial Sequence
  Synthetic Polynucleotide
taatacgactcactatagggtaatagggttgcggtaggaaaagtcatcacaacagaggagagtgatgatgtttcctaccaacctggcggcagcgcaaaagatg

SEQ ID NO: 6111 - DNA, 103 bp, Artificial Sequence
  Synthetic Polynucleotide
taatacgactcactatagggggggctaatagggttgcggtaggaaaagtcaacagaggagagactttatgtaccgcaacaacctggcggcagcgcaaaagatg

SEQ ID NO: 6112 - DNA, 103 bp, Artificial Sequence
  Synthetic Polynucleotide
taatacgactcactatagggtagggggggctaatagggttgcggtaggaaaacagaggagattcctaatgcaaccctataacctggcggcagcgcaaaagatg

SEQ ID NO: 6113 - DNA, 103 bp, Artificial Sequence
  Synthetic Polynucleotide
taatacgactcactataggggaaggtagggggggctaatagggttgcggtaacagaggagaaccgcaatgctattagccaacctggcggcagcgcaaaagatg

SEQ ID NO: 6114 - DNA, 103 bp, Artificial Sequence
  Synthetic Polynucleotide
taatacgactcactataggggctctgaaggtagggggggctaatagggttaacagaggagaaaccctatgagcccccccaacctggcggcagcgcaaaagatg

SEQ ID NO: 6115 - DNA, 103 bp, Artificial Sequence
  Synthetic Polynucleotide
taatacgactcactatagggtctgggctctgaaggtagggggggctaataaacagaggagatattagatgcccctacctaacctggcggcagcgcaaaagatg

SEQ ID NO: 6116 - DNA, 103 bp, Artificial Sequence
  Synthetic Polynucleotide
taatacgactcactataggggaggatctgggctctgaaggtagggggggcaacagaggagagcccccatgaccttcagaaacctggcggcagcgcaaaagatg

SEQ ID NO: 6117 - DNA, 103 bp, Artificial Sequence
  Synthetic Polynucleotide
taatacgactcactatagggggtcaccttaagatccacaaagggcgtggaaacagaggagatccacgatgtttgtggataacctggcggcagcgcaaaagatg

SEQ ID NO: 6118 - DNA, 103 bp, Artificial Sequence
  Synthetic Polynucleotide
taatacgactcactataggggtcatgaggatctgggctctgaaggtagggaacagaggagaccctacatgcagagcccaaacctggcggcagcgcaaaagatg

SEQ ID NO: 6119 - DNA, 103 bp, Artificial Sequence
  Synthetic Polynucleotide
taatacgactcactatagggaaattgtcatgaggatctgggctctgaaggaacagaggagaccttcaatgcccagatccaacctggcggcagcgcaaaagatg

SEQ ID NO: 6120 - DNA, 103 bp, Artificial Sequence
  Synthetic Polynucleotide
taatacgactcactatagggtttctaaattgtcatgaggatctgggctctaacagaggagaagagccatgatcctcatgaacctggcggcagcgcaaaagatg

SEQ ID NO: 6121 - DNA, 103 bp, Artificial Sequence
  Synthetic Polynucleotide
taatacgactcactataggggccactttctaaattgtcatgaggatctggaacagaggagaccagatatgcatgacaataacctggcggcagcgcaaaagatg

SEQ ID NO: 6122 - DNA, 103 bp, Artificial Sequence
  Synthetic Polynucleotide
taatacgactcactatagggctggtgccactttctaaattgtcatgaggaaacagaggagatcctcaatgcaatttagaaacctggcggcagcgcaaaagatg

SEQ ID NO: 6123 - DNA, 103 bp, Artificial Sequence
  Synthetic Polynucleotide
taatacgactcactatagggtcttactggtgccactttctaaattgtcataacagaggagaatgacaatgtagaaagtgaacctggcggcagcgcaaaagatg

SEQ ID NO: 6124 - DNA, 103 bp, Artificial Sequence
  Synthetic Polynucleotide
taatacgactcactatagggtgtattcttactggtgccactttctaaattaacagaggagaaatttaatgagtggcaccaacctggcggcagcgcaaaagatg

SEQ ID NO: 6125 - DNA, 103 bp, Artificial Sequence
  Synthetic Polynucleotide
taatacgactcactataggggcatctgtattcttactggtgccactttctaacagaggagaagaaagatgcaccagtaaaacctggcggcagcgcaaaagatg

SEQ ID NO: 6126 - DNA, 103 bp, Artificial Sequence
  Synthetic Polynucleotide
taatacgactcactatagggagccagcatctgtattcttactggtgccacaacagaggagagtggcaatggtaagaataaacctggcggcagcgcaaaagatg

SEQ ID NO: 6127 - DNA, 103 bp, Artificial Sequence
  Synthetic Polynucleotide
taatacgactcactatagggattcaagccagcatctgtattcttactggtaacagaggagaaccagtatgaatacagataacctggcggcagcgcaaaagatg

SEQ ID NO: 6128 - DNA, 103 bp, Artificial Sequence
  Synthetic Polynucleotide
taatacgactcactatagggagacgtcaaaccacacgtttcaagactgccaacagaggagaggcagtatggaaacgtgtaacctggcggcagcgcaaaagatg

SEQ ID NO: 6129 - DNA, 103 bp, Artificial Sequence
  Synthetic Polynucleotide
taatacgactcactataggggacttggtcaccttaagatccacaaagggcaacagaggagagcccttatgggatcttaaaacctggcggcagcgcaaaagatg

SEQ ID NO: 6130 - DNA, 103 bp, Artificial Sequence
  Synthetic Polynucleotide
taatacgactcactatagggccagaattcaagccagcatctgtattcttaaacagaggagataagaaatgagatgctggaacctggcggcagcgcaaaagatg

SEQ ID NO: 6131 - DNA, 103 bp, Artificial Sequence
  Synthetic Polynucleotide
taatacgactcactatagggtatgtccagaattcaagccagcatctgtataacagaggagaatacagatgctggcttgaaacctggcggcagcgcaaaagatg

SEQ ID NO: 6132 - DNA, 103 bp, Artificial Sequence
  Synthetic Polynucleotide
taatacgactcactatagggtacattatgtccagaattcaagccagcatcaacagaggagagatgctatgttgaattctaacctggcggcagcgcaaaagatg

SEQ ID NO: 6133 - DNA, 103 bp, Artificial Sequence
  Synthetic Polynucleotide
taatacgactcactatagggatacctacattatgtccagaattcaagccaaacagaggagatggcttatgttctggacaaacctggcggcagcgcaaaagatg

SEQ ID NO: 6134 - DNA, 103 bp, Artificial Sequence
  Synthetic Polynucleotide
taatacgactcactatagggtaatcatacctacattatgtccagaattcaaacagaggagatgaattatggacataatgaacctggcggcagcgcaaaagatg

SEQ ID NO: 6135 - DNA, 103 bp, Artificial Sequence
  Synthetic Polynucleotide
taatacgactcactatagggattgttaatcatacctacattatgtccagaaacagaggagatctggaatgaatgtaggtaacctggcggcagcgcaaaagatg

SEQ ID NO: 6136 - DNA, 103 bp, Artificial Sequence
  Synthetic Polynucleotide
taatacgactcactataggggaatgattgttaatcatacctacattatgtaacagaggagaacataaatgaggtatgataacctggcggcagcgcaaaagatg

SEQ ID NO: 6137 - DNA, 103 bp, Artificial Sequence
  Synthetic Polynucleotide
taatacgactcactatagggagtttgaatgattgttaatcatacctacataacagaggagaatgtagatgtgattaacaaacctggcggcagcgcaaaagatg

SEQ ID NO: 6138 - DNA, 103 bp, Artificial Sequence
  Synthetic Polynucleotide
taatacgactcactataggggctacagtttgaatgattgttaatcataccaacagaggagaggtatgatgaacaatcataacctggcggcagcgcaaaagatg

SEQ ID NO: 6139 - DNA, 103 bp, Artificial Sequence
  Synthetic Polynucleotide
taatacgactcactatagggaagaagctacagtttgaatgattgttaatcaacagaggagagattaaatgtcattcaaaaacctggcggcagcgcaaaagatg

SEQ ID NO: 6140 - DNA, 103 bp, Artificial Sequence
  Synthetic Polynucleotide
taatacgactcactatagggccagtgacttggtcaccttaagatccacaaaacagaggagattgtggatgttaaggtgaaacctggcggcagcgcaaaagatg

SEQ ID NO: 6141 - DNA, 103 bp, Artificial Sequence
  Synthetic Polynucleotide
taatacgactcactatagggcataaaagaagctacagtttgaatgattgtaacagaggagaacaatcatgcaaactgtaaacctggcggcagcgcaaaagatg

SEQ ID NO: 6142 - DNA, 103 bp, Artificial Sequence
  Synthetic Polynucleotide
taatacgactcactatagggcctatcataaaagaagctacagtttgaatgaacagaggagacattcaatgtgtagcttcaacctggcggcagcgcaaaagatg

SEQ ID NO: 6143 - DNA, 103 bp, Artificial Sequence
  Synthetic Polynucleotide
taatacgactcactatagggctatacctatcataaaagaagctacagtttaacagaggagaaaactgatgcttcttttaaacctggcggcagcgcaaaagatg

SEQ ID NO: 6144 - DNA, 103 bp, Artificial Sequence
  Synthetic Polynucleotide
taatacgactcactatagggagaacctatacctatcataaaagaagctacaacagaggagagtagctatgtttatgataaacctggcggcagcgcaaaagatg

SEQ ID NO: 6145 - DNA, 103 bp, Artificial Sequence
  Synthetic Polynucleotide
taatacgactcactataggggcctaagaacctatacctatcataaaagaaaacagaggagattctttatggataggtataacctggcggcagcgcaaaagatg

SEQ ID NO: 6146 - DNA, 103 bp, Artificial Sequence
  Synthetic Polynucleotide
taatacgactcactatagggaccaggcctaagaacctatacctatcataaaacagaggagattatgaatggtataggttaacctggcggcagcgcaaaagatg

SEQ ID NO: 6147 - DNA, 103 bp, Artificial Sequence
  Synthetic Polynucleotide
taatacgactcactatagggattctaccaggcctaagaacctatacctataacagaggagaataggtatgggttcttagaacctggcggcagcgcaaaagatg

SEQ ID NO: 6148 - DNA, 103 bp, Artificial Sequence
  Synthetic Polynucleotide
taatacgactcactatagggagatgattctaccaggcctaagaacctataaacagaggagatataggatgttaggcctgaacctggcggcagcgcaaaagatg

SEQ ID NO: 6149 - DNA, 103 bp, Artificial Sequence
  Synthetic Polynucleotide
taatacgactcactatagggtttgaagatgattctaccaggcctaagaacaacagaggagagttcttatgcctggtagaaacctggcggcagcgcaaaagatg

SEQ ID NO: 6150 - DNA, 103 bp, Artificial Sequence
  Synthetic Polynucleotide
taatacgactcactatagggcagcatttgaagatgattctaccaggcctaaacagaggagataggccatgtagaatcataacctggcggcagcgcaaaagatg

SEQ ID NO: 6151 - DNA, 103 bp, Artificial Sequence
  Synthetic Polynucleotide
taatacgactcactatagggcaacaccagtgacttggtcaccttaagatcaacagaggagagatcttatggtgaccaagaacctggcggcagcgcaaaagatg

SEQ ID NO: 6152 - DNA, 103 bp, Artificial Sequence
  Synthetic Polynucleotide
taatacgactcactataggggggtccagcatttgaagatgattctaccagaacagaggagactggtaatgtcatcttcaaacctggcggcagcgcaaaagatg

SEQ ID NO: 6153 - DNA, 103 bp, Artificial Sequence
  Synthetic Polynucleotide
taatacgactcactatagggattttgggtccagcatttgaagatgattctaacagaggagaagaatcatgttcaaatgcaacctggcggcagcgcaaaagatg

SEQ ID NO: 6154 - DNA, 103 bp, Artificial Sequence
  Synthetic Polynucleotide
taatacgactcactatagggaatttattttgggtccagcatttgaagatgaacagaggagacatcttatgatgctggacaacctggcggcagcgcaaaagatg

SEQ ID NO: 6155 - DNA, 103 bp, Artificial Sequence
  Synthetic Polynucleotide
taatacgactcactatagggtggagaatttattttgggtccagcatttgaaacagaggagatcaaatatgggacccaaaaacctggcggcagcgcaaaagatg

SEQ ID NO: 6156 - DNA, 103 bp, Artificial Sequence
  Synthetic Polynucleotide
taatacgactcactatagggttatatggagaatttattttgggtccagcaaacagaggagatgctggatgcaaaataaaaacctggcggcagcgcaaaagatg

SEQ ID NO: 6157 - DNA, 103 bp, Artificial Sequence
  Synthetic Polynucleotide
taatacgactcactatagggtaggattatatggagaatttattttgggtcaacagaggagagacccaatgtaaattctcaacctggcggcagcgcaaaagatg

SEQ ID NO: 6158 - DNA, 103 bp, Artificial Sequence
  Synthetic Polynucleotide
taatacgactcactataggggttagtaggattatatggagaatttattttaacagaggagaaaaataatgtctccatataacctggcggcagcgcaaaagatg

SEQ ID NO: 6159 - DNA, 103 bp, Artificial Sequence
  Synthetic Polynucleotide
taatacgactcactatagggttttggttagtaggattatatggagaatttaacagaggagaaaattcatgatataatccaacctggcggcagcgcaaaagatg

SEQ ID NO: 6160 - DNA, 103 bp, Artificial Sequence
  Synthetic Polynucleotide
taatacgactcactatagggtcactttttggttagtaggattatatggagaacagaggagactccatatgatcctactaaacctggcggcagcgcaaaagatg

SEQ ID NO: 6161 - DNA, 103 bp, Artificial Sequence
  Synthetic Polynucleotide
taatacgactcactatagggatccttcactttttggttagtaggattataaacagaggagatataatatgactaaccaaaacctggcggcagcgcaaaagatg

SEQ ID NO: 6162 - DNA, 103 bp, Artificial Sequence
  Synthetic Polynucleotide
taatacgactcactatagggacctccaacaccagtgacttggtcaccttaaacagaggagataaggtatgcaagtcactaacctggcggcagcgcaaaagatg

SEQ ID NO: 6163 - DNA, 103 bp, Artificial Sequence
  Synthetic Polynucleotide
taatacgactcactatagggctgagatccttcactttttggttagtaggaaacagaggagatcctacatgccaaaaagtaacctggcggcagcgcaaaagatg

SEQ ID NO: 6164 - DNA, 103 bp, Artificial Sequence
  Synthetic Polynucleotide
taatacgactcactatagggtttctctgagatccttcactttttggttagaacagaggagactaaccatgaagtgaaggaacctggcggcagcgcaaaagatg

SEQ ID NO: 6165 - DNA, 103 bp, Artificial Sequence
  Synthetic Polynucleotide
taatacgactcactatagggaaaattttctctgagatccttcactttttgaacagaggagacaaaaaatgaaggatctcaacctggcggcagcgcaaaagatg

SEQ ID NO: 6166 - DNA, 103 bp, Artificial Sequence
  Synthetic Polynucleotide
taatacgactcactatagggactttaaaattttctctgagatccttcactaacagaggagaagtgaaatgtctcagagaaacctggcggcagcgcaaaagatg

SEQ ID NO: 6167 - DNA, 103 bp, Artificial Sequence
  Synthetic Polynucleotide
taatacgactcactatagggcactaactttaaaattttctctgagatcctaacagaggagaaggatcatggagaaaattaacctggcggcagcgcaaaagatg

SEQ ID NO: 6168 - DNA, 103 bp, Artificial Sequence
  Synthetic Polynucleotide
taatacgactcactatagggggtgtcactaactttaaaattttctctgagaacagaggagactcagaatgaattttaaaaacctggcggcagcgcaaaagatg

SEQ ID NO: 6169 - DNA, 103 bp, Artificial Sequence
  Synthetic Polynucleotide
taatacgactcactatagggctctgggtgtcactaactttaaaattttctaacagaggagaagaaaaatgtaaagttagaacctggcggcagcgcaaaagatg

SEQ ID NO: 6170 - DNA, 103 bp, Artificial Sequence
  Synthetic Polynucleotide
taatacgactcactatagggagggtctctgggtgtcactaactttaaaataacagaggagaattttaatgttagtgacaaacctggcggcagcgcaaaagatg

SEQ ID NO: 6171 - DNA, 103 bp, Artificial Sequence
  Synthetic Polynucleotide
taatacgactcactatagggactgtagggtctctgggtgtcactaactttaacagaggagaaaagttatggacacccagaacctggcggcagcgcaaaagatg

SEQ ID NO: 6172 - DNA, 103 bp, Artificial Sequence
  Synthetic Polynucleotide
taatacgactcactatagggaaggcactgtagggtctctgggtgtcactaaacagaggagatagtgaatgccagagaccaacctggcggcagcgcaaaagatg

SEQ ID NO: 6173 - DNA, 103 bp, Artificial Sequence
  Synthetic Polynucleotide
taatacgactcactatagggtcttcacctccaacaccagtgacttggtcaaacagaggagatgaccaatgcactggtgtaacctggcggcagcgcaaaagatg

SEQ ID NO: 6174 - DNA, 103 bp, Artificial Sequence
  Synthetic Polynucleotide
taatacgactcactatagggaagccaaggcactgtagggtctctgggtgtaacagaggagaacacccatggaccctacaaacctggcggcagcgcaaaagatg

SEQ ID NO: 6175 - DNA, 103 bp, Artificial Sequence
  Synthetic Polynucleotide
taatacgactcactatagggggacaaagccaaggcactgtagggtctctgaacagaggagacagagaatgtacagtgccaacctggcggcagcgcaaaagatg

SEQ ID NO: 6176 - DNA, 103 bp, Artificial Sequence
  Synthetic Polynucleotide
taatacgactcactatagggatgggggacaaagccaaggcactgtagggtaacagaggagaaccctaatgtgccttggcaacctggcggcagcgcaaaagatg

SEQ ID NO: 6177 - DNA, 103 bp, Artificial Sequence
  Synthetic Polynucleotide
taatacgactcactatagggatggtatgggggacaaagccaaggcactgtaacagaggagaacagtgatgtggctttgtaacctggcggcagcgcaaaagatg

SEQ ID NO: 6178 - DNA, 103 bp, Artificial Sequence
  Synthetic Polynucleotide
taatacgactcactatagggaatggatggtatgggggacaaagccaaggcaacagaggagagccttgatgttgtcccccaacctggcggcagcgcaaaagatg

SEQ ID NO: 6179 - DNA, 103 bp, Artificial Sequence
  Synthetic Polynucleotide
taatacgactcactatagggccatcaatggatggtatgggggacaaagccaacagaggagaggctttatgccccataccaacctggcggcagcgcaaaagatg

SEQ ID NO: 6180 - DNA, 103 bp, Artificial Sequence
  Synthetic Polynucleotide
taatacgactcactataggggagatccatcaatggatggtatgggggacaaacagaggagatgtcccatgtaccatccaaacctggcggcagcgcaaaagatg

SEQ ID NO: 6181 - DNA, 103 bp, Artificial Sequence
  Synthetic Polynucleotide
taatacgactcactataggggattagagatccatcaatggatggtatgggaacagaggagacccataatgtccattgataacctggcggcagcgcaaaagatg

SEQ ID NO: 6182 - DNA, 103 bp, Artificial Sequence
  Synthetic Polynucleotide
taatacgactcactataggggtagtgattagagatccatcaatggatggtaacagaggagaaccatcatgtgatggatcaacctggcggcagcgcaaaagatg

SEQ ID NO: 6183 - DNA, 103 bp, Artificial Sequence
  Synthetic Polynucleotide
taatacgactcactatagggagtaagtagtgattagagatccatcaatggaacagaggagaccattgatggatctctaaaacctggcggcagcgcaaaagatg

SEQ ID NO: 6184 - DNA, 103 bp, Artificial Sequence
  Synthetic Polynucleotide
taatacgactcactatagggctctatcttcacctccaacaccagtgacttaacagaggagaaagtcaatggtgttggagaacctggcggcagcgcaaaagatg

SEQ ID NO: 6185 - DNA, 103 bp, Artificial Sequence
  Synthetic Polynucleotide
taatacgactcactatagggaactaagtaagtagtgattagagatccatcaacagaggagagatggaatgctaatcactaacctggcggcagcgcaaaagatg

SEQ ID NO: 6186 - DNA, 103 bp, Artificial Sequence
  Synthetic Polynucleotide
taatacgactcactataggggaagaaactaagtaagtagtgattagagataacagaggagaatctctatgcactacttaaacctggcggcagcgcaaaagatg

SEQ ID NO: 6187 - DNA, 103 bp, Artificial Sequence
  Synthetic Polynucleotide
taatacgactcactatagggtgtctgaagaaactaagtaagtagtgattaaacagaggagataatcaatgcttacttagaacctggcggcagcgcaaaagatg

SEQ ID NO: 6188 - DNA, 103 bp, Artificial Sequence
  Synthetic Polynucleotide
taatacgactcactatagggaacattgtctgaagaaactaagtaagtagtaacagaggagaactactatgttagtttctaacctggcggcagcgcaaaagatg

SEQ ID NO: 6189 - DNA, 103 bp, Artificial Sequence
  Synthetic Polynucleotide
taatacgactcactatagggggagcaacattgtctgaagaaactaagtaaaacagaggagattacttatgttcttcagaaacctggcggcagcgcaaaagatg

SEQ ID NO: 6190 - DNA, 103 bp, Artificial Sequence
  Synthetic Polynucleotide
taatacgactcactatagggaggaaggagcaacattgtctgaagaaactaaacagaggagatagtttatgcagacaatgaacctggcggcagcgcaaaagatg

SEQ ID NO: 6191 - DNA, 103 bp, Artificial Sequence
  Synthetic Polynucleotide
taatacgactcactataggggttagaggaaggagcaacattgtctgaagaaacagaggagatcttcaatgaatgttgctaacctggcggcagcgcaaaagatg

SEQ ID NO: 6192 - DNA, 103 bp, Artificial Sequence
  Synthetic Polynucleotide
taatacgactcactataggggaggtgttagaggaaggagcaacattgtctaacagaggagaagacaaatgtgctccttcaacctggcggcagcgcaaaagatg

SEQ ID NO: 6193 - DNA, 103 bp, Artificial Sequence
  Synthetic Polynucleotide
taatacgactcactatagggaaagggaggtgttagaggaaggagcaacataacagaggagaatgttgatgcttcctctaaacctggcggcagcgcaaaagatg

SEQ ID NO: 6194 - DNA, 103 bp, Artificial Sequence
  Synthetic Polynucleotide
taatacgactcactatagggattaaaaagggaggtgttagaggaaggagcaacagaggagagctcctatgtctaacaccaacctggcggcagcgcaaaagatg

SEQ ID NO: 6195 - DNA, 103 bp, Artificial Sequence
  Synthetic Polynucleotide
taatacgactcactatagggggactctctatcttcacctccaacaccagtaacagaggagaactggtatgggaggtgaaaacctggcggcagcgcaaaagatg

SEQ ID NO: 6196 - DNA, 103 bp, Artificial Sequence
  Synthetic Polynucleotide
taatacgactcactataggggtaacattaaaaagggaggtgttagaggaaaacagaggagattcctcatgcacctccctaacctggcggcagcgcaaaagatg

SEQ ID NO: 6197 - DNA, 103 bp, Artificial Sequence
  Synthetic Polynucleotide
taatacgactcactatagggctgtagtaacattaaaaagggaggtgttagaacagaggagactaacaatgccctttttaaacctggcggcagcgcaaaagatg

SEQ ID NO: 6198 - DNA, 103 bp, Artificial Sequence
  Synthetic Polynucleotide
taatacgactcactatagggatctcctgtagtaacattaaaaagggaggtaacagaggagaacctccatgtttaatgttaacctggcggcagcgcaaaagatg

SEQ ID NO: 6199 - DNA, 103 bp, Artificial Sequence
  Synthetic Polynucleotide
taatacgactcactatagggtgtctatctcctgtagtaacattaaaaaggaacagaggagaccttttatgtgttactacaacctggcggcagcgcaaaagatg

SEQ ID NO: 6200 - DNA, 103 bp, Artificial Sequence
  Synthetic Polynucleotide
taatacgactcactatagggacaaatgtctatctcctgtagtaacattaaaacagaggagattaatgatgctacaggagaacctggcggcagcgcaaaagatg

SEQ ID NO: 6201 - DNA, 103 bp, Artificial Sequence
  Synthetic Polynucleotide
taatacgactcactatagggattatacaaatgtctatctcctgtagtaacaacagaggagagttactatgggagatagaaacctggcggcagcgcaaaagatg

SEQ ID NO: 6202 - DNA, 103 bp, Artificial Sequence
  Synthetic Polynucleotide
taatacgactcactatagggcagctattatacaaatgtctatctcctgtaaacagaggagatacaggatgtagacatttaacctggcggcagcgcaaaagatg

SEQ ID NO: 6203 - DNA, 103 bp, Artificial Sequence
  Synthetic Polynucleotide
taatacgactcactatagggaaggacagctattatacaaatgtctatctcaacagaggagagagataatgatttgtataaacctggcggcagcgcaaaagatg

SEQ ID NO: 6204 - DNA, 103 bp, Artificial Sequence
  Synthetic Polynucleotide
taatacgactcactatagggagtgaaaggacagctattatacaaatgtctaacagaggagaagacatatgtataatagcaacctggcggcagcgcaaaagatg

SEQ ID NO: 6205 - DNA, 103 bp, Artificial Sequence
  Synthetic Polynucleotide
taatacgactcactatagggatataagtgaaaggacagctattatacaaaaacagaggagatttgtaatgtagctgtccaacctggcggcagcgcaaaagatg

SEQ ID NO: 6206 - DNA, 103 bp, Artificial Sequence
  Synthetic Polynucleotide
taatacgactcactatagggcaagaggactctctatcttcacctccaacaaacagaggagatgttggatgtgaagatagaacctggcggcagcgcaaaagatg

SEQ ID NO: 6207 - DNA, 103 bp, Artificial Sequence
  Synthetic Polynucleotide
taatacgactcactatagggaatggatataagtgaaaggacagctattataacagaggagaataataatggtcctttcaaacctggcggcagcgcaaaagatg

SEQ ID NO: 6208 - DNA, 103 bp, Artificial Sequence
  Synthetic Polynucleotide
taatacgactcactataggggtcacaatggatataagtgaaaggacagctaacagaggagaagctgtatgttcacttataacctggcggcagcgcaaaagatg

SEQ ID NO: 6209 - DNA, 103 bp, Artificial Sequence
  Synthetic Polynucleotide
taatacgactcactatagggtccaagtcacaatggatataagtgaaaggaaacagaggagatcctttatgttatatccaaacctggcggcagcgcaaaagatg

SEQ ID NO: 6210 - DNA, 103 bp, Artificial Sequence
  Synthetic Polynucleotide
taatacgactcactatagggtcacttccaagtcacaatggatataagtgaaacagaggagatcacttatgtccattgtgaacctggcggcagcgcaaaagatg

SEQ ID NO: 6211 - DNA, 103 bp, Artificial Sequence
  Synthetic Polynucleotide
taatacgactcactataggggacggtcacttccaagtcacaatggatataaacagaggagatatatcatgtgtgacttgaacctggcggcagcgcaaaagatg

SEQ ID NO: 6212 - DNA, 103 bp, Artificial Sequence
  Synthetic Polynucleotide
taatacgactcactatagggggtttgacggtcacttccaagtcacaatggaacagaggagaccattgatgcttggaagtaacctggcggcagcgcaaaagatg

SEQ ID NO: 6213 - DNA, 103 bp, Artificial Sequence
  Synthetic Polynucleotide
taatacgactcactataggggtggaggtttgacggtcacttccaagtcacaacagaggagagtgactatgaagtgaccgaacctggcggcagcgcaaaagatg

SEQ ID NO: 6214 - DNA, 103 bp, Artificial Sequence
  Synthetic Polynucleotide
taatacgactcactatagggtcccagtggaggtttgacggtcacttccaaaacagaggagattggaaatgaccgtcaaaaacctggcggcagcgcaaaagatg

SEQ ID NO: 6215 - DNA, 103 bp, Artificial Sequence
  Synthetic Polynucleotide
taatacgactcactatagggtcaaatcccagtggaggtttgacggtcactaacagaggagaagtgacatgcaaacctccaacctggcggcagcgcaaaagatg

SEQ ID NO: 6216 - DNA, 103 bp, Artificial Sequence
  Synthetic Polynucleotide
taatacgactcactataggggtttgtcaaatcccagtggaggtttgacggaacagaggagaccgtcaatgctccactggaacctggcggcagcgcaaaagatg

SEQ ID NO: 6217 - DNA, 103 bp, Artificial Sequence
  Synthetic Polynucleotide
taatacgactcactatagggattcccaagaggactctctatcttcacctcaacagaggagagaggtgatgatagagagtaacctggcggcagcgcaaaagatg

SEQ ID NO: 6218 - DNA, 103 bp, Artificial Sequence
  Synthetic Polynucleotide
taatacgactcactatagggccagcgtttgtcaaatcccagtggaggtttaacagaggagaaaacctatgctgggatttaacctggcggcagcgcaaaagatg

SEQ ID NO: 6219 - DNA, 103 bp, Artificial Sequence
  Synthetic Polynucleotide
taatacgactcactatagggacacgccagcgtttgtcaaatcccagtggaaacagaggagatccactatgatttgacaaaacctggcggcagcgcaaaagatg

SEQ ID NO: 6220 - DNA, 103 bp, Artificial Sequence
  Synthetic Polynucleotide
taatacgactcactatagggatgtaacacgccagcgtttgtcaaatcccaaacagaggagatgggatatgacaaacgctaacctggcggcagcgcaaaagatg

SEQ ID NO: 6221 - DNA, 103 bp, Artificial Sequence
  Synthetic Polynucleotide
taatacgactcactatagggataccatgtaacacgccagcgtttgtcaaaaacagaggagatttgacatgcgctggcgtaacctggcggcagcgcaaaagatg

SEQ ID NO: 6222 - DNA, 103 bp, Artificial Sequence
  Synthetic Polynucleotide
taatacgactcactatagggggtggataccatgtaacacgccagcgtttgaacagaggagacaaacgatggcgtgttacaacctggcggcagcgcaaaagatg

SEQ ID NO: 6223 - DNA, 103 bp, Artificial Sequence
  Synthetic Polynucleotide
taatacgactcactatagggctcctggtggataccatgtaacacgccagcaacagaggagagctggcatgttacatggtaacctggcggcagcgcaaaagatg

SEQ ID NO: 6224 - DNA, 103 bp, Artificial Sequence
  Synthetic Polynucleotide
taatacgactcactatagggtggtgctcctggtggataccatgtaacacgaacagaggagacgtgttatgtggtatccaaacctggcggcagcgcaaaagatg

SEQ ID NO: 6225 - DNA, 103 bp, Artificial Sequence
  Synthetic Polynucleotide
taatacgactcactatagggtcaattggtgctcctggtggataccatgtaaacagaggagatacatgatgtccaccaggaacctggcggcagcgcaaaagatg

SEQ ID NO: 6226 - DNA, 103 bp, Artificial Sequence
  Synthetic Polynucleotide
taatacgactcactatagggctgtatcaattggtgctcctggtggataccaacagaggagaggtatcatgcaggagcacaacctggcggcagcgcaaaagatg

SEQ ID NO: 6227 - DNA, 103 bp, Artificial Sequence
  Synthetic Polynucleotide
taatacgactcactatagggagtggctgtatcaattggtgctcctggtggaacagaggagaccaccaatggcaccaattaacctggcggcagcgcaaaagatg

SEQ ID NO: 6228 - DNA, 103 bp, Artificial Sequence
  Synthetic Polynucleotide
taatacgactcactatagggatgacattcccaagaggactctctatcttcaacagaggagagaagatatggagtcctctaacctggcggcagcgcaaaagatg

SEQ ID NO: 6229 - DNA, 103 bp, Artificial Sequence
  Synthetic Polynucleotide
taatacgactcactatagggttcacagtggctgtatcaattggtgctcctaacagaggagaaggagcatgaattgatacaacctggcggcagcgcaaaagatg

SEQ ID NO: 6230 - DNA, 103 bp, Artificial Sequence
  Synthetic Polynucleotide
taatacgactcactataggggtagtttcacagtggctgtatcaattggtgaacagaggagacaccaaatgatacagccaaacctggcggcagcgcaaaagatg

SEQ ID NO: 6231 - DNA, 103 bp, Artificial Sequence
  Synthetic Polynucleotide
taatacgactcactatagggaagaggtagtttcacagtggctgtatcaataacagaggagaattgatatggccactgtgaacctggcggcagcgcaaaagatg

SEQ ID NO: 6232 - DNA, 103 bp, Artificial Sequence
  Synthetic Polynucleotide
taatacgactcactatagggctttcaagaggtagtttcacagtggctgtaaacagaggagatacagcatgtgtgaaactaacctggcggcagcgcaaaagatg

SEQ ID NO: 6233 - DNA, 103 bp, Artificial Sequence
  Synthetic Polynucleotide
taatacgactcactatagggaatcactttcaagaggtagtttcacagtggaacagaggagaccactgatgaactacctcaacctggcggcagcgcaaaagatg

SEQ ID NO: 6234 - DNA, 103 bp, Artificial Sequence
  Synthetic Polynucleotide
taatacgactcactatagggggttgaatcactttcaagaggtagtttcacaacagaggagagtgaaaatgcctcttgaaaacctggcggcagcgcaaaagatg

SEQ ID NO: 6235 - DNA, 103 bp, Artificial Sequence
  Synthetic Polynucleotide
taatacgactcactatagggaaatgggttgaatcactttcaagaggtagtaacagaggagaactaccatgtgaaagtgaaacctggcggcagcgcaaaagatg

SEQ ID NO: 6236 - DNA, 103 bp, Artificial Sequence
  Synthetic Polynucleotide
taatacgactcactatagggatgtgaaatgggttgaatcactttcaagagaacagaggagactcttgatggtgattcaaaacctggcggcagcgcaaaagatg

SEQ ID NO: 6237 - DNA, 103 bp, Artificial Sequence
  Synthetic Polynucleotide
taatacgactcactatagggctgggatgtgaaatgggttgaatcactttcaacagaggagagaaagtatgtcaacccataacctggcggcagcgcaaaagatg

SEQ ID NO: 6238 - DNA, 103 bp, Artificial Sequence
  Synthetic Polynucleotide
taatacgactcactatagggtccatctgggatgtgaaatgggttgaatcaaacagaggagatgattcatgccatttcacaacctggcggcagcgcaaaagatg

SEQ ID NO: 6239 - DNA, 103 bp, Artificial Sequence
  Synthetic Polynucleotide
taatacgactcactatagggaaggtagacgtcaaaccacacgtttcaagaaacagaggagatcttgaatggtgtggtttaacctggcggcagcgcaaaagatg

SEQ ID NO: 6240 - DNA, 103 bp, Artificial Sequence
  Synthetic Polynucleotide
taatacgactcactataggggccacatgacattcccaagaggactctctaaacagaggagatagagaatgctcttgggaaacctggcggcagcgcaaaagatg

SEQ ID NO: 6241 - DNA, 103 bp, Artificial Sequence
  Synthetic Polynucleotide
taatacgactcactatagggatgattccatctgggatgtgaaatgggttgaacagaggagacaacccatgtcacatcccaacctggcggcagcgcaaaagatg

SEQ ID NO: 6242 - DNA, 103 bp, Artificial Sequence
  Synthetic Polynucleotide
taatacgactcactatagggaccagatgattccatctgggatgtgaaatgaacagaggagacatttcatgtcccagatgaacctggcggcagcgcaaaagatg

SEQ ID NO: 6243 - DNA, 103 bp, Artificial Sequence
  Synthetic Polynucleotide
taatacgactcactatagggaaggaaccagatgattccatctgggatgtgaacagaggagacacatcatggatggaatcaacctggcggcagcgcaaaagatg

SEQ ID NO: 6244 - DNA, 103 bp, Artificial Sequence
  Synthetic Polynucleotide
taatacgactcactatagggacattaaggaaccagatgattccatctgggaacagaggagacccagaatgaatcatctgaacctggcggcagcgcaaaagatg

SEQ ID NO: 6245 - DNA, 103 bp, Artificial Sequence
  Synthetic Polynucleotide
taatacgactcactatagggtagtgacattaaggaaccagatgattccataacagaggagaatggaaatgtctggttccaacctggcggcagcgcaaaagatg

SEQ ID NO: 6246 - DNA, 103 bp, Artificial Sequence
  Synthetic Polynucleotide
taatacgactcactatagggggatttagtgacattaaggaaccagatgataacagaggagaatcatcatgttccttaataacctggcggcagcgcaaaagatg

SEQ ID NO: 6247 - DNA, 103 bp, Artificial Sequence
  Synthetic Polynucleotide
taatacgactcactatagggatgttggatttagtgacattaaggaaccagaacagaggagactggttatgtaatgtcacaacctggcggcagcgcaaaagatg

SEQ ID NO: 6248 - DNA, 103 bp, Artificial Sequence
  Synthetic Polynucleotide
taatacgactcactatagggataaaatgttggatttagtgacattaaggaaacagaggagatccttaatgtcactaaataacctggcggcagcgcaaaagatg

SEQ ID NO: 6249 - DNA, 103 bp, Artificial Sequence
  Synthetic Polynucleotide
taatacgactcactatagggttgccataaaatgttggatttagtgacattaacagaggagaaatgtcatgaaatccaacaacctggcggcagcgcaaaagatg

SEQ ID NO: 6250 - DNA, 103 bp, Artificial Sequence
  Synthetic Polynucleotide
taatacgactcactatagggcgcccttgccataaaatgttggatttagtgaacagaggagacactaaatgcaacattttaacctggcggcagcgcaaaagatg

SEQ ID NO: 6251 - DNA, 103 bp, Artificial Sequence
  Synthetic Polynucleotide
taatacgactcactataggggcacagccacatgacattcccaagaggactaacagaggagaagtcctatggggaatgtcaacctggcggcagcgcaaaagatg

SEQ ID NO: 6252 - DNA, 103 bp, Artificial Sequence
  Synthetic Polynucleotide
taatacgactcactataggggttgtcgcccttgccataaaatgttggattaacagaggagaaatccaatgttttatggcaacctggcggcagcgcaaaagatg

SEQ ID NO: 6253 - DNA, 103 bp, Artificial Sequence
  Synthetic Polynucleotide
taatacgactcactatagggacagcgttgtcgcccttgccataaaatgttaacagaggagaaacattatgtggcaagggaacctggcggcagcgcaaaagatg

SEQ ID NO: 6254 - DNA, 103 bp, Artificial Sequence
  Synthetic Polynucleotide
taatacgactcactatagggaagaaacagcgttgtcgcccttgccataaaaacagaggagatttatgatgagggcgacaaacctggcggcagcgcaaaagatg

SEQ ID NO: 6255 - DNA, 103 bp, Artificial Sequence
  Synthetic Polynucleotide
taatacgactcactataggggacaaaagaaacagcgttgtcgcccttgccaacagaggagaggcaagatggacaacgctaacctggcggcagcgcaaaagatg

SEQ ID NO: 6256 - DNA, 103 bp, Artificial Sequence
  Synthetic Polynucleotide
taatacgactcactatagggggtatgacaaaagaaacagcgttgtcgcccaacagaggagagggcgaatgcgctgtttcaacctggcggcagcgcaaaagatg

SEQ ID NO: 6257 - DNA, 103 bp, Artificial Sequence
  Synthetic Polynucleotide
taatacgactcactatagggaaaagggtatgacaaaagaaacagcgttgtaacagaggagaacaacgatgtttcttttgaacctggcggcagcgcaaaagatg

SEQ ID NO: 6258 - DNA, 103 bp, Artificial Sequence
  Synthetic Polynucleotide
taatacgactcactatagggagagcaaaagggtatgacaaaagaaacagcaacagaggagagctgttatgtttgtcataaacctggcggcagcgcaaaagatg

SEQ ID NO: 6259 - DNA, 103 bp, Artificial Sequence
  Synthetic Polynucleotide
taatacgactcactatagggagaggagagcaaaagggtatgacaaaagaaaacagaggagattctttatgcatacccttaacctggcggcagcgcaaaagatg

SEQ ID NO: 6260 - DNA, 103 bp, Artificial Sequence
  Synthetic Polynucleotide
taatacgactcactatagggcagaaagaggagagcaaaagggtatgacaaaacagaggagattgtcaatgccttttgctaacctggcggcagcgcaaaagatg

SEQ ID NO: 6261 - DNA, 103 bp, Artificial Sequence
  Synthetic Polynucleotide
taatacgactcactatagggaattgcagaaagaggagagcaaaagggtataacagaggagaatacccatgtgctctcctaacctggcggcagcgcaaaagatg

SEQ ID NO: 6262 - DNA, 103 bp, Artificial Sequence
  Synthetic Polynucleotide
taatacgactcactatagggccctggcacagccacatgacattcccaagaaacagaggagatcttggatgtgtcatgtgaacctggcggcagcgcaaaagatg

SEQ ID NO: 6263 - DNA, 103 bp, Artificial Sequence
  Synthetic Polynucleotide
taatacgactcactatagggagcggaattgcagaaagaggagagcaaaagaacagaggagacttttgatgtcctctttcaacctggcggcagcgcaaaagatg

SEQ ID NO: 6264 - DNA, 103 bp, Artificial Sequence
  Synthetic Polynucleotide
taatacgactcactatagggagtaaagcggaattgcagaaagaggagagcaacagaggagagctctcatgtttctgcaaaacctggcggcagcgcaaaagatg

SEQ ID NO: 6265 - DNA, 103 bp, Artificial Sequence
  Synthetic Polynucleotide
taatacgactcactatagggatcaaagtaaagcggaattgcagaaagaggaacagaggagacctcttatggcaattccgaacctggcggcagcgcaaaagatg

SEQ ID NO: 6266 - DNA, 103 bp, Artificial Sequence
  Synthetic Polynucleotide
taatacgactcactatagggtaaccatcaaagtaaagcggaattgcagaaaacagaggagattctgcatgtccgctttaaacctggcggcagcgcaaaagatg

SEQ ID NO: 6267 - DNA, 103 bp, Artificial Sequence
  Synthetic Polynucleotide
taatacgactcactatagggctgggtaaccatcaaagtaaagcggaattgaacagaggagacaattcatgtttactttgaacctggcggcagcgcaaaagatg

SEQ ID NO: 6268 - DNA, 103 bp, Artificial Sequence
  Synthetic Polynucleotide
taatacgactcactataggggtagtctgggtaaccatcaaagtaaagcggaacagaggagaccgcttatgtttgatggtaacctggcggcagcgcaaaagatg

SEQ ID NO: 6269 - DNA, 103 bp, Artificial Sequence
  Synthetic Polynucleotide
taatacgactcactatagggcgtttgtagtctgggtaaccatcaaagtaaaacagaggagattacttatgtggttacccaacctggcggcagcgcaaaagatg

SEQ ID NO: 6270 - DNA, 103 bp, Artificial Sequence
  Synthetic Polynucleotide
taatacgactcactatagggccccacgtttgtagtctgggtaaccatcaaaacagaggagattgatgatgacccagactaacctggcggcagcgcaaaagatg

SEQ ID NO: 6271 - DNA, 103 bp, Artificial Sequence
  Synthetic Polynucleotide
taatacgactcactatagggacctgccccacgtttgtagtctgggtaaccaacagaggagaggttacatggactacaaaaacctggcggcagcgcaaaagatg

SEQ ID NO: 6272 - DNA, 103 bp, Artificial Sequence
  Synthetic Polynucleotide
taatacgactcactatagggtaaccacctgccccacgtttgtagtctgggaacagaggagacccagaatgcaaacgtggaacctggcggcagcgcaaaagatg

SEQ ID NO: 6273 - DNA, 103 bp, Artificial Sequence
  Synthetic Polynucleotide
taatacgactcactatagggacaacccctggcacagccacatgacattccaacagaggagaggaatgatgtgtggctgtaacctggcggcagcgcaaaagatg

SEQ ID NO: 6274 - DNA, 103 bp, Artificial Sequence
  Synthetic Polynucleotide
taatacgactcactatagggtcccgtaaccacctgccccacgtttgtagtaacagaggagaactacaatggtggggcagaacctggcggcagcgcaaaagatg

SEQ ID NO: 6275 - DNA, 103 bp, Artificial Sequence
  Synthetic Polynucleotide
taatacgactcactatagggtccaatcccgtaaccacctgccccacgtttaacagaggagaaaacgtatggcaggtggtaacctggcggcagcgcaaaagatg

SEQ ID NO: 6276 - DNA, 103 bp, Artificial Sequence
  Synthetic Polynucleotide
taatacgactcactataggggcaggtccaatcccgtaaccacctgccccaaacagaggagatggggcatgtggttacggaacctggcggcagcgcaaaagatg

SEQ ID NO: 6277 - DNA, 103 bp, Artificial Sequence
  Synthetic Polynucleotide
taatacgactcactatagggaagctgcaggtccaatcccgtaaccacctgaacagaggagacaggtgatgacgggattgaacctggcggcagcgcaaaagatg

SEQ ID NO: 6278 - DNA, 103 bp, Artificial Sequence
  Synthetic Polynucleotide
taatacgactcactatagggaaatgaagctgcaggtccaatcccgtaaccaacagaggagaggttacatgattggacctaacctggcggcagcgcaaaagatg

SEQ ID NO: 6279 - DNA, 103 bp, Artificial Sequence
  Synthetic Polynucleotide
taatacgactcactataggggtcccaaatgaagctgcaggtccaatcccgaacagaggagacgggatatgacctgcagcaacctggcggcagcgcaaaagatg

SEQ ID NO: 6280 - DNA, 103 bp, Artificial Sequence
  Synthetic Polynucleotide
taatacgactcactatagggtgatggtcccaaatgaagctgcaggtccaaaacagaggagattggacatgcagcttcataacctggcggcagcgcaaaagatg

SEQ ID NO: 6281 - DNA, 103 bp, Artificial Sequence
  Synthetic Polynucleotide
taatacgactcactatagggaatggtgatggtcccaaatgaagctgcaggaacagaggagacctgcaatgtcatttgggaacctggcggcagcgcaaaagatg

SEQ ID NO: 6282 - DNA, 103 bp, Artificial Sequence
  Synthetic Polynucleotide
taatacgactcactataggggcatcaatggtgatggtcccaaatgaagctaacagaggagaagcttcatgtgggaccataacctggcggcagcgcaaaagatg

SEQ ID NO: 6283 - DNA, 103 bp, Artificial Sequence
  Synthetic Polynucleotide
taatacgactcactatagggtgttagcatcaatggtgatggtcccaaatgaacagaggagacatttgatgccatcaccaaacctggcggcagcgcaaaagatg

SEQ ID NO: 6284 - DNA, 103 bp, Artificial Sequence
  Synthetic Polynucleotide
taatacgactcactatagggtcgctacaacccctggcacagccacatgacaacagaggagagtcatgatgctgtgccagaacctggcggcagcgcaaaagatg

SEQ ID NO: 6285 - DNA, 103 bp, Artificial Sequence
  Synthetic Polynucleotide
taatacgactcactatagggattggtgttagcatcaatggtgatggtcccaacagaggagagggaccatgaccattgataacctggcggcagcgcaaaagatg

SEQ ID NO: 6286 - DNA, 103 bp, Artificial Sequence
  Synthetic Polynucleotide
taatacgactcactataggggtcttattggtgttagcatcaatggtgatgaacagaggagacatcacatgtgatgctaaaacctggcggcagcgcaaaagatg

SEQ ID NO: 6287 - DNA, 103 bp, Artificial Sequence
  Synthetic Polynucleotide
taatacgactcactatagggacattgtcttattggtgttagcatcaatggaacagaggagaccattgatgctaacaccaaacctggcggcagcgcaaaagatg

SEQ ID NO: 6288 - DNA, 103 bp, Artificial Sequence
  Synthetic Polynucleotide
taatacgactcactatagggtgaaaacattgtcttattggtgttagcatcaacagaggagagatgctatgaccaataagaacctggcggcagcgcaaaagatg

SEQ ID NO: 6289 - DNA, 103 bp, Artificial Sequence
  Synthetic Polynucleotide
taatacgactcactatagggaaagctgaaaacattgtcttattggtgttaaacagaggagataacacatgtaagacaataacctggcggcagcgcaaaagatg

SEQ ID NO: 6290 - DNA, 103 bp, Artificial Sequence
  Synthetic Polynucleotide
taatacgactcactatagggttatgaaagctgaaaacattgtcttattggaacagaggagaccaataatgcaatgttttaacctggcggcagcgcaaaagatg

SEQ ID NO: 6291 - DNA, 103 bp, Artificial Sequence
  Synthetic Polynucleotide
taatacgactcactataggggtatcttatgaaagctgaaaacattgtcttaacagaggagaaagacaatgttttcagctaacctggcggcagcgcaaaagatg

SEQ ID NO: 6292 - DNA, 103 bp, Artificial Sequence
  Synthetic Polynucleotide
taatacgactcactatagggttcttgtatcttatgaaagctgaaaacattaacagaggagaaatgttatgagctttcataacctggcggcagcgcaaaagatg

SEQ ID NO: 6293 - DNA, 103 bp, Artificial Sequence
  Synthetic Polynucleotide
taatacgactcactatagggtgaaattcttgtatcttatgaaagctgaaaaacagaggagatttcagatgtcataagataacctggcggcagcgcaaaagatg

SEQ ID NO: 6294 - DNA, 103 bp, Artificial Sequence
  Synthetic Polynucleotide
taatacgactcactatagggacctttgaaattcttgtatcttatgaaagcaacagaggagagctttcatgagatacaagaacctggcggcagcgcaaaagatg

SEQ ID NO: 6295 - DNA, 103 bp, Artificial Sequence
  Synthetic Polynucleotide
taatacgactcactatagggtggcatcgctacaacccctggcacagccacaacagaggagagtggctatgccaggggttaacctggcggcagcgcaaaagatg

SEQ ID NO: 6296 - DNA, 103 bp, Artificial Sequence
  Synthetic Polynucleotide
taatacgactcactatagggacgtaacctttgaaattcttgtatcttatgaacagaggagacataagatgcaagaatttaacctggcggcagcgcaaaagatg

SEQ ID NO: 6297 - DNA, 103 bp, Artificial Sequence
  Synthetic Polynucleotide
taatacgactcactatagggtagggacgtaacctttgaaattcttgtatcaacagaggagagatacaatgatttcaaagaacctggcggcagcgcaaaagatg

SEQ ID NO: 6298 - DNA, 103 bp, Artificial Sequence
  Synthetic Polynucleotide
taatacgactcactatagggaggcctagggacgtaacctttgaaattcttaacagaggagaaagaatatgaaaggttacaacctggcggcagcgcaaaagatg

SEQ ID NO: 6299 - DNA, 103 bp, Artificial Sequence
  Synthetic Polynucleotide
taatacgactcactatagggataagaggcctagggacgtaacctttgaaaaacagaggagatttcaaatgttacgtcccaacctggcggcagcgcaaaagatg

SEQ ID NO: 6300 - DNA, 103 bp, Artificial Sequence
  Synthetic Polynucleotide
taatacgactcactatagggatctaataagaggcctagggacgtaaccttaacagaggagaaaggttatgtccctaggcaacctggcggcagcgcaaaagatg

SEQ ID NO: 6301 - DNA, 103 bp, Artificial Sequence
  Synthetic Polynucleotide
taatacgactcactatagggtggatatctaataagaggcctagggacgtaaacagaggagatacgtcatgaggcctcttaacctggcggcagcgcaaaagatg

SEQ ID NO: 6302 - DNA, 103 bp, Artificial Sequence
  Synthetic Polynucleotide
taatacgactcactatagggattgttggatatctaataagaggcctagggaacagaggagaccctagatgtcttattagaacctggcggcagcgcaaaagatg

SEQ ID NO: 6303 - DNA, 103 bp, Artificial Sequence
  Synthetic Polynucleotide
taatacgactcactatagggggtcaattgttggatatctaataagaggccaacagaggagaggcctcatgttagatatcaacctggcggcagcgcaaaagatg

SEQ ID NO: 6304 - DNA, 103 bp, Artificial Sequence
  Synthetic Polynucleotide
taatacgactcactataggggtttgggtcaattgttggatatctaataagaacagaggagacttattatgtatccaacaaacctggcggcagcgcaaaagatg

SEQ ID NO: 6305 - DNA, 103 bp, Artificial Sequence
  Synthetic Polynucleotide
taatacgactcactataggggttctgtttgggtcaattgttggatatctaaacagaggagatagataatgaacaattgaaacctggcggcagcgcaaaagatg

SEQ ID NO: 6306 - DNA, 103 bp, Artificial Sequence
  Synthetic Polynucleotide
taatacgactcactatagggacgaatggcatcgctacaacccctggcacaaacagaggagatgtgccatgggttgtagcaacctggcggcagcgcaaaagatg

SEQ ID NO: 6307 - DNA, 103 bp, Artificial Sequence
  Synthetic Polynucleotide
taatacgactcactatagggcttgtgttctgtttgggtcaattgttggataacagaggagaatccaaatgttgacccaaaacctggcggcagcgcaaaagatg

SEQ ID NO: 6308 - DNA, 103 bp, Artificial Sequence
  Synthetic Polynucleotide
taatacgactcactatagggtttaacttgtgttctgtttgggtcaattgtaacagaggagaacaattatgccaaacagaaacctggcggcagcgcaaaagatg

SEQ ID NO: 6309 - DNA, 103 bp, Artificial Sequence
  Synthetic Polynucleotide
taatacgactcactatagggaacaatttaacttgtgttctgtttgggtcaaacagaggagatgacccatgcagaacacaaacctggcggcagcgcaaaagatg

SEQ ID NO: 6310 - DNA, 103 bp, Artificial Sequence
  Synthetic Polynucleotide
taatacgactcactatagggaggtcaacaatttaacttgtgttctgtttgaacagaggagacaaacaatgcacaagttaaacctggcggcagcgcaaaagatg

SEQ ID NO: 6311 - DNA, 103 bp, Artificial Sequence
  Synthetic Polynucleotide
taatacgactcactatagggttcaaaggtcaacaatttaacttgtgttctaacagaggagaagaacaatggttaaattgaacctggcggcagcgcaaaagatg

SEQ ID NO: 6312 - DNA, 103 bp, Artificial Sequence
  Synthetic Polynucleotide
taatacgactcactatagggcctccttcaaaggtcaacaatttaacttgtaacagaggagaacaagtatgattgttgacaacctggcggcagcgcaaaagatg

SEQ ID NO: 6313 - DNA, 103 bp, Artificial Sequence
  Synthetic Polynucleotide
taatacgactcactataggggtgttcctccttcaaaggtcaacaatttaaaacagaggagattaaatatgtgacctttgaacctggcggcagcgcaaaagatg

SEQ ID NO: 6314 - DNA, 103 bp, Artificial Sequence
  Synthetic Polynucleotide
taatacgactcactatagggtctgggtgttcctccttcaaaggtcaacaaaacagaggagattgttgatgtttgaaggaaacctggcggcagcgcaaaagatg

SEQ ID NO: 6315 - DNA, 103 bp, Artificial Sequence
  Synthetic Polynucleotide
taatacgactcactatagggattggtctgggtgttcctccttcaaaggtcaacagaggagagaccttatgaggaggaacaacctggcggcagcgcaaaagatg

SEQ ID NO: 6316 - DNA, 103 bp, Artificial Sequence
  Synthetic Polynucleotide
taatacgactcactataggggcgttattggtctgggtgttcctccttcaaaacagaggagattgaagatggaacacccaaacctggcggcagcgcaaaagatg

SEQ ID NO: 6317 - DNA, 103 bp, Artificial Sequence
  Synthetic Polynucleotide
taatacgactcactatagggcacacacgaatggcatcgctacaacccctgaacagaggagacaggggatgtagcgatgcaacctggcggcagcgcaaaagatg

SEQ ID NO: 6318 - DNA, 103 bp, Artificial Sequence
  Synthetic Polynucleotide
taatacgactcactataggggcctggcgttattggtctgggtgttcctccaacagaggagaggaggaatgcccagaccaaacctggcggcagcgcaaaagatg

SEQ ID NO: 6319 - DNA, 103 bp, Artificial Sequence
  Synthetic Polynucleotide
taatacgactcactatagggtacctgcctggcgttattggtctgggtgttaacagaggagaaacaccatgaccaataacaacctggcggcagcgcaaaagatg

SEQ ID NO: 6320 - DNA, 103 bp, Artificial Sequence
  Synthetic Polynucleotide
taatacgactcactatagggctctatacctgcctggcgttattggtctggaacagaggagaccagacatgtaacgccagaacctggcggcagcgcaaaagatg

SEQ ID NO: 6321 - DNA, 103 bp, Artificial Sequence
  Synthetic Polynucleotide
taatacgactcactatagggttggactctatacctgcctggcgttattggaacagaggagaccaataatgccaggcaggaacctggcggcagcgcaaaagatg

SEQ ID NO: 6322 - DNA, 103 bp, Artificial Sequence
  Synthetic Polynucleotide
taatacgactcactatagggttcttttggactctatacctgcctggcgttaacagaggagaaacgccatgcaggtatagaacctggcggcagcgcaaaagatg

SEQ ID NO: 6323 - DNA, 103 bp, Artificial Sequence
  Synthetic Polynucleotide
taatacgactcactataggggtatattcttttggactctatacctgcctgaacagaggagacaggcaatgatagagtccaacctggcggcagcgcaaaagatg

SEQ ID NO: 6324 - DNA, 103 bp, Artificial Sequence
  Synthetic Polynucleotide
taatacgactcactatagggcagaagtatattcttttggactctatacctaacagaggagaaggtatatggtccaaaagaacctggcggcagcgcaaaagatg

SEQ ID NO: 6325 - DNA, 103 bp, Artificial Sequence
  Synthetic Polynucleotide
taatacgactcactatagggccggacagaagtatattcttttggactctaaacagaggagatagagtatgaaagaatataacctggcggcagcgcaaaagatg

SEQ ID NO: 6326 - DNA, 103 bp, Artificial Sequence
  Synthetic Polynucleotide
taatacgactcactatagggcgtcaccggacagaagtatattcttttggaaacagaggagatccaaaatgatatacttcaacctggcggcagcgcaaaagatg

SEQ ID NO: 6327 - DNA, 103 bp, Artificial Sequence
  Synthetic Polynucleotide
taatacgactcactatagggttcaacgtcaccggacagaagtatattcttaacagaggagaaagaatatgcttctgtccaacctggcggcagcgcaaaagatg

SEQ ID NO: 6328 - DNA, 103 bp, Artificial Sequence
  Synthetic Polynucleotide
taatacgactcactatagggatccgcacacacgaatggcatcgctacaacaacagaggagagttgtaatgatgccattcaacctggcggcagcgcaaaagatg

SEQ ID NO: 6329 - DNA, 103 bp, Artificial Sequence
  Synthetic Polynucleotide
taatacgactcactatagggtttgtttcaacgtcaccggacagaagtataaacagaggagatatactatggtccggtgaaacctggcggcagcgcaaaagatg

SEQ ID NO: 6330 - DNA, 103 bp, Artificial Sequence
  Synthetic Polynucleotide
taatacgactcactatagggctggatttgtttcaacgtcaccggacagaaaacagaggagattctgtatggtgacgttgaacctggcggcagcgcaaaagatg

SEQ ID NO: 6331 - DNA, 103 bp, Artificial Sequence
  Synthetic Polynucleotide
taatacgactcactatagggaggccctggatttgtttcaacgtcaccggaaacagaggagatccggtatggttgaaacaaacctggcggcagcgcaaaagatg

SEQ ID NO: 6332 - DNA, 103 bp, Artificial Sequence
  Synthetic Polynucleotide
taatacgactcactatagggttacaaggccctggatttgtttcaacgtcaaacagaggagatgacgtatgaacaaatccaacctggcggcagcgcaaaagatg

SEQ ID NO: 6333 - DNA, 103 bp, Artificial Sequence
  Synthetic Polynucleotide
taatacgactcactatagggtggaattacaaggccctggatttgtttcaaaacagaggagattgaaaatgatccagggcaacctggcggcagcgcaaaagatg

SEQ ID NO: 6334 - DNA, 103 bp, Artificial Sequence
  Synthetic Polynucleotide
taatacgactcactatagggaaacttggaattacaaggccctggatttgtaacagaggagaacaaatatggggccttgtaacctggcggcagcgcaaaagatg

SEQ ID NO: 6335 - DNA, 103 bp, Artificial Sequence
  Synthetic Polynucleotide
taatacgactcactatagggacataaaacttggaattacaaggccctggaaacagaggagatccaggatgttgtaattcaacctggcggcagcgcaaaagatg

SEQ ID NO: 6336 - DNA, 103 bp, Artificial Sequence
  Synthetic Polynucleotide
taatacgactcactatagggattgcacataaaacttggaattacaaggccaacagaggagaggccttatgattccaagtaacctggcggcagcgcaaaagatg

SEQ ID NO: 6337 - DNA, 103 bp, Artificial Sequence
  Synthetic Polynucleotide
taatacgactcactatagggaggagattgcacataaaacttggaattacaaacagaggagatgtaatatgaagttttataacctggcggcagcgcaaaagatg

SEQ ID NO: 6338 - DNA, 103 bp, Artificial Sequence
  Synthetic Polynucleotide
taatacgactcactataggggaaagaggagattgcacataaaacttggaaaacagaggagattccaaatgttatgtgcaaacctggcggcagcgcaaaagatg

SEQ ID NO: 6339 - DNA, 103 bp, Artificial Sequence
  Synthetic Polynucleotide
taatacgactcactatagggaggaaatccgcacacacgaatggcatcgctaacagaggagaagcgatatgattcgtgtgaacctggcggcagcgcaaaagatg

SEQ ID NO: 6340 - DNA, 103 bp, Artificial Sequence
  Synthetic Polynucleotide
taatacgactcactatagggattcagaaagaggagattgcacataaaactaacagaggagaagttttatgtgcaatctcaacctggcggcagcgcaaaagatg

SEQ ID NO: 6341 - DNA, 103 bp, Artificial Sequence
  Synthetic Polynucleotide
taatacgactcactatagggaaggaattcagaaagaggagattgcacataaacagaggagatatgtgatgtctcctcttaacctggcggcagcgcaaaagatg

SEQ ID NO: 6342 - DNA, 103 bp, Artificial Sequence
  Synthetic Polynucleotide
taatacgactcactatagggacctgaaggaattcagaaagaggagattgcaacagaggagagcaatcatgtctttctgaaacctggcggcagcgcaaaagatg

SEQ ID NO: 6343 - DNA, 103 bp, Artificial Sequence
  Synthetic Polynucleotide
taatacgactcactatagggtggccacctgaaggaattcagaaagaggagaacagaggagactcctcatgctgaattccaacctggcggcagcgcaaaagatg

SEQ ID NO: 6344 - DNA, 103 bp, Artificial Sequence
  Synthetic Polynucleotide
taatacgactcactatagggttttttggccacctgaaggaattcagaaagaacagaggagactttctatgttccttcagaacctggcggcagcgcaaaagatg

SEQ ID NO: 6345 - DNA, 103 bp, Artificial Sequence
  Synthetic Polynucleotide
taatacgactcactatagggtctggttttttggccacctgaaggaattcaaacagaggagatgaattatgtcaggtggcaacctggcggcagcgcaaaagatg

SEQ ID NO: 6346 - DNA, 103 bp, Artificial Sequence
  Synthetic Polynucleotide
taatacgactcactataggggtgtttctggttttttggccacctgaaggaaacagaggagatccttcatgtggccaaaaaacctggcggcagcgcaaaagatg

SEQ ID NO: 6347 - DNA, 103 bp, Artificial Sequence
  Synthetic Polynucleotide
taatacgactcactataggggtccagtgtttctggttttttggccacctgaacagaggagacaggtgatgaaaaaaccaaacctggcggcagcgcaaaagatg

SEQ ID NO: 6348 - DNA, 103 bp, Artificial Sequence
  Synthetic Polynucleotide
taatacgactcactatagggacattgtccagtgtttctggttttttggccaacagaggagaggccaaatgaccagaaacaacctggcggcagcgcaaaagatg

SEQ ID NO: 6349 - DNA, 103 bp, Artificial Sequence
  Synthetic Polynucleotide
taatacgactcactatagggtagtcacattgtccagtgtttctggtttttaacagaggagaaaaaacatgaaacactggaacctggcggcagcgcaaaagatg

SEQ ID NO: 6350 - DNA, 103 bp, Artificial Sequence
  Synthetic Polynucleotide
taatacgactcactatagggcatataaggtagacgtcaaaccacacgtttaacagaggagaaaacgtatggtttgacgtaacctggcggcagcgcaaaagatg

SEQ ID NO: 6351 - DNA, 103 bp, Artificial Sequence
  Synthetic Polynucleotide
taatacgactcactatagggacgagaggaaatccgcacacacgaatggcaaacagaggagatgccatatgtgtgtgcggaacctggcggcagcgcaaaagatg

SEQ ID NO: 6352 - DNA, 103 bp, Artificial Sequence
  Synthetic Polynucleotide
taatacgactcactatagggaagcctagtcacattgtccagtgtttctggaacagaggagaccagaaatgctggacaataacctggcggcagcgcaaaagatg

SEQ ID NO: 6353 - DNA, 103 bp, Artificial Sequence
  Synthetic Polynucleotide
taatacgactcactatagggttcaaaagcctagtcacattgtccagtgttaacagaggagaaacactatgcaatgtgacaacctggcggcagcgcaaaagatg

SEQ ID NO: 6354 - DNA, 103 bp, Artificial Sequence
  Synthetic Polynucleotide
taatacgactcactataggggggtattcaaaagcctagtcacattgtccaaacagaggagatggacaatgtgactaggcaacctggcggcagcgcaaaagatg

SEQ ID NO: 6355 - DNA, 103 bp, Artificial Sequence
  Synthetic Polynucleotide
taatacgactcactataggggtttagggtattcaaaagcctagtcacattaacagaggagaaatgtgatgaggcttttgaacctggcggcagcgcaaaagatg

SEQ ID NO: 6356 - DNA, 103 bp, Artificial Sequence
  Synthetic Polynucleotide
taatacgactcactatagggacattgtttagggtattcaaaagcctagtcaacagaggagagactagatgtttgaatacaacctggcggcagcgcaaaagatg

SEQ ID NO: 6357 - DNA, 103 bp, Artificial Sequence
  Synthetic Polynucleotide
taatacgactcactatagggtgatgacattgtttagggtattcaaaagccaacagaggagaggctttatgataccctaaaacctggcggcagcgcaaaagatg

SEQ ID NO: 6358 - DNA, 103 bp, Artificial Sequence
  Synthetic Polynucleotide
taatacgactcactatagggcttgttgatgacattgtttagggtattcaaaacagaggagattgaatatgctaaacaataacctggcggcagcgcaaaagatg

SEQ ID NO: 6359 - DNA, 103 bp, Artificial Sequence
  Synthetic Polynucleotide
taatacgactcactatagggttccacttgttgatgacattgtttagggtaaacagaggagataccctatgcaatgtcataacctggcggcagcgcaaaagatg

SEQ ID NO: 6360 - DNA, 103 bp, Artificial Sequence
  Synthetic Polynucleotide
taatacgactcactataggggttcattccacttgttgatgacattgtttaaacagaggagataaacaatgtcatcaacaaacctggcggcagcgcaaaagatg

SEQ ID NO: 6361 - DNA, 103 bp, Artificial Sequence
  Synthetic Polynucleotide
taatacgactcactatagggcttgagttcattccacttgttgatgacattaacagaggagaaatgtcatgaacaagtggaacctggcggcagcgcaaaagatg

SEQ ID NO: 6362 - DNA, 103 bp, Artificial Sequence
  Synthetic Polynucleotide
taatacgactcactatagggtcaccacgagaggaaatccgcacacacgaaaacagaggagattcgtgatggcggatttcaacctggcggcagcgcaaaagatg

SEQ ID NO: 6363 - DNA, 103 bp, Artificial Sequence
  Synthetic Polynucleotide
taatacgactcactataggggtagtcttgagttcattccacttgttgatgaacagaggagacatcaaatggtggaatgaaacctggcggcagcgcaaaagatg

SEQ ID NO: 6364 - DNA, 103 bp, Artificial Sequence
  Synthetic Polynucleotide
taatacgactcactatagggtcattgtagtcttgagttcattccacttgtaacagaggagaacaagtatgatgaactcaaacctggcggcagcgcaaaagatg

SEQ ID NO: 6365 - DNA, 103 bp, Artificial Sequence
  Synthetic Polynucleotide
taatacgactcactatagggatctgtcattgtagtcttgagttcattccaaacagaggagatggaatatgctcaagactaacctggcggcagcgcaaaagatg

SEQ ID NO: 6366 - DNA, 103 bp, Artificial Sequence
  Synthetic Polynucleotide
taatacgactcactatagggacagcatctgtcattgtagtcttgagttcaaacagaggagatgaactatggactacaataacctggcggcagcgcaaaagatg

SEQ ID NO: 6367 - DNA, 103 bp, Artificial Sequence
  Synthetic Polynucleotide
taatacgactcactatagggaaaacacagcatctgtcattgtagtcttgaaacagaggagatcaagaatgcaatgacagaacctggcggcagcgcaaaagatg

SEQ ID NO: 6368 - DNA, 103 bp, Artificial Sequence
  Synthetic Polynucleotide
taatacgactcactatagggcctcaaaaacacagcatctgtcattgtagtaacagaggagaactacaatgacagatgctaacctggcggcagcgcaaaagatg

SEQ ID NO: 6369 - DNA, 103 bp, Artificial Sequence
  Synthetic Polynucleotide
taatacgactcactatagggatatccctcaaaaacacagcatctgtcattaacagaggagaaatgacatgtgctgtgttaacctggcggcagcgcaaaagatg

SEQ ID NO: 6370 - DNA, 103 bp, Artificial Sequence
  Synthetic Polynucleotide
taatacgactcactatagggagaccatatccctcaaaaacacagcatctgaacagaggagacagatgatgtgtttttgaaacctggcggcagcgcaaaagatg

SEQ ID NO: 6371 - DNA, 103 bp, Artificial Sequence
  Synthetic Polynucleotide
taatacgactcactatagggtaagcagaccatatccctcaaaaacacagcaacagaggagagctgtgatgttgagggataacctggcggcagcgcaaaagatg

SEQ ID NO: 6372 - DNA, 103 bp, Artificial Sequence
  Synthetic Polynucleotide
taatacgactcactatagggactattaagcagaccatatccctcaaaaacaacagaggagagtttttatgggatatggtaacctggcggcagcgcaaaagatg

SEQ ID NO: 6373 - DNA, 103 bp, Artificial Sequence
  Synthetic Polynucleotide
taatacgactcactatagggtcgtgtcaccacgagaggaaatccgcacacaacagaggagagtgtgcatgtttcctctcaacctggcggcagcgcaaaagatg

SEQ ID NO: 6374 - DNA, 103 bp, Artificial Sequence
  Synthetic Polynucleotide
taatacgactcactataggggctttactattaagcagaccatatccctcaaacagaggagatgagggatgtggtctgctaacctggcggcagcgcaaaagatg

SEQ ID NO: 6375 - DNA, 103 bp, Artificial Sequence
  Synthetic Polynucleotide
taatacgactcactatagggcatcagctttactattaagcagaccatatcaacagaggagagatatgatgtgcttaataaacctggcggcagcgcaaaagatg

SEQ ID NO: 6376 - DNA, 103 bp, Artificial Sequence
  Synthetic Polynucleotide
taatacgactcactatagggagtgacatcagctttactattaagcagaccaacagaggagaggtctgatgaatagtaaaaacctggcggcagcgcaaaagatg

SEQ ID NO: 6377 - DNA, 103 bp, Artificial Sequence
  Synthetic Polynucleotide
taatacgactcactatagggaccctagtgacatcagctttactattaagcaacagaggagagcttaaatgtaaagctgaaacctggcggcagcgcaaaagatg

SEQ ID NO: 6378 - DNA, 103 bp, Artificial Sequence
  Synthetic Polynucleotide
taatacgactcactatagggtagataccctagtgacatcagctttactataacagaggagaatagtaatgctgatgtcaaacctggcggcagcgcaaaagatg

SEQ ID NO: 6379 - DNA, 103 bp, Artificial Sequence
  Synthetic Polynucleotide
taatacgactcactatagggttcactagataccctagtgacatcagctttaacagaggagaaaagctatggtcactaggaacctggcggcagcgcaaaagatg

SEQ ID NO: 6380 - DNA, 103 bp, Artificial Sequence
  Synthetic Polynucleotide
taatacgactcactatagggcatttttcactagataccctagtgacatcaaacagaggagatgatgtatgtagggtatcaacctggcggcagcgcaaaagatg

SEQ ID NO: 6381 - DNA, 103 bp, Artificial Sequence
  Synthetic Polynucleotide
taatacgactcactatagggtccaccatttttcactagataccctagtgaaacagaggagatcactaatgtatctagtgaacctggcggcagcgcaaaagatg

SEQ ID NO: 6382 - DNA, 103 bp, Artificial Sequence
  Synthetic Polynucleotide
taatacgactcactatagggcctggtccaccatttttcactagataccctaacagaggagaagggtaatgagtgaaaaaaacctggcggcagcgcaaaagatg

SEQ ID NO: 6383 - DNA, 103 bp, Artificial Sequence
  Synthetic Polynucleotide
taatacgactcactatagggaagagcctggtccaccatttttcactagataacagaggagaatctagatgaaaatggtgaacctggcggcagcgcaaaagatg

SEQ ID NO: 6384 - DNA, 103 bp, Artificial Sequence
  Synthetic Polynucleotide
taatacgactcactataggggaggctcgtgtcaccacgagaggaaatccgaacagaggagacggattatgtctcgtggtaacctggcggcagcgcaaaagatg

SEQ ID NO: 6385 - DNA, 103 bp, Artificial Sequence
  Synthetic Polynucleotide
taatacgactcactataggggaaataagagcctggtccaccatttttcacaacagaggagagtgaaaatgggtggaccaaacctggcggcagcgcaaaagatg

SEQ ID NO: 6386 - DNA, 103 bp, Artificial Sequence
  Synthetic Polynucleotide
taatacgactcactataggggctgcgaaataagagcctggtccaccatttaacagaggagaaaatggatgaccaggctcaacctggcggcagcgcaaaagatg

SEQ ID NO: 6387 - DNA, 103 bp, Artificial Sequence
  Synthetic Polynucleotide
taatacgactcactatagggaagcagctgcgaaataagagcctggtccacaacagaggagagtggacatggctcttattaacctggcggcagcgcaaaagatg

SEQ ID NO: 6388 - DNA, 103 bp, Artificial Sequence
  Synthetic Polynucleotide
taatacgactcactatagggcaccgaagcagctgcgaaataagagcctggaacagaggagaccaggcatgtatttcgcaaacctggcggcagcgcaaaagatg

SEQ ID NO: 6389 - DNA, 103 bp, Artificial Sequence
  Synthetic Polynucleotide
taatacgactcactatagggaacagcaccgaagcagctgcgaaataagagaacagaggagactcttaatgcgcagctgcaacctggcggcagcgcaaaagatg

SEQ ID NO: 6390 - DNA, 103 bp, Artificial Sequence
  Synthetic Polynucleotide
taatacgactcactatagggcacacaacagcaccgaagcagctgcgaaataacagaggagaatttcgatgctgcttcggaacctggcggcagcgcaaaagatg

SEQ ID NO: 6391 - DNA, 103 bp, Artificial Sequence
  Synthetic Polynucleotide
taatacgactcactatagggtccatcacacaacagcaccgaagcagctgcaacagaggagagcagctatgtcggtgctgaacctggcggcagcgcaaaagatg

SEQ ID NO: 6392 - DNA, 103 bp, Artificial Sequence
  Synthetic Polynucleotide
taatacgactcactataggggtaattccatcacacaacagcaccgaagcaaacagaggagatgcttcatggctgttgtgaacctggcggcagcgcaaaagatg

SEQ ID NO: 6393 - DNA, 103 bp, Artificial Sequence
  Synthetic Polynucleotide
taatacgactcactatagggagaaagtaattccatcacacaacagcaccgaacagaggagacggtgcatgtgtgtgatgaacctggcggcagcgcaaaagatg

SEQ ID NO: 6394 - DNA, 103 bp, Artificial Sequence
  Synthetic Polynucleotide
taatacgactcactatagggatcaaagaaagtaattccatcacacaacagaacagaggagactgttgatggatggaattaacctggcggcagcgcaaaagatg

SEQ ID NO: 6395 - DNA, 103 bp, Artificial Sequence
  Synthetic Polynucleotide
taatacgactcactatagggcctgtgaggctcgtgtcaccacgagaggaaaacagaggagattcctcatgtggtgacacaacctggcggcagcgcaaaagatg

SEQ ID NO: 6396 - DNA, 103 bp, Artificial Sequence
  Synthetic Polynucleotide
taatacgactcactatagggtaccaatcaaagaaagtaattccatcacacaacagaggagagtgtgaatgaattactttaacctggcggcagcgcaaaagatg

SEQ ID NO: 6397 - DNA, 103 bp, Artificial Sequence
  Synthetic Polynucleotide
taatacgactcactatagggtttcataccaatcaaagaaagtaattccataacagaggagaatggaaatgctttctttgaacctggcggcagcgcaaaagatg

SEQ ID NO: 6398 - DNA, 103 bp, Artificial Sequence
  Synthetic Polynucleotide
taatacgactcactatagggtatcttttcataccaatcaaagaaagtaataacagaggagaattactatgtttgattggaacctggcggcagcgcaaaagatg

SEQ ID NO: 6399 - DNA, 103 bp, Artificial Sequence
  Synthetic Polynucleotide
taatacgactcactatagggatccttatcttttcataccaatcaaagaaaaacagaggagatttcttatgttggtatgaaacctggcggcagcgcaaaagatg

SEQ ID NO: 6400 - DNA, 103 bp, Artificial Sequence
  Synthetic Polynucleotide
taatacgactcactatagggccaccatccttatcttttcataccaatcaaaacagaggagattgattatgatgaaaagaaacctggcggcagcgcaaaagatg

SEQ ID NO: 6401 - DNA, 103 bp, Artificial Sequence
  Synthetic Polynucleotide
taatacgactcactatagggacttgccaccatccttatcttttcataccaaacagaggagatggtatatgaagataaggaacctggcggcagcgcaaaagatg

SEQ ID NO: 6402 - DNA, 103 bp, Artificial Sequence
  Synthetic Polynucleotide
taatacgactcactatagggtacttacttgccaccatccttatcttttcaaacagaggagatgaaaaatgaaggatggtaacctggcggcagcgcaaaagatg

SEQ ID NO: 6403 - DNA, 103 bp, Artificial Sequence
  Synthetic Polynucleotide
taatacgactcactatagggtgaagtacttacttgccaccatccttatctaacagaggagaagataaatgtggtggcaaaacctggcggcagcgcaaaagatg

SEQ ID NO: 6404 - DNA, 103 bp, Artificial Sequence
  Synthetic Polynucleotide
taatacgactcactatagggagttctgaagtacttacttgccaccatcctaacagaggagaaggatgatggcaagtaagaacctggcggcagcgcaaaagatg

SEQ ID NO: 6405 - DNA, 103 bp, Artificial Sequence
  Synthetic Polynucleotide
taatacgactcactataggggggggagttctgaagtacttacttgccaccaacagaggagaggtggcatgtaagtacttaacctggcggcagcgcaaaagatg

SEQ ID NO: 6406 - DNA, 103 bp, Artificial Sequence
  Synthetic Polynucleotide
taatacgactcactatagggtttggcctgtgaggctcgtgtcaccacgagaacagaggagactcgtgatgacacgagccaacctggcggcagcgcaaaagatg

SEQ ID NO: 6407 - DNA, 103 bp, Artificial Sequence
  Synthetic Polynucleotide
taatacgactcactatagggggggagggggagttctgaagtacttacttgaacagaggagacaagtaatgacttcagaaaacctggcggcagcgcaaaagatg

SEQ ID NO: 6408 - DNA, 103 bp, Artificial Sequence
  Synthetic Polynucleotide
taatacgactcactataggggaaagggggagggggagttctgaagtacttaacagaggagaaagtacatgagaactcccaacctggcggcagcgcaaaagatg

SEQ ID NO: 6409 - DNA, 103 bp, Artificial Sequence
  Synthetic Polynucleotide
taatacgactcactatagggagagcgaaagggggagggggagttctgaagaacagaggagacttcagatgtccccctccaacctggcggcagcgcaaaagatg

SEQ ID NO: 6410 - DNA, 103 bp, Artificial Sequence
  Synthetic Polynucleotide
taatacgactcactataggggtacaagagcgaaagggggagggggagttcaacagaggagagaactcatgctcccccttaacctggcggcagcgcaaaagatg

SEQ ID NO: 6411 - DNA, 103 bp, Artificial Sequence
  Synthetic Polynucleotide
taatacgactcactatagggtccttgtacaagagcgaaagggggagggggaacagaggagaccccctatgcctttcgctaacctggcggcagcgcaaaagatg

SEQ ID NO: 6412 - DNA, 103 bp, Artificial Sequence
  Synthetic Polynucleotide
taatacgactcactatagggtcaagtccttgtacaagagcgaaagggggaaacagaggagatcccccatgcgctcttgtaacctggcggcagcgcaaaagatg

SEQ ID NO: 6413 - DNA, 103 bp, Artificial Sequence
  Synthetic Polynucleotide
taatacgactcactataggggtaggtcaagtccttgtacaagagcgaaagaacagaggagactttcgatgttgtacaagaacctggcggcagcgcaaaagatg

SEQ ID NO: 6414 - DNA, 103 bp, Artificial Sequence
  Synthetic Polynucleotide
taatacgactcactatagggatcgcgtaggtcaagtccttgtacaagagcaacagaggagagctcttatgcaaggacttaacctggcggcagcgcaaaagatg

SEQ ID NO: 6415 - DNA, 103 bp, Artificial Sequence
  Synthetic Polynucleotide
taatacgactcactatagggaccacatcgcgtaggtcaagtccttgtacaaacagaggagatgtacaatgacttgacctaacctggcggcagcgcaaaagatg

SEQ ID NO: 6416 - DNA, 103 bp, Artificial Sequence
  Synthetic Polynucleotide
taatacgactcactatagggaggtcaccacatcgcgtaggtcaagtccttaacagaggagaaaggacatgacctacgcgaacctggcggcagcgcaaaagatg

SEQ ID NO: 6417 - DNA, 103 bp, Artificial Sequence
  Synthetic Polynucleotide
taatacgactcactataggggggcttttggcctgtgaggctcgtgtcaccaacagaggagaggtgacatgagcctcacaaacctggcggcagcgcaaaagatg

SEQ ID NO: 6418 - DNA, 103 bp, Artificial Sequence
  Synthetic Polynucleotide
taatacgactcactataggggaaaaaggtcaccacatcgcgtaggtcaagaacagaggagacttgacatgcgcgatgtgaacctggcggcagcgcaaaagatg

SEQ ID NO: 6419 - DNA, 103 bp, Artificial Sequence
  Synthetic Polynucleotide
taatacgactcactataggggcattgaaaaaggtcaccacatcgcgtaggaacagaggagacctacgatgtgtggtgacaacctggcggcagcgcaaaagatg

SEQ ID NO: 6420 - DNA, 103 bp, Artificial Sequence
  Synthetic Polynucleotide
taatacgactcactatagggtggctgcattgaaaaaggtcaccacatcgcaacagaggagagcgatgatgtgaccttttaacctggcggcagcgcaaaagatg

SEQ ID NO: 6421 - DNA, 103 bp, Artificial Sequence
  Synthetic Polynucleotide
taatacgactcactatagggccccttggctgcattgaaaaaggtcaccacaacagaggagagtggtgatgtttttcaataacctggcggcagcgcaaaagatg

SEQ ID NO: 6422 - DNA, 103 bp, Artificial Sequence
  Synthetic Polynucleotide
taatacgactcactatagggtgcaaccccttggctgcattgaaaaaggtcaacagaggagagaccttatgcaatgcagcaacctggcggcagcgcaaaagatg

SEQ ID NO: 6423 - DNA, 103 bp, Artificial Sequence
  Synthetic Polynucleotide
taatacgactcactatagggtccactgcaaccccttggctgcattgaaaaaacagaggagattttcaatgcagccaaggaacctggcggcagcgcaaaagatg

SEQ ID NO: 6424 - DNA, 103 bp, Artificial Sequence
  Synthetic Polynucleotide
taatacgactcactatagggcaccatccactgcaaccccttggctgcattaacagaggagaaatgcaatgaaggggttgaacctggcggcagcgcaaaagatg

SEQ ID NO: 6425 - DNA, 103 bp, Artificial Sequence
  Synthetic Polynucleotide
taatacgactcactataggggtgtccaccatccactgcaaccccttggctaacagaggagaagccaaatggttgcagtgaacctggcggcagcgcaaaagatg

SEQ ID NO: 6426 - DNA, 103 bp, Artificial Sequence
  Synthetic Polynucleotide
taatacgactcactataggggaatggtgtccaccatccactgcaacccctaacagaggagaaggggtatgagtggatggaacctggcggcagcgcaaaagatg

SEQ ID NO: 6427 - DNA, 103 bp, Artificial Sequence
  Synthetic Polynucleotide
taatacgactcactatagggagcacgaatggtgtccaccatccactgcaaaacagaggagattgcagatgatggtggacaacctggcggcagcgcaaaagatg

SEQ ID NO: 6428 - DNA, 103 bp, Artificial Sequence
  Synthetic Polynucleotide
taatacgactcactatagggggacggggcttttggcctgtgaggctcgtgaacagaggagacacgagatgcacaggccaaacctggcggcagcgcaaaagatg

SEQ ID NO: 6429 - DNA, 103 bp, Artificial Sequence
  Synthetic Polynucleotide
taatacgactcactatagggatcaaagcacgaatggtgtccaccatccacaacagaggagagtggatatgggacaccataacctggcggcagcgcaaaagatg

SEQ ID NO: 6430 - DNA, 103 bp, Artificial Sequence
  Synthetic Polynucleotide
taatacgactcactatagggagttaatcaaagcacgaatggtgtccaccaaacagaggagatggtggatgccattcgtgaacctggcggcagcgcaaaagatg

SEQ ID NO: 6431 - DNA, 103 bp, Artificial Sequence
  Synthetic Polynucleotide
taatacgactcactatagggtagccagttaatcaaagcacgaatggtgtcaacagaggagagacaccatgcgtgctttgaacctggcggcagcgcaaaagatg

SEQ ID NO: 6432 - DNA, 103 bp, Artificial Sequence
  Synthetic Polynucleotide
taatacgactcactatagggttctttagccagttaatcaaagcacgaatgaacagaggagacattcgatgtttgattaaaacctggcggcagcgcaaaagatg

SEQ ID NO: 6433 - DNA, 103 bp, Artificial Sequence
  Synthetic Polynucleotide
taatacgactcactatagggtccatttctttagccagttaatcaaagcacaacagaggagagtgcttatgttaactggcaacctggcggcagcgcaaaagatg

SEQ ID NO: 6434 - DNA, 103 bp, Artificial Sequence
  Synthetic Polynucleotide
taatacgactcactataggggtccatccatttctttagccagttaatcaaaacagaggagattgattatgtggctaaagaacctggcggcagcgcaaaagatg

SEQ ID NO: 6435 - DNA, 103 bp, Artificial Sequence
  Synthetic Polynucleotide
taatacgactcactatagggtcattgtccatccatttctttagccagttaaacagaggagataactgatgaaagaaatgaacctggcggcagcgcaaaagatg

SEQ ID NO: 6436 - DNA, 103 bp, Artificial Sequence
  Synthetic Polynucleotide
taatacgactcactatagggcggtttcattgtccatccatttctttagccaacagaggagaggctaaatgaatggatggaacctggcggcagcgcaaaagatg

SEQ ID NO: 6437 - DNA, 103 bp, Artificial Sequence
  Synthetic Polynucleotide
taatacgactcactatagggattttcggtttcattgtccatccatttcttaacagaggagaaagaaaatgatggacaataacctggcggcagcgcaaaagatg

SEQ ID NO: 6438 - DNA, 103 bp, Artificial Sequence
  Synthetic Polynucleotide
taatacgactcactatagggccatcattttcggtttcattgtccatccataacagaggagaatggatatgcaatgaaacaacctggcggcagcgcaaaagatg

SEQ ID NO: 6439 - DNA, 103 bp, Artificial Sequence
  Synthetic Polynucleotide
taatacgactcactatagggctttcggacggggcttttggcctgtgaggcaacagaggagagcctcaatggccaaaagcaacctggcggcagcgcaaaagatg

SEQ ID NO: 6440 - DNA, 103 bp, Artificial Sequence
  Synthetic Polynucleotide
taatacgactcactatagggtaataccatcattttcggtttcattgtccaaacagaggagatggacaatgaaaccgaaaaacctggcggcagcgcaaaagatg

SEQ ID NO: 6441 - DNA, 103 bp, Artificial Sequence
  Synthetic Polynucleotide
taatacgactcactatagggcaacttaataccatcattttcggtttcattaacagaggagaaatgaaatggaaaatgataacctggcggcagcgcaaaagatg

SEQ ID NO: 6442 - DNA, 103 bp, Artificial Sequence
  Synthetic Polynucleotide
taatacgactcactatagggtgttccaacttaataccatcattttcggttaacagaggagaaaccgaatgtgatggtataacctggcggcagcgcaaaagatg

SEQ ID NO: 6443 - DNA, 103 bp, Artificial Sequence
  Synthetic Polynucleotide
taatacgactcactatagggacatttgttccaacttaataccatcattttaacagaggagaaaaatgatggtattaagtaacctggcggcagcgcaaaagatg

SEQ ID NO: 6444 - DNA, 103 bp, Artificial Sequence
  Synthetic Polynucleotide
taatacgactcactataggggattaacatttgttccaacttaataccatcaacagaggagagatggtatgaagttggaaaacctggcggcagcgcaaaagatg

SEQ ID NO: 6445 - DNA, 103 bp, Artificial Sequence
  Synthetic Polynucleotide
taatacgactcactatagggctatcgattaacatttgttccaacttaataaacagaggagatattaaatgggaacaaataacctggcggcagcgcaaaagatg

SEQ ID NO: 6446 - DNA, 103 bp, Artificial Sequence
  Synthetic Polynucleotide
taatacgactcactataggggagggctatcgattaacatttgttccaactaacagaggagaagttggatgaaatgttaaaacctggcggcagcgcaaaagatg

SEQ ID NO: 6447 - DNA, 103 bp, Artificial Sequence
  Synthetic Polynucleotide
taatacgactcactataggggtgtggagggctatcgattaacatttgttcaacagaggagagaacaaatgttaatcgataacctggcggcagcgcaaaagatg

SEQ ID NO: 6448 - DNA, 103 bp, Artificial Sequence
  Synthetic Polynucleotide
taatacgactcactatagggttgcagtgtggagggctatcgattaacattaacagaggagaaatgttatgcgatagcccaacctggcggcagcgcaaaagatg

SEQ ID NO: 6449 - DNA, 103 bp, Artificial Sequence
  Synthetic Polynucleotide
taatacgactcactatagggttgctttgcagtgtggagggctatcgattaaacagaggagataatcgatggccctccacaacctggcggcagcgcaaaagatg

SEQ ID NO: 6450 - DNA, 103 bp, Artificial Sequence
  Synthetic Polynucleotide
taatacgactcactataggggggtcctttcggacggggcttttggcctgtaacagaggagaacaggcatgaagccccgtaacctggcggcagcgcaaaagatg

SEQ ID NO: 6451 - DNA, 103 bp, Artificial Sequence
  Synthetic Polynucleotide
taatacgactcactatagggatgtattgctttgcagtgtggagggctatcaacagaggagagatagcatgccacactgcaacctggcggcagcgcaaaagatg

SEQ ID NO: 6452 - DNA, 103 bp, Artificial Sequence
  Synthetic Polynucleotide
taatacgactcactatagggtaggcatgtattgctttgcagtgtggagggaacagaggagaccctccatgctgcaaagcaacctggcggcagcgcaaaagatg

SEQ ID NO: 6453 - DNA, 103 bp, Artificial Sequence
  Synthetic Polynucleotide
taatacgactcactatagggtgttgtaggcatgtattgctttgcagtgtgaacagaggagacacactatgaagcaatacaacctggcggcagcgcaaaagatg

SEQ ID NO: 6454 - DNA, 103 bp, Artificial Sequence
  Synthetic Polynucleotide
taatacgactcactatagggtcccctgttgtaggcatgtattgctttgcaaacagaggagatgcaaaatgatacatgccaacctggcggcagcgcaaaagatg

SEQ ID NO: 6455 - DNA, 103 bp, Artificial Sequence
  Synthetic Polynucleotide
taatacgactcactataggggtttctcccctgttgtaggcatgtattgctaacagaggagaagcaatatgtgcctacaaaacctggcggcagcgcaaaagatg

SEQ ID NO: 6456 - DNA, 103 bp, Artificial Sequence
  Synthetic Polynucleotide
taatacgactcactatagggtaaaagtttctcccctgttgtaggcatgtaaacagaggagatacatgatgacaacagggaacctggcggcagcgcaaaagatg

SEQ ID NO: 6457 - DNA, 103 bp, Artificial Sequence
  Synthetic Polynucleotide
taatacgactcactatagggttttttaaaagtttctcccctgttgtaggcaacagaggagagcctacatgaggggagaaaacctggcggcagcgcaaaagatg

SEQ ID NO: 6458 - DNA, 103 bp, Artificial Sequence
  Synthetic Polynucleotide
taatacgactcactataggggttggttttttaaaagtttctcccctgttgaacagaggagacaacagatgagaaactttaacctggcggcagcgcaaaagatg

SEQ ID NO: 6459 - DNA, 103 bp, Artificial Sequence
  Synthetic Polynucleotide
taatacgactcactatagggagtctgttggttttttaaaagtttctccccaacagaggagaggggagatgcttttaaaaaacctggcggcagcgcaaaagatg

SEQ ID NO: 6460 - DNA, 103 bp, Artificial Sequence
  Synthetic Polynucleotide
taatacgactcactatagggaaaagagtctgttggttttttaaaagtttcaacagaggagagaaactatgaaaaaaccaaacctggcggcagcgcaaaagatg

SEQ ID NO: 6461 - DNA, 103 bp, Artificial Sequence
  Synthetic Polynucleotide
taatacgactcactatagggactgccatataaggtagacgtcaaaccacaaacagaggagatgtggtatgacgtctaccaacctggcggcagcgcaaaagatg

SEQ ID NO: 6462 - DNA, 103 bp, Artificial Sequence
  Synthetic Polynucleotide
taatacgactcactatagggcattcgggtcctttcggacggggcttttggaacagaggagaccaaaaatgccgtccgaaaacctggcggcagcgcaaaagatg

SEQ ID NO: 6463 - DNA, 103 bp, Artificial Sequence
  Synthetic Polynucleotide
taatacgactcactatagggaattgaaaagagtctgttggttttttaaaaaacagaggagattttaaatgaccaacagaaacctggcggcagcgcaaaagatg

SEQ ID NO: 6464 - DNA, 103 bp, Artificial Sequence
  Synthetic Polynucleotide
taatacgactcactatagggcaatgaattgaaaagagtctgttggtttttaacagaggagaaaaaacatgcagactcttaacctggcggcagcgcaaaagatg

SEQ ID NO: 6465 - DNA, 103 bp, Artificial Sequence
  Synthetic Polynucleotide
taatacgactcactatagggtttgtcaatgaattgaaaagagtctgttggaacagaggagaccaacaatgtcttttcaaaacctggcggcagcgcaaaagatg

SEQ ID NO: 6466 - DNA, 103 bp, Artificial Sequence
  Synthetic Polynucleotide
taatacgactcactatagggataagtttgtcaatgaattgaaaagagtctaacagaggagaagactcatgtcaattcataacctggcggcagcgcaaaagatg

SEQ ID NO: 6467 - DNA, 103 bp, Artificial Sequence
  Synthetic Polynucleotide
taatacgactcactatagggaatcaataagtttgtcaatgaattgaaaagaacagaggagacttttcatgtcattgacaaacctggcggcagcgcaaaagatg

SEQ ID NO: 6468 - DNA, 103 bp, Artificial Sequence
  Synthetic Polynucleotide
taatacgactcactatagggggccaaatcaataagtttgtcaatgaattgaacagaggagacaattcatggacaaacttaacctggcggcagcgcaaaagatg

SEQ ID NO: 6469 - DNA, 103 bp, Artificial Sequence
  Synthetic Polynucleotide
taatacgactcactataggggctgtggccaaatcaataagtttgtcaatgaacagaggagacattgaatgacttattgaaacctggcggcagcgcaaaagatg

SEQ ID NO: 6470 - DNA, 103 bp, Artificial Sequence
  Synthetic Polynucleotide
taatacgactcactatagggcttgagctgtggccaaatcaataagtttgtaacagaggagaacaaacatgttgatttggaacctggcggcagcgcaaaagatg

SEQ ID NO: 6471 - DNA, 103 bp, Artificial Sequence
  Synthetic Polynucleotide
taatacgactcactatagggttttccttgagctgtggccaaatcaataagaacagaggagacttattatgttggccacaaacctggcggcagcgcaaaagatg

SEQ ID NO: 6472 - DNA, 103 bp, Artificial Sequence
  Synthetic Polynucleotide
taatacgactcactatagggtgtaattttccttgagctgtggccaaatcaaacagaggagatgatttatgcacagctcaaacctggcggcagcgcaaaagatg

SEQ ID NO: 6473 - DNA, 103 bp, Artificial Sequence
  Synthetic Polynucleotide
taatacgactcactatagggtccaccattcgggtcctttcggacggggctaacagaggagaagccccatgcgaaaggacaacctggcggcagcgcaaaagatg

SEQ ID NO: 6474 - DNA, 103 bp, Artificial Sequence
  Synthetic Polynucleotide
taatacgactcactatagggccatgtgtaattttccttgagctgtggccaaacagaggagatggccaatgctcaaggaaaacctggcggcagcgcaaaagatg

SEQ ID NO: 6475 - DNA, 103 bp, Artificial Sequence
  Synthetic Polynucleotide
taatacgactcactatagggagatgccatgtgtaattttccttgagctgtaacagaggagaacagctatgggaaaattaaacctggcggcagcgcaaaagatg

SEQ ID NO: 6476 - DNA, 103 bp, Artificial Sequence
  Synthetic Polynucleotide
taatacgactcactatagggaaataagatgccatgtgtaattttccttgaaacagaggagatcaaggatgattacacataacctggcggcagcgcaaaagatg

SEQ ID NO: 6477 - DNA, 103 bp, Artificial Sequence
  Synthetic Polynucleotide
taatacgactcactatagggttttgaaataagatgccatgtgtaattttcaacagaggagagaaaatatgacatggcataacctggcggcagcgcaaaagatg

SEQ ID NO: 6478 - DNA, 103 bp, Artificial Sequence
  Synthetic Polynucleotide
taatacgactcactatagggataatttttgaaataagatgccatgtgtaaaacagaggagattacacatggcatcttataacctggcggcagcgcaaaagatg

SEQ ID NO: 6479 - DNA, 103 bp, Artificial Sequence
  Synthetic Polynucleotide
taatacgactcactataggggcaacataatttttgaaataagatgccatgaacagaggagacatggcatgttatttcaaaacctggcggcagcgcaaaagatg

SEQ ID NO: 6480 - DNA, 103 bp, Artificial Sequence
  Synthetic Polynucleotide
taatacgactcactatagggcatcagcaacataatttttgaaataagatgaacagaggagacatcttatgtcaaaaattaacctggcggcagcgcaaaagatg

SEQ ID NO: 6481 - DNA, 103 bp, Artificial Sequence
  Synthetic Polynucleotide
taatacgactcactatagggtgaaacatcagcaacataatttttgaaataaacagaggagatatttcatgaattatgttaacctggcggcagcgcaaaagatg

SEQ ID NO: 6482 - DNA, 103 bp, Artificial Sequence
  Synthetic Polynucleotide
taatacgactcactataggggggtctgaaacatcagcaacataatttttgaacagaggagacaaaaaatgtgttgctgaaacctggcggcagcgcaaaagatg

SEQ ID NO: 6483 - DNA, 103 bp, Artificial Sequence
  Synthetic Polynucleotide
taatacgactcactatagggggcatgggtctgaaacatcagcaacataataacagaggagaattatgatgctgatgtttaacctggcggcagcgcaaaagatg

SEQ ID NO: 6484 - DNA, 103 bp, Artificial Sequence
  Synthetic Polynucleotide
taatacgactcactataggggtcactccaccattcgggtcctttcggacgaacagaggagacgtccgatgggacccgaaaacctggcggcagcgcaaaagatg

SEQ ID NO: 6485 - DNA, 103 bp, Artificial Sequence
  Synthetic Polynucleotide
taatacgactcactatagggagggcggcatgggtctgaaacatcagcaacaacagaggagagttgctatggtttcagacaacctggcggcagcgcaaaagatg

SEQ ID NO: 6486 - DNA, 103 bp, Artificial Sequence
  Synthetic Polynucleotide
taatacgactcactatagggggttcagggcggcatgggtctgaaacatcaaacagaggagatgatgtatgagacccatgaacctggcggcagcgcaaaagatg

SEQ ID NO: 6487 - DNA, 103 bp, Artificial Sequence
  Synthetic Polynucleotide
taatacgactcactatagggctactggttcagggcggcatgggtctgaaaaacagaggagatttcagatgcatgccgccaacctggcggcagcgcaaaagatg

SEQ ID NO: 6488 - DNA, 103 bp, Artificial Sequence
  Synthetic Polynucleotide
taatacgactcactatagggaatcactactggttcagggcggcatgggtcaacagaggagagacccaatgcgccctgaaaacctggcggcagcgcaaaagatg

SEQ ID NO: 6489 - DNA, 103 bp, Artificial Sequence
  Synthetic Polynucleotide
taatacgactcactatagggaaaacaatcactactggttcagggcggcataacagaggagaatgccgatgtgaaccagtaacctggcggcagcgcaaaagatg

SEQ ID NO: 6490 - DNA, 103 bp, Artificial Sequence
  Synthetic Polynucleotide
taatacgactcactatagggctctcaaaacaatcactactggttcagggcaacagaggagagccctgatgcagtagtgaaacctggcggcagcgcaaaagatg

SEQ ID NO: 6491 - DNA, 103 bp, Artificial Sequence
  Synthetic Polynucleotide
taatacgactcactatagggtttgcctctcaaaacaatcactactggttcaacagaggagagaaccaatggtgattgttaacctggcggcagcgcaaaagatg

SEQ ID NO: 6492 - DNA, 103 bp, Artificial Sequence
  Synthetic Polynucleotide
taatacgactcactatagggcctggtttgcctctcaaaacaatcactactaacagaggagaagtagtatgtgttttgagaacctggcggcagcgcaaaagatg

SEQ ID NO: 6493 - DNA, 103 bp, Artificial Sequence
  Synthetic Polynucleotide
taatacgactcactatagggcggcccctggtttgcctctcaaaacaatcaaacagaggagatgattgatgtgagaggcaaacctggcggcagcgcaaaagatg

SEQ ID NO: 6494 - DNA, 103 bp, Artificial Sequence
  Synthetic Polynucleotide
taatacgactcactatagggcttgccggcccctggtttgcctctcaaaacaacagaggagagttttgatgggcaaaccaaacctggcggcagcgcaaaagatg

SEQ ID NO: 6495 - DNA, 103 bp, Artificial Sequence
  Synthetic Polynucleotide
taatacgactcactatagggtcagggtcactccaccattcgggtcctttcaacagaggagagaaaggatgcgaatggtgaacctggcggcagcgcaaaagatg

SEQ ID NO: 6496 - DNA, 103 bp, Artificial Sequence
  Synthetic Polynucleotide
taatacgactcactataggggctgacttgccggcccctggtttgcctctcaacagaggagagagaggatgaccaggggcaacctggcggcagcgcaaaagatg

SEQ ID NO: 6497 - DNA, 103 bp, Artificial Sequence
  Synthetic Polynucleotide
taatacgactcactatagggccgctgctgacttgccggcccctggtttgcaacagaggagagcaaacatggggccggcaaacctggcggcagcgcaaaagatg

SEQ ID NO: 6498 - DNA, 103 bp, Artificial Sequence
  Synthetic Polynucleotide
taatacgactcactatagggagtggccgctgctgacttgccggcccctggaacagaggagaccagggatgggcaagtcaaacctggcggcagcgcaaaagatg

SEQ ID NO: 6499 - DNA, 103 bp, Artificial Sequence
  Synthetic Polynucleotide
taatacgactcactatagggaagacagtggccgctgctgacttgccggccaacagaggagaggccggatggtcagcagcaacctggcggcagcgcaaaagatg

SEQ ID NO: 6500 - DNA, 103 bp, Artificial Sequence
  Synthetic Polynucleotide
taatacgactcactatagggcagccaagacagtggccgctgctgacttgcaacagaggagagcaagtatgcagcggccaaacctggcggcagcgcaaaagatg

SEQ ID NO: 6501 - DNA, 103 bp, Artificial Sequence
  Synthetic Polynucleotide
taatacgactcactatagggtgctgcagccaagacagtggccgctgctgaaacagaggagatcagcaatggccactgtcaacctggcggcagcgcaaaagatg

SEQ ID NO: 6502 - DNA, 103 bp, Artificial Sequence
  Synthetic Polynucleotide
taatacgactcactataggggaaattgctgcagccaagacagtggccgctaacagaggagaagcggcatgtgtcttggcaacctggcggcagcgcaaaagatg

SEQ ID NO: 6503 - DNA, 103 bp, Artificial Sequence
  Synthetic Polynucleotide
taatacgactcactatagggtcttggaaattgctgcagccaagacagtggaacagaggagaccactgatgtggctgcagaacctggcggcagcgcaaaagatg

SEQ ID NO: 6504 - DNA, 103 bp, Artificial Sequence
  Synthetic Polynucleotide
taatacgactcactatagggtatcatcttggaaattgctgcagccaagacaacagaggagagtcttgatggcagcaattaacctggcggcagcgcaaaagatg

SEQ ID NO: 6505 - DNA, 103 bp, Artificial Sequence
  Synthetic Polynucleotide
taatacgactcactatagggcctactatcatcttggaaattgctgcagccaacagaggagaggctgcatgaatttccaaaacctggcggcagcgcaaaagatg

SEQ ID NO: 6506 - DNA, 103 bp, Artificial Sequence
  Synthetic Polynucleotide
taatacgactcactataggggggagtcagggtcactccaccattcgggtcaacagaggagagacccgatgggtggagtgaacctggcggcagcgcaaaagatg

SEQ ID NO: 6507 - DNA, 103 bp, Artificial Sequence
  Synthetic Polynucleotide
taatacgactcactataggggttcacctactatcatcttggaaattgctgaacagaggagacagcaaatgccaagatgaaacctggcggcagcgcaaaagatg

SEQ ID NO: 6508 - DNA, 103 bp, Artificial Sequence
  Synthetic Polynucleotide
taatacgactcactatagggtgattgttcacctactatcatcttggaaataacagaggagaatttccatgatgatagtaaacctggcggcagcgcaaaagatg

SEQ ID NO: 6509 - DNA, 103 bp, Artificial Sequence
  Synthetic Polynucleotide
taatacgactcactatagggtaaactgattgttcacctactatcatcttgaacagaggagacaagatatgagtaggtgaaacctggcggcagcgcaaaagatg

SEQ ID NO: 6510 - DNA, 103 bp, Artificial Sequence
  Synthetic Polynucleotide
taatacgactcactataggggtgtataaactgattgttcacctactatcaaacagaggagatgatagatggtgaacaataacctggcggcagcgcaaaagatg

SEQ ID NO: 6511 - DNA, 103 bp, Artificial Sequence
  Synthetic Polynucleotide
taatacgactcactatagggagatagtgtataaactgattgttcacctacaacagaggagagtaggtatgcaatcagttaacctggcggcagcgcaaaagatg

SEQ ID NO: 6512 - DNA, 103 bp, Artificial Sequence
  Synthetic Polynucleotide
taatacgactcactatagggtctggagatagtgtataaactgattgttcaaacagaggagatgaacaatgagtttatacaacctggcggcagcgcaaaagatg

SEQ ID NO: 6513 - DNA, 103 bp, Artificial Sequence
  Synthetic Polynucleotide
taatacgactcactatagggcagtgtctggagatagtgtataaactgattaacagaggagaaatcagatgatacactataacctggcggcagcgcaaaagatg

SEQ ID NO: 6514 - DNA, 103 bp, Artificial Sequence
  Synthetic Polynucleotide
taatacgactcactataggggtggtcagtgtctggagatagtgtataaacaacagaggagagtttatatgctatctccaaacctggcggcagcgcaaaagatg

SEQ ID NO: 6515 - DNA, 103 bp, Artificial Sequence
  Synthetic Polynucleotide
taatacgactcactatagggtccatgtggtcagtgtctggagatagtgtaaacagaggagatacactatgtccagacacaacctggcggcagcgcaaaagatg

SEQ ID NO: 6516 - DNA, 103 bp, Artificial Sequence
  Synthetic Polynucleotide
taatacgactcactatagggaaccgtccatgtggtcagtgtctggagataaacagaggagatatctcatgacactgaccaacctggcggcagcgcaaaagatg

SEQ ID NO: 6517 - DNA, 103 bp, Artificial Sequence
  Synthetic Polynucleotide
taatacgactcactatagggcaggggggagtcagggtcactccaccattcaacagaggagagaatggatgagtgaccctaacctggcggcagcgcaaaagatg

SEQ ID NO: 6518 - DNA, 103 bp, Artificial Sequence
  Synthetic Polynucleotide
taatacgactcactatagggtgtataaccgtccatgtggtcagtgtctggaacagaggagaccagacatggaccacatgaacctggcggcagcgcaaaagatg

SEQ ID NO: 6519 - DNA, 103 bp, Artificial Sequence
  Synthetic Polynucleotide
taatacgactcactatagggtgtcctgtataaccgtccatgtggtcagtgaacagaggagacactgaatgcatggacggaacctggcggcagcgcaaaagatg

SEQ ID NO: 6520 - DNA, 103 bp, Artificial Sequence
  Synthetic Polynucleotide
taatacgactcactatagggcgtactgtcctgtataaccgtccatgtggtaacagaggagaaccacaatgacggttataaacctggcggcagcgcaaaagatg

SEQ ID NO: 6521 - DNA, 103 bp, Artificial Sequence
  Synthetic Polynucleotide
taatacgactcactatagggcacaacgtactgtcctgtataaccgtccataacagaggagaatggacatgtatacaggaaacctggcggcagcgcaaaagatg

SEQ ID NO: 6522 - DNA, 103 bp, Artificial Sequence
  Synthetic Polynucleotide
taatacgactcactatagggattatcacaacgtactgtcctgtataaccgaacagaggagacggttaatgaggacagtaaacctggcggcagcgcaaaagatg

SEQ ID NO: 6523 - DNA, 103 bp, Artificial Sequence
  Synthetic Polynucleotide
taatacgactcactatagggcatccattatcacaacgtactgtcctgtataacagaggagaatacagatgagtacgttgaacctggcggcagcgcaaaagatg

SEQ ID NO: 6524 - DNA, 103 bp, Artificial Sequence
  Synthetic Polynucleotide
taatacgactcactatagggcaagtcatccattatcacaacgtactgtccaacagaggagaggacagatggttgtgataaacctggcggcagcgcaaaagatg

SEQ ID NO: 6525 - DNA, 103 bp, Artificial Sequence
  Synthetic Polynucleotide
taatacgactcactatagggtgtcccaagtcatccattatcacaacgtacaacagaggagagtacgtatggataatggaaacctggcggcagcgcaaaagatg

SEQ ID NO: 6526 - DNA, 103 bp, Artificial Sequence
  Synthetic Polynucleotide
taatacgactcactatagggggttctgtcccaagtcatccattatcacaaaacagaggagattgtgaatgtggatgactaacctggcggcagcgcaaaagatg

SEQ ID NO: 6527 - DNA, 103 bp, Artificial Sequence
  Synthetic Polynucleotide
taatacgactcactatagggatccgggttctgtcccaagtcatccattataacagaggagaataatgatggacttgggaaacctggcggcagcgcaaaagatg

SEQ ID NO: 6528 - DNA, 103 bp, Artificial Sequence
  Synthetic Polynucleotide
taatacgactcactatagggctatgcaggggggagtcagggtcactccacaacagaggagagtggagatgccctgactcaacctggcggcagcgcaaaagatg

SEQ ID NO: 6529 - DNA, 103 bp, Artificial Sequence
  Synthetic Polynucleotide
taatacgactcactatagggtcaccatccgggttctgtcccaagtcatccaacagaggagaggatgaatggggacagaaaacctggcggcagcgcaaaagatg

SEQ ID NO: 6530 - DNA, 103 bp, Artificial Sequence
  Synthetic Polynucleotide
taatacgactcactatagggaatcttcaccatccgggttctgtcccaagtaacagaggagaacttggatgagaacccggaacctggcggcagcgcaaaagatg

SEQ ID NO: 6531 - DNA, 103 bp, Artificial Sequence
  Synthetic Polynucleotide
taatacgactcactatagggtctgaaatcttcaccatccgggttctgtccaacagaggagaggacagatgccggatggtaacctggcggcagcgcaaaagatg

SEQ ID NO: 6532 - DNA, 103 bp, Artificial Sequence
  Synthetic Polynucleotide
taatacgactcactatagggaaatatctgaaatcttcaccatccgggttcaacagaggagagaacccatgtggtgaagaaacctggcggcagcgcaaaagatg

SEQ ID NO: 6533 - DNA, 103 bp, Artificial Sequence
  Synthetic Polynucleotide
taatacgactcactataggggacaaaaatatctgaaatcttcaccatccgaacagaggagacggatgatgaagatttcaaacctggcggcagcgcaaaagatg

SEQ ID NO: 6534 - DNA, 103 bp, Artificial Sequence
  Synthetic Polynucleotide
taatacgactcactatagggcatctgacaaaaatatctgaaatcttcaccaacagaggagaggtgaaatgttcagatataacctggcggcagcgcaaaagatg

SEQ ID NO: 6535 - DNA, 103 bp, Artificial Sequence
  Synthetic Polynucleotide
taatacgactcactataggggataccatctgacaaaaatatctgaaatctaacagaggagaagatttatgatatttttgaacctggcggcagcgcaaaagatg

SEQ ID NO: 6536 - DNA, 103 bp, Artificial Sequence
  Synthetic Polynucleotide
taatacgactcactatagggtagtggataccatctgacaaaaatatctgaaacagaggagatcagatatgtttgtcagaaacctggcggcagcgcaaaagatg

SEQ ID NO: 6537 - DNA, 103 bp, Artificial Sequence
  Synthetic Polynucleotide
taatacgactcactatagggacatgtagtggataccatctgacaaaaataaacagaggagatattttatgcagatggtaaacctggcggcagcgcaaaagatg

SEQ ID NO: 6538 - DNA, 103 bp, Artificial Sequence
  Synthetic Polynucleotide
taatacgactcactatagggctgtaacatgtagtggataccatctgacaaaacagaggagattgtcaatgggtatccacaacctggcggcagcgcaaaagatg

SEQ ID NO: 6539 - DNA, 103 bp, Artificial Sequence
  Synthetic Polynucleotide
taatacgactcactatagggcaaaactatgcaggggggagtcagggtcacaacagaggagagtgaccatgactccccccaacctggcggcagcgcaaaagatg

SEQ ID NO: 6540 - DNA, 103 bp, Artificial Sequence
  Synthetic Polynucleotide
taatacgactcactatagggccggtctgtaacatgtagtggataccatctaacagaggagaagatggatgccactacataacctggcggcagcgcaaaagatg

SEQ ID NO: 6541 - DNA, 103 bp, Artificial Sequence
  Synthetic Polynucleotide
taatacgactcactatagggcatggccggtctgtaacatgtagtggatacaacagaggagagtatccatgacatgttacaacctggcggcagcgcaaaagatg

SEQ ID NO: 6542 - DNA, 103 bp, Artificial Sequence
  Synthetic Polynucleotide
taatacgactcactatagggtctgccatggccggtctgtaacatgtagtgaacagaggagacactacatgttacagaccaacctggcggcagcgcaaaagatg

SEQ ID NO: 6543 - DNA, 103 bp, Artificial Sequence
  Synthetic Polynucleotide
taatacgactcactatagggtaagatctgccatggccggtctgtaacatgaacagaggagacatgttatggaccggccaaacctggcggcagcgcaaaagatg

SEQ ID NO: 6544 - DNA, 103 bp, Artificial Sequence
  Synthetic Polynucleotide
taatacgactcactatagggatccttaagatctgccatggccggtctgtaaacagaggagatacagaatggccatggcaaacctggcggcagcgcaaaagatg

SEQ ID NO: 6545 - DNA, 103 bp, Artificial Sequence
  Synthetic Polynucleotide
taatacgactcactatagggcctttatccttaagatctgccatggccggtaacagaggagaaccggcatgggcagatctaacctggcggcagcgcaaaagatg

SEQ ID NO: 6546 - DNA, 103 bp, Artificial Sequence
  Synthetic Polynucleotide
taatacgactcactataggggaattcctttatccttaagatctgccatggaacagaggagaccatggatgatcttaaggaacctggcggcagcgcaaaagatg

SEQ ID NO: 6547 - DNA, 103 bp, Artificial Sequence
  Synthetic Polynucleotide
taatacgactcactataggggaagagaattcctttatccttaagatctgcaacagaggagagcagatatgaaggataaaaacctggcggcagcgcaaaagatg

SEQ ID NO: 6548 - DNA, 103 bp, Artificial Sequence
  Synthetic Polynucleotide
taatacgactcactataggggaagtgaagagaattcctttatccttaagaaacagaggagatcttaaatgtaaaggaataacctggcggcagcgcaaaagatg

SEQ ID NO: 6549 - DNA, 103 bp, Artificial Sequence
  Synthetic Polynucleotide
taatacgactcactatagggctctggaagtgaagagaattcctttatcctaacagaggagaaggataatggaattctctaacctggcggcagcgcaaaagatg

SEQ ID NO: 6550 - DNA, 103 bp, Artificial Sequence
  Synthetic Polynucleotide
taatacgactcactatagggaatcacaaaactatgcaggggggagtcaggaacagaggagacctgacatgcccctgcataacctggcggcagcgcaaaagatg

SEQ ID NO: 6551 - DNA, 103 bp, Artificial Sequence
  Synthetic Polynucleotide
taatacgactcactatagggtaaaactctggaagtgaagagaattcctttaacagaggagaaaaggaatgctcttcactaacctggcggcagcgcaaaagatg

SEQ ID NO: 6552 - DNA, 103 bp, Artificial Sequence
  Synthetic Polynucleotide
taatacgactcactatagggactattaaaactctggaagtgaagagaattaacagaggagaaattctatgcacttccagaacctggcggcagcgcaaaagatg

SEQ ID NO: 6553 - DNA, 103 bp, Artificial Sequence
  Synthetic Polynucleotide
taatacgactcactatagggttgttactattaaaactctggaagtgaagaaacagaggagatcttcaatgccagagtttaacctggcggcagcgcaaaagatg

SEQ ID NO: 6554 - DNA, 103 bp, Artificial Sequence
  Synthetic Polynucleotide
taatacgactcactataggggttagttgttactattaaaactctggaagtaacagaggagaacttccatggttttaataaacctggcggcagcgcaaaagatg

SEQ ID NO: 6555 - DNA, 103 bp, Artificial Sequence
  Synthetic Polynucleotide
taatacgactcactatagggtgaaggttagttgttactattaaaactctgaacagaggagacagagtatgaatagtaacaacctggcggcagcgcaaaagatg

SEQ ID NO: 6556 - DNA, 103 bp, Artificial Sequence
  Synthetic Polynucleotide
taatacgactcactatagggaatcttgaaggttagttgttactattaaaaaacagaggagattttaaatgtaacaactaaacctggcggcagcgcaaaagatg

SEQ ID NO: 6557 - DNA, 103 bp, Artificial Sequence
  Synthetic Polynucleotide
taatacgactcactatagggtgagaaatcttgaaggttagttgttactataacagaggagaatagtaatgactaaccttaacctggcggcagcgcaaaagatg

SEQ ID NO: 6558 - DNA, 103 bp, Artificial Sequence
  Synthetic Polynucleotide
taatacgactcactatagggattggtgagaaatcttgaaggttagttgttaacagaggagaaacaacatgccttcaagaaacctggcggcagcgcaaaagatg

SEQ ID NO: 6559 - DNA, 103 bp, Artificial Sequence
  Synthetic Polynucleotide
taatacgactcactatagggttgtaattggtgagaaatcttgaaggttagaacagaggagactaaccatgaagatttctaacctggcggcagcgcaaaagatg

SEQ ID NO: 6560 - DNA, 103 bp, Artificial Sequence
  Synthetic Polynucleotide
taatacgactcactatagggtgagattgtaattggtgagaaatcttgaagaacagaggagacttcaaatgttctcaccaaacctggcggcagcgcaaaagatg

SEQ ID NO: 6561 - DNA, 103 bp, Artificial Sequence
  Synthetic Polynucleotide
taatacgactcactatagggttcctaatcacaaaactatgcaggggggagaacagaggagactccccatggcatagtttaacctggcggcagcgcaaaagatg

SEQ ID NO: 6562 - DNA, 103 bp, Artificial Sequence
  Synthetic Polynucleotide
taatacgactcactataggggggtctgagattgtaattggtgagaaatctaacagaggagaagatttatgaccaattacaacctggcggcagcgcaaaagatg

SEQ ID NO: 6563 - DNA, 103 bp, Artificial Sequence
  Synthetic Polynucleotide
taatacgactcactatagggcgcgagggtctgagattgtaattggtgagaaacagaggagatctcacatgttacaatctaacctggcggcagcgcaaaagatg

SEQ ID NO: 6564 - DNA, 103 bp, Artificial Sequence
  Synthetic Polynucleotide
taatacgactcactatagggcaacgcgcgagggtctgagattgtaattggaacagaggagaccaattatgatctcagacaacctggcggcagcgcaaaagatg

SEQ ID NO: 6565 - DNA, 103 bp, Artificial Sequence
  Synthetic Polynucleotide
taatacgactcactatagggctttccaacgcgcgagggtctgagattgtaaacagaggagatacaatatgagaccctcgaacctggcggcagcgcaaaagatg

SEQ ID NO: 6566 - DNA, 103 bp, Artificial Sequence
  Synthetic Polynucleotide
taatacgactcactatagggtgcgtctttccaacgcgcgagggtctgagaaacagaggagatctcagatgctcgcgcgtaacctggcggcagcgcaaaagatg

SEQ ID NO: 6567 - DNA, 103 bp, Artificial Sequence
  Synthetic Polynucleotide
taatacgactcactatagggggttatgcgtctttccaacgcgcgagggtcaacagaggagagaccctatggcgttggaaaacctggcggcagcgcaaaagatg

SEQ ID NO: 6568 - DNA, 103 bp, Artificial Sequence
  Synthetic Polynucleotide
taatacgactcactatagggtcaaaggttatgcgtctttccaacgcgcgaaacagaggagatcgcgcatgggaaagacgaacctggcggcagcgcaaaagatg

SEQ ID NO: 6569 - DNA, 103 bp, Artificial Sequence
  Synthetic Polynucleotide
taatacgactcactatagggatatgtcaaaggttatgcgtctttccaacgaacagaggagacgttggatggacgcataaaacctggcggcagcgcaaaagatg

SEQ ID NO: 6570 - DNA, 103 bp, Artificial Sequence
  Synthetic Polynucleotide
taatacgactcactatagggaaccaatatgtcaaaggttatgcgtctttcaacagaggagagaaagaatgataacctttaacctggcggcagcgcaaaagatg

SEQ ID NO: 6571 - DNA, 103 bp, Artificial Sequence
  Synthetic Polynucleotide
taatacgactcactatagggggtgaaaccaatatgtcaaaggttatgcgtaacagaggagaacgcatatgctttgacataacctggcggcagcgcaaaagatg

SEQ ID NO: 6572 - DNA, 103 bp, Artificial Sequence
  Synthetic Polynucleotide
taatacgactcactatagggcacccactgccatataaggtagacgtcaaaaacagaggagatttgacatgtaccttataaacctggcggcagcgcaaaagatg

SEQ ID NO: 6573 - DNA, 103 bp, Artificial Sequence
  Synthetic Polynucleotide
taatacgactcactatagggtcaagttcctaatcacaaaactatgcagggaacagaggagaccctgcatggttttgtgaaacctggcggcagcgcaaaagatg

SEQ ID NO: 6574 - DNA, 103 bp, Artificial Sequence
  Synthetic Polynucleotide
taatacgactcactataggggtccgggtgaaaccaatatgtcaaaggttaaacagaggagataacctatgacatattggaacctggcggcagcgcaaaagatg

SEQ ID NO: 6575 - DNA, 103 bp, Artificial Sequence
  Synthetic Polynucleotide
taatacgactcactatagggtgcaggtccgggtgaaaccaatatgtcaaaaacagaggagatttgacatgttggtttcaaacctggcggcagcgcaaaagatg

SEQ ID NO: 6576 - DNA, 103 bp, Artificial Sequence
  Synthetic Polynucleotide
taatacgactcactataggggttgctgcaggtccgggtgaaaccaatatgaacagaggagacatattatgttcacccggaacctggcggcagcgcaaaagatg

SEQ ID NO: 6577 - DNA, 103 bp, Artificial Sequence
  Synthetic Polynucleotide
taatacgactcactatagggtgcgagttgctgcaggtccgggtgaaaccaaacagaggagatggtttatgccggacctgaacctggcggcagcgcaaaagatg

SEQ ID NO: 6578 - DNA, 103 bp, Artificial Sequence
  Synthetic Polynucleotide
taatacgactcactatagggcccgttgcgagttgctgcaggtccgggtgaaacagaggagatcacccatgcctgcagcaaacctggcggcagcgcaaaagatg

SEQ ID NO: 6579 - DNA, 103 bp, Artificial Sequence
  Synthetic Polynucleotide
taatacgactcactatagggaatttcccgttgcgagttgctgcaggtccgaacagaggagacggaccatgagcaactcgaacctggcggcagcgcaaaagatg

SEQ ID NO: 6580 - DNA, 103 bp, Artificial Sequence
  Synthetic Polynucleotide
taatacgactcactatagggagtccaatttcccgttgcgagttgctgcagaacagaggagactgcagatgctcgcaacgaacctggcggcagcgcaaaagatg

SEQ ID NO: 6581 - DNA, 103 bp, Artificial Sequence
  Synthetic Polynucleotide
taatacgactcactatagggggccaagtccaatttcccgttgcgagttgcaacagaggagagcaactatgaacgggaaaaacctggcggcagcgcaaaagatg

SEQ ID NO: 6582 - DNA, 103 bp, Artificial Sequence
  Synthetic Polynucleotide
taatacgactcactataggggctctggccaagtccaatttcccgttgcgaaacagaggagatcgcaaatggaaattggaaacctggcggcagcgcaaaagatg

SEQ ID NO: 6583 - DNA, 103 bp, Artificial Sequence
  Synthetic Polynucleotide
taatacgactcactatagggggagtgctctggccaagtccaatttcccgtaacagaggagaacgggaatgtggacttggaacctggcggcagcgcaaaagatg

SEQ ID NO: 6584 - DNA, 103 bp, Artificial Sequence
  Synthetic Polynucleotide
taatacgactcactatagggattcctcaagttcctaatcacaaaactatgaacagaggagacatagtatggtgattaggaacctggcggcagcgcaaaagatg

SEQ ID NO: 6585 - DNA, 103 bp, Artificial Sequence
  Synthetic Polynucleotide
taatacgactcactatagggcggttggagtgctctggccaagtccaatttaacagaggagaaaattgatgttggccagaaacctggcggcagcgcaaaagatg

SEQ ID NO: 6586 - DNA, 103 bp, Artificial Sequence
  Synthetic Polynucleotide
taatacgactcactatagggccgtccggttggagtgctctggccaagtccaacagaggagaggacttatgcagagcactaacctggcggcagcgcaaaagatg

SEQ ID NO: 6587 - DNA, 103 bp, Artificial Sequence
  Synthetic Polynucleotide
taatacgactcactatagggctgggccgtccggttggagtgctctggccaaacagaggagatggccaatgcactccaacaacctggcggcagcgcaaaagatg

SEQ ID NO: 6588 - DNA, 103 bp, Artificial Sequence
  Synthetic Polynucleotide
taatacgactcactatagggttctcctgggccgtccggttggagtgctctaacagaggagaagagcaatgcaaccggacaacctggcggcagcgcaaaagatg

SEQ ID NO: 6589 - DNA, 103 bp, Artificial Sequence
  Synthetic Polynucleotide
taatacgactcactatagggggtccttctcctgggccgtccggttggagtaacagaggagaactccaatgggacggcccaacctggcggcagcgcaaaagatg

SEQ ID NO: 6590 - DNA, 103 bp, Artificial Sequence
  Synthetic Polynucleotide
taatacgactcactatagggtaaaaggtccttctcctgggccgtccggttaacagaggagaaaccggatggcccaggagaacctggcggcagcgcaaaagatg

SEQ ID NO: 6591 - DNA, 103 bp, Artificial Sequence
  Synthetic Polynucleotide
taatacgactcactatagggattggtaaaaggtccttctcctgggccgtcaacagaggagagacggcatgggagaaggaaacctggcggcagcgcaaaagatg

SEQ ID NO: 6592 - DNA, 103 bp, Artificial Sequence
  Synthetic Polynucleotide
taatacgactcactatagggcaatcattggtaaaaggtccttctcctgggaacagaggagacccaggatgaggacctttaacctggcggcagcgcaaaagatg

SEQ ID NO: 6593 - DNA, 103 bp, Artificial Sequence
  Synthetic Polynucleotide
taatacgactcactatagggacgcacaatcattggtaaaaggtccttctcaacagaggagagagaagatgcttttaccaaacctggcggcagcgcaaaagatg

SEQ ID NO: 6594 - DNA, 103 bp, Artificial Sequence
  Synthetic Polynucleotide
taatacgactcactatagggcaataacgcacaatcattggtaaaaggtccaacagaggagaggacctatgaccaatgataacctggcggcagcgcaaaagatg

SEQ ID NO: 6595 - DNA, 103 bp, Artificial Sequence
  Synthetic Polynucleotide
taatacgactcactatagggcagaaattcctcaagttcctaatcacaaaaaacagaggagattttgtatgtaggaacttaacctggcggcagcgcaaaagatg

SEQ ID NO: 6596 - DNA, 103 bp, Artificial Sequence
  Synthetic Polynucleotide
taatacgactcactataggggtgtgcaataacgcacaatcattggtaaaaaacagaggagattttacatgtgattgtgcaacctggcggcagcgcaaaagatg

SEQ ID NO: 6597 - DNA, 103 bp, Artificial Sequence
  Synthetic Polynucleotide
taatacgactcactatagggctgtagtgtgcaataacgcacaatcattggaacagaggagaccaatgatggtgcgttataacctggcggcagcgcaaaagatg

SEQ ID NO: 6598 - DNA, 103 bp, Artificial Sequence
  Synthetic Polynucleotide
taatacgactcactatagggcaagcctgtagtgtgcaataacgcacaatcaacagaggagagattgtatgttattgcacaacctggcggcagcgcaaaagatg

SEQ ID NO: 6599 - DNA, 103 bp, Artificial Sequence
  Synthetic Polynucleotide
taatacgactcactatagggaaattcaagcctgtagtgtgcaataacgcaaacagaggagatgcgttatggcacactacaacctggcggcagcgcaaaagatg

SEQ ID NO: 6600 - DNA, 103 bp, Artificial Sequence
  Synthetic Polynucleotide
taatacgactcactatagggtcttcaaattcaagcctgtagtgtgcaataaacagaggagatattgcatgctacaggctaacctggcggcagcgcaaaagatg

SEQ ID NO: 6601 - DNA, 103 bp, Artificial Sequence
  Synthetic Polynucleotide
taatacgactcactatagggcaaattcttcaaattcaagcctgtagtgtgaacagaggagacacactatgggcttgaataacctggcggcagcgcaaaagatg

SEQ ID NO: 6602 - DNA, 103 bp, Artificial Sequence
  Synthetic Polynucleotide
taatacgactcactatagggttcctcaaattcttcaaattcaagcctgtaaacagaggagatacaggatggaatttgaaaacctggcggcagcgcaaaagatg

SEQ ID NO: 6603 - DNA, 103 bp, Artificial Sequence
  Synthetic Polynucleotide
taatacgactcactatagggttccattcctcaaattcttcaaattcaagcaacagaggagagcttgaatgtgaagaattaacctggcggcagcgcaaaagatg

SEQ ID NO: 6604 - DNA, 103 bp, Artificial Sequence
  Synthetic Polynucleotide
taatacgactcactatagggttcttttccattcctcaaattcttcaaattaacagaggagaaatttgatgaatttgaggaacctggcggcagcgcaaaagatg

SEQ ID NO: 6605 - DNA, 103 bp, Artificial Sequence
  Synthetic Polynucleotide
taatacgactcactatagggttgaattcttttccattcctcaaattcttcaacagaggagagaagaaatggaggaatggaacctggcggcagcgcaaaagatg

SEQ ID NO: 6606 - DNA, 103 bp, Artificial Sequence
  Synthetic Polynucleotide
taatacgactcactatagggtatgacagaaattcctcaagttcctaatcaaacagaggagatgattaatgacttgaggaaacctggcggcagcgcaaaagatg

SEQ ID NO: 6607 - DNA, 103 bp, Artificial Sequence
  Synthetic Polynucleotide
taatacgactcactatagggccaagttgaattcttttccattcctcaaataacagaggagaatttgaatgatggaaaagaacctggcggcagcgcaaaagatg

SEQ ID NO: 6608 - DNA, 103 bp, Artificial Sequence
  Synthetic Polynucleotide
taatacgactcactatagggatccaccaagttgaattcttttccattcctaacagaggagaaggaatatgaaagaattcaacctggcggcagcgcaaaagatg

SEQ ID NO: 6609 - DNA, 103 bp, Artificial Sequence
  Synthetic Polynucleotide
taatacgactcactatagggaccagatccaccaagttgaattcttttccaaacagaggagatggaaaatgattcaacttaacctggcggcagcgcaaaagatg

SEQ ID NO: 6610 - DNA, 103 bp, Artificial Sequence
  Synthetic Polynucleotide
taatacgactcactatagggtttctaccagatccaccaagttgaattcttaacagaggagaaagaatatgacttggtggaacctggcggcagcgcaaaagatg

SEQ ID NO: 6611 - DNA, 103 bp, Artificial Sequence
  Synthetic Polynucleotide
taatacgactcactatagggagtcttttctaccagatccaccaagttgaaaacagaggagattcaacatggtggatctgaacctggcggcagcgcaaaagatg

SEQ ID NO: 6612 - DNA, 103 bp, Artificial Sequence
  Synthetic Polynucleotide
taatacgactcactatagggttgacagtcttttctaccagatccaccaagaacagaggagacttggtatgtctggtagaaacctggcggcagcgcaaaagatg

SEQ ID NO: 6613 - DNA, 103 bp, Artificial Sequence
  Synthetic Polynucleotide
taatacgactcactatagggccttcttgacagtcttttctaccagatccaaacagaggagatggatcatgtagaaaagaaacctggcggcagcgcaaaagatg

SEQ ID NO: 6614 - DNA, 103 bp, Artificial Sequence
  Synthetic Polynucleotide
taatacgactcactatagggttgcaccttcttgacagtcttttctaccagaacagaggagactggtaatgaagactgtcaacctggcggcagcgcaaaagatg

SEQ ID NO: 6615 - DNA, 103 bp, Artificial Sequence
  Synthetic Polynucleotide
taatacgactcactatagggttttcttgcaccttcttgacagtcttttctaacagaggagaagaaaaatgtgtcaagaaaacctggcggcagcgcaaaagatg

SEQ ID NO: 6616 - DNA, 103 bp, Artificial Sequence
  Synthetic Polynucleotide
taatacgactcactatagggtcttcttttcttgcaccttcttgacagtctaacagaggagaagactgatgagaaggtgcaacctggcggcagcgcaaaagatg

SEQ ID NO: 6617 - DNA, 103 bp, Artificial Sequence
  Synthetic Polynucleotide
taatacgactcactatagggagatttatgacagaaattcctcaagttcctaacagaggagaaggaacatgaggaatttcaacctggcggcagcgcaaaagatg

SEQ ID NO: 6618 - DNA, 103 bp, Artificial Sequence
  Synthetic Polynucleotide
taatacgactcactatagggcacagtcttcttttcttgcaccttcttgacaacagaggagagtcaagatggtgcaagaaaacctggcggcagcgcaaaagatg

SEQ ID NO: 6619 - DNA, 103 bp, Artificial Sequence
  Synthetic Polynucleotide
taatacgactcactatagggccacacacagtcttcttttcttgcaccttcaacagaggagagaaggtatgagaaaagaaaacctggcggcagcgcaaaagatg

SEQ ID NO: 6620 - DNA, 103 bp, Artificial Sequence
  Synthetic Polynucleotide
taatacgactcactatagggacataccacacacagtcttcttttcttgcaaacagaggagatgcaagatgagaagactgaacctggcggcagcgcaaaagatg

SEQ ID NO: 6621 - DNA, 103 bp, Artificial Sequence
  Synthetic Polynucleotide
taatacgactcactatagggttctaacataccacacacagtcttcttttcaacagaggagagaaaagatgactgtgtgtaacctggcggcagcgcaaaagatg

SEQ ID NO: 6622 - DNA, 103 bp, Artificial Sequence
  Synthetic Polynucleotide
taatacgactcactatagggagaccttctaacataccacacacagtcttcaacagaggagagaagacatggtgtggtataacctggcggcagcgcaaaagatg

SEQ ID NO: 6623 - DNA, 103 bp, Artificial Sequence
  Synthetic Polynucleotide
taatacgactcactatagggcaactagaccttctaacataccacacacagaacagaggagactgtgtatggtatgttagaacctggcggcagcgcaaaagatg

SEQ ID NO: 6624 - DNA, 103 bp, Artificial Sequence
  Synthetic Polynucleotide
taatacgactcactatagggttgaacaactagaccttctaacataccacaaacagaggagatgtggtatgttagaaggtaacctggcggcagcgcaaaagatg

SEQ ID NO: 6625 - DNA, 103 bp, Artificial Sequence
  Synthetic Polynucleotide
taatacgactcactataggggggctttgaacaactagaccttctaacataaacagaggagatatgttatgaggtctagtaacctggcggcagcgcaaaagatg

SEQ ID NO: 6626 - DNA, 103 bp, Artificial Sequence
  Synthetic Polynucleotide
taatacgactcactataggggatttgggctttgaacaactagaccttctaaacagaggagatagaagatgtagttgttcaacctggcggcagcgcaaaagatg

SEQ ID NO: 6627 - DNA, 103 bp, Artificial Sequence
  Synthetic Polynucleotide
taatacgactcactatagggtattagatttgggctttgaacaactagaccaacagaggagaggtctaatggttcaaagcaacctggcggcagcgcaaaagatg

SEQ ID NO: 6628 - DNA, 103 bp, Artificial Sequence
  Synthetic Polynucleotide
taatacgactcactataggggatagagatttatgacagaaattcctcaagaacagaggagacttgagatgtttctgtcaaacctggcggcagcgcaaaagatg

SEQ ID NO: 6629 - DNA, 103 bp, Artificial Sequence
  Synthetic Polynucleotide
taatacgactcactatagggcctactattagatttgggctttgaacaactaacagaggagaagttgtatgaagcccaaaaacctggcggcagcgcaaaagatg

SEQ ID NO: 6630 - DNA, 103 bp, Artificial Sequence
  Synthetic Polynucleotide
taatacgactcactatagggtataccctactattagatttgggctttgaaaacagaggagattcaaaatgcaaatctaaaacctggcggcagcgcaaaagatg

SEQ ID NO: 6631 - DNA, 103 bp, Artificial Sequence
  Synthetic Polynucleotide
taatacgactcactatagggcttagtataccctactattagatttgggctaacagaggagaagcccaatgctaatagtaaacctggcggcagcgcaaaagatg

SEQ ID NO: 6632 - DNA, 103 bp, Artificial Sequence
  Synthetic Polynucleotide
taatacgactcactatagggtcatccttagtataccctactattagatttaacagaggagaaaatctatgagtagggtaaacctggcggcagcgcaaaagatg

SEQ ID NO: 6633 - DNA, 103 bp, Artificial Sequence
  Synthetic Polynucleotide
taatacgactcactatagggcatcatcatccttagtataccctactattaaacagaggagataatagatgggtatactaaacctggcggcagcgcaaaagatg

SEQ ID NO: 6634 - DNA, 103 bp, Artificial Sequence
  Synthetic Polynucleotide
taatacgactcactatagggaacaccatcatcatccttagtataccctacaacagaggagagtagggatgactaaggataacctggcggcagcgcaaaagatg

SEQ ID NO: 6635 - DNA, 103 bp, Artificial Sequence
  Synthetic Polynucleotide
taatacgactcactatagggatgacaacaccatcatcatccttagtatacaacagaggagagtatacatgggatgatgaaacctggcggcagcgcaaaagatg

SEQ ID NO: 6636 - DNA, 103 bp, Artificial Sequence
  Synthetic Polynucleotide
taatacgactcactatagggcaacaatgacaacaccatcatcatccttagaacagaggagactaaggatgatgatggtgaacctggcggcagcgcaaaagatg

SEQ ID NO: 6637 - DNA, 103 bp, Artificial Sequence
  Synthetic Polynucleotide
taatacgactcactatagggagagtcaacaatgacaacaccatcatcatcaacagaggagagatgatatgggtgttgtcaacctggcggcagcgcaaaagatg

SEQ ID NO: 6638 - DNA, 103 bp, Artificial Sequence
  Synthetic Polynucleotide
taatacgactcactatagggtctagagagtcaacaatgacaacaccatcaaacagaggagatgatggatgtgtcattgtaacctggcggcagcgcaaaagatg

SEQ ID NO: 6639 - DNA, 103 bp, Artificial Sequence
  Synthetic Polynucleotide
taatacgactcactataggggatgtgatagagatttatgacagaaattccaacagaggagaggaattatggtcataaataacctggcggcagcgcaaaagatg

SEQ ID NO: 6640 - DNA, 103 bp, Artificial Sequence
  Synthetic Polynucleotide
taatacgactcactatagggattcttctagagagtcaacaatgacaacacaacagaggagagtgttgatgttgttgactaacctggcggcagcgcaaaagatg

SEQ ID NO: 6641 - DNA, 103 bp, Artificial Sequence
  Synthetic Polynucleotide
taatacgactcactataggggtgccattcttctagagagtcaacaatgacaacagaggagagtcattatggactctctaaacctggcggcagcgcaaaagatg

SEQ ID NO: 6642 - DNA, 103 bp, Artificial Sequence
  Synthetic Polynucleotide
taatacgactcactatagggattttgtgccattcttctagagagtcaacaaacagaggagatgttgaatgtctagaagaaacctggcggcagcgcaaaagatg

SEQ ID NO: 6643 - DNA, 103 bp, Artificial Sequence
  Synthetic Polynucleotide
taatacgactcactatagggcctggattttgtgccattcttctagagagtaacagaggagaactctcatgaagaatggcaacctggcggcagcgcaaaagatg

SEQ ID NO: 6644 - DNA, 103 bp, Artificial Sequence
  Synthetic Polynucleotide
taatacgactcactatagggcttgtcctggattttgtgccattcttctagaacagaggagactagaaatgtggcacaaaaacctggcggcagcgcaaaagatg

SEQ ID NO: 6645 - DNA, 103 bp, Artificial Sequence
  Synthetic Polynucleotide
taatacgactcactatagggcttttcttgtcctggattttgtgccattctaacagaggagaagaatgatgcaaaatccaaacctggcggcagcgcaaaagatg

SEQ ID NO: 6646 - DNA, 103 bp, Artificial Sequence
  Synthetic Polynucleotide
taatacgactcactataggggtttccttttcttgtcctggattttgtgccaacagaggagaggcacaatgtccaggacaaacctggcggcagcgcaaaagatg

SEQ ID NO: 6647 - DNA, 103 bp, Artificial Sequence
  Synthetic Polynucleotide
taatacgactcactatagggttgttgtttccttttcttgtcctggattttaacagaggagaaaaatcatggacaagaaaaacctggcggcagcgcaaaagatg

SEQ ID NO: 6648 - DNA, 103 bp, Artificial Sequence
  Synthetic Polynucleotide
taatacgactcactatagggagaacttgttgtttccttttcttgtcctggaacagaggagaccaggaatggaaaaggaaaacctggcggcagcgcaaaagatg

SEQ ID NO: 6649 - DNA, 103 bp, Artificial Sequence
  Synthetic Polynucleotide
taatacgactcactatagggtctcaagaacttgttgtttccttttcttgtaacagaggagaacaagaatgggaaacaacaacctggcggcagcgcaaaagatg

SEQ ID NO: 6650 - DNA, 103 bp, Artificial Sequence
  Synthetic Polynucleotide
taatacgactcactatagggggcctgatgtgatagagatttatgacagaaaacagaggagattctgtatgaaatctctaaacctggcggcagcgcaaaagatg

SEQ ID NO: 6651 - DNA, 103 bp, Artificial Sequence
  Synthetic Polynucleotide
taatacgactcactataggggattgtctcaagaacttgttgtttccttttaacagaggagaaaaaggatgcaacaagttaacctggcggcagcgcaaaagatg

SEQ ID NO: 6652 - DNA, 103 bp, Artificial Sequence
  Synthetic Polynucleotide
taatacgactcactatagggtctgagattgtctcaagaacttgttgtttcaacagaggagagaaacaatgagttcttgaaacctggcggcagcgcaaaagatg

SEQ ID NO: 6653 - DNA, 103 bp, Artificial Sequence
  Synthetic Polynucleotide
taatacgactcactataggggctcttctgagattgtctcaagaacttgttaacagaggagaaacaagatgttgagacaaaacctggcggcagcgcaaaagatg

SEQ ID NO: 6654 - DNA, 103 bp, Artificial Sequence
  Synthetic Polynucleotide
taatacgactcactataggggtcgagctcttctgagattgtctcaagaacaacagaggagagttcttatgacaatctcaaacctggcggcagcgcaaaagatg

SEQ ID NO: 6655 - DNA, 103 bp, Artificial Sequence
  Synthetic Polynucleotide
taatacgactcactatagggcttttgtcgagctcttctgagattgtctcaaacagaggagatgagacatgctcagaagaaacctggcggcagcgcaaaagatg

SEQ ID NO: 6656 - DNA, 103 bp, Artificial Sequence
  Synthetic Polynucleotide
taatacgactcactatagggtgtgtcttttgtcgagctcttctgagattgaacagaggagacaatctatgaagagctcgaacctggcggcagcgcaaaagatg

SEQ ID NO: 6657 - DNA, 103 bp, Artificial Sequence
  Synthetic Polynucleotide
taatacgactcactatagggttctttgtgtcttttgtcgagctcttctgaaacagaggagatcagaaatgctcgacaaaaacctggcggcagcgcaaaagatg

SEQ ID NO: 6658 - DNA, 103 bp, Artificial Sequence
  Synthetic Polynucleotide
taatacgactcactatagggtggtgttctttgtgtcttttgtcgagctctaacagaggagaagagctatgcaaaagacaaacctggcggcagcgcaaaagatg

SEQ ID NO: 6659 - DNA, 103 bp, Artificial Sequence
  Synthetic Polynucleotide
taatacgactcactatagggattgctggtgttctttgtgtcttttgtcgaaacagaggagatcgacaatggacacaaagaacctggcggcagcgcaaaagatg

SEQ ID NO: 6660 - DNA, 103 bp, Artificial Sequence
  Synthetic Polynucleotide
taatacgactcactatagggccagaattgctggtgttctttgtgtcttttaacagaggagaaaaagaatgaaagaacacaacctggcggcagcgcaaaagatg

SEQ ID NO: 6661 - DNA, 103 bp, Artificial Sequence
  Synthetic Polynucleotide
taatacgactcactatagggtttggggcctgatgtgatagagatttatgaaacagaggagatcataaatgtctatcacaaacctggcggcagcgcaaaagatg

SEQ ID NO: 6662 - DNA, 103 bp, Artificial Sequence
  Synthetic Polynucleotide
taatacgactcactatagggagaagccagaattgctggtgttctttgtgtaacagaggagaacacaaatgacaccagcaaacctggcggcagcgcaaaagatg

SEQ ID NO: 6663 - DNA, 103 bp, Artificial Sequence
  Synthetic Polynucleotide
taatacgactcactatagggtcataagaagccagaattgctggtgttcttaacagaggagaaagaacatgagcaattctaacctggcggcagcgcaaaagatg

SEQ ID NO: 6664 - DNA, 103 bp, Artificial Sequence
  Synthetic Polynucleotide
taatacgactcactatagggttgtttcataagaagccagaattgctggtgaacagaggagacaccagatgttctggcttaacctggcggcagcgcaaaagatg

SEQ ID NO: 6665 - DNA, 103 bp, Artificial Sequence
  Synthetic Polynucleotide
taatacgactcactatagggacaaattgtttcataagaagccagaattgcaacagaggagagcaattatggcttcttataacctggcggcagcgcaaaagatg

SEQ ID NO: 6666 - DNA, 103 bp, Artificial Sequence
  Synthetic Polynucleotide
taatacgactcactatagggctgatacaaattgtttcataagaagccagaaacagaggagatctggcatgttatgaaacaacctggcggcagcgcaaaagatg

SEQ ID NO: 6667 - DNA, 103 bp, Artificial Sequence
  Synthetic Polynucleotide
taatacgactcactatagggtaaagctgatacaaattgtttcataagaagaacagaggagacttcttatgaaacaatttaacctggcggcagcgcaaaagatg

SEQ ID NO: 6668 - DNA, 103 bp, Artificial Sequence
  Synthetic Polynucleotide
taatacgactcactatagggacacctaaagctgatacaaattgtttcataaacagaggagatatgaaatgatttgtatcaacctggcggcagcgcaaaagatg

SEQ ID NO: 6669 - DNA, 103 bp, Artificial Sequence
  Synthetic Polynucleotide
taatacgactcactatagggcaagaacacctaaagctgatacaaattgttaacagaggagaaacaatatgtatcagcttaacctggcggcagcgcaaaagatg

SEQ ID NO: 6670 - DNA, 103 bp, Artificial Sequence
  Synthetic Polynucleotide
taatacgactcactatagggggcagcaagaacacctaaagctgatacaaaaacagaggagatttgtaatggctttaggtaacctggcggcagcgcaaaagatg

SEQ ID NO: 6671 - DNA, 103 bp, Artificial Sequence
  Synthetic Polynucleotide
taatacgactcactatagggcctacggcagcaagaacacctaaagctgataacagaggagaatcagcatgaggtgttctaacctggcggcagcgcaaaagatg

SEQ ID NO: 6672 - DNA, 103 bp, Artificial Sequence
  Synthetic Polynucleotide
taatacgactcactatagggacatctttggggcctgatgtgatagagattaacagaggagaaatctcatgcacatcaggaacctggcggcagcgcaaaagatg

SEQ ID NO: 6673 - DNA, 103 bp, Artificial Sequence
  Synthetic Polynucleotide
taatacgactcactatagggctgcacctacggcagcaagaacacctaaagaacagaggagactttagatgttcttgctgaacctggcggcagcgcaaaagatg

SEQ ID NO: 6674 - DNA, 103 bp, Artificial Sequence
  Synthetic Polynucleotide
taatacgactcactatagggataggctgcacctacggcagcaagaacaccaacagaggagaggtgttatggctgccgtaaacctggcggcagcgcaaaagatg

SEQ ID NO: 6675 - DNA, 103 bp, Artificial Sequence
  Synthetic Polynucleotide
taatacgactcactataggggtgccataggctgcacctacggcagcaagaaacagaggagatcttgcatgcgtaggtgcaacctggcggcagcgcaaaagatg

SEQ ID NO: 6676 - DNA, 103 bp, Artificial Sequence
  Synthetic Polynucleotide
taatacgactcactatagggtatatgtgccataggctgcacctacggcagaacagaggagactgccgatggtgcagcctaacctggcggcagcgcaaaagatg

SEQ ID NO: 6677 - DNA, 103 bp, Artificial Sequence
  Synthetic Polynucleotide
taatacgactcactatagggatacttatatgtgccataggctgcacctacaacagaggagagtaggtatggcctatggcaacctggcggcagcgcaaaagatg

SEQ ID NO: 6678 - DNA, 103 bp, Artificial Sequence
  Synthetic Polynucleotide
taatacgactcactataggggagaaatacttatatgtgccataggctgcaaacagaggagatgcagcatgtggcacataaacctggcggcagcgcaaaagatg

SEQ ID NO: 6679 - DNA, 103 bp, Artificial Sequence
  Synthetic Polynucleotide
taatacgactcactatagggccttggagaaatacttatatgtgccataggaacagaggagacctatgatgcatataagtaacctggcggcagcgcaaaagatg

SEQ ID NO: 6680 - DNA, 103 bp, Artificial Sequence
  Synthetic Polynucleotide
taatacgactcactatagggtttttccttggagaaatacttatatgtgccaacagaggagaggcacaatgaagtatttcaacctggcggcagcgcaaaagatg

SEQ ID NO: 6681 - DNA, 103 bp, Artificial Sequence
  Synthetic Polynucleotide
taatacgactcactatagggggttgtttttccttggagaaatacttatataacagaggagaatataaatgtttctccaaaacctggcggcagcgcaaaagatg

SEQ ID NO: 6682 - DNA, 103 bp, Artificial Sequence
  Synthetic Polynucleotide
taatacgactcactatagggcctctggttgtttttccttggagaaatactaacagaggagaagtattatgccaaggaaaaacctggcggcagcgcaaaagatg

SEQ ID NO: 6683 - DNA, 103 bp, Artificial Sequence
  Synthetic Polynucleotide
taatacgactcactatagggtgggtgggatcaacccacaggctgttttaaaacagaggagattaaaaatgcctgtgggtaacctggcggcagcgcaaaagatg

SEQ ID NO: 6684 - DNA, 103 bp, Artificial Sequence
  Synthetic Polynucleotide
taatacgactcactatagggacaaaggtaccgtgataccagagtgctagcaacagaggagagctagcatgctggtatcaaacctggcggcagcgcaaaagatg

SEQ ID NO: 6685 - DNA, 103 bp, Artificial Sequence
  Synthetic Polynucleotide
taatacgactcactataggggcccgttacgacacactgccctctggcttgaacagaggagacaagccatggggcagtgtaacctggcggcagcgcaaaagatg

SEQ ID NO: 6686 - DNA, 103 bp, Artificial Sequence
  Synthetic Polynucleotide
taatacgactcactatagggaacagtgcctcaagcgtggtccccacgctaaacagaggagatagcgtatggaccacgctaacctggcggcagcgcaaaagatg

SEQ ID NO: 6687 - DNA, 103 bp, Artificial Sequence
  Synthetic Polynucleotide
taatacgactcactatagggcctggaacagtgcctcaagcgtggtccccaaacagaggagatggggaatgcgcttgaggaacctggcggcagcgcaaaagatg

SEQ ID NO: 6688 - DNA, 103 bp, Artificial Sequence
  Synthetic Polynucleotide
taatacgactcactatagggtggtccctggaacagtgcctcaagcgtggtaacagaggagaaccacgatggaggcactgaacctggcggcagcgcaaaagatg

SEQ ID NO: 6689 - DNA, 103 bp, Artificial Sequence
  Synthetic Polynucleotide
taatacgactcactatagggactggtggtccctggaacagtgcctcaagcaacagaggagagcttgaatgactgttccaaacctggcggcagcgcaaaagatg

SEQ ID NO: 6690 - DNA, 103 bp, Artificial Sequence
  Synthetic Polynucleotide
taatacgactcactatagggtgtatactggtggtccctggaacagtgcctaacagaggagaaggcacatgtccagggacaacctggcggcagcgcaaaagatg

SEQ ID NO: 6691 - DNA, 103 bp, Artificial Sequence
  Synthetic Polynucleotide
taatacgactcactatagggctctctgtatactggtggtccctggaacagaacagaggagactgttcatgggaccaccaaacctggcggcagcgcaaaagatg

SEQ ID NO: 6692 - DNA, 103 bp, Artificial Sequence
  Synthetic Polynucleotide
taatacgactcactatagggttgatctctctgtatactggtggtccctggaacagaggagaccagggatgaccagtataaacctggcggcagcgcaaaagatg

SEQ ID NO: 6693 - DNA, 103 bp, Artificial Sequence
  Synthetic Polynucleotide
taatacgactcactatagggtaattttgatctctctgtatactggtggtcaacagaggagagaccacatgtatacagagaacctggcggcagcgcaaaagatg

SEQ ID NO: 6694 - DNA, 103 bp, Artificial Sequence
  Synthetic Polynucleotide
taatacgactcactatagggaacgctaattttgatctctctgtatactggaacagaggagaccagtaatgagagagatcaacctggcggcagcgcaaaagatg

SEQ ID NO: 6695 - DNA, 103 bp, Artificial Sequence
  Synthetic Polynucleotide
taatacgactcactatagggggtgcaacgctaattttgatctctctgtataacagaggagaatacagatggatcaaaataacctggcggcagcgcaaaagatg

SEQ ID NO: 6696 - DNA, 103 bp, Artificial Sequence
  Synthetic Polynucleotide
taatacgactcactataggggagttgcccgttacgacacactgccctctgaacagaggagacagaggatggtgtgtcgtaacctggcggcagcgcaaaagatg

SEQ ID NO: 6697 - DNA, 103 bp, Artificial Sequence
  Synthetic Polynucleotide
taatacgactcactatagggtctctggtgcaacgctaattttgatctctcaacagaggagagagagaatgaaattagcgaacctggcggcagcgcaaaagatg

SEQ ID NO: 6698 - DNA, 103 bp, Artificial Sequence
  Synthetic Polynucleotide
taatacgactcactatagggtggtgtctctggtgcaacgctaattttgataacagaggagaatcaaaatgagcgttgcaaacctggcggcagcgcaaaagatg

SEQ ID NO: 6699 - DNA, 103 bp, Artificial Sequence
  Synthetic Polynucleotide
taatacgactcactatagggggtggtggtgtctctggtgcaacgctaattaacagaggagaaattagatgtgcaccagaaacctggcggcagcgcaaaagatg

SEQ ID NO: 6700 - DNA, 103 bp, Artificial Sequence
  Synthetic Polynucleotide
taatacgactcactatagggcgggcggtggtggtgtctctggtgcaacgcaacagaggagagcgttgatgcagagacacaacctggcggcagcgcaaaagatg

SEQ ID NO: 6701 - DNA, 103 bp, Artificial Sequence
  Synthetic Polynucleotide
taatacgactcactatagggaatggcgggcggtggtggtgtctctggtgcaacagaggagagcaccaatgacaccaccaaacctggcggcagcgcaaaagatg

SEQ ID NO: 6702 - DNA, 103 bp, Artificial Sequence
  Synthetic Polynucleotide
taatacgactcactatagggtccgcaatggcgggcggtggtggtgtctctaacagaggagaagagacatgaccaccgccaacctggcggcagcgcaaaagatg

SEQ ID NO: 6703 - DNA, 103 bp, Artificial Sequence
  Synthetic Polynucleotide
taatacgactcactataggggcaggtccgcaatggcgggcggtggtggtgaacagaggagacaccacatgcgcccgccaaacctggcggcagcgcaaaagatg

SEQ ID NO: 6704 - DNA, 103 bp, Artificial Sequence
  Synthetic Polynucleotide
taatacgactcactatagggtttgagcaggtccgcaatggcgggcggtggaacagaggagaccaccgatggccattgcgaacctggcggcagcgcaaaagatg

SEQ ID NO: 6705 - DNA, 103 bp, Artificial Sequence
  Synthetic Polynucleotide
taatacgactcactatagggaccgatttgagcaggtccgcaatggcgggcaacagaggagagcccgcatgtgcggacctaacctggcggcagcgcaaaagatg

SEQ ID NO: 6706 - DNA, 103 bp, Artificial Sequence
  Synthetic Polynucleotide
taatacgactcactatagggtgtctaccgatttgagcaggtccgcaatggaacagaggagaccattgatgacctgctcaaacctggcggcagcgcaaaagatg

SEQ ID NO: 6707 - DNA, 103 bp, Artificial Sequence
  Synthetic Polynucleotide
taatacgactcactatagggctgcagagttgcccgttacgacacactgccaacagaggagaggcagtatgtcgtaacggaacctggcggcagcgcaaaagatg

SEQ ID NO: 6708 - DNA, 103 bp, Artificial Sequence
  Synthetic Polynucleotide
taatacgactcactatagggctcactgtctaccgatttgagcaggtccgcaacagaggagagcggacatgctcaaatcgaacctggcggcagcgcaaaagatg

SEQ ID NO: 6709 - DNA, 103 bp, Artificial Sequence
  Synthetic Polynucleotide
taatacgactcactatagggacagcctcactgtctaccgatttgagcaggaacagaggagacctgctatgatcggtagaaacctggcggcagcgcaaaagatg

SEQ ID NO: 6710 - DNA, 103 bp, Artificial Sequence
  Synthetic Polynucleotide
taatacgactcactatagggccctcacagcctcactgtctaccgatttgaaacagaggagatcaaatatgtagacagtgaacctggcggcagcgcaaaagatg

SEQ ID NO: 6711 - DNA, 103 bp, Artificial Sequence
  Synthetic Polynucleotide
taatacgactcactataggggtactccctcacagcctcactgtctaccgaaacagaggagatcggtaatgagtgaggctaacctggcggcagcgcaaaagatg

SEQ ID NO: 6712 - DNA, 103 bp, Artificial Sequence
  Synthetic Polynucleotide
taatacgactcactatagggttgcagtactccctcacagcctcactgtctaacagaggagaagacagatgggctgtgagaacctggcggcagcgcaaaagatg

SEQ ID NO: 6713 - DNA, 103 bp, Artificial Sequence
  Synthetic Polynucleotide
taatacgactcactatagggtttctttgcagtactccctcacagcctcacaacagaggagagtgaggatgtgagggagtaacctggcggcagcgcaaaagatg

SEQ ID NO: 6714 - DNA, 103 bp, Artificial Sequence
  Synthetic Polynucleotide
taatacgactcactatagggtcctttttctttgcagtactccctcacagcaacagaggagagctgtgatggagtactgcaacctggcggcagcgcaaaagatg

SEQ ID NO: 6715 - DNA, 103 bp, Artificial Sequence
  Synthetic Polynucleotide
taatacgactcactatagggaaccatcctttttctttgcagtactccctcaacagaggagagagggaatgctgcaaagaaacctggcggcagcgcaaaagatg

SEQ ID NO: 6716 - DNA, 103 bp, Artificial Sequence
  Synthetic Polynucleotide
taatacgactcactataggggaaccaaccatcctttttctttgcagtactaacagaggagaagtactatgaagaaaaagaacctggcggcagcgcaaaagatg

SEQ ID NO: 6717 - DNA, 103 bp, Artificial Sequence
  Synthetic Polynucleotide
taatacgactcactatagggctcaggaaccaaccatcctttttctttgcaaacagaggagatgcaaaatgaaaggatggaacctggcggcagcgcaaaagatg

SEQ ID NO: 6718 - DNA, 103 bp, Artificial Sequence
  Synthetic Polynucleotide
taatacgactcactatagggttccgctgcagagttgcccgttacgacacaaacagaggagatgtgtcatgacgggcaacaacctggcggcagcgcaaaagatg

SEQ ID NO: 6719 - DNA, 103 bp, Artificial Sequence
  Synthetic Polynucleotide
taatacgactcactatagggttgatctcaggaaccaaccatcctttttctaacagaggagaagaaaaatgatggttggtaacctggcggcagcgcaaaagatg

SEQ ID NO: 6720 - DNA, 103 bp, Artificial Sequence
  Synthetic Polynucleotide
taatacgactcactatagggtggagttgatctcaggaaccaaccatccttaacagaggagaaaggatatgtggttcctgaacctggcggcagcgcaaaagatg

SEQ ID NO: 6721 - DNA, 103 bp, Artificial Sequence
  Synthetic Polynucleotide
taatacgactcactataggggagggtggagttgatctcaggaaccaaccaaacagaggagatggttgatgcctgagatcaacctggcggcagcgcaaaagatg

SEQ ID NO: 6722 - DNA, 103 bp, Artificial Sequence
  Synthetic Polynucleotide
taatacgactcactatagggatttggagggtggagttgatctcaggaaccaacagaggagaggttccatggatcaactcaacctggcggcagcgcaaaagatg

SEQ ID NO: 6723 - DNA, 103 bp, Artificial Sequence
  Synthetic Polynucleotide
taatacgactcactatagggtctcaatttggagggtggagttgatctcagaacagaggagactgagaatgactccacccaacctggcggcagcgcaaaagatg

SEQ ID NO: 6724 - DNA, 103 bp, Artificial Sequence
  Synthetic Polynucleotide
taatacgactcactatagggatgtttctcaatttggagggtggagttgataacagaggagaatcaacatgaccctccaaaacctggcggcagcgcaaaagatg

SEQ ID NO: 6725 - DNA, 103 bp, Artificial Sequence
  Synthetic Polynucleotide
taatacgactcactatagggctgacatgtttctcaatttggagggtggagaacagaggagactccacatgccaaattgaaacctggcggcagcgcaaaagatg

SEQ ID NO: 6726 - DNA, 103 bp, Artificial Sequence
  Synthetic Polynucleotide
taatacgactcactatagggcccgactgacatgtttctcaatttggagggaacagaggagaccctccatgttgagaaacaacctggcggcagcgcaaaagatg

SEQ ID NO: 6727 - DNA, 103 bp, Artificial Sequence
  Synthetic Polynucleotide
taatacgactcactataggggaaagcccgactgacatgtttctcaatttgaacagaggagacaaattatgaaacatgtcaacctggcggcagcgcaaaagatg

SEQ ID NO: 6728 - DNA, 103 bp, Artificial Sequence
  Synthetic Polynucleotide
taatacgactcactatagggcaaatgaaagcccgactgacatgtttctcaaacagaggagatgagaaatgtgtcagtcgaacctggcggcagcgcaaaagatg

SEQ ID NO: 6729 - DNA, 103 bp, Artificial Sequence
  Synthetic Polynucleotide
taatacgactcactataggggtcggttccgctgcagagttgcccgttacgaacagaggagacgtaacatgcaactctgcaacctggcggcagcgcaaaagatg

SEQ ID NO: 6730 - DNA, 103 bp, Artificial Sequence
  Synthetic Polynucleotide
taatacgactcactataggggtaagcaaatgaaagcccgactgacatgttaacagaggagaaacatgatggtcgggcttaacctggcggcagcgcaaaagatg

SEQ ID NO: 6731 - DNA, 103 bp, Artificial Sequence
  Synthetic Polynucleotide
taatacgactcactatagggtgcctgtaagcaaatgaaagcccgactgacaacagaggagagtcagtatggctttcattaacctggcggcagcgcaaaagatg

SEQ ID NO: 6732 - DNA, 103 bp, Artificial Sequence
  Synthetic Polynucleotide
taatacgactcactataggggtcaatgcctgtaagcaaatgaaagcccgaaacagaggagatcgggcatgcatttgcttaacctggcggcagcgcaaaagatg

SEQ ID NO: 6733 - DNA, 103 bp, Artificial Sequence
  Synthetic Polynucleotide
taatacgactcactatagggatgtggtcaatgcctgtaagcaaatgaaagaacagaggagactttcaatggcttacaggaacctggcggcagcgcaaaagatg

SEQ ID NO: 6734 - DNA, 103 bp, Artificial Sequence
  Synthetic Polynucleotide
taatacgactcactatagggcacaaatgtggtcaatgcctgtaagcaaataacagaggagaatttgcatgcaggcattgaacctggcggcagcgcaaaagatg

SEQ ID NO: 6735 - DNA, 103 bp, Artificial Sequence
  Synthetic Polynucleotide
taatacgactcactatagggactgacacaaatgtggtcaatgcctgtaagaacagaggagacttacaatgattgaccacaacctggcggcagcgcaaaagatg

SEQ ID NO: 6736 - DNA, 103 bp, Artificial Sequence
  Synthetic Polynucleotide
taatacgactcactatagggcagccactgacacaaatgtggtcaatgcctaacagaggagaaggcatatgccacatttgaacctggcggcagcgcaaaagatg

SEQ ID NO: 6737 - DNA, 103 bp, Artificial Sequence
  Synthetic Polynucleotide
taatacgactcactataggggattccagccactgacacaaatgtggtcaaaacagaggagattgaccatgtttgtgtcaaacctggcggcagcgcaaaagatg

SEQ ID NO: 6738 - DNA, 103 bp, Artificial Sequence
  Synthetic Polynucleotide
taatacgactcactatagggtatatgattccagccactgacacaaatgtgaacagaggagacacattatggtcagtggcaacctggcggcagcgcaaaagatg

SEQ ID NO: 6739 - DNA, 103 bp, Artificial Sequence
  Synthetic Polynucleotide
taatacgactcactatagggttatatatatgattccagccactgacacaaaacagaggagattgtgtatgtggctggaaaacctggcggcagcgcaaaagatg

SEQ ID NO: 6740 - DNA, 103 bp, Artificial Sequence
  Synthetic Polynucleotide
taatacgactcactatagggaagtagtcggttccgctgcagagttgcccgaacagaggagacgggcaatgctgcagcggaacctggcggcagcgcaaaagatg

SEQ ID NO: 6741 - DNA, 103 bp, Artificial Sequence
  Synthetic Polynucleotide
taatacgactcactatagggatatattatatatatgattccagccactgaaacagaggagatcagtgatgggaatcataaacctggcggcagcgcaaaagatg

SEQ ID NO: 6742 - DNA, 103 bp, Artificial Sequence
  Synthetic Polynucleotide
taatacgactcactatagggagcttatatattatatatatgattccagccaacagaggagaggctggatgcatatatataacctggcggcagcgcaaaagatg

SEQ ID NO: 6743 - DNA, 103 bp, Artificial Sequence
  Synthetic Polynucleotide
taatacgactcactatagggcaaagagcttatatattatatatatgattcaacagaggagagaatcaatgatataatataacctggcggcagcgcaaaagatg

SEQ ID NO: 6744 - DNA, 103 bp, Artificial Sequence
  Synthetic Polynucleotide
taatacgactcactatagggacccgcaaagagcttatatattatatatataacagaggagaatatatatgatatataagaacctggcggcagcgcaaaagatg

SEQ ID NO: 6745 - DNA, 103 bp, Artificial Sequence
  Synthetic Polynucleotide
taatacgactcactatagggtgaaaacccgcaaagagcttatatattataaacagaggagatataatatgtaagctcttaacctggcggcagcgcaaaagatg

SEQ ID NO: 6746 - DNA, 103 bp, Artificial Sequence
  Synthetic Polynucleotide
taatacgactcactatagggcaccttgaaaacccgcaaagagcttatataaacagaggagatatataatgtctttgcggaacctggcggcagcgcaaaagatg

SEQ ID NO: 6747 - DNA, 103 bp, Artificial Sequence
  Synthetic Polynucleotide
taatacgactcactatagggataagcaccttgaaaacccgcaaagagcttaacagaggagaaagctcatggcgggttttaacctggcggcagcgcaaaagatg

SEQ ID NO: 6748 - DNA, 103 bp, Artificial Sequence
  Synthetic Polynucleotide
taatacgactcactatagggcctgtataagcaccttgaaaacccgcaaagaacagaggagactttgcatgttttcaaggaacctggcggcagcgcaaaagatg

SEQ ID NO: 6749 - DNA, 103 bp, Artificial Sequence
  Synthetic Polynucleotide
taatacgactcactataggggcactcctgtataagcaccttgaaaacccgaacagaggagacgggttatgaaggtgcttaacctggcggcagcgcaaaagatg

SEQ ID NO: 6750 - DNA, 103 bp, Artificial Sequence
  Synthetic Polynucleotide
taatacgactcactataggggttgggcactcctgtataagcaccttgaaaaacagaggagatttcaaatggcttatacaaacctggcggcagcgcaaaagatg

SEQ ID NO: 6751 - DNA, 103 bp, Artificial Sequence
  Synthetic Polynucleotide
taatacgactcactatagggacccaaagtagtcggttccgctgcagagttaacagaggagaaactctatggcggaaccgaacctggcggcagcgcaaaagatg

SEQ ID NO: 6752 - DNA, 103 bp, Artificial Sequence
  Synthetic Polynucleotide
taatacgactcactatagggttctggttgggcactcctgtataagcacctaacagaggagaaggtgcatgtacaggagtaacctggcggcagcgcaaaagatg

SEQ ID NO: 6753 - DNA, 103 bp, Artificial Sequence
  Synthetic Polynucleotide
taatacgactcactatagggtgggcttctggttgggcactcctgtataagaacagaggagacttataatggagtgcccaaacctggcggcagcgcaaaagatg

SEQ ID NO: 6754 - DNA, 103 bp, Artificial Sequence
  Synthetic Polynucleotide
taatacgactcactatagggcactctgggcttctggttgggcactcctgtaacagaggagaacaggaatgcccaaccagaacctggcggcagcgcaaaagatg

SEQ ID NO: 6755 - DNA, 103 bp, Artificial Sequence
  Synthetic Polynucleotide
taatacgactcactataggggtaggcactctgggcttctggttgggcactaacagaggagaagtgccatgccagaagccaacctggcggcagcgcaaaagatg

SEQ ID NO: 6756 - DNA, 103 bp, Artificial Sequence
  Synthetic Polynucleotide
taatacgactcactatagggtcagggtaggcactctgggcttctggttggaacagaggagaccaaccatgagcccagagaacctggcggcagcgcaaaagatg

SEQ ID NO: 6757 - DNA, 103 bp, Artificial Sequence
  Synthetic Polynucleotide
taatacgactcactatagggttgcctcagggtaggcactctgggcttctgaacagaggagacagaagatgagagtgcctaacctggcggcagcgcaaaagatg

SEQ ID NO: 6758 - DNA, 103 bp, Artificial Sequence
  Synthetic Polynucleotide
taatacgactcactatagggtttgcttgcctcagggtaggcactctgggcaacagaggagagcccagatggcctaccctaacctggcggcagcgcaaaagatg

SEQ ID NO: 6759 - DNA, 103 bp, Artificial Sequence
  Synthetic Polynucleotide
taatacgactcactataggggcacttttgcttgcctcagggtaggcactcaacagaggagagagtgcatgccctgaggcaacctggcggcagcgcaaaagatg

SEQ ID NO: 6760 - DNA, 103 bp, Artificial Sequence
  Synthetic Polynucleotide
taatacgactcactataggggccttgcacttttgcttgcctcagggtaggaacagaggagacctaccatgaggcaagcaaacctggcggcagcgcaaaagatg

SEQ ID NO: 6761 - DNA, 103 bp, Artificial Sequence
  Synthetic Polynucleotide
taatacgactcactataggggcagggccttgcacttttgcttgcctcaggaacagaggagacctgagatgagcaaaagtaacctggcggcagcgcaaaagatg

SEQ ID NO: 6762 - DNA, 103 bp, Artificial Sequence
  Synthetic Polynucleotide
taatacgactcactatagggcggacacccaaagtagtcggttccgctgcaaacagaggagatgcagcatgaccgactacaacctggcggcagcgcaaaagatg

SEQ ID NO: 6763 - DNA, 103 bp, Artificial Sequence
  Synthetic Polynucleotide
taatacgactcactatagggcaaaggcagggccttgcacttttgcttgccaacagaggagaggcaagatgaagtgcaagaacctggcggcagcgcaaaagatg

SEQ ID NO: 6764 - DNA, 103 bp, Artificial Sequence
  Synthetic Polynucleotide
taatacgactcactataggggaactcaaaggcagggccttgcacttttgcaacagaggagagcaaaaatgcaaggccctaacctggcggcagcgcaaaagatg

SEQ ID NO: 6765 - DNA, 103 bp, Artificial Sequence
  Synthetic Polynucleotide
taatacgactcactatagggacagcgaactcaaaggcagggccttgcactaacagaggagaagtgcaatgccctgccttaacctggcggcagcgcaaaagatg

SEQ ID NO: 6766 - DNA, 103 bp, Artificial Sequence
  Synthetic Polynucleotide
taatacgactcactatagggttgcgacagcgaactcaaaggcagggccttaacagaggagaaaggccatgcctttgagtaacctggcggcagcgcaaaagatg

SEQ ID NO: 6767 - DNA, 103 bp, Artificial Sequence
  Synthetic Polynucleotide
taatacgactcactatagggcatcattgcgacagcgaactcaaaggcaggaacagaggagacctgccatggagttcgctaacctggcggcagcgcaaaagatg

SEQ ID NO: 6768 - DNA, 103 bp, Artificial Sequence
  Synthetic Polynucleotide
taatacgactcactatagggcttttcatcattgcgacagcgaactcaaagaacagaggagactttgaatgcgctgtcgcaacctggcggcagcgcaaaagatg

SEQ ID NO: 6769 - DNA, 103 bp, Artificial Sequence
  Synthetic Polynucleotide
taatacgactcactatagggagttccttttcatcattgcgacagcgaactaacagaggagaagttcgatgtcgcaatgaaacctggcggcagcgcaaaagatg

SEQ ID NO: 6770 - DNA, 103 bp, Artificial Sequence
  Synthetic Polynucleotide
taatacgactcactataggggcttgagttccttttcatcattgcgacagcaacagaggagagctgtcatgatgatgaaaaacctggcggcagcgcaaaagatg

SEQ ID NO: 6771 - DNA, 103 bp, Artificial Sequence
  Synthetic Polynucleotide
taatacgactcactatagggaccctgcttgagttccttttcatcattgcgaacagaggagacgcaatatggaaaaggaaaacctggcggcagcgcaaaagatg

SEQ ID NO: 6772 - DNA, 103 bp, Artificial Sequence
  Synthetic Polynucleotide
taatacgactcactatagggttttcaccctgcttgagttccttttcatcaaacagaggagatgatgaatgggaactcaaaacctggcggcagcgcaaaagatg

SEQ ID NO: 6773 - DNA, 103 bp, Artificial Sequence
  Synthetic Polynucleotide
taatacgactcactatagggaaacacggacacccaaagtagtcggttccgaacagaggagacggaacatgctactttggaacctggcggcagcgcaaaagatg

SEQ ID NO: 6774 - DNA, 103 bp, Artificial Sequence
  Synthetic Polynucleotide
taatacgactcactatagggttcagttttcaccctgcttgagttccttttaacagaggagaaaaaggatgtcaagcaggaacctggcggcagcgcaaaagatg

SEQ ID NO: 6775 - DNA, 103 bp, Artificial Sequence
  Synthetic Polynucleotide
taatacgactcactatagggccatattcagttttcaccctgcttgagttcaacagaggagagaactcatgcagggtgaaaacctggcggcagcgcaaaagatg

SEQ ID NO: 6776 - DNA, 103 bp, Artificial Sequence
  Synthetic Polynucleotide
taatacgactcactatagggactcgccatattcagttttcaccctgcttgaacagaggagacaagcaatgtgaaaactgaacctggcggcagcgcaaaagatg

SEQ ID NO: 6777 - DNA, 103 bp, Artificial Sequence
  Synthetic Polynucleotide
taatacgactcactatagggggtaaactcgccatattcagttttcaccctaacagaggagaagggtgatgactgaatataacctggcggcagcgcaaaagatg

SEQ ID NO: 6778 - DNA, 103 bp, Artificial Sequence
  Synthetic Polynucleotide
taatacgactcactatagggagcatggtaaactcgccatattcagttttcaacagaggagagaaaacatgatatggcgaaacctggcggcagcgcaaaagatg

SEQ ID NO: 6779 - DNA, 103 bp, Artificial Sequence
  Synthetic Polynucleotide
taatacgactcactatagggtgcccagcatggtaaactcgccatattcagaacagaggagactgaatatggcgagtttaaacctggcggcagcgcaaaagatg

SEQ ID NO: 6780 - DNA, 103 bp, Artificial Sequence
  Synthetic Polynucleotide
taatacgactcactatagggatagatgcccagcatggtaaactcgccataaacagaggagatatggcatgtttaccatgaacctggcggcagcgcaaaagatg

SEQ ID NO: 6781 - DNA, 103 bp, Artificial Sequence
  Synthetic Polynucleotide
taatacgactcactatagggctgtcatagatgcccagcatggtaaactcgaacagaggagacgagttatgcatgctgggaacctggcggcagcgcaaaagatg

SEQ ID NO: 6782 - DNA, 103 bp, Artificial Sequence
  Synthetic Polynucleotide
taatacgactcactatagggcccacctgtcatagatgcccagcatggtaaaacagaggagattaccaatgtgggcatctaacctggcggcagcgcaaaagatg

SEQ ID NO: 6783 - DNA, 103 bp, Artificial Sequence
  Synthetic Polynucleotide
taatacgactcactatagggaacggcccacctgtcatagatgcccagcataacagaggagaatgctgatgatctatgacaacctggcggcagcgcaaaagatg

SEQ ID NO: 6784 - DNA, 103 bp, Artificial Sequence
  Synthetic Polynucleotide
taatacgactcactatagggaaatgaaacacggacacccaaagtagtcggaacagaggagaccgactatgttgggtgtcaacctggcggcagcgcaaaagatg

SEQ ID NO: 6785 - DNA, 103 bp, Artificial Sequence
  Synthetic Polynucleotide
taatacgactcactatagggggcaaaacggcccacctgtcatagatgcccaacagaggagagggcatatgtgacaggtgaacctggcggcagcgcaaaagatg

SEQ ID NO: 6786 - DNA, 103 bp, Artificial Sequence
  Synthetic Polynucleotide
taatacgactcactatagggggcgtggcaaaacggcccacctgtcatagaaacagaggagatctatgatgggtgggccgaacctggcggcagcgcaaaagatg

SEQ ID NO: 6787 - DNA, 103 bp, Artificial Sequence
  Synthetic Polynucleotide
taatacgactcactatagggggcgtggcgtggcaaaacggcccacctgtcaacagaggagagacaggatggccgttttgaacctggcggcagcgcaaaagatg

SEQ ID NO: 6788 - DNA, 103 bp, Artificial Sequence
  Synthetic Polynucleotide
taatacgactcactatagggggtttggcgtggcgtggcaaaacggcccacaacagaggagagtgggcatgtttgccacgaacctggcggcagcgcaaaagatg

SEQ ID NO: 6789 - DNA, 103 bp, Artificial Sequence
  Synthetic Polynucleotide
taatacgactcactataggggcccaggtttggcgtggcgtggcaaaacggaacagaggagaccgtttatgcacgccacgaacctggcggcagcgcaaaagatg

SEQ ID NO: 6790 - DNA, 103 bp, Artificial Sequence
  Synthetic Polynucleotide
taatacgactcactatagggggttggcccaggtttggcgtggcgtggcaaaacagaggagattgccaatgcacgccaaaaacctggcggcagcgcaaaagatg

SEQ ID NO: 6791 - DNA, 103 bp, Artificial Sequence
  Synthetic Polynucleotide
taatacgactcactatagggaagatggttggcccaggtttggcgtggcgtaacagaggagaacgccaatgcaaacctggaacctggcggcagcgcaaaagatg

SEQ ID NO: 6792 - DNA, 103 bp, Artificial Sequence
  Synthetic Polynucleotide
taatacgactcactatagggtcatcaagatggttggcccaggtttggcgtaacagaggagaacgccaatgctgggccaaaacctggcggcagcgcaaaagatg

SEQ ID NO: 6793 - DNA, 103 bp, Artificial Sequence
  Synthetic Polynucleotide
taatacgactcactatagggatcattcatcaagatggttggcccaggtttaacagaggagaaaacctatgccaaccatcaacctggcggcagcgcaaaagatg

SEQ ID NO: 6794 - DNA, 103 bp, Artificial Sequence
  Synthetic Polynucleotide
taatacgactcactatagggtcttgatcattcatcaagatggttggcccaaacagaggagatgggccatgcatcttgataacctggcggcagcgcaaaagatg

SEQ ID NO: 6795 - DNA, 103 bp, Artificial Sequence
  Synthetic Polynucleotide
taatacgactcactatagggggcgcacaaaggtaccgtgataccagagtgaacagaggagacactctatgatcacggtaaacctggcggcagcgcaaaagatg

SEQ ID NO: 6796 - DNA, 103 bp, Artificial Sequence
  Synthetic Polynucleotide
taatacgactcactataggggaataaaatgaaacacggacacccaaagtaaacagaggagatactttatgtgtccgtgtaacctggcggcagcgcaaaagatg

SEQ ID NO: 6797 - DNA, 103 bp, Artificial Sequence
  Synthetic Polynucleotide
taatacgactcactatagggcaacctcttgatcattcatcaagatggttgaacagaggagacaaccaatgtgatgaatgaacctggcggcagcgcaaaagatg

SEQ ID NO: 6798 - DNA, 103 bp, Artificial Sequence
  Synthetic Polynucleotide
taatacgactcactatagggcacaccaacctcttgatcattcatcaagataacagaggagaatcttgatgaatgatcaaaacctggcggcagcgcaaaagatg

SEQ ID NO: 6799 - DNA, 103 bp, Artificial Sequence
  Synthetic Polynucleotide
taatacgactcactatagggtctagcacaccaacctcttgatcattcatcaacagaggagagatgaaatgtcaagaggtaacctggcggcagcgcaaaagatg

SEQ ID NO: 6800 - DNA, 103 bp, Artificial Sequence
  Synthetic Polynucleotide
taatacgactcactatagggtggcatctagcacaccaacctcttgatcataacagaggagaatgatcatgaggttggtgaacctggcggcagcgcaaaagatg

SEQ ID NO: 6801 - DNA, 103 bp, Artificial Sequence
  Synthetic Polynucleotide
taatacgactcactatagggctccttggcatctagcacaccaacctcttgaacagaggagacaagagatgggtgtgctaaacctggcggcagcgcaaaagatg

SEQ ID NO: 6802 - DNA, 103 bp, Artificial Sequence
  Synthetic Polynucleotide
taatacgactcactatagggactagctccttggcatctagcacaccaaccaacagaggagaggttggatggctagatgcaacctggcggcagcgcaaaagatg

SEQ ID NO: 6803 - DNA, 103 bp, Artificial Sequence
  Synthetic Polynucleotide
taatacgactcactatagggtgtctactagctccttggcatctagcacacaacagaggagagtgtgcatgatgccaaggaacctggcggcagcgcaaaagatg

SEQ ID NO: 6804 - DNA, 103 bp, Artificial Sequence
  Synthetic Polynucleotide
taatacgactcactataggggtccttgtctactagctccttggcatctagaacagaggagactagatatgaaggagctaaacctggcggcagcgcaaaagatg

SEQ ID NO: 6805 - DNA, 103 bp, Artificial Sequence
  Synthetic Polynucleotide
taatacgactcactataggggtgccgtccttgtctactagctccttggcaaacagaggagatgccaaatggctagtagaaacctggcggcagcgcaaaagatg

SEQ ID NO: 6806 - DNA, 103 bp, Artificial Sequence
  Synthetic Polynucleotide
taatacgactcactatagggagttggtgccgtccttgtctactagctcctaacagaggagaaggagcatgtagacaaggaacctggcggcagcgcaaaagatg

SEQ ID NO: 6807 - DNA, 103 bp, Artificial Sequence
  Synthetic Polynucleotide
taatacgactcactatagggtataggaataaaatgaaacacggacacccaaacagaggagatgggtgatggtgtttcataacctggcggcagcgcaaaagatg

SEQ ID NO: 6808 - DNA, 103 bp, Artificial Sequence
  Synthetic Polynucleotide
taatacgactcactatagggttctaagttggtgccgtccttgtctactagaacagaggagactagtaatgaaggacggcaacctggcggcagcgcaaaagatg

SEQ ID NO: 6809 - DNA, 103 bp, Artificial Sequence
  Synthetic Polynucleotide
taatacgactcactataggggtcagttctaagttggtgccgtccttgtctaacagaggagaagacaaatgcggcaccaaaacctggcggcagcgcaaaagatg

SEQ ID NO: 6810 - DNA, 103 bp, Artificial Sequence
  Synthetic Polynucleotide
taatacgactcactataggggtagtgtcagttctaagttggtgccgtcctaacagaggagaaggacgatgccaacttagaacctggcggcagcgcaaaagatg

SEQ ID NO: 6811 - DNA, 103 bp, Artificial Sequence
  Synthetic Polynucleotide
taatacgactcactatagggtttgagtagtgtcagttctaagttggtgccaacagaggagaggcaccatgttagaactgaacctggcggcagcgcaaaagatg

SEQ ID NO: 6812 - DNA, 103 bp, Artificial Sequence
  Synthetic Polynucleotide
taatacgactcactatagggttcaatttgagtagtgtcagttctaagttgaacagaggagacaacttatgactgacactaacctggcggcagcgcaaaagatg

SEQ ID NO: 6813 - DNA, 103 bp, Artificial Sequence
  Synthetic Polynucleotide
taatacgactcactatagggtccggttcaatttgagtagtgtcagttctaaacagaggagatagaacatgcactactcaaacctggcggcagcgcaaaagatg

SEQ ID NO: 6814 - DNA, 103 bp, Artificial Sequence
  Synthetic Polynucleotide
taatacgactcactatagggctcattccggttcaatttgagtagtgtcagaacagaggagactgacaatgctcaaattgaacctggcggcagcgcaaaagatg

SEQ ID NO: 6815 - DNA, 103 bp, Artificial Sequence
  Synthetic Polynucleotide
taatacgactcactatagggaacttctcattccggttcaatttgagtagtaacagaggagaactactatgattgaaccgaacctggcggcagcgcaaaagatg

SEQ ID NO: 6816 - DNA, 103 bp, Artificial Sequence
  Synthetic Polynucleotide
taatacgactcactatagggctctgaacttctcattccggttcaatttgaaacagaggagatcaaatatgaccggaatgaacctggcggcagcgcaaaagatg

SEQ ID NO: 6817 - DNA, 103 bp, Artificial Sequence
  Synthetic Polynucleotide
taatacgactcactataggggatgtctctgaacttctcattccggttcaaaacagaggagattgaacatgaatgagaagaacctggcggcagcgcaaaagatg

SEQ ID NO: 6818 - DNA, 103 bp, Artificial Sequence
  Synthetic Polynucleotide
taatacgactcactataggggccagtataggaataaaatgaaacacggacaacagaggagagtccgtatgtcattttataacctggcggcagcgcaaaagatg

SEQ ID NO: 6819 - DNA, 103 bp, Artificial Sequence
  Synthetic Polynucleotide
taatacgactcactatagggcctctgatgtctctgaacttctcattccggaacagaggagaccggaaatggaagttcagaacctggcggcagcgcaaaagatg

SEQ ID NO: 6820 - DNA, 103 bp, Artificial Sequence
  Synthetic Polynucleotide
taatacgactcactatagggagaagcctctgatgtctctgaacttctcataacagaggagaatgagaatgtcagagacaaacctggcggcagcgcaaaagatg

SEQ ID NO: 6821 - DNA, 103 bp, Artificial Sequence
  Synthetic Polynucleotide
taatacgactcactatagggggctaagaagcctctgatgtctctgaacttaacagaggagaaagttcatggacatcagaaacctggcggcagcgcaaaagatg

SEQ ID NO: 6822 - DNA, 103 bp, Artificial Sequence
  Synthetic Polynucleotide
taatacgactcactatagggtccttggctaagaagcctctgatgtctctgaacagaggagacagagaatgcagaggcttaacctggcggcagcgcaaaagatg

SEQ ID NO: 6823 - DNA, 103 bp, Artificial Sequence
  Synthetic Polynucleotide
taatacgactcactatagggcttcctccttggctaagaagcctctgatgtaacagaggagaacatcaatggcttcttagaacctggcggcagcgcaaaagatg

SEQ ID NO: 6824 - DNA, 103 bp, Artificial Sequence
  Synthetic Polynucleotide
taatacgactcactatagggctccacttcctccttggctaagaagcctctaacagaggagaagaggcatgttagccaagaacctggcggcagcgcaaaagatg

SEQ ID NO: 6825 - DNA, 103 bp, Artificial Sequence
  Synthetic Polynucleotide
taatacgactcactatagggttaacctccacttcctccttggctaagaagaacagaggagacttcttatgcaaggaggaaacctggcggcagcgcaaaagatg

SEQ ID NO: 6826 - DNA, 103 bp, Artificial Sequence
  Synthetic Polynucleotide
taatacgactcactatagggcctcattaacctccacttcctccttggctaaacagaggagatagccaatgaggaagtggaacctggcggcagcgcaaaagatg

SEQ ID NO: 6827 - DNA, 103 bp, Artificial Sequence
  Synthetic Polynucleotide
taatacgactcactatagggcactgcctcattaacctccacttcctccttaacagaggagaaaggagatggtggaggttaacctggcggcagcgcaaaagatg

SEQ ID NO: 6828 - DNA, 103 bp, Artificial Sequence
  Synthetic Polynucleotide
taatacgactcactataggggctagcactgcctcattaacctccacttccaacagaggagaggaagtatgggttaatgaaacctggcggcagcgcaaaagatg

SEQ ID NO: 6829 - DNA, 103 bp, Artificial Sequence
  Synthetic Polynucleotide
taatacgactcactatagggaagcagccagtataggaataaaatgaaacaaacagaggagatgtttcatgttattcctaaacctggcggcagcgcaaaagatg

SEQ ID NO: 6830 - DNA, 103 bp, Artificial Sequence
  Synthetic Polynucleotide
taatacgactcactatagggtaattgctagcactgcctcattaacctccaaacagaggagatggaggatgatgaggcagaacctggcggcagcgcaaaagatg

SEQ ID NO: 6831 - DNA, 103 bp, Artificial Sequence
  Synthetic Polynucleotide
taatacgactcactatagggggtgttaattgctagcactgcctcattaacaacagaggagagttaatatggcagtgctaaacctggcggcagcgcaaaagatg

SEQ ID NO: 6832 - DNA, 103 bp, Artificial Sequence
  Synthetic Polynucleotide
taatacgactcactatagggttgctggtgttaattgctagcactgcctcaaacagaggagatgaggcatggctagcaataacctggcggcagcgcaaaagatg

SEQ ID NO: 6833 - DNA, 103 bp, Artificial Sequence
  Synthetic Polynucleotide
taatacgactcactataggggaaacttgctggtgttaattgctagcactgaacagaggagacagtgcatgcaattaacaaacctggcggcagcgcaaaagatg

SEQ ID NO: 6834 - DNA, 103 bp, Artificial Sequence
  Synthetic Polynucleotide
taatacgactcactataggggttgggaaacttgctggtgttaattgctagaacagaggagactagcaatgaacaccagcaacctggcggcagcgcaaaagatg

SEQ ID NO: 6835 - DNA, 103 bp, Artificial Sequence
  Synthetic Polynucleotide
taatacgactcactatagggtacatgttgggaaacttgctggtgttaattaacagaggagaaattaaatgcagcaagttaacctggcggcagcgcaaaagatg

SEQ ID NO: 6836 - DNA, 103 bp, Artificial Sequence
  Synthetic Polynucleotide
taatacgactcactataggggaatgtacatgttgggaaacttgctggtgtaacagaggagaacaccaatgagtttcccaaacctggcggcagcgcaaaagatg

SEQ ID NO: 6837 - DNA, 103 bp, Artificial Sequence
  Synthetic Polynucleotide
taatacgactcactatagggtactggaatgtacatgttgggaaacttgctaacagaggagaagcaagatgcccaacatgaacctggcggcagcgcaaaagatg

SEQ ID NO: 6838 - DNA, 103 bp, Artificial Sequence
  Synthetic Polynucleotide
taatacgactcactatagggtgtcctactggaatgtacatgttgggaaacaacagaggagagtttccatgcatgtacataacctggcggcagcgcaaaagatg

SEQ ID NO: 6839 - DNA, 103 bp, Artificial Sequence
  Synthetic Polynucleotide
taatacgactcactatagggtgacctgtcctactggaatgtacatgttggaacagaggagaccaacaatgacattccagaacctggcggcagcgcaaaagatg

SEQ ID NO: 6840 - DNA, 103 bp, Artificial Sequence
  Synthetic Polynucleotide
taatacgactcactatagggaccataagcagccagtataggaataaaatgaacagaggagacattttatgcctatactgaacctggcggcagcgcaaaagatg

SEQ ID NO: 6841 - DNA, 103 bp, Artificial Sequence
  Synthetic Polynucleotide
taatacgactcactatagggttctgtgacctgtcctactggaatgtacataacagaggagaatgtacatgccagtaggaaacctggcggcagcgcaaaagatg

SEQ ID NO: 6842 - DNA, 103 bp, Artificial Sequence
  Synthetic Polynucleotide
taatacgactcactatagggccgtattctgtgacctgtcctactggaatgaacagaggagacattccatgaggacaggtaacctggcggcagcgcaaaagatg

SEQ ID NO: 6843 - DNA, 103 bp, Artificial Sequence
  Synthetic Polynucleotide
taatacgactcactatagggagaagccgtattctgtgacctgtcctactgaacagaggagacagtagatgaggtcacagaacctggcggcagcgcaaaagatg

SEQ ID NO: 6844 - DNA, 103 bp, Artificial Sequence
  Synthetic Polynucleotide
taatacgactcactataggggtttaagaagccgtattctgtgacctgtccaacagaggagaggacagatgacagaatacaacctggcggcagcgcaaaagatg

SEQ ID NO: 6845 - DNA, 103 bp, Artificial Sequence
  Synthetic Polynucleotide
taatacgactcactatagggcctaggtttaagaagccgtattctgtgaccaacagaggagaggtcacatgatacggcttaacctggcggcagcgcaaaagatg

SEQ ID NO: 6846 - DNA, 103 bp, Artificial Sequence
  Synthetic Polynucleotide
taatacgactcactatagggtgccacctaggtttaagaagccgtattctgaacagaggagacagaatatggcttcttaaaacctggcggcagcgcaaaagatg

SEQ ID NO: 6847 - DNA, 103 bp, Artificial Sequence
  Synthetic Polynucleotide
taatacgactcactataggggggtgtgccacctaggtttaagaagccgtaaacagaggagatacggcatgttaaacctaaacctggcggcagcgcaaaagatg

SEQ ID NO: 6848 - DNA, 103 bp, Artificial Sequence
  Synthetic Polynucleotide
taatacgactcactatagggttggtgggtgtgccacctaggtttaagaagaacagaggagacttcttatgcctaggtggaacctggcggcagcgcaaaagatg

SEQ ID NO: 6849 - DNA, 103 bp, Artificial Sequence
  Synthetic Polynucleotide
taatacgactcactatagggttctcttggtgggtgtgccacctaggtttaaacagaggagataaaccatggtggcacacaacctggcggcagcgcaaaagatg

SEQ ID NO: 6850 - DNA, 103 bp, Artificial Sequence
  Synthetic Polynucleotide
taatacgactcactatagggaagcattctcttggtgggtgtgccacctagaacagaggagactaggtatgacacccaccaacctggcggcagcgcaaaagatg

SEQ ID NO: 6851 - DNA, 103 bp, Artificial Sequence
  Synthetic Polynucleotide
taatacgactcactatagggttgtcaccataagcagccagtataggaataaacagaggagatattccatgactggctgcaacctggcggcagcgcaaaagatg

SEQ ID NO: 6852 - DNA, 103 bp, Artificial Sequence
  Synthetic Polynucleotide
taatacgactcactatagggtacataagcattctcttggtgggtgtgccaaacagaggagatggcacatgcaccaagagaacctggcggcagcgcaaaagatg

SEQ ID NO: 6853 - DNA, 103 bp, Artificial Sequence
  Synthetic Polynucleotide
taatacgactcactatagggagttgtacataagcattctcttggtgggtgaacagaggagacacccaatgagagaatgcaacctggcggcagcgcaaaagatg

SEQ ID NO: 6854 - DNA, 103 bp, Artificial Sequence
  Synthetic Polynucleotide
taatacgactcactatagggggggaagttgtacataagcattctcttggtaacagaggagaaccaagatgatgcttatgaacctggcggcagcgcaaaagatg

SEQ ID NO: 6855 - DNA, 103 bp, Artificial Sequence
  Synthetic Polynucleotide
taatacgactcactatagggcttgtggggaagttgtacataagcattctcaacagaggagagagaatatgtatgtacaaaacctggcggcagcgcaaaagatg

SEQ ID NO: 6856 - DNA, 103 bp, Artificial Sequence
  Synthetic Polynucleotide
taatacgactcactatagggctgctcttgtggggaagttgtacataagcaaacagaggagatgcttaatgacaacttccaacctggcggcagcgcaaaagatg

SEQ ID NO: 6857 - DNA, 103 bp, Artificial Sequence
  Synthetic Polynucleotide
taatacgactcactatagggctggcctgctcttgtggggaagttgtacataacagaggagaatgtacatgttccccacaaacctggcggcagcgcaaaagatg

SEQ ID NO: 6858 - DNA, 103 bp, Artificial Sequence
  Synthetic Polynucleotide
taatacgactcactatagggccacactggcctgctcttgtggggaagttgaacagaggagacaacttatgcacaagagcaacctggcggcagcgcaaaagatg

SEQ ID NO: 6859 - DNA, 103 bp, Artificial Sequence
  Synthetic Polynucleotide
taatacgactcactatagggctccaccacactggcctgctcttgtggggaaacagaggagatccccaatggagcaggccaacctggcggcagcgcaaaagatg

SEQ ID NO: 6860 - DNA, 103 bp, Artificial Sequence
  Synthetic Polynucleotide
taatacgactcactataggggagcactccaccacactggcctgctcttgtaacagaggagaacaagaatgggccagtgtaacctggcggcagcgcaaaagatg

SEQ ID NO: 6861 - DNA, 103 bp, Artificial Sequence
  Synthetic Polynucleotide
taatacgactcactataggggacatgagcactccaccacactggcctgctaacagaggagaagcaggatggtgtggtggaacctggcggcagcgcaaaagatg

SEQ ID NO: 6862 - DNA, 103 bp, Artificial Sequence
  Synthetic Polynucleotide
taatacgactcactatagggctcaattgtcaccataagcagccagtatagaacagaggagactatacatgctgcttatgaacctggcggcagcgcaaaagatg

SEQ ID NO: 6863 - DNA, 103 bp, Artificial Sequence
  Synthetic Polynucleotide
taatacgactcactatagggcggtggacatgagcactccaccacactggcaacagaggagagccagtatggtggagtgcaacctggcggcagcgcaaaagatg

SEQ ID NO: 6864 - DNA, 103 bp, Artificial Sequence
  Synthetic Polynucleotide
taatacgactcactatagggcttgccggtggacatgagcactccaccacaaacagaggagatgtggtatggtgctcatgaacctggcggcagcgcaaaagatg

SEQ ID NO: 6865 - DNA, 103 bp, Artificial Sequence
  Synthetic Polynucleotide
taatacgactcactatagggagtaccttgccggtggacatgagcactccaaacagaggagatggagtatgcatgtccacaacctggcggcagcgcaaaagatg

SEQ ID NO: 6866 - DNA, 103 bp, Artificial Sequence
  Synthetic Polynucleotide
taatacgactcactatagggtacccagtaccttgccggtggacatgagcaaacagaggagatgctcaatgccaccggcaaacctggcggcagcgcaaaagatg

SEQ ID NO: 6867 - DNA, 103 bp, Artificial Sequence
  Synthetic Polynucleotide
taatacgactcactatagggatggatacccagtaccttgccggtggacataacagaggagaatgtccatgggcaaggtaaacctggcggcagcgcaaaagatg

SEQ ID NO: 6868 - DNA, 103 bp, Artificial Sequence
  Synthetic Polynucleotide
taatacgactcactatagggccaacatggatacccagtaccttgccggtgaacagaggagacaccggatgggtactgggaacctggcggcagcgcaaaagatg

SEQ ID NO: 6869 - DNA, 103 bp, Artificial Sequence
  Synthetic Polynucleotide
taatacgactcactatagggttccaccaacatggatacccagtaccttgcaacagaggagagcaaggatgtgggtatccaacctggcggcagcgcaaaagatg

SEQ ID NO: 6870 - DNA, 103 bp, Artificial Sequence
  Synthetic Polynucleotide
taatacgactcactataggggccatttccaccaacatggatacccagtacaacagaggagagtactgatgatccatgttaacctggcggcagcgcaaaagatg

SEQ ID NO: 6871 - DNA, 103 bp, Artificial Sequence
  Synthetic Polynucleotide
taatacgactcactatagggtgatggccatttccaccaacatggatacccaacagaggagagggtatatgtgttggtggaacctggcggcagcgcaaaagatg

SEQ ID NO: 6872 - DNA, 103 bp, Artificial Sequence
  Synthetic Polynucleotide
taatacgactcactatagggagccctgatggccatttccaccaacatggaaacagaggagatccatgatggtggaaatgaacctggcggcagcgcaaaagatg

SEQ ID NO: 6873 - DNA, 103 bp, Artificial Sequence
  Synthetic Polynucleotide
taatacgactcactatagggaatctctcaattgtcaccataagcagccagaacagaggagactggctatgtatggtgacaacctggcggcagcgcaaaagatg

SEQ ID NO: 6874 - DNA, 103 bp, Artificial Sequence
  Synthetic Polynucleotide
taatacgactcactatagggtgagaagccctgatggccatttccaccaacaacagaggagagttggtatgaatggccataacctggcggcagcgcaaaagatg

SEQ ID NO: 6875 - DNA, 103 bp, Artificial Sequence
  Synthetic Polynucleotide
taatacgactcactataggggctgctgagaagccctgatggccatttccaaacagaggagatggaaaatgccatcagggaacctggcggcagcgcaaaagatg

SEQ ID NO: 6876 - DNA, 103 bp, Artificial Sequence
  Synthetic Polynucleotide
taatacgactcactatagggggagtgctgctgagaagccctgatggccataacagaggagaatggccatgagggcttctaacctggcggcagcgcaaaagatg

SEQ ID NO: 6877 - DNA, 103 bp, Artificial Sequence
  Synthetic Polynucleotide
taatacgactcactatagggtttgaggagtgctgctgagaagccctgatgaacagaggagacatcagatgttctcagcaaacctggcggcagcgcaaaagatg

SEQ ID NO: 6878 - DNA, 103 bp, Artificial Sequence
  Synthetic Polynucleotide
taatacgactcactatagggtagtgtttgaggagtgctgctgagaagcccaacagaggagagggcttatgagcagcactaacctggcggcagcgcaaaagatg

SEQ ID NO: 6879 - DNA, 103 bp, Artificial Sequence
  Synthetic Polynucleotide
taatacgactcactatagggtgaagtagtgtttgaggagtgctgctgagaaacagaggagatctcagatgcactcctcaaacctggcggcagcgcaaaagatg

SEQ ID NO: 6880 - DNA, 103 bp, Artificial Sequence
  Synthetic Polynucleotide
taatacgactcactatagggatcattgaagtagtgtttgaggagtgctgcaacagaggagagcagcaatgctcaaacacaacctggcggcagcgcaaaagatg

SEQ ID NO: 6881 - DNA, 103 bp, Artificial Sequence
  Synthetic Polynucleotide
taatacgactcactatagggtgctcatcattgaagtagtgtttgaggagtaacagaggagaactcctatgacactacttaacctggcggcagcgcaaaagatg

SEQ ID NO: 6882 - DNA, 103 bp, Artificial Sequence
  Synthetic Polynucleotide
taatacgactcactatagggcaccttgctcatcattgaagtagtgtttgaaacagaggagatcaaacatgacttcaatgaacctggcggcagcgcaaaagatg

SEQ ID NO: 6883 - DNA, 103 bp, Artificial Sequence
  Synthetic Polynucleotide
taatacgactcactatagggtatttcaccttgctcatcattgaagtagtgaacagaggagacactacatgaatgatgagaacctggcggcagcgcaaaagatg

SEQ ID NO: 6884 - DNA, 103 bp, Artificial Sequence
  Synthetic Polynucleotide
taatacgactcactataggggtaacaatctctcaattgtcaccataagcaaacagaggagatgcttaatgtgacaattgaacctggcggcagcgcaaaagatg

SEQ ID NO: 6885 - DNA, 103 bp, Artificial Sequence
  Synthetic Polynucleotide
taatacgactcactatagggaattctatttcaccttgctcatcattgaagaacagaggagacttcaaatgtgagcaaggaacctggcggcagcgcaaaagatg

SEQ ID NO: 6886 - DNA, 103 bp, Artificial Sequence
  Synthetic Polynucleotide
taatacgactcactatagggcaataaattctatttcaccttgctcatcataacagaggagaatgatgatgaaggtgaaaaacctggcggcagcgcaaaagatg

SEQ ID NO: 6887 - DNA, 103 bp, Artificial Sequence
  Synthetic Polynucleotide
taatacgactcactataggggctctcaataaattctatttcaccttgctcaacagaggagagagcaaatggaaatagaaaacctggcggcagcgcaaaagatg

SEQ ID NO: 6888 - DNA, 103 bp, Artificial Sequence
  Synthetic Polynucleotide
taatacgactcactatagggtttgagctctcaataaattctatttcacctaacagaggagaaggtgaatgagaatttataacctggcggcagcgcaaaagatg

SEQ ID NO: 6889 - DNA, 103 bp, Artificial Sequence
  Synthetic Polynucleotide
taatacgactcactatagggcgtcctttgagctctcaataaattctatttaacagaggagaaaatagatgttattgagaaacctggcggcagcgcaaaagatg

SEQ ID NO: 6890 - DNA, 103 bp, Artificial Sequence
  Synthetic Polynucleotide
taatacgactcactatagggcccggcgtcctttgagctctcaataaattcaacagaggagagaatttatggagagctcaaacctggcggcagcgcaaaagatg

SEQ ID NO: 6891 - DNA, 103 bp, Artificial Sequence
  Synthetic Polynucleotide
taatacgactcactatagggggaaacccggcgtcctttgagctctcaataaacagaggagatattgaatgctcaaaggaaacctggcggcagcgcaaaagatg

SEQ ID NO: 6892 - DNA, 103 bp, Artificial Sequence
  Synthetic Polynucleotide
taatacgactcactatagggtgactggaaacccggcgtcctttgagctctaacagaggagaagagctatgaggacgccgaacctggcggcagcgcaaaagatg

SEQ ID NO: 6893 - DNA, 103 bp, Artificial Sequence
  Synthetic Polynucleotide
taatacgactcactataggggttgatgactggaaacccggcgtcctttgaaacagaggagatcaaagatggccgggtttaacctggcggcagcgcaaaagatg

SEQ ID NO: 6894 - DNA, 103 bp, Artificial Sequence
  Synthetic Polynucleotide
taatacgactcactatagggggtgtgttgatgactggaaacccggcgtccaacagaggagaggacgcatggtttccagtaacctggcggcagcgcaaaagatg

SEQ ID NO: 6895 - DNA, 103 bp, Artificial Sequence
  Synthetic Polynucleotide
taatacgactcactatagggatatggtaacaatctctcaattgtcaccataacagaggagaatggtgatgattgagagaaacctggcggcagcgcaaaagatg

SEQ ID NO: 6896 - DNA, 103 bp, Artificial Sequence
  Synthetic Polynucleotide
taatacgactcactatagggtacttggtgtgttgatgactggaaacccggaacagaggagaccgggtatgcagtcatcaaacctggcggcagcgcaaaagatg

SEQ ID NO: 6897 - DNA, 103 bp, Artificial Sequence
  Synthetic Polynucleotide
taatacgactcactatagggtgttttacttggtgtgttgatgactggaaaaacagaggagatttccaatgatcaacacaaacctggcggcagcgcaaaagatg

SEQ ID NO: 6898 - DNA, 103 bp, Artificial Sequence
  Synthetic Polynucleotide
taatacgactcactatagggaactttgttttacttggtgtgttgatgactaacagaggagaagtcatatgcacaccaagaacctggcggcagcgcaaaagatg

SEQ ID NO: 6899 - DNA, 103 bp, Artificial Sequence
  Synthetic Polynucleotide
taatacgactcactataggggctccaactttgttttacttggtgtgttgaaacagaggagatcaacaatgcaagtaaaaaacctggcggcagcgcaaaagatg

SEQ ID NO: 6900 - DNA, 103 bp, Artificial Sequence
  Synthetic Polynucleotide
taatacgactcactatagggactaggctccaactttgttttacttggtgtaacagaggagaacaccaatgaaaacaaagaacctggcggcagcgcaaaagatg

SEQ ID NO: 6901 - DNA, 103 bp, Artificial Sequence
  Synthetic Polynucleotide
taatacgactcactatagggaaaacactaggctccaactttgttttacttaacagaggagaaagtaaatgaaagttggaaacctggcggcagcgcaaaagatg

SEQ ID NO: 6902 - DNA, 103 bp, Artificial Sequence
  Synthetic Polynucleotide
taatacgactcactatagggggtggaaaacactaggctccaactttgtttaacagaggagaaaacaaatgtggagcctaaacctggcggcagcgcaaaagatg

SEQ ID NO: 6903 - DNA, 103 bp, Artificial Sequence
  Synthetic Polynucleotide
taatacgactcactataggggacctggtggaaaacactaggctccaacttaacagaggagaaagttgatgcctagtgttaacctggcggcagcgcaaaagatg

SEQ ID NO: 6904 - DNA, 103 bp, Artificial Sequence
  Synthetic Polynucleotide
taatacgactcactatagggtcaaagacctggtggaaaacactaggctccaacagaggagaggagccatgtgttttccaaacctggcggcagcgcaaaagatg

SEQ ID NO: 6905 - DNA, 103 bp, Artificial Sequence
  Synthetic Polynucleotide
taatacgactcactatagggtcccctcaaagacctggtggaaaacactagaacagaggagactagtgatgtccaccaggaacctggcggcagcgcaaaagatg

SEQ ID NO: 6906 - DNA, 103 bp, Artificial Sequence
  Synthetic Polynucleotide
taatacgactcactatagggaaacaggcgcacaaaggtaccgtgataccaaacagaggagatggtatatgggtacctttaacctggcggcagcgcaaaagatg

SEQ ID NO: 6907 - DNA, 103 bp, Artificial Sequence
  Synthetic Polynucleotide
taatacgactcactatagggtagctatatggtaacaatctctcaattgtcaacagaggagagacaatatggagattgttaacctggcggcagcgcaaaagatg

SEQ ID NO: 6908 - DNA, 103 bp, Artificial Sequence
  Synthetic Polynucleotide
taatacgactcactatagggtttgttcccctcaaagacctggtggaaaacaacagaggagagttttcatgcaggtctttaacctggcggcagcgcaaaagatg

SEQ ID NO: 6909 - DNA, 103 bp, Artificial Sequence
  Synthetic Polynucleotide
taatacgactcactatagggggttctttgttcccctcaaagacctggtggaacagaggagaccaccaatgctttgagggaacctggcggcagcgcaaaagatg

SEQ ID NO: 6910 - DNA, 103 bp, Artificial Sequence
  Synthetic Polynucleotide
taatacgactcactatagggctgctggttctttgttcccctcaaagacctaacagaggagaaggtctatgaggggaacaaacctggcggcagcgcaaaagatg

SEQ ID NO: 6911 - DNA, 103 bp, Artificial Sequence
  Synthetic Polynucleotide
taatacgactcactataggggagtactgctggttctttgttcccctcaaaaacagaggagatttgagatgaacaaagaaaacctggcggcagcgcaaaagatg

SEQ ID NO: 6912 - DNA, 103 bp, Artificial Sequence
  Synthetic Polynucleotide
taatacgactcactatagggctcctgagtactgctggttctttgttccccaacagaggagaggggaaatgagaaccagcaacctggcggcagcgcaaaagatg

SEQ ID NO: 6913 - DNA, 103 bp, Artificial Sequence
  Synthetic Polynucleotide
taatacgactcactatagggccccactcctgagtactgctggttctttgtaacagaggagaacaaagatgcagcagtacaacctggcggcagcgcaaaagatg

SEQ ID NO: 6914 - DNA, 103 bp, Artificial Sequence
  Synthetic Polynucleotide
taatacgactcactatagggtggatccccactcctgagtactgctggttcaacagaggagagaaccaatggtactcaggaacctggcggcagcgcaaaagatg

SEQ ID NO: 6915 - DNA, 103 bp, Artificial Sequence
  Synthetic Polynucleotide
taatacgactcactatagggagacgtggatccccactcctgagtactgctaacagaggagaagcagtatgcaggagtggaacctggcggcagcgcaaaagatg

SEQ ID NO: 6916 - DNA, 103 bp, Artificial Sequence
  Synthetic Polynucleotide
taatacgactcactatagggccttgagacgtggatccccactcctgagtaaacagaggagatactcaatggtggggatcaacctggcggcagcgcaaaagatg

SEQ ID NO: 6917 - DNA, 103 bp, Artificial Sequence
  Synthetic Polynucleotide
taatacgactcactatagggattggccttgagacgtggatccccactcctaacagaggagaaggagtatggatccacgtaacctggcggcagcgcaaaagatg

SEQ ID NO: 6918 - DNA, 103 bp, Artificial Sequence
  Synthetic Polynucleotide
taatacgactcactatagggtccaatagctatatggtaacaatctctcaaaacagaggagattgagaatgtgttaccataacctggcggcagcgcaaaagatg

SEQ ID NO: 6919 - DNA, 103 bp, Artificial Sequence
  Synthetic Polynucleotide
taatacgactcactatagggtcaaaattggccttgagacgtggatccccaaacagaggagatggggaatgacgtctcaaaacctggcggcagcgcaaaagatg

SEQ ID NO: 6920 - DNA, 103 bp, Artificial Sequence
  Synthetic Polynucleotide
taatacgactcactatagggcctcttcaaaattggccttgagacgtggataacagaggagaatccacatgtcaaggccaaacctggcggcagcgcaaaagatg

SEQ ID NO: 6921 - DNA, 103 bp, Artificial Sequence
  Synthetic Polynucleotide
taatacgactcactatagggtatagcctcttcaaaattggccttgagacgaacagaggagacgtctcatggccaattttaacctggcggcagcgcaaaagatg

SEQ ID NO: 6922 - DNA, 103 bp, Artificial Sequence
  Synthetic Polynucleotide
taatacgactcactataggggaaaatatagcctcttcaaaattggccttgaacagaggagacaaggcatgttttgaagaaacctggcggcagcgcaaaagatg

SEQ ID NO: 6923 - DNA, 103 bp, Artificial Sequence
  Synthetic Polynucleotide
taatacgactcactatagggacttggaaaatatagcctcttcaaaattggaacagaggagaccaattatgaagaggctaaacctggcggcagcgcaaaagatg

SEQ ID NO: 6924 - DNA, 103 bp, Artificial Sequence
  Synthetic Polynucleotide
taatacgactcactatagggtatatacttggaaaatatagcctcttcaaaaacagaggagatttgaaatggctatatttaacctggcggcagcgcaaaagatg

SEQ ID NO: 6925 - DNA, 103 bp, Artificial Sequence
  Synthetic Polynucleotide
taatacgactcactatagggtttcctatatacttggaaaatatagcctctaacagaggagaagaggcatgattttccaaaacctggcggcagcgcaaaagatg

SEQ ID NO: 6926 - DNA, 103 bp, Artificial Sequence
  Synthetic Polynucleotide
taatacgactcactatagggtgacatttcctatatacttggaaaatatagaacagaggagactatatatgccaagtataaacctggcggcagcgcaaaagatg

SEQ ID NO: 6927 - DNA, 103 bp, Artificial Sequence
  Synthetic Polynucleotide
taatacgactcactatagggtgtgttgacatttcctatatacttggaaaaaacagaggagattttccatgtatataggaaacctggcggcagcgcaaaagatg

SEQ ID NO: 6928 - DNA, 103 bp, Artificial Sequence
  Synthetic Polynucleotide
taatacgactcactatagggacgtgtgtgttgacatttcctatatacttgaacagaggagacaagtaatgaggaaatgtaacctggcggcagcgcaaaagatg

SEQ ID NO: 6929 - DNA, 103 bp, Artificial Sequence
  Synthetic Polynucleotide
taatacgactcactataggggccaatccaatagctatatggtaacaatctaacagaggagaagattgatgccatatagcaacctggcggcagcgcaaaagatg

SEQ ID NO: 6930 - DNA, 103 bp, Artificial Sequence
  Synthetic Polynucleotide
taatacgactcactatagggcatccacgtgtgtgttgacatttcctatataacagaggagaatatagatgatgtcaacaaacctggcggcagcgcaaaagatg

SEQ ID NO: 6931 - DNA, 103 bp, Artificial Sequence
  Synthetic Polynucleotide
taatacgactcactataggggtactcatccacgtgtgtgttgacatttccaacagaggagaggaaatatgaacacacacaacctggcggcagcgcaaaagatg

SEQ ID NO: 6932 - DNA, 103 bp, Artificial Sequence
  Synthetic Polynucleotide
taatacgactcactatagggagcatgtactcatccacgtgtgtgttgacaaacagaggagatgtcaaatgacacgtggaaacctggcggcagcgcaaaagatg

SEQ ID NO: 6933 - DNA, 103 bp, Artificial Sequence
  Synthetic Polynucleotide
taatacgactcactatagggcttccagcatgtactcatccacgtgtgtgtaacagaggagaacacacatgtggatgagtaacctggcggcagcgcaaaagatg

SEQ ID NO: 6934 - DNA, 103 bp, Artificial Sequence
  Synthetic Polynucleotide
taatacgactcactatagggcactgcttccagcatgtactcatccacgtgaacagaggagacacgtgatggagtacatgaacctggcggcagcgcaaaagatg

SEQ ID NO: 6935 - DNA, 103 bp, Artificial Sequence
  Synthetic Polynucleotide
taatacgactcactatagggtggtccactgcttccagcatgtactcatccaacagaggagaggatgaatgcatgctggaaacctggcggcagcgcaaaagatg

SEQ ID NO: 6936 - DNA, 103 bp, Artificial Sequence
  Synthetic Polynucleotide
taatacgactcactatagggcgtagtggtccactgcttccagcatgtactaacagaggagaagtacaatgtggaagcagaacctggcggcagcgcaaaagatg

SEQ ID NO: 6937 - DNA, 103 bp, Artificial Sequence
  Synthetic Polynucleotide
taatacgactcactataggggcctgcgtagtggtccactgcttccagcataacagaggagaatgctgatggcagtggacaacctggcggcagcgcaaaagatg

SEQ ID NO: 6938 - DNA, 103 bp, Artificial Sequence
  Synthetic Polynucleotide
taatacgactcactatagggagttggcctgcgtagtggtccactgcttccaacagaggagaggaagcatgggaccactaaacctggcggcagcgcaaaagatg

SEQ ID NO: 6939 - DNA, 103 bp, Artificial Sequence
  Synthetic Polynucleotide
taatacgactcactatagggtggctagttggcctgcgtagtggtccactgaacagaggagacagtggatgactacgcagaacctggcggcagcgcaaaagatg

SEQ ID NO: 6940 - DNA, 103 bp, Artificial Sequence
  Synthetic Polynucleotide
taatacgactcactatagggggatggccaatccaatagctatatggtaacaacagaggagagttaccatgtagctattgaacctggcggcagcgcaaaagatg

SEQ ID NO: 6941 - DNA, 103 bp, Artificial Sequence
  Synthetic Polynucleotide
taatacgactcactatagggtagggtggctagttggcctgcgtagtggtcaacagaggagagaccacatggcaggccaaaacctggcggcagcgcaaaagatg

SEQ ID NO: 6942 - DNA, 103 bp, Artificial Sequence
  Synthetic Polynucleotide
taatacgactcactatagggatatctagggtggctagttggcctgcgtagaacagaggagactacgcatgccaactagcaacctggcggcagcgcaaaagatg

SEQ ID NO: 6943 - DNA, 103 bp, Artificial Sequence
  Synthetic Polynucleotide
taatacgactcactatagggtgctgatatctagggtggctagttggcctgaacagaggagacaggccatgtagccacccaacctggcggcagcgcaaaagatg

SEQ ID NO: 6944 - DNA, 103 bp, Artificial Sequence
  Synthetic Polynucleotide
taatacgactcactatagggttcagtgctgatatctagggtggctagttgaacagaggagacaactaatgaccctagataacctggcggcagcgcaaaagatg

SEQ ID NO: 6945 - DNA, 103 bp, Artificial Sequence
  Synthetic Polynucleotide
taatacgactcactatagggattggttcagtgctgatatctagggtggctaacagaggagaagccacatgagatatcagaacctggcggcagcgcaaaagatg

SEQ ID NO: 6946 - DNA, 103 bp, Artificial Sequence
  Synthetic Polynucleotide
taatacgactcactataggggtttcattggttcagtgctgatatctagggaacagaggagaccctagatgtcagcactgaacctggcggcagcgcaaaagatg

SEQ ID NO: 6947 - DNA, 103 bp, Artificial Sequence
  Synthetic Polynucleotide
taatacgactcactatagggctccagtttcattggttcagtgctgatatcaacagaggagagatatcatgactgaaccaaacctggcggcagcgcaaaagatg

SEQ ID NO: 6948 - DNA, 103 bp, Artificial Sequence
  Synthetic Polynucleotide
taatacgactcactataggggcgtcctccagtttcattggttcagtgctgaacagaggagacagcacatgaccaatgaaaacctggcggcagcgcaaaagatg

SEQ ID NO: 6949 - DNA, 103 bp, Artificial Sequence
  Synthetic Polynucleotide
taatacgactcactatagggacactgcgtcctccagtttcattggttcagaacagaggagactgaacatgtgaaactggaacctggcggcagcgcaaaagatg

SEQ ID NO: 6950 - DNA, 103 bp, Artificial Sequence
  Synthetic Polynucleotide
taatacgactcactatagggaccgtacactgcgtcctccagtttcattggaacagaggagaccaatgatgctggaggacaacctggcggcagcgcaaaagatg

SEQ ID NO: 6951 - DNA, 103 bp, Artificial Sequence
  Synthetic Polynucleotide
taatacgactcactatagggtcaccggatggccaatccaatagctatatgaacagaggagacatataatgattggattgaacctggcggcagcgcaaaagatg

SEQ ID NO: 6952 - DNA, 103 bp, Artificial Sequence
  Synthetic Polynucleotide
taatacgactcactatagggtcggtaccgtacactgcgtcctccagtttcaacagaggagagaaactatgggacgcagtaacctggcggcagcgcaaaagatg

SEQ ID NO: 6953 - DNA, 103 bp, Artificial Sequence
  Synthetic Polynucleotide
taatacgactcactataggggaccctcggtaccgtacactgcgtcctccaaacagaggagatggaggatgcagtgtacgaacctggcggcagcgcaaaagatg

SEQ ID NO: 6954 - DNA, 103 bp, Artificial Sequence
  Synthetic Polynucleotide
taatacgactcactatagggctcaagaccctcggtaccgtacactgcgtcaacagaggagagacgcaatgtacggtaccaacctggcggcagcgcaaaagatg

SEQ ID NO: 6955 - DNA, 103 bp, Artificial Sequence
  Synthetic Polynucleotide
taatacgactcactatagggagcgcctcaagaccctcggtaccgtacactaacagaggagaagtgtaatgtaccgagggaacctggcggcagcgcaaaagatg

SEQ ID NO: 6956 - DNA, 103 bp, Artificial Sequence
  Synthetic Polynucleotide
taatacgactcactataggggatcaagcgcctcaagaccctcggtaccgtaacagaggagaacggtaatgagggtcttgaacctggcggcagcgcaaaagatg

SEQ ID NO: 6957 - DNA, 103 bp, Artificial Sequence
  Synthetic Polynucleotide
taatacgactcactatagggtgttagatcaagcgcctcaagaccctcggtaacagaggagaaccgagatgcttgaggcgaacctggcggcagcgcaaaagatg

SEQ ID NO: 6958 - DNA, 103 bp, Artificial Sequence
  Synthetic Polynucleotide
taatacgactcactatagggctcgttgttagatcaagcgcctcaagacccaacagaggagagggtctatgggcgcttgaaacctggcggcagcgcaaaagatg

SEQ ID NO: 6959 - DNA, 103 bp, Artificial Sequence
  Synthetic Polynucleotide
taatacgactcactatagggcggcactcgttgttagatcaagcgcctcaaaacagaggagattgaggatgttgatctaaaacctggcggcagcgcaaaagatg

SEQ ID NO: 6960 - DNA, 103 bp, Artificial Sequence
  Synthetic Polynucleotide
taatacgactcactataggggtaaccggcactcgttgttagatcaagcgcaacagaggagagcgcttatgctaacaacgaacctggcggcagcgcaaaagatg

SEQ ID NO: 6961 - DNA, 103 bp, Artificial Sequence
  Synthetic Polynucleotide
taatacgactcactatagggtatgggtaaccggcactcgttgttagatcaaacagaggagatgatctatgaacgagtgcaacctggcggcagcgcaaaagatg

SEQ ID NO: 6962 - DNA, 103 bp, Artificial Sequence
  Synthetic Polynucleotide
taatacgactcactatagggattggtcaccggatggccaatccaatagctaacagaggagaagctatatgattggccataacctggcggcagcgcaaaagatg

SEQ ID NO: 6963 - DNA, 103 bp, Artificial Sequence
  Synthetic Polynucleotide
taatacgactcactatagggcaacatatgggtaaccggcactcgttgttaaacagaggagataacaaatggtgccggttaacctggcggcagcgcaaaagatg

SEQ ID NO: 6964 - DNA, 103 bp, Artificial Sequence
  Synthetic Polynucleotide
taatacgactcactatagggcagtgcaacatatgggtaaccggcactcgtaacagaggagaacgagtatgggttacccaaacctggcggcagcgcaaaagatg

SEQ ID NO: 6965 - DNA, 103 bp, Artificial Sequence
  Synthetic Polynucleotide
taatacgactcactatagggatacccagtgcaacatatgggtaaccggcaaacagaggagatgccggatgcccatatgtaacctggcggcagcgcaaaagatg

SEQ ID NO: 6966 - DNA, 103 bp, Artificial Sequence
  Synthetic Polynucleotide
taatacgactcactatagggtcttgatacccagtgcaacatatgggtaacaacagaggagagttaccatgatgttgcacaacctggcggcagcgcaaaagatg

SEQ ID NO: 6967 - DNA, 103 bp, Artificial Sequence
  Synthetic Polynucleotide
taatacgactcactatagggcctcttcttgatacccagtgcaacatatggaacagaggagaccatatatggcactgggtaacctggcggcagcgcaaaagatg

SEQ ID NO: 6968 - DNA, 103 bp, Artificial Sequence
  Synthetic Polynucleotide
taatacgactcactatagggatgtccctcttcttgatacccagtgcaacaaacagaggagatgttgcatggggtatcaaaacctggcggcagcgcaaaagatg

SEQ ID NO: 6969 - DNA, 103 bp, Artificial Sequence
  Synthetic Polynucleotide
taatacgactcactatagggagaggatgtccctcttcttgatacccagtgaacagaggagacactggatgtcaagaagaaacctggcggcagcgcaaaagatg

SEQ ID NO: 6970 - DNA, 103 bp, Artificial Sequence
  Synthetic Polynucleotide
taatacgactcactatagggcttagagaggatgtccctcttcttgataccaacagaggagaggtatcatgaagagggacaacctggcggcagcgcaaaagatg

SEQ ID NO: 6971 - DNA, 103 bp, Artificial Sequence
  Synthetic Polynucleotide
taatacgactcactataggggtcttcttagagaggatgtccctcttcttgaacagaggagacaagaaatgggacatcctaacctggcggcagcgcaaaagatg

SEQ ID NO: 6972 - DNA, 103 bp, Artificial Sequence
  Synthetic Polynucleotide
taatacgactcactatagggccttagtcttcttagagaggatgtccctctaacagaggagaagagggatgtcctctctaaacctggcggcagcgcaaaagatg

SEQ ID NO: 6973 - DNA, 103 bp, Artificial Sequence
  Synthetic Polynucleotide
taatacgactcactataggggctctattggtcaccggatggccaatccaaaacagaggagattggatatgccatccggtaacctggcggcagcgcaaaagatg

SEQ ID NO: 6974 - DNA, 103 bp, Artificial Sequence
  Synthetic Polynucleotide
taatacgactcactatagggtaggtccttagtcttcttagagaggatgtcaacagaggagagacatcatgtctaagaagaacctggcggcagcgcaaaagatg

SEQ ID NO: 6975 - DNA, 103 bp, Artificial Sequence
  Synthetic Polynucleotide
taatacgactcactatagggtttgttaggtccttagtcttcttagagaggaacagaggagacctctcatggaagactaaaacctggcggcagcgcaaaagatg

SEQ ID NO: 6976 - DNA, 103 bp, Artificial Sequence
  Synthetic Polynucleotide
taatacgactcactatagggttaactttgttaggtccttagtcttcttagaacagaggagactaagaatgctaaggaccaacctggcggcagcgcaaaagatg

SEQ ID NO: 6977 - DNA, 103 bp, Artificial Sequence
  Synthetic Polynucleotide
taatacgactcactatagggttcctttaactttgttaggtccttagtcttaacagaggagaaagactatggacctaacaaacctggcggcagcgcaaaagatg

SEQ ID NO: 6978 - DNA, 103 bp, Artificial Sequence
  Synthetic Polynucleotide
taatacgactcactatagggatacattcctttaactttgttaggtccttaaacagaggagataaggaatgaacaaagttaacctggcggcagcgcaaaagatg

SEQ ID NO: 6979 - DNA, 103 bp, Artificial Sequence
  Synthetic Polynucleotide
taatacgactcactatagggtgtccatacattcctttaactttgttaggtaacagaggagaacctaaatgagttaaaggaacctggcggcagcgcaaaagatg

SEQ ID NO: 6980 - DNA, 103 bp, Artificial Sequence
  Synthetic Polynucleotide
taatacgactcactatagggatacttgtccatacattcctttaactttgtaacagaggagaacaaagatgaaggaatgtaacctggcggcagcgcaaaagatg

SEQ ID NO: 6981 - DNA, 103 bp, Artificial Sequence
  Synthetic Polynucleotide
taatacgactcactatagggaggccatacttgtccatacattcctttaacaacagaggagagttaaaatgatgtatggaaacctggcggcagcgcaaaagatg

SEQ ID NO: 6982 - DNA, 103 bp, Artificial Sequence
  Synthetic Polynucleotide
taatacgactcactatagggggttcaggccatacttgtccatacattcctaacagaggagaaggaatatgtggacaagtaacctggcggcagcgcaaaagatg

SEQ ID NO: 6983 - DNA, 103 bp, Artificial Sequence
  Synthetic Polynucleotide
taatacgactcactatagggtggtaggttcaggccatacttgtccatacaaacagaggagatgtatgatgaagtatggcaacctggcggcagcgcaaaagatg

SEQ ID NO: 6984 - DNA, 103 bp, Artificial Sequence
  Synthetic Polynucleotide
taatacgactcactatagggtaatagctctattggtcaccggatggccaaaacagaggagattggccatgcggtgaccaaacctggcggcagcgcaaaagatg

SEQ ID NO: 6985 - DNA, 103 bp, Artificial Sequence
  Synthetic Polynucleotide
taatacgactcactatagggaccattggtaggttcaggccatacttgtccaacagaggagaggacaaatgtggcctgaaaacctggcggcagcgcaaaagatg

SEQ ID NO: 6986 - DNA, 103 bp, Artificial Sequence
  Synthetic Polynucleotide
taatacgactcactatagggaagtcaccattggtaggttcaggccatactaacagaggagaagtatgatgtgaacctacaacctggcggcagcgcaaaagatg

SEQ ID NO: 6987 - DNA, 103 bp, Artificial Sequence
  Synthetic Polynucleotide
taatacgactcactatagggtacataagtcaccattggtaggttcaggccaacagaggagaggcctgatgctaccaatgaacctggcggcagcgcaaaagatg

SEQ ID NO: 6988 - DNA, 103 bp, Artificial Sequence
  Synthetic Polynucleotide
taatacgactcactatagggtcttttacataagtcaccattggtaggttcaacagaggagagaacctatgaatggtgacaacctggcggcagcgcaaaagatg

SEQ ID NO: 6989 - DNA, 103 bp, Artificial Sequence
  Synthetic Polynucleotide
taatacgactcactataggggctcatcttttacataagtcaccattggtaaacagaggagataccaaatgtgacttatgaacctggcggcagcgcaaaagatg

SEQ ID NO: 6990 - DNA, 103 bp, Artificial Sequence
  Synthetic Polynucleotide
taatacgactcactatagggcctgagctcatcttttacataagtcaccataacagaggagaatggtgatgtatgtaaaaaacctggcggcagcgcaaaagatg

SEQ ID NO: 6991 - DNA, 103 bp, Artificial Sequence
  Synthetic Polynucleotide
taatacgactcactatagggatggacctgagctcatcttttacataagtcaacagaggagagacttaatgaaaagatgaaacctggcggcagcgcaaaagatg

SEQ ID NO: 6992 - DNA, 103 bp, Artificial Sequence
  Synthetic Polynucleotide
taatacgactcactatagggtctctatggacctgagctcatcttttacataacagaggagaatgtaaatgatgagctcaaacctggcggcagcgcaaaagatg

SEQ ID NO: 6993 - DNA, 103 bp, Artificial Sequence
  Synthetic Polynucleotide
taatacgactcactatagggtaccttctctatggacctgagctcatctttaacagaggagaaaagatatgctcaggtccaacctggcggcagcgcaaaagatg

SEQ ID NO: 6994 - DNA, 103 bp, Artificial Sequence
  Synthetic Polynucleotide
taatacgactcactatagggttcgctaccttctctatggacctgagctcaaacagaggagatgagctatggtccatagaaacctggcggcagcgcaaaagatg

SEQ ID NO: 6995 - DNA, 103 bp, Artificial Sequence
  Synthetic Polynucleotide
taatacgactcactatagggatatataatagctctattggtcaccggatgaacagaggagacatccgatgaccaatagaaacctggcggcagcgcaaaagatg

SEQ ID NO: 6996 - DNA, 103 bp, Artificial Sequence
  Synthetic Polynucleotide
taatacgactcactatagggttcctttcgctaccttctctatggacctgaaacagaggagatcaggtatgtagagaaggaacctggcggcagcgcaaaagatg

SEQ ID NO: 6997 - DNA, 103 bp, Artificial Sequence
  Synthetic Polynucleotide
taatacgactcactatagggagactttcctttcgctaccttctctatggaaacagaggagatccataatgaaggtagcgaacctggcggcagcgcaaaagatg

SEQ ID NO: 6998 - DNA, 103 bp, Artificial Sequence
  Synthetic Polynucleotide
taatacgactcactatagggagcctagactttcctttcgctaccttctctaacagaggagaagagaaatgagcgaaaggaacctggcggcagcgcaaaagatg

SEQ ID NO: 6999 - DNA, 103 bp, Artificial Sequence
  Synthetic Polynucleotide
taatacgactcactatagggcaatcagcctagactttcctttcgctacctaacagaggagaaggtagatgaaggaaagtaacctggcggcagcgcaaaagatg

SEQ ID NO: 7000 - DNA, 103 bp, Artificial Sequence
  Synthetic Polynucleotide
taatacgactcactatagggcgcctcaatcagcctagactttcctttcgcaacagaggagagcgaaaatgaagtctaggaacctggcggcagcgcaaaagatg

SEQ ID NO: 7001 - DNA, 103 bp, Artificial Sequence
  Synthetic Polynucleotide
taatacgactcactatagggctggacgcctcaatcagcctagactttcctaacagaggagaaggaaaatgtaggctgataacctggcggcagcgcaaaagatg

SEQ ID NO: 7002 - DNA, 103 bp, Artificial Sequence
  Synthetic Polynucleotide
taatacgactcactatagggtcaaactggacgcctcaatcagcctagactaacagaggagaagtctaatgtgattgaggaacctggcggcagcgcaaaagatg

SEQ ID NO: 7003 - DNA, 103 bp, Artificial Sequence
  Synthetic Polynucleotide
taatacgactcactatagggatcattcaaactggacgcctcaatcagcctaacagaggagaaggctgatggaggcgtccaacctggcggcagcgcaaaagatg

SEQ ID NO: 7004 - DNA, 103 bp, Artificial Sequence
  Synthetic Polynucleotide
taatacgactcactatagggactgaatcattcaaactggacgcctcaatcaacagaggagagattgaatggtccagtttaacctggcggcagcgcaaaagatg

SEQ ID NO: 7005 - DNA, 103 bp, Artificial Sequence
  Synthetic Polynucleotide
taatacgactcactatagggtcgccactgaatcattcaaactggacgcctaacagaggagaaggcgtatggtttgaatgaacctggcggcagcgcaaaagatg

SEQ ID NO: 7006 - DNA, 103 bp, Artificial Sequence
  Synthetic Polynucleotide
taatacgactcactatagggaagagatatataatagctctattggtcaccaacagaggagaggtgacatgtagagctataacctggcggcagcgcaaaagatg

SEQ ID NO: 7007 - DNA, 103 bp, Artificial Sequence
  Synthetic Polynucleotide
taatacgactcactatagggtctcatcgccactgaatcattcaaactggaaacagaggagatccagtatgaatgattcaaacctggcggcagcgcaaaagatg

SEQ ID NO: 7008 - DNA, 103 bp, Artificial Sequence
  Synthetic Polynucleotide
taatacgactcactataggggtctgtctcatcgccactgaatcattcaaaaacagaggagatttgaaatgttcagtggcaacctggcggcagcgcaaaagatg

SEQ ID NO: 7009 - DNA, 103 bp, Artificial Sequence
  Synthetic Polynucleotide
taatacgactcactatagggcaaatgtctgtctcatcgccactgaatcataacagaggagaatgattatgtggcgatgaaacctggcggcagcgcaaaagatg

SEQ ID NO: 7010 - DNA, 103 bp, Artificial Sequence
  Synthetic Polynucleotide
taatacgactcactatagggattaccaaatgtctgtctcatcgccactgaaacagaggagatcagtgatgatgagacagaacctggcggcagcgcaaaagatg

SEQ ID NO: 7011 - DNA, 103 bp, Artificial Sequence
  Synthetic Polynucleotide
taatacgactcactatagggtacagattaccaaatgtctgtctcatcgccaacagaggagaggcgatatgacagacattaacctggcggcagcgcaaaagatg

SEQ ID NO: 7012 - DNA, 103 bp, Artificial Sequence
  Synthetic Polynucleotide
taatacgactcactatagggttttgtacagattaccaaatgtctgtctcaaacagaggagatgagacatgcatttggtaaacctggcggcagcgcaaaagatg

SEQ ID NO: 7013 - DNA, 103 bp, Artificial Sequence
  Synthetic Polynucleotide
taatacgactcactataggggaaagttttgtacagattaccaaatgtctgaacagaggagacagacaatgggtaatctgaacctggcggcagcgcaaaagatg

SEQ ID NO: 7014 - DNA, 103 bp, Artificial Sequence
  Synthetic Polynucleotide
taatacgactcactatagggaggtggaaagttttgtacagattaccaaataacagaggagaatttggatgtctgtacaaaacctggcggcagcgcaaaagatg

SEQ ID NO: 7015 - DNA, 103 bp, Artificial Sequence
  Synthetic Polynucleotide
taatacgactcactatagggggtttaggtggaaagttttgtacagattacaacagaggagagtaatcatgacaaaacttaacctggcggcagcgcaaaagatg

SEQ ID NO: 7016 - DNA, 103 bp, Artificial Sequence
  Synthetic Polynucleotide
taatacgactcactatagggccctgggtttaggtggaaagttttgtacagaacagaggagactgtacatgactttccacaacctggcggcagcgcaaaagatg

SEQ ID NO: 7017 - DNA, 103 bp, Artificial Sequence
  Synthetic Polynucleotide
taatacgactcactataggggtataaaacaggcgcacaaaggtaccgtgaaacagaggagatcacggatgctttgtgcgaacctggcggcagcgcaaaagatg

SEQ ID NO: 7018 - DNA, 103 bp, Artificial Sequence
  Synthetic Polynucleotide
taatacgactcactatagggcaacaaagagatatataatagctctattggaacagaggagaccaataatgctattatataacctggcggcagcgcaaaagatg

SEQ ID NO: 7019 - DNA, 103 bp, Artificial Sequence
  Synthetic Polynucleotide
taatacgactcactatagggacaacccctgggtttaggtggaaagttttgaacagaggagacaaaacatgccacctaaaaacctggcggcagcgcaaaagatg

SEQ ID NO: 7020 - DNA, 103 bp, Artificial Sequence
  Synthetic Polynucleotide
taatacgactcactatagggcagtcacaacccctgggtttaggtggaaagaacagaggagactttccatgtaaacccagaacctggcggcagcgcaaaagatg

SEQ ID NO: 7021 - DNA, 103 bp, Artificial Sequence
  Synthetic Polynucleotide
taatacgactcactatagggactaccagtcacaacccctgggtttaggtgaacagaggagacacctaatgccaggggttaacctggcggcagcgcaaaagatg

SEQ ID NO: 7022 - DNA, 103 bp, Artificial Sequence
  Synthetic Polynucleotide
taatacgactcactatagggacagcactaccagtcacaacccctgggtttaacagaggagaaaacccatgggttgtgacaacctggcggcagcgcaaaagatg

SEQ ID NO: 7023 - DNA, 103 bp, Artificial Sequence
  Synthetic Polynucleotide
taatacgactcactatagggacccaacagcactaccagtcacaacccctgaacagaggagacaggggatgtgactggtaaacctggcggcagcgcaaaagatg

SEQ ID NO: 7024 - DNA, 103 bp, Artificial Sequence
  Synthetic Polynucleotide
taatacgactcactataggggtcacacccaacagcactaccagtcacaacaacagaggagagttgtgatgggtagtgctaacctggcggcagcgcaaaagatg

SEQ ID NO: 7025 - DNA, 103 bp, Artificial Sequence
  Synthetic Polynucleotide
taatacgactcactatagggtctgggtcacacccaacagcactaccagtcaacagaggagagactggatgtgctgttggaacctggcggcagcgcaaaagatg

SEQ ID NO: 7026 - DNA, 103 bp, Artificial Sequence
  Synthetic Polynucleotide
taatacgactcactatagggagaggtctgggtcacacccaacagcactacaacagaggagagtagtgatgttgggtgtgaacctggcggcagcgcaaaagatg

SEQ ID NO: 7027 - DNA, 103 bp, Artificial Sequence
  Synthetic Polynucleotide
taatacgactcactatagggccaaaagaggtctgggtcacacccaacagcaacagaggagagctgttatgtgtgacccaaacctggcggcagcgcaaaagatg

SEQ ID NO: 7028 - DNA, 103 bp, Artificial Sequence
  Synthetic Polynucleotide
taatacgactcactatagggttgctccaaaagaggtctgggtcacacccaaacagaggagatgggtgatgcccagacctaacctggcggcagcgcaaaagatg

SEQ ID NO: 7029 - DNA, 103 bp, Artificial Sequence
  Synthetic Polynucleotide
taatacgactcactatagggaaacccaacaaagagatatataatagctctaacagaggagaagagctatgatatatctcaacctggcggcagcgcaaaagatg

SEQ ID NO: 7030 - DNA, 103 bp, Artificial Sequence
  Synthetic Polynucleotide
taatacgactcactataggggtatcttgctccaaaagaggtctgggtcacaacagaggagagtgaccatgacctcttttaacctggcggcagcgcaaaagatg

SEQ ID NO: 7031 - DNA, 103 bp, Artificial Sequence
  Synthetic Polynucleotide
taatacgactcactatagggcactggtatcttgctccaaaagaggtctggaacagaggagaccagacatgttttggagcaacctggcggcagcgcaaaagatg

SEQ ID NO: 7032 - DNA, 103 bp, Artificial Sequence
  Synthetic Polynucleotide
taatacgactcactatagggaacatcactggtatcttgctccaaaagaggaacagaggagacctcttatggagcaagataacctggcggcagcgcaaaagatg

SEQ ID NO: 7033 - DNA, 103 bp, Artificial Sequence
  Synthetic Polynucleotide
taatacgactcactatagggcatctaacatcactggtatcttgctccaaaaacagaggagatttggaatgagataccagaacctggcggcagcgcaaaagatg

SEQ ID NO: 7034 - DNA, 103 bp, Artificial Sequence
  Synthetic Polynucleotide
taatacgactcactatagggatgtccatctaacatcactggtatcttgctaacagaggagaagcaagatgccagtgatgaacctggcggcagcgcaaaagatg

SEQ ID NO: 7035 - DNA, 103 bp, Artificial Sequence
  Synthetic Polynucleotide
taatacgactcactatagggatgagatgtccatctaacatcactggtatcaacagaggagagataccatggatgttagaaacctggcggcagcgcaaaagatg

SEQ ID NO: 7036 - DNA, 103 bp, Artificial Sequence
  Synthetic Polynucleotide
taatacgactcactatagggatgctatgagatgtccatctaacatcactgaacagaggagacagtgaatgtagatggacaacctggcggcagcgcaaaagatg

SEQ ID NO: 7037 - DNA, 103 bp, Artificial Sequence
  Synthetic Polynucleotide
taatacgactcactatagggatcaaatgctatgagatgtccatctaacataacagaggagaatgttaatgggacatctcaacctggcggcagcgcaaaagatg

SEQ ID NO: 7038 - DNA, 103 bp, Artificial Sequence
  Synthetic Polynucleotide
taatacgactcactataggggagtaatcaaatgctatgagatgtccatctaacagaggagaagatggatgtctcatagcaacctggcggcagcgcaaaagatg

SEQ ID NO: 7039 - DNA, 103 bp, Artificial Sequence
  Synthetic Polynucleotide
taatacgactcactatagggacccagagtaatcaaatgctatgagatgtcaacagaggagagacatcatgtagcatttgaacctggcggcagcgcaaaagatg

SEQ ID NO: 7040 - DNA, 103 bp, Artificial Sequence
  Synthetic Polynucleotide
taatacgactcactatagggggtataaacccaacaaagagatatataataaacagaggagatattatatgtctctttgtaacctggcggcagcgcaaaagatg

SEQ ID NO: 7041 - DNA, 103 bp, Artificial Sequence
  Synthetic Polynucleotide
taatacgactcactatagggatcgtacccagagtaatcaaatgctatgagaacagaggagactcataatgtttgattacaacctggcggcagcgcaaaagatg

SEQ ID NO: 7042 - DNA, 103 bp, Artificial Sequence
  Synthetic Polynucleotide
taatacgactcactatagggctagcatcgtacccagagtaatcaaatgctaacagaggagaagcattatgttactctggaacctggcggcagcgcaaaagatg

SEQ ID NO: 7043 - DNA, 103 bp, Artificial Sequence
  Synthetic Polynucleotide
taatacgactcactatagggttaagctagcatcgtacccagagtaatcaaaacagaggagattgattatgctgggtacgaacctggcggcagcgcaaaagatg

SEQ ID NO: 7044 - DNA, 103 bp, Artificial Sequence
  Synthetic Polynucleotide
taatacgactcactatagggagggcttaagctagcatcgtacccagagtaaacagaggagatactctatgtacgatgctaacctggcggcagcgcaaaagatg

SEQ ID NO: 7045 - DNA, 103 bp, Artificial Sequence
  Synthetic Polynucleotide
taatacgactcactatagggcagacagggcttaagctagcatcgtacccaaacagaggagatgggtaatgtgctagcttaacctggcggcagcgcaaaagatg

SEQ ID NO: 7046 - DNA, 103 bp, Artificial Sequence
  Synthetic Polynucleotide
taatacgactcactatagggcaaaccagacagggcttaagctagcatcgtaacagaggagaacgatgatggcttaagccaacctggcggcagcgcaaaagatg

SEQ ID NO: 7047 - DNA, 103 bp, Artificial Sequence
  Synthetic Polynucleotide
taatacgactcactataggggcaagcaaaccagacagggcttaagctagcaacagaggagagctagcatgagccctgtcaacctggcggcagcgcaaaagatg

SEQ ID NO: 7048 - DNA, 103 bp, Artificial Sequence
  Synthetic Polynucleotide
taatacgactcactatagggtttaggcaagcaaaccagacagggcttaagaacagaggagacttaagatgtgtctggttaacctggcggcagcgcaaaagatg

SEQ ID NO: 7049 - DNA, 103 bp, Artificial Sequence
  Synthetic Polynucleotide
taatacgactcactatagggacatttttaggcaagcaaaccagacagggcaacagaggagagccctgatgggtttgcttaacctggcggcagcgcaaaagatg

SEQ ID NO: 7050 - DNA, 103 bp, Artificial Sequence
  Synthetic Polynucleotide
taatacgactcactatagggaagtaacatttttaggcaagcaaaccagacaacagaggagagtctggatggcttgcctaaacctggcggcagcgcaaaagatg

SEQ ID NO: 7051 - DNA, 103 bp, Artificial Sequence
  Synthetic Polynucleotide
taatacgactcactatagggtaagtggtataaacccaacaaagagatataaacagaggagatatatcatgttgttgggtaacctggcggcagcgcaaaagatg

SEQ ID NO: 7052 - DNA, 103 bp, Artificial Sequence
  Synthetic Polynucleotide
taatacgactcactatagggttctcaagtaacatttttaggcaagcaaacaacagaggagagtttgcatgcctaaaaataacctggcggcagcgcaaaagatg

SEQ ID NO: 7053 - DNA, 103 bp, Artificial Sequence
  Synthetic Polynucleotide
taatacgactcactatagggcaagcttctcaagtaacatttttaggcaagaacagaggagacttgccatgaaatgttacaacctggcggcagcgcaaaagatg

SEQ ID NO: 7054 - DNA, 103 bp, Artificial Sequence
  Synthetic Polynucleotide
taatacgactcactataggggtatccaagcttctcaagtaacatttttagaacagaggagactaaaaatgttacttgagaacctggcggcagcgcaaaagatg

SEQ ID NO: 7055 - DNA, 103 bp, Artificial Sequence
  Synthetic Polynucleotide
taatacgactcactatagggtgcgtgtatccaagcttctcaagtaacattaacagaggagaaatgttatgtgagaagctaacctggcggcagcgcaaaagatg

SEQ ID NO: 7056 - DNA, 103 bp, Artificial Sequence
  Synthetic Polynucleotide
taatacgactcactatagggctttgtgcgtgtatccaagcttctcaagtaaacagaggagatacttgatgagcttggataacctggcggcagcgcaaaagatg

SEQ ID NO: 7057 - DNA, 103 bp, Artificial Sequence
  Synthetic Polynucleotide
taatacgactcactatagggtgtctctttgtgcgtgtatccaagcttctcaacagaggagagagaagatgggatacacgaacctggcggcagcgcaaaagatg

SEQ ID NO: 7058 - DNA, 103 bp, Artificial Sequence
  Synthetic Polynucleotide
taatacgactcactatagggtagtttgtctctttgtgcgtgtatccaagcaacagaggagagcttggatgcacgcacaaaacctggcggcagcgcaaaagatg

SEQ ID NO: 7059 - DNA, 103 bp, Artificial Sequence
  Synthetic Polynucleotide
taatacgactcactatagggcaatgtagtttgtctctttgtgcgtgtatcaacagaggagagatacaatgacaaagagaaacctggcggcagcgcaaaagatg

SEQ ID NO: 7060 - DNA, 103 bp, Artificial Sequence
  Synthetic Polynucleotide
taatacgactcactataggggtagtcaatgtagtttgtctctttgtgcgtaacagaggagaacgcacatggagacaaacaacctggcggcagcgcaaaagatg

SEQ ID NO: 7061 - DNA, 103 bp, Artificial Sequence
  Synthetic Polynucleotide
taatacgactcactatagggcacaagtagtcaatgtagtttgtctctttgaacagaggagacaaagaatgaaactacataacctggcggcagcgcaaaagatg

SEQ ID NO: 7062 - DNA, 103 bp, Artificial Sequence
  Synthetic Polynucleotide
taatacgactcactatagggcaagctaagtggtataaacccaacaaagagaacagaggagactctttatggggtttataaacctggcggcagcgcaaaagatg

SEQ ID NO: 7063 - DNA, 103 bp, Artificial Sequence
  Synthetic Polynucleotide
taatacgactcactatagggagttgcacaagtagtcaatgtagtttgtctaacagaggagaagacaaatgacattgactaacctggcggcagcgcaaaagatg

SEQ ID NO: 7064 - DNA, 103 bp, Artificial Sequence
  Synthetic Polynucleotide
taatacgactcactatagggatgggagttgcacaagtagtcaatgtagttaacagaggagaaactacatggactacttgaacctggcggcagcgcaaaagatg

SEQ ID NO: 7065 - DNA, 103 bp, Artificial Sequence
  Synthetic Polynucleotide
taatacgactcactatagggaggtgatgggagttgcacaagtagtcaatgaacagaggagacattgaatgcttgtgcaaaacctggcggcagcgcaaaagatg

SEQ ID NO: 7066 - DNA, 103 bp, Artificial Sequence
  Synthetic Polynucleotide
taatacgactcactatagggtgtacaggtgatgggagttgcacaagtagtaacagaggagaactactatggcaactcccaacctggcggcagcgcaaaagatg

SEQ ID NO: 7067 - DNA, 103 bp, Artificial Sequence
  Synthetic Polynucleotide
taatacgactcactatagggatccctgtacaggtgatgggagttgcacaaaacagaggagattgtgcatgtcccatcacaacctggcggcagcgcaaaagatg

SEQ ID NO: 7068 - DNA, 103 bp, Artificial Sequence
  Synthetic Polynucleotide
taatacgactcactatagggtgtttatccctgtacaggtgatgggagttgaacagaggagacaactcatgtcacctgtaaacctggcggcagcgcaaaagatg

SEQ ID NO: 7069 - DNA, 103 bp, Artificial Sequence
  Synthetic Polynucleotide
taatacgactcactatagggagtaatgtttatccctgtacaggtgatgggaacagaggagacccatcatgtgtacagggaacctggcggcagcgcaaaagatg

SEQ ID NO: 7070 - DNA, 103 bp, Artificial Sequence
  Synthetic Polynucleotide
taatacgactcactatagggcacaaagtaatgtttatccctgtacaggtgaacagaggagacacctgatgagggataaaaacctggcggcagcgcaaaagatg

SEQ ID NO: 7071 - DNA, 103 bp, Artificial Sequence
  Synthetic Polynucleotide
taatacgactcactatagggcccctcacaaagtaatgtttatccctgtacaacagaggagagtacagatgtaaacattaaacctggcggcagcgcaaaagatg

SEQ ID NO: 7072 - DNA, 103 bp, Artificial Sequence
  Synthetic Polynucleotide
taatacgactcactatagggtgccacccctcacaaagtaatgtttatcccaacagaggagagggataatgattactttgaacctggcggcagcgcaaaagatg

SEQ ID NO: 7073 - DNA, 103 bp, Artificial Sequence
  Synthetic Polynucleotide
taatacgactcactatagggtctttcaagctaagtggtataaacccaacaaacagaggagatgttggatgtataccactaacctggcggcagcgcaaaagatg

SEQ ID NO: 7074 - DNA, 103 bp, Artificial Sequence
  Synthetic Polynucleotide
taatacgactcactataggggggcatgccacccctcacaaagtaatgtttaacagaggagaaaacatatgtttgtgaggaacctggcggcagcgcaaaagatg

SEQ ID NO: 7075 - DNA, 103 bp, Artificial Sequence
  Synthetic Polynucleotide
taatacgactcactatagggcccgagggcatgccacccctcacaaagtaaaacagaggagattacttatggaggggtggaacctggcggcagcgcaaaagatg

SEQ ID NO: 7076 - DNA, 103 bp, Artificial Sequence
  Synthetic Polynucleotide
taatacgactcactatagggaacatcccgagggcatgccacccctcacaaaacagaggagattgtgaatggtggcatgcaacctggcggcagcgcaaaagatg

SEQ ID NO: 7077 - DNA, 103 bp, Artificial Sequence
  Synthetic Polynucleotide
taatacgactcactatagggaccagaacatcccgagggcatgccacccctaacagaggagaaggggtatgatgccctcgaacctggcggcagcgcaaaagatg

SEQ ID NO: 7078 - DNA, 103 bp, Artificial Sequence
  Synthetic Polynucleotide
taatacgactcactatagggctggtaccagaacatcccgagggcatgccaaacagaggagatggcatatgctcgggatgaacctggcggcagcgcaaaagatg

SEQ ID NO: 7079 - DNA, 103 bp, Artificial Sequence
  Synthetic Polynucleotide
taatacgactcactatagggaaatactggtaccagaacatcccgagggcaaacagaggagatgccctatggatgttctgaacctggcggcagcgcaaaagatg

SEQ ID NO: 7080 - DNA, 103 bp, Artificial Sequence
  Synthetic Polynucleotide
taatacgactcactataggggttgaaaatactggtaccagaacatcccgaaacagaggagatcgggaatgtctggtaccaacctggcggcagcgcaaaagatg

SEQ ID NO: 7081 - DNA, 103 bp, Artificial Sequence
  Synthetic Polynucleotide
taatacgactcactatagggattgagttgaaaatactggtaccagaacataacagaggagaatgttcatgtaccagtataacctggcggcagcgcaaaagatg

SEQ ID NO: 7082 - DNA, 103 bp, Artificial Sequence
  Synthetic Polynucleotide
taatacgactcactatagggtaatcattgagttgaaaatactggtaccagaacagaggagactggtaatggtattttcaaacctggcggcagcgcaaaagatg

SEQ ID NO: 7083 - DNA, 103 bp, Artificial Sequence
  Synthetic Polynucleotide
taatacgactcactatagggattgttaatcattgagttgaaaatactggtaacagaggagaaccagtatgttcaactcaaacctggcggcagcgcaaaagatg

SEQ ID NO: 7084 - DNA, 103 bp, Artificial Sequence
  Synthetic Polynucleotide
taatacgactcactatagggtaacctctttcaagctaagtggtataaaccaacagaggagaggtttaatgcacttagctaacctggcggcagcgcaaaagatg

SEQ ID NO: 7085 - DNA, 103 bp, Artificial Sequence
  Synthetic Polynucleotide
taatacgactcactatagggatgatattgttaatcattgagttgaaaataaacagaggagatattttatgctcaatgataacctggcggcagcgcaaaagatg

SEQ ID NO: 7086 - DNA, 103 bp, Artificial Sequence
  Synthetic Polynucleotide
taatacgactcactatagggtaattatgatattgttaatcattgagttgaaacagaggagatcaactatgtgattaacaaacctggcggcagcgcaaaagatg

SEQ ID NO: 7087 - DNA, 103 bp, Artificial Sequence
  Synthetic Polynucleotide
taatacgactcactatagggtgtcctaattatgatattgttaatcattgaaacagaggagatcaatgatgaacaatatcaacctggcggcagcgcaaaagatg

SEQ ID NO: 7088 - DNA, 103 bp, Artificial Sequence
  Synthetic Polynucleotide
taatacgactcactatagggattagtgtcctaattatgatattgttaatcaacagaggagagattaaatgtatcataataacctggcggcagcgcaaaagatg

SEQ ID NO: 7089 - DNA, 103 bp, Artificial Sequence
  Synthetic Polynucleotide
taatacgactcactatagggttagcattagtgtcctaattatgatattgtaacagaggagaacaataatgtaattaggaaacctggcggcagcgcaaaagatg

SEQ ID NO: 7090 - DNA, 103 bp, Artificial Sequence
  Synthetic Polynucleotide
taatacgactcactatagggcacttttagcattagtgtcctaattatgataacagaggagaatcataatgaggacactaaacctggcggcagcgcaaaagatg

SEQ ID NO: 7091 - DNA, 103 bp, Artificial Sequence
  Synthetic Polynucleotide
taatacgactcactatagggttgtacacttttagcattagtgtcctaattaacagaggagaaattagatgactaatgctaacctggcggcagcgcaaaagatg

SEQ ID NO: 7092 - DNA, 103 bp, Artificial Sequence
  Synthetic Polynucleotide
taatacgactcactatagggtccctttgtacacttttagcattagtgtccaacagaggagaggacacatgtgctaaaagaacctggcggcagcgcaaaagatg

SEQ ID NO: 7093 - DNA, 103 bp, Artificial Sequence
  Synthetic Polynucleotide
taatacgactcactataggggtcaatccctttgtacacttttagcattagaacagaggagactaatgatgaaagtgtacaacctggcggcagcgcaaaagatg

SEQ ID NO: 7094 - DNA, 103 bp, Artificial Sequence
  Synthetic Polynucleotide
taatacgactcactatagggtccaagtcaatccctttgtacacttttagcaacagaggagagctaaaatggtacaaaggaacctggcggcagcgcaaaagatg

SEQ ID NO: 7095 - DNA, 103 bp, Artificial Sequence
  Synthetic Polynucleotide
taatacgactcactatagggtgttttaacctctttcaagctaagtggtataacagaggagaataccaatgagcttgaaaaacctggcggcagcgcaaaagatg

SEQ ID NO: 7096 - DNA, 103 bp, Artificial Sequence
  Synthetic Polynucleotide
taatacgactcactatagggattggtccaagtcaatccctttgtacacttaacagaggagaaagtgtatgaagggattgaacctggcggcagcgcaaaagatg

SEQ ID NO: 7097 - DNA, 103 bp, Artificial Sequence
  Synthetic Polynucleotide
taatacgactcactatagggcctgaattggtccaagtcaatccctttgtaaacagaggagatacaaaatgattgacttgaacctggcggcagcgcaaaagatg

SEQ ID NO: 7098 - DNA, 103 bp, Artificial Sequence
  Synthetic Polynucleotide
taatacgactcactatagggatcatcctgaattggtccaagtcaatccctaacagaggagaagggatatgcttggaccaaacctggcggcagcgcaaaagatg

SEQ ID NO: 7099 - DNA, 103 bp, Artificial Sequence
  Synthetic Polynucleotide
taatacgactcactatagggatgcgatcatcctgaattggtccaagtcaaaacagaggagattgactatgaccaattcaaacctggcggcagcgcaaaagatg

SEQ ID NO: 7100 - DNA, 103 bp, Artificial Sequence
  Synthetic Polynucleotide
taatacgactcactatagggaccatatgcgatcatcctgaattggtccaaaacagaggagattggacatgttcaggatgaacctggcggcagcgcaaaagatg

SEQ ID NO: 7101 - DNA, 103 bp, Artificial Sequence
  Synthetic Polynucleotide
taatacgactcactatagggtcatcaccatatgcgatcatcctgaattggaacagaggagaccaattatggatgatcgcaacctggcggcagcgcaaaagatg

SEQ ID NO: 7102 - DNA, 103 bp, Artificial Sequence
  Synthetic Polynucleotide
taatacgactcactatagggtcacatcatcaccatatgcgatcatcctgaaacagaggagatcaggaatgtcgcatatgaacctggcggcagcgcaaaagatg

SEQ ID NO: 7103 - DNA, 103 bp, Artificial Sequence
  Synthetic Polynucleotide
taatacgactcactatagggtgcgatcacatcatcaccatatgcgatcataacagaggagaatgatcatgtatggtgataacctggcggcagcgcaaaagatg

SEQ ID NO: 7104 - DNA, 103 bp, Artificial Sequence
  Synthetic Polynucleotide
taatacgactcactatagggtacgatgcgatcacatcatcaccatatgcgaacagaggagacgcataatgtgatgatgtaacctggcggcagcgcaaaagatg

SEQ ID NO: 7105 - DNA, 103 bp, Artificial Sequence
  Synthetic Polynucleotide
taatacgactcactatagggatgggtacgatgcgatcacatcatcaccataacagaggagaatggtgatgatgtgatcgaacctggcggcagcgcaaaagatg

SEQ ID NO: 7106 - DNA, 103 bp, Artificial Sequence
  Synthetic Polynucleotide
taatacgactcactatagggtgtaatgttttaacctctttcaagctaagtaacagaggagaacttagatggaaagaggtaacctggcggcagcgcaaaagatg

SEQ ID NO: 7107 - DNA, 103 bp, Artificial Sequence
  Synthetic Polynucleotide
taatacgactcactatagggaggccatgggtacgatgcgatcacatcatcaacagaggagagatgatatgatcgcatcgaacctggcggcagcgcaaaagatg

SEQ ID NO: 7108 - DNA, 103 bp, Artificial Sequence
  Synthetic Polynucleotide
taatacgactcactatagggtctataggccatgggtacgatgcgatcacaaacagaggagatgtgatatgatcgtacccaacctggcggcagcgcaaaagatg

SEQ ID NO: 7109 - DNA, 103 bp, Artificial Sequence
  Synthetic Polynucleotide
taatacgactcactatagggatgcatctataggccatgggtacgatgcgaaacagaggagatcgcatatgacccatggcaacctggcggcagcgcaaaagatg

SEQ ID NO: 7110 - DNA, 103 bp, Artificial Sequence
  Synthetic Polynucleotide
taatacgactcactatagggtaaagatgcatctataggccatgggtacgaaacagaggagatcgtacatgtggcctataaacctggcggcagcgcaaaagatg

SEQ ID NO: 7111 - DNA, 103 bp, Artificial Sequence
  Synthetic Polynucleotide
taatacgactcactataggggcgagtaaagatgcatctataggccatgggaacagaggagacccatgatgtatagatgcaacctggcggcagcgcaaaagatg

SEQ ID NO: 7112 - DNA, 103 bp, Artificial Sequence
  Synthetic Polynucleotide
taatacgactcactatagggcttcagcgagtaaagatgcatctataggccaacagaggagaggcctaatgatgcatcttaacctggcggcagcgcaaaagatg

SEQ ID NO: 7113 - DNA, 103 bp, Artificial Sequence
  Synthetic Polynucleotide
taatacgactcactatagggaccagcttcagcgagtaaagatgcatctataacagaggagaatagatatgtctttactcaacctggcggcagcgcaaaagatg

SEQ ID NO: 7114 - DNA, 103 bp, Artificial Sequence
  Synthetic Polynucleotide
taatacgactcactatagggcccttaccagcttcagcgagtaaagatgcaaacagaggagatgcatcatgactcgctgaaacctggcggcagcgcaaaagatg

SEQ ID NO: 7115 - DNA, 103 bp, Artificial Sequence
  Synthetic Polynucleotide
taatacgactcactatagggcgtaacccttaccagcttcagcgagtaaagaacagaggagactttacatgctgaagctgaacctggcggcagcgcaaaagatg

SEQ ID NO: 7116 - DNA, 103 bp, Artificial Sequence
  Synthetic Polynucleotide
taatacgactcactatagggcagcccgtaacccttaccagcttcagcgagaacagaggagactcgctatggctggtaagaacctggcggcagcgcaaaagatg

SEQ ID NO: 7117 - DNA, 103 bp, Artificial Sequence
  Synthetic Polynucleotide
taatacgactcactatagggtgaattgtaatgttttaacctctttcaagcaacagaggagagcttgaatgaggttaaaaaacctggcggcagcgcaaaagatg

SEQ ID NO: 7118 - DNA, 103 bp, Artificial Sequence
  Synthetic Polynucleotide
taatacgactcactatagggatgatcagcccgtaacccttaccagcttcaaacagaggagatgaagcatgtaagggttaaacctggcggcagcgcaaaagatg

SEQ ID NO: 7119 - DNA, 103 bp, Artificial Sequence
  Synthetic Polynucleotide
taatacgactcactataggggtgtcatgatcagcccgtaacccttaccagaacagaggagactggtaatggttacgggcaacctggcggcagcgcaaaagatg

SEQ ID NO: 7120 - DNA, 103 bp, Artificial Sequence
  Synthetic Polynucleotide
taatacgactcactatagggtgctggtgtcatgatcagcccgtaacccttaacagaggagaaagggtatggggctgatcaacctggcggcagcgcaaaagatg

SEQ ID NO: 7121 - DNA, 103 bp, Artificial Sequence
  Synthetic Polynucleotide
taatacgactcactatagggttatctgctggtgtcatgatcagcccgtaaaacagaggagattacggatggatcatgacaacctggcggcagcgcaaaagatg

SEQ ID NO: 7122 - DNA, 103 bp, Artificial Sequence
  Synthetic Polynucleotide
taatacgactcactatagggctcccttatctgctggtgtcatgatcagccaacagaggagaggctgaatgtgacaccagaacctggcggcagcgcaaaagatg

SEQ ID NO: 7123 - DNA, 103 bp, Artificial Sequence
  Synthetic Polynucleotide
taatacgactcactataggggcactctcccttatctgctggtgtcatgataacagaggagaatcatgatgccagcagataacctggcggcagcgcaaaagatg

SEQ ID NO: 7124 - DNA, 103 bp, Artificial Sequence
  Synthetic Polynucleotide
taatacgactcactatagggttaaagcactctcccttatctgctggtgtcaacagaggagagacaccatgagataagggaacctggcggcagcgcaaaagatg

SEQ ID NO: 7125 - DNA, 103 bp, Artificial Sequence
  Synthetic Polynucleotide
taatacgactcactatagggcttcgttaaagcactctcccttatctgctgaacagaggagacagcagatgagggagagtaacctggcggcagcgcaaaagatg

SEQ ID NO: 7126 - DNA, 103 bp, Artificial Sequence
  Synthetic Polynucleotide
taatacgactcactatagggggtaacttcgttaaagcactctcccttatcaacagaggagagataagatggagtgctttaacctggcggcagcgcaaaagatg

SEQ ID NO: 7127 - DNA, 103 bp, Artificial Sequence
  Synthetic Polynucleotide
taatacgactcactataggggtccaggtaacttcgttaaagcactctcccaacagaggagagggagaatgctttaacgaaacctggcggcagcgcaaaagatg

SEQ ID NO: 7128 - DNA, 103 bp, Artificial Sequence
  Synthetic Polynucleotide
taatacgactcactatagggagggggtataaaacaggcgcacaaaggtacaacagaggagagtacctatgtgcgcctgtaacctggcggcagcgcaaaagatg

SEQ ID NO: 7129 - DNA, 103 bp, Artificial Sequence
  Synthetic Polynucleotide
taatacgactcactatagggaacaatgaattgtaatgttttaacctctttaacagaggagaaaagagatgaaaacattaaacctggcggcagcgcaaaagatg

SEQ ID NO: 7130 - DNA, 103 bp, Artificial Sequence
  Synthetic Polynucleotide
taatacgactcactatagggcgttggtccaggtaacttcgttaaagcactaacagaggagaagtgctatgacgaagttaaacctggcggcagcgcaaaagatg

SEQ ID NO: 7131 - DNA, 103 bp, Artificial Sequence
  Synthetic Polynucleotide
taatacgactcactatagggagtgacgttggtccaggtaacttcgttaaaaacagaggagatttaacatggttacctggaacctggcggcagcgcaaaagatg

SEQ ID NO: 7132 - DNA, 103 bp, Artificial Sequence
  Synthetic Polynucleotide
taatacgactcactatagggaggaaagtgacgttggtccaggtaacttcgaacagaggagacgaagtatgctggaccaaaacctggcggcagcgcaaaagatg

SEQ ID NO: 7133 - DNA, 103 bp, Artificial Sequence
  Synthetic Polynucleotide
taatacgactcactatagggtctttaggaaagtgacgttggtccaggtaaaacagaggagattacctatgccaacgtcaaacctggcggcagcgcaaaagatg

SEQ ID NO: 7134 - DNA, 103 bp, Artificial Sequence
  Synthetic Polynucleotide
taatacgactcactatagggatacctctttaggaaagtgacgttggtccaaacagaggagatggaccatggtcactttcaacctggcggcagcgcaaaagatg

SEQ ID NO: 7135 - DNA, 103 bp, Artificial Sequence
  Synthetic Polynucleotide
taatacgactcactatagggctaaaatacctctttaggaaagtgacgttgaacagaggagacaacgtatgtttcctaaaaacctggcggcagcgcaaaagatg

SEQ ID NO: 7136 - DNA, 103 bp, Artificial Sequence
  Synthetic Polynucleotide
taatacgactcactatagggctgctctaaaatacctctttaggaaagtgaaacagaggagatcacttatgtaaagaggtaacctggcggcagcgcaaaagatg

SEQ ID NO: 7137 - DNA, 103 bp, Artificial Sequence
  Synthetic Polynucleotide
taatacgactcactatagggttcatctgctctaaaatacctctttaggaaaacagaggagattcctaatgaggtattttaacctggcggcagcgcaaaagatg

SEQ ID NO: 7138 - DNA, 103 bp, Artificial Sequence
  Synthetic Polynucleotide
taatacgactcactatagggtactgttcatctgctctaaaatacctctttaacagaggagaaaagagatgttttagagcaacctggcggcagcgcaaaagatg

SEQ ID NO: 7139 - DNA, 103 bp, Artificial Sequence
  Synthetic Polynucleotide
taatacgactcactatagggaggggtactgttcatctgctctaaaataccaacagaggagaggtattatggagcagatgaacctggcggcagcgcaaaagatg

SEQ ID NO: 7140 - DNA, 103 bp, Artificial Sequence
  Synthetic Polynucleotide
taatacgactcactatagggaacttaacaatgaattgtaatgttttaaccaacagaggagaggttaaatgattacaattaacctggcggcagcgcaaaagatg

SEQ ID NO: 7141 - DNA, 103 bp, Artificial Sequence
  Synthetic Polynucleotide
taatacgactcactatagggcaggaaggggtactgttcatctgctctaaaaacagaggagatttagaatggatgaacagaacctggcggcagcgcaaaagatg

SEQ ID NO: 7142 - DNA, 103 bp, Artificial Sequence
  Synthetic Polynucleotide
taatacgactcactatagggtgcaccaggaaggggtactgttcatctgctaacagaggagaagcagaatgacagtacccaacctggcggcagcgcaaaagatg

SEQ ID NO: 7143 - DNA, 103 bp, Artificial Sequence
  Synthetic Polynucleotide
taatacgactcactatagggcaggatgcaccaggaaggggtactgttcataacagaggagaatgaacatgaccccttccaacctggcggcagcgcaaaagatg

SEQ ID NO: 7144 - DNA, 103 bp, Artificial Sequence
  Synthetic Polynucleotide
taatacgactcactatagggcataacaggatgcaccaggaaggggtactgaacagaggagacagtacatgttcctggtgaacctggcggcagcgcaaaagatg

SEQ ID NO: 7145 - DNA, 103 bp, Artificial Sequence
  Synthetic Polynucleotide
taatacgactcactatagggatgggcataacaggatgcaccaggaaggggaacagaggagaccccttatgggtgcatccaacctggcggcagcgcaaaagatg

SEQ ID NO: 7146 - DNA, 103 bp, Artificial Sequence
  Synthetic Polynucleotide
taatacgactcactatagggctttcatgggcataacaggatgcaccaggaaacagaggagatcctggatgatcctgttaaacctggcggcagcgcaaaagatg

SEQ ID NO: 7147 - DNA, 103 bp, Artificial Sequence
  Synthetic Polynucleotide
taatacgactcactatagggtatgtctttcatgggcataacaggatgcacaacagaggagagtgcatatggttatgcccaacctggcggcagcgcaaaagatg

SEQ ID NO: 7148 - DNA, 103 bp, Artificial Sequence
  Synthetic Polynucleotide
taatacgactcactatagggtcgtgtatgtctttcatgggcataacaggaaacagaggagatcctgtatggcccatgaaaacctggcggcagcgcaaaagatg

SEQ ID NO: 7149 - DNA, 103 bp, Artificial Sequence
  Synthetic Polynucleotide
taatacgactcactatagggttgattcgtgtatgtctttcatgggcataaaacagaggagattatgcatgtgaaagacaaacctggcggcagcgcaaaagatg

SEQ ID NO: 7150 - DNA, 103 bp, Artificial Sequence
  Synthetic Polynucleotide
taatacgactcactatagggtctaattgattcgtgtatgtctttcatgggaacagaggagacccatgatggacatacacaacctggcggcagcgcaaaagatg

SEQ ID NO: 7151 - DNA, 103 bp, Artificial Sequence
  Synthetic Polynucleotide
taatacgactcactatagggtattcaacttaacaatgaattgtaatgtttaacagaggagaaaacatatgaattcattgaacctggcggcagcgcaaaagatg

SEQ ID NO: 7152 - DNA, 103 bp, Artificial Sequence
  Synthetic Polynucleotide
taatacgactcactataggggtccatctaattgattcgtgtatgtctttcaacagaggagagaaagaatgacacgaatcaacctggcggcagcgcaaaagatg

SEQ ID NO: 7153 - DNA, 103 bp, Artificial Sequence
  Synthetic Polynucleotide
taatacgactcactatagggccttggtccatctaattgattcgtgtatgtaacagaggagaacatacatgaatcaattaaacctggcggcagcgcaaaagatg

SEQ ID NO: 7154 - DNA, 103 bp, Artificial Sequence
  Synthetic Polynucleotide
taatacgactcactatagggtggatccttggtccatctaattgattcgtgaacagaggagacacgaaatgattagatggaacctggcggcagcgcaaaagatg

SEQ ID NO: 7155 - DNA, 103 bp, Artificial Sequence
  Synthetic Polynucleotide
taatacgactcactatagggttctttggatccttggtccatctaattgataacagaggagaatcaatatgatggaccaaaacctggcggcagcgcaaaagatg

SEQ ID NO: 7156 - DNA, 103 bp, Artificial Sequence
  Synthetic Polynucleotide
taatacgactcactataggggggtgttctttggatccttggtccatctaaaacagaggagattagatatgccaaggatcaacctggcggcagcgcaaaagatg

SEQ ID NO: 7157 - DNA, 103 bp, Artificial Sequence
  Synthetic Polynucleotide
taatacgactcactatagggatcttgggtgttctttggatccttggtccaaacagaggagatggaccatggatccaaagaacctggcggcagcgcaaaagatg

SEQ ID NO: 7158 - DNA, 103 bp, Artificial Sequence
  Synthetic Polynucleotide
taatacgactcactatagggacgtgatcttgggtgttctttggatccttgaacagaggagacaaggaatgaaagaacacaacctggcggcagcgcaaaagatg

SEQ ID NO: 7159 - DNA, 103 bp, Artificial Sequence
  Synthetic Polynucleotide
taatacgactcactatagggagcgcacgtgatcttgggtgttctttggataacagaggagaatccaaatgacacccaagaacctggcggcagcgcaaaagatg

SEQ ID NO: 7160 - DNA, 103 bp, Artificial Sequence
  Synthetic Polynucleotide
taatacgactcactatagggcagtgagcgcacgtgatcttgggtgttcttaacagaggagaaagaacatgcaagatcacaacctggcggcagcgcaaaagatg

SEQ ID NO: 7161 - DNA, 103 bp, Artificial Sequence
  Synthetic Polynucleotide
taatacgactcactatagggagacacagtgagcgcacgtgatcttgggtgaacagaggagacacccaatgtcacgtgcgaacctggcggcagcgcaaaagatg

SEQ ID NO: 7162 - DNA, 103 bp, Artificial Sequence
  Synthetic Polynucleotide
taatacgactcactatagggtgctgtattcaacttaacaatgaattgtaaaacagaggagattacaaatgattgttaagaacctggcggcagcgcaaaagatg

SEQ ID NO: 7163 - DNA, 103 bp, Artificial Sequence
  Synthetic Polynucleotide
taatacgactcactatagggctaatagacacagtgagcgcacgtgatcttaacagaggagaaagatcatgtgcgctcacaacctggcggcagcgcaaaagatg

SEQ ID NO: 7164 - DNA, 103 bp, Artificial Sequence
  Synthetic Polynucleotide
taatacgactcactatagggccaagctaatagacacagtgagcgcacgtgaacagaggagacacgtgatgtcactgtgtaacctggcggcagcgcaaaagatg

SEQ ID NO: 7165 - DNA, 103 bp, Artificial Sequence
  Synthetic Polynucleotide
taatacgactcactatagggttatgccaagctaatagacacagtgagcgcaacagaggagagcgctcatggtgtctattaacctggcggcagcgcaaaagatg

SEQ ID NO: 7166 - DNA, 103 bp, Artificial Sequence
  Synthetic Polynucleotide
taatacgactcactatagggccccgttatgccaagctaatagacacagtgaacagaggagacactgtatgtattagcttaacctggcggcagcgcaaaagatg

SEQ ID NO: 7167 - DNA, 103 bp, Artificial Sequence
  Synthetic Polynucleotide
taatacgactcactataggggtgctccccgttatgccaagctaatagacaaacagaggagatgtctaatggcttggcataacctggcggcagcgcaaaagatg

SEQ ID NO: 7168 - DNA, 103 bp, Artificial Sequence
  Synthetic Polynucleotide
taatacgactcactatagggtattcgtgctccccgttatgccaagctaataacagaggagaattagcatggcataacggaacctggcggcagcgcaaaagatg

SEQ ID NO: 7169 - DNA, 103 bp, Artificial Sequence
  Synthetic Polynucleotide
taatacgactcactatagggcctcatattcgtgctccccgttatgccaagaacagaggagacttggcatgacggggagcaacctggcggcagcgcaaaagatg

SEQ ID NO: 7170 - DNA, 103 bp, Artificial Sequence
  Synthetic Polynucleotide
taatacgactcactataggggaactcctcatattcgtgctccccgttatgaacagaggagacataacatggagcacgaaaacctggcggcagcgcaaaagatg

SEQ ID NO: 7171 - DNA, 103 bp, Artificial Sequence
  Synthetic Polynucleotide
taatacgactcactatagggcggatgaactcctcatattcgtgctccccgaacagaggagacggggaatgcgaatatgaaacctggcggcagcgcaaaagatg

SEQ ID NO: 7172 - DNA, 103 bp, Artificial Sequence
  Synthetic Polynucleotide
taatacgactcactatagggttttacggatgaactcctcatattcgtgctaacagaggagaagcacgatgatgaggagtaacctggcggcagcgcaaaagatg

SEQ ID NO: 7173 - DNA, 103 bp, Artificial Sequence
  Synthetic Polynucleotide
taatacgactcactatagggcattttgctgtattcaacttaacaatgaataacagaggagaattcatatgtaagttgaaaacctggcggcagcgcaaaagatg

SEQ ID NO: 7174 - DNA, 103 bp, Artificial Sequence
  Synthetic Polynucleotide
taatacgactcactatagggtctaattttacggatgaactcctcatattcaacagaggagagaatatatggagttcatcaacctggcggcagcgcaaaagatg

SEQ ID NO: 7175 - DNA, 103 bp, Artificial Sequence
  Synthetic Polynucleotide
taatacgactcactatagggacgcttctaattttacggatgaactcctcaaacagaggagatgaggaatgcatccgtaaaacctggcggcagcgcaaaagatg

SEQ ID NO: 7176 - DNA, 103 bp, Artificial Sequence
  Synthetic Polynucleotide
taatacgactcactatagggctgggacgcttctaattttacggatgaactaacagaggagaagttcaatggtaaaattaaacctggcggcagcgcaaaagatg

SEQ ID NO: 7177 - DNA, 103 bp, Artificial Sequence
  Synthetic Polynucleotide
taatacgactcactatagggtccgactgggacgcttctaattttacggataacagaggagaatccgtatgattagaagcaacctggcggcagcgcaaaagatg

SEQ ID NO: 7178 - DNA, 103 bp, Artificial Sequence
  Synthetic Polynucleotide
taatacgactcactatagggcaacgtccgactgggacgcttctaattttaaacagaggagataaaatatgaagcgtcccaacctggcggcagcgcaaaagatg

SEQ ID NO: 7179 - DNA, 103 bp, Artificial Sequence
  Synthetic Polynucleotide
taatacgactcactatagggtcaaacaacgtccgactgggacgcttctaaaacagaggagattagaaatgtcccagtcgaacctggcggcagcgcaaaagatg

SEQ ID NO: 7180 - DNA, 103 bp, Artificial Sequence
  Synthetic Polynucleotide
taatacgactcactataggggagggtcaaacaacgtccgactgggacgctaacagaggagaagcgtcatggtcggacgtaacctggcggcagcgcaaaagatg

SEQ ID NO: 7181 - DNA, 103 bp, Artificial Sequence
  Synthetic Polynucleotide
taatacgactcactataggggcggggagggtcaaacaacgtccgactgggaacagaggagacccagtatgacgttgtttaacctggcggcagcgcaaaagatg

SEQ ID NO: 7182 - DNA, 103 bp, Artificial Sequence
  Synthetic Polynucleotide
taatacgactcactatagggaaaacgcggggagggtcaaacaacgtccgaaacagaggagatcggacatggtttgacccaacctggcggcagcgcaaaagatg

SEQ ID NO: 7183 - DNA, 103 bp, Artificial Sequence
  Synthetic Polynucleotide
taatacgactcactatagggagttgaaaacgcggggagggtcaaacaacgaacagaggagacgttgtatgaccctccccaacctggcggcagcgcaaaagatg

SEQ ID NO: 7184 - DNA, 103 bp, Artificial Sequence
  Synthetic Polynucleotide
taatacgactcactataggggctcccattttgctgtattcaacttaacaaaacagaggagattgttaatgtgaatacagaacctggcggcagcgcaaaagatg

SEQ ID NO: 7185 - DNA, 103 bp, Artificial Sequence
  Synthetic Polynucleotide
taatacgactcactatagggcgtagagttgaaaacgcggggagggtcaaaaacagaggagatttgacatgccccgcgttaacctggcggcagcgcaaaagatg

SEQ ID NO: 7186 - DNA, 103 bp, Artificial Sequence
  Synthetic Polynucleotide
taatacgactcactatagggtcctgcgtagagttgaaaacgcggggagggaacagaggagaccctccatgcgttttcaaaacctggcggcagcgcaaaagatg

SEQ ID NO: 7187 - DNA, 103 bp, Artificial Sequence
  Synthetic Polynucleotide
taatacgactcactatagggccacttcctgcgtagagttgaaaacgcgggaacagaggagacccgcgatgtcaactctaaacctggcggcagcgcaaaagatg

SEQ ID NO: 7188 - DNA, 103 bp, Artificial Sequence
  Synthetic Polynucleotide
taatacgactcactatagggtccaaccacttcctgcgtagagttgaaaacaacagaggagagttttcatgtctacgcagaacctggcggcagcgcaaaagatg

SEQ ID NO: 7189 - DNA, 103 bp, Artificial Sequence
  Synthetic Polynucleotide
taatacgactcactatagggaggagtccaaccacttcctgcgtagagttgaacagaggagacaactcatggcaggaagtaacctggcggcagcgcaaaagatg

SEQ ID NO: 7190 - DNA, 103 bp, Artificial Sequence
  Synthetic Polynucleotide
taatacgactcactatagggctaaaaggagtccaaccacttcctgcgtagaacagaggagactacgcatgaagtggttgaacctggcggcagcgcaaaagatg

SEQ ID NO: 7191 - DNA, 103 bp, Artificial Sequence
  Synthetic Polynucleotide
taatacgactcactatagggctaatctaaaaggagtccaaccacttcctgaacagaggagacaggaaatggttggactcaacctggcggcagcgcaaaagatg

SEQ ID NO: 7192 - DNA, 103 bp, Artificial Sequence
  Synthetic Polynucleotide
taatacgactcactatagggtgtctctaatctaaaaggagtccaaccactaacagaggagaagtggtatgactccttttaacctggcggcagcgcaaaagatg

SEQ ID NO: 7193 - DNA, 103 bp, Artificial Sequence
  Synthetic Polynucleotide
taatacgactcactatagggcaaattgtctctaatctaaaaggagtccaaaacagaggagattggacatgttttagattaacctggcggcagcgcaaaagatg

SEQ ID NO: 7194 - DNA, 103 bp, Artificial Sequence
  Synthetic Polynucleotide
taatacgactcactatagggtatttcaaattgtctctaatctaaaaggagaacagaggagactccttatggattagagaaacctggcggcagcgcaaaagatg

SEQ ID NO: 7195 - DNA, 103 bp, Artificial Sequence
  Synthetic Polynucleotide
taatacgactcactatagggcttgagctcccattttgctgtattcaacttaacagaggagaaagttgatgacagcaaaaaacctggcggcagcgcaaaagatg

SEQ ID NO: 7196 - DNA, 103 bp, Artificial Sequence
  Synthetic Polynucleotide
taatacgactcactatagggtaaattatttcaaattgtctctaatctaaaaacagaggagatttagaatggagacaattaacctggcggcagcgcaaaagatg

SEQ ID NO: 7197 - DNA, 103 bp, Artificial Sequence
  Synthetic Polynucleotide
taatacgactcactatagggcaatctaaattatttcaaattgtctctaataacagaggagaattagaatgaatttgaaaaacctggcggcagcgcaaaagatg

SEQ ID NO: 7198 - DNA, 103 bp, Artificial Sequence
  Synthetic Polynucleotide
taatacgactcactatagggtaagccaatctaaattatttcaaattgtctaacagaggagaagacaaatggaaataattaacctggcggcagcgcaaaagatg

SEQ ID NO: 7199 - DNA, 103 bp, Artificial Sequence
  Synthetic Polynucleotide
taatacgactcactatagggagggttaagccaatctaaattatttcaaataacagaggagaatttgaatgaatttagataacctggcggcagcgcaaaagatg

SEQ ID NO: 7200 - DNA, 103 bp, Artificial Sequence
  Synthetic Polynucleotide
taatacgactcactatagggacagtagggttaagccaatctaaattatttaacagaggagaaaataaatgagattggctaacctggcggcagcgcaaaagatg

SEQ ID NO: 7201 - DNA, 103 bp, Artificial Sequence
  Synthetic Polynucleotide
taatacgactcactatagggttagcacagtagggttaagccaatctaaataacagaggagaatttagatgggcttaaccaacctggcggcagcgcaaaagatg

SEQ ID NO: 7202 - DNA, 103 bp, Artificial Sequence
  Synthetic Polynucleotide
taatacgactcactatagggttcggttagcacagtagggttaagccaatcaacagaggagagattggatgaaccctactaacctggcggcagcgcaaaagatg

SEQ ID NO: 7203 - DNA, 103 bp, Artificial Sequence
  Synthetic Polynucleotide
taatacgactcactatagggtctggttcggttagcacagtagggttaagcaacagaggagagcttaaatgtactgtgctaacctggcggcagcgcaaaagatg

SEQ ID NO: 7204 - DNA, 103 bp, Artificial Sequence
  Synthetic Polynucleotide
taatacgactcactatagggcgttatctggttcggttagcacagtagggtaacagaggagaaccctaatgtgctaaccgaacctggcggcagcgcaaaagatg

SEQ ID NO: 7205 - DNA, 103 bp, Artificial Sequence
  Synthetic Polynucleotide
taatacgactcactatagggtgtaccgttatctggttcggttagcacagtaacagaggagaactgtgatgaccgaaccaaacctggcggcagcgcaaaagatg

SEQ ID NO: 7206 - DNA, 103 bp, Artificial Sequence
  Synthetic Polynucleotide
taatacgactcactatagggtgatacttgagctcccattttgctgtattcaacagaggagagaatacatgaaaatgggaaacctggcggcagcgcaaaagatg

SEQ ID NO: 7207 - DNA, 103 bp, Artificial Sequence
  Synthetic Polynucleotide
taatacgactcactatagggcctactgtaccgttatctggttcggttagcaacagaggagagctaacatgaccagataaaacctggcggcagcgcaaaagatg

SEQ ID NO: 7208 - DNA, 103 bp, Artificial Sequence
  Synthetic Polynucleotide
taatacgactcactatagggttacccctactgtaccgttatctggttcggaacagaggagaccgaacatgataacggtaaacctggcggcagcgcaaaagatg

SEQ ID NO: 7209 - DNA, 103 bp, Artificial Sequence
  Synthetic Polynucleotide
taatacgactcactatagggagaatttacccctactgtaccgttatctggaacagaggagaccagatatgggtacagtaaacctggcggcagcgcaaaagatg

SEQ ID NO: 7210 - DNA, 103 bp, Artificial Sequence
  Synthetic Polynucleotide
taatacgactcactatagggtgcggagaatttacccctactgtaccgttaaacagaggagataacggatgagtaggggtaacctggcggcagcgcaaaagatg

SEQ ID NO: 7211 - DNA, 103 bp, Artificial Sequence
  Synthetic Polynucleotide
taatacgactcactatagggccgaatgcggagaatttacccctactgtacaacagaggagagtacagatggggtaaattaacctggcggcagcgcaaaagatg

SEQ ID NO: 7212 - DNA, 103 bp, Artificial Sequence
  Synthetic Polynucleotide
taatacgactcactatagggtgcgttgatacttgagctcccattttgctgaacagaggagacagcaaatggggagctcaaacctggcggcagcgcaaaagatg

SEQ ID NO: 7213 - DNA, 103 bp, Artificial Sequence
  Synthetic Polynucleotide
taatacgactcactatagggtcttttgcgttgatacttgagctcccatttaacagaggagaaaatggatgctcaagtataacctggcggcagcgcaaaagatg

SEQ ID NO: 7214 - DNA, 103 bp, Artificial Sequence
  Synthetic Polynucleotide
taatacgactcactataggggggggagggggtataaaacaggcgcacaaaaacagaggagatttgtgatgctgttttataacctggcggcagcgcaaaagatg

SEQ ID NO: 7215 - DNA, 103 bp, Artificial Sequence
  Synthetic Polynucleotide
taatacgactcactatagggcccagtcttttgcgttgatacttgagctccaacagaggagaggagctatggtatcaacgaacctggcggcagcgcaaaagatg

SEQ ID NO: 7216 - DNA, 103 bp, Artificial Sequence
  Synthetic Polynucleotide
taatacgactcactatagggtgtgccccagtcttttgcgttgatacttgaaacagaggagatcaagtatgaacgcaaaaaacctggcggcagcgcaaaagatg

SEQ ID NO: 7217 - DNA, 103 bp, Artificial Sequence
  Synthetic Polynucleotide
taatacgactcactatagggtctcatgtgccccagtcttttgcgttgataaacagaggagatatcaaatgaaaagactgaacctggcggcagcgcaaaagatg

SEQ ID NO: 7218 - DNA, 103 bp, Artificial Sequence
  Synthetic Polynucleotide
taatacgactcactatagggcctggtctcatgtgccccagtcttttgcgtaacagaggagaacgcaaatgactggggcaaacctggcggcagcgcaaaagatg

SEQ ID NO: 7219 - DNA, 103 bp, Artificial Sequence
  Synthetic Polynucleotide
taatacgactcactatagggttcagcctggtctcatgtgccccagtctttaacagaggagaaaagacatgggcacatgaaacctggcggcagcgcaaaagatg

SEQ ID NO: 7220 - DNA, 103 bp, Artificial Sequence
  Synthetic Polynucleotide
taatacgactcactatagggtagcattcagcctggtctcatgtgccccagaacagaggagactggggatgatgagaccaaacctggcggcagcgcaaaagatg

SEQ ID NO: 7221 - DNA, 103 bp, Artificial Sequence
  Synthetic Polynucleotide
taatacgactcactataggggccgctagcattcagcctggtctcatgtgcaacagaggagagcacatatgaccaggctgaacctggcggcagcgcaaaagatg

SEQ ID NO: 7222 - DNA, 103 bp, Artificial Sequence
  Synthetic Polynucleotide
taatacgactcactataggggaattgccgctagcattcagcctggtctcaaacagaggagatgagacatggctgaatgcaacctggcggcagcgcaaaagatg

SEQ ID NO: 7223 - DNA, 103 bp, Artificial Sequence
  Synthetic Polynucleotide
taatacgactcactatagggtgatggaattgccgctagcattcagcctggaacagaggagaccaggcatgatgctagcgaacctggcggcagcgcaaaagatg

SEQ ID NO: 7224 - DNA, 103 bp, Artificial Sequence
  Synthetic Polynucleotide
taatacgactcactataggggtgaatgatggaattgccgctagcattcagaacagaggagactgaatatgagcggcaataacctggcggcagcgcaaaagatg

SEQ ID NO: 7225 - DNA, 103 bp, Artificial Sequence
  Synthetic Polynucleotide
taatacgactcactatagggcagttgggggagggggtataaaacaggcgcaacagaggagagcgcctatgttataccccaacctggcggcagcgcaaaagatg

SEQ ID NO: 7226 - DNA, 103 bp, Artificial Sequence
  Synthetic Polynucleotide
taatacgactcactataggggtgtagtgaatgatggaattgccgctagcaaacagaggagatgctagatgcaattccataacctggcggcagcgcaaaagatg

SEQ ID NO: 7227 - DNA, 103 bp, Artificial Sequence
  Synthetic Polynucleotide
taatacgactcactatagggtatttgtgtagtgaatgatggaattgccgcaacagaggagagcggcaatgccatcattcaacctggcggcagcgcaaaagatg

SEQ ID NO: 7228 - DNA, 103 bp, Artificial Sequence
  Synthetic Polynucleotide
taatacgactcactatagggattaatatttgtgtagtgaatgatggaattaacagaggagaaattccatgattcactacaacctggcggcagcgcaaaagatg

SEQ ID NO: 7229 - DNA, 103 bp, Artificial Sequence
  Synthetic Polynucleotide
taatacgactcactatagggtaataattaatatttgtgtagtgaatgatgaacagaggagacatcatatgctacacaaaaacctggcggcagcgcaaaagatg

SEQ ID NO: 7230 - DNA, 103 bp, Artificial Sequence
  Synthetic Polynucleotide
taatacgactcactatagggccttgtaataattaatatttgtgtagtgaaaacagaggagattcactatgcaaatattaaacctggcggcagcgcaaaagatg

SEQ ID NO: 7231 - DNA, 103 bp, Artificial Sequence
  Synthetic Polynucleotide
taatacgactcactatagggggcatccttgtaataattaatatttgtgtaaacagaggagatacacaatgattaattataacctggcggcagcgcaaaagatg

SEQ ID NO: 7232 - DNA, 103 bp, Artificial Sequence
  Synthetic Polynucleotide
taatacgactcactataggggatgcggcatccttgtaataattaatatttaacagaggagaaaatatatgttattacaaaacctggcggcagcgcaaaagatg

SEQ ID NO: 7233 - DNA, 103 bp, Artificial Sequence
  Synthetic Polynucleotide
taatacgactcactatagggagttggatgcggcatccttgtaataattaaaacagaggagattaattatgacaaggatgaacctggcggcagcgcaaaagatg

SEQ ID NO: 7234 - DNA, 103 bp, Artificial Sequence
  Synthetic Polynucleotide
taatacgactcactatagggggctgagttggatgcggcatccttgtaataaacagaggagatattacatggatgccgcaaacctggcggcagcgcaaaagatg

SEQ ID NO: 7235 - DNA, 103 bp, Artificial Sequence
  Synthetic Polynucleotide
taatacgactcactatagggcgattggctgagttggatgcggcatccttgaacagaggagacaaggaatgcgcatccaaaacctggcggcagcgcaaaagatg

SEQ ID NO: 7236 - DNA, 103 bp, Artificial Sequence
  Synthetic Polynucleotide
taatacgactcactatagggagttacagttgggggagggggtataaaacaaacagaggagatgttttatgccccctcccaacctggcggcagcgcaaaagatg

SEQ ID NO: 7237 - DNA, 103 bp, Artificial Sequence
  Synthetic Polynucleotide
taatacgactcactatagggcctgccgattggctgagttggatgcggcataacagaggagaatgccgatgccaactcagaacctggcggcagcgcaaaagatg

SEQ ID NO: 7238 - DNA, 103 bp, Artificial Sequence
  Synthetic Polynucleotide
taatacgactcactataggggaaatcctgccgattggctgagttggatgcaacagaggagagcatccatgtcagccaataacctggcggcagcgcaaaagatg

SEQ ID NO: 7239 - DNA, 103 bp, Artificial Sequence
  Synthetic Polynucleotide
taatacgactcactatagggtgagtgaaatcctgccgattggctgagttgaacagaggagacaactcatgcaatcggcaaacctggcggcagcgcaaaagatg

SEQ ID NO: 7240 - DNA, 103 bp, Artificial Sequence
  Synthetic Polynucleotide
taatacgactcactatagggggtcttgagtgaaatcctgccgattggctgaacagaggagacagccaatgggcaggattaacctggcggcagcgcaaaagatg

SEQ ID NO: 7241 - DNA, 103 bp, Artificial Sequence
  Synthetic Polynucleotide
taatacgactcactataggggcccgggtcttgagtgaaatcctgccgattaacagaggagaaatcggatggatttcactaacctggcggcagcgcaaaagatg

SEQ ID NO: 7242 - DNA, 103 bp, Artificial Sequence
  Synthetic Polynucleotide
taatacgactcactatagggaacttgcccgggtcttgagtgaaatcctgcaacagaggagagcaggaatgcactcaagaaacctggcggcagcgcaaaagatg

SEQ ID NO: 7243 - DNA, 103 bp, Artificial Sequence
  Synthetic Polynucleotide
taatacgactcactatagggctgtgaacttgcccgggtcttgagtgaaataacagaggagaatttcaatgaagacccggaacctggcggcagcgcaaaagatg

SEQ ID NO: 7244 - DNA, 103 bp, Artificial Sequence
  Synthetic Polynucleotide
taatacgactcactatagggtggttctgtgaacttgcccgggtcttgagtaacagaggagaactcaaatgccgggcaagaacctggcggcagcgcaaaagatg

SEQ ID NO: 7245 - DNA, 103 bp, Artificial Sequence
  Synthetic Polynucleotide
taatacgactcactatagggtttactggttctgtgaacttgcccgggtctaacagaggagaagacccatgcaagttcacaacctggcggcagcgcaaaagatg

SEQ ID NO: 7246 - DNA, 103 bp, Artificial Sequence
  Synthetic Polynucleotide
taatacgactcactatagggtatcttttactggttctgtgaacttgcccgaacagaggagacgggcaatgtcacagaacaacctggcggcagcgcaaaagatg

SEQ ID NO: 7247 - DNA, 103 bp, Artificial Sequence
  Synthetic Polynucleotide
taatacgactcactatagggttctaagttacagttgggggagggggtataaacagaggagatataccatgtcccccaacaacctggcggcagcgcaaaagatg

SEQ ID NO: 7248 - DNA, 103 bp, Artificial Sequence
  Synthetic Polynucleotide
taatacgactcactatagggcatgatatcttttactggttctgtgaacttaacagaggagaaagttcatggaaccagtaaacctggcggcagcgcaaaagatg

SEQ ID NO: 7249 - DNA, 103 bp, Artificial Sequence
  Synthetic Polynucleotide
taatacgactcactatagggttaatcatgatatcttttactggttctgtgaacagaggagacacagaatgagtaaaagaaacctggcggcagcgcaaaagatg

SEQ ID NO: 7250 - DNA, 103 bp, Artificial Sequence
  Synthetic Polynucleotide
taatacgactcactataggggtgatttaatcatgatatcttttactggttaacagaggagaaaccagatgaagatatcaaacctggcggcagcgcaaaagatg

SEQ ID NO: 7251 - DNA, 103 bp, Artificial Sequence
  Synthetic Polynucleotide
taatacgactcactatagggtggtagtgatttaatcatgatatcttttacaacagaggagagtaaaaatgatcatgattaacctggcggcagcgcaaaagatg

SEQ ID NO: 7252 - DNA, 103 bp, Artificial Sequence
  Synthetic Polynucleotide
taatacgactcactatagggagagctggtagtgatttaatcatgatatctaacagaggagaagatatatggattaaatcaacctggcggcagcgcaaaagatg

SEQ ID NO: 7253 - DNA, 103 bp, Artificial Sequence
  Synthetic Polynucleotide
taatacgactcactatagggagttgagagctggtagtgatttaatcatgaaacagaggagatcatgaatgaatcactacaacctggcggcagcgcaaaagatg

SEQ ID NO: 7254 - DNA, 103 bp, Artificial Sequence
  Synthetic Polynucleotide
taatacgactcactataggggggggagttgagagctggtagtgatttaataacagaggagaattaaaatgctaccagctaacctggcggcagcgcaaaagatg

SEQ ID NO: 7255 - DNA, 103 bp, Artificial Sequence
  Synthetic Polynucleotide
taatacgactcactatagggactgtgggggagttgagagctggtagtgataacagaggagaatcactatgagctctcaaaacctggcggcagcgcaaaagatg

SEQ ID NO: 7256 - DNA, 103 bp, Artificial Sequence
  Synthetic Polynucleotide
taatacgactcactatagggcctctactgtgggggagttgagagctggtaaacagaggagataccagatgtcaactcccaacctggcggcagcgcaaaagatg

SEQ ID NO: 7257 - DNA, 103 bp, Artificial Sequence
  Synthetic Polynucleotide
taatacgactcactataggggcactcctctactgtgggggagttgagagcaacagaggagagctctcatgtcccccacaaacctggcggcagcgcaaaagatg

SEQ ID NO: 7258 - DNA, 103 bp, Artificial Sequence
  Synthetic Polynucleotide
taatacgactcactataggggttacttctaagttacagttgggggaggggaacagaggagacccctcatgcaactgtaaaacctggcggcagcgcaaaagatg

SEQ ID NO: 7259 - DNA, 103 bp, Artificial Sequence
  Synthetic Polynucleotide
taatacgactcactatagggtatccgcactcctctactgtgggggagttgaacagaggagacaactcatgcacagtagaaacctggcggcagcgcaaaagatg

SEQ ID NO: 7260 - DNA, 103 bp, Artificial Sequence
  Synthetic Polynucleotide
taatacgactcactatagggcactgtatccgcactcctctactgtgggggaacagaggagacccccaatgtagaggagtaacctggcggcagcgcaaaagatg

SEQ ID NO: 7261 - DNA, 103 bp, Artificial Sequence
  Synthetic Polynucleotide
taatacgactcactatagggcctgtcactgtatccgcactcctctactgtaacagaggagaacagtaatggagtgcggaaacctggcggcagcgcaaaagatg

SEQ ID NO: 7262 - DNA, 103 bp, Artificial Sequence
  Synthetic Polynucleotide
taatacgactcactatagggctcaccctgtcactgtatccgcactcctctaacagaggagaagaggaatgcggatacagaacctggcggcagcgcaaaagatg

SEQ ID NO: 7263 - DNA, 103 bp, Artificial Sequence
  Synthetic Polynucleotide
taatacgactcactatagggttgatctcaccctgtcactgtatccgcactaacagaggagaagtgcgatgacagtgacaaacctggcggcagcgcaaaagatg

SEQ ID NO: 7264 - DNA, 103 bp, Artificial Sequence
  Synthetic Polynucleotide
taatacgactcactatagggtgtgattgatctcaccctgtcactgtatccaacagaggagaggatacatggacagggtgaacctggcggcagcgcaaaagatg

SEQ ID NO: 7265 - DNA, 103 bp, Artificial Sequence
  Synthetic Polynucleotide
taatacgactcactatagggcctaatgtgattgatctcaccctgtcactgaacagaggagacagtgaatgggtgagatcaacctggcggcagcgcaaaagatg

SEQ ID NO: 7266 - DNA, 103 bp, Artificial Sequence
  Synthetic Polynucleotide
taatacgactcactatagggagttacctaatgtgattgatctcaccctgtaacagaggagaacagggatggatcaatcaaacctggcggcagcgcaaaagatg

SEQ ID NO: 7267 - DNA, 103 bp, Artificial Sequence
  Synthetic Polynucleotide
taatacgactcactatagggggtggagttacctaatgtgattgatctcacaacagaggagagtgagaatgatcacattaaacctggcggcagcgcaaaagatg

SEQ ID NO: 7268 - DNA, 103 bp, Artificial Sequence
  Synthetic Polynucleotide
taatacgactcactataggggttatggtggagttacctaatgtgattgataacagaggagaatcaatatgattaggtaaaacctggcggcagcgcaaaagatg

SEQ ID NO: 7269 - DNA, 103 bp, Artificial Sequence
  Synthetic Polynucleotide
taatacgactcactatagggccctgtgggtgggatcaacccacaggctgtaacagaggagaacagccatggggttgatcaacctggcggcagcgcaaaagatg

SEQ ID NO: 7270 - DNA, 103 bp, Artificial Sequence
  Synthetic Polynucleotide
taatacgactcactatagggtgtgtgttacttctaagttacagttgggggaacagaggagacccccaatggtaacttagaacctggcggcagcgcaaaagatg

SEQ ID NO: 7271 - DNA, 103 bp, Artificial Sequence
  Synthetic Polynucleotide
taatacgactcactataggggagtcgttatggtggagttacctaatgtgaaacagaggagatcacatatggtaactccaaacctggcggcagcgcaaaagatg

SEQ ID NO: 7272 - DNA, 103 bp, Artificial Sequence
  Synthetic Polynucleotide
taatacgactcactatagggttcctgagtcgttatggtggagttacctaaaacagaggagattaggtatgtccaccataaacctggcggcagcgcaaaagatg

SEQ ID NO: 7273 - DNA, 103 bp, Artificial Sequence
  Synthetic Polynucleotide
taatacgactcactataggggcgcattcctgagtcgttatggtggagttaaacagaggagataactcatgcataacgacaacctggcggcagcgcaaaagatg

SEQ ID NO: 7274 - DNA, 103 bp, Artificial Sequence
  Synthetic Polynucleotide
taatacgactcactatagggcgttggcgcattcctgagtcgttatggtggaacagaggagaccaccaatgcgactcaggaacctggcggcagcgcaaaagatg

SEQ ID NO: 7275 - DNA, 103 bp, Artificial Sequence
  Synthetic Polynucleotide
taatacgactcactatagggcaccacgttggcgcattcctgagtcgttataacagaggagaataacgatgcaggaatgcaacctggcggcagcgcaaaagatg

SEQ ID NO: 7276 - DNA, 103 bp, Artificial Sequence
  Synthetic Polynucleotide
taatacgactcactatagggcccaccaccacgttggcgcattcctgagtcaacagaggagagactcaatgatgcgccaaaacctggcggcagcgcaaaagatg

SEQ ID NO: 7277 - DNA, 103 bp, Artificial Sequence
  Synthetic Polynucleotide
taatacgactcactatagggcatagcccaccaccacgttggcgcattcctaacagaggagaaggaatatgccaacgtggaacctggcggcagcgcaaaagatg

SEQ ID NO: 7278 - DNA, 103 bp, Artificial Sequence
  Synthetic Polynucleotide
taatacgactcactatagggtactccatagcccaccaccacgttggcgcaaacagaggagatgcgccatggtggtggtgaacctggcggcagcgcaaaagatg

SEQ ID NO: 7279 - DNA, 103 bp, Artificial Sequence
  Synthetic Polynucleotide
taatacgactcactatagggggccatactccatagcccaccaccacgttgaacagaggagacaacgtatgggtgggctaaacctggcggcagcgcaaaagatg

SEQ ID NO: 7280 - DNA, 103 bp, Artificial Sequence
  Synthetic Polynucleotide
taatacgactcactatagggaatctggccatactccatagcccaccaccaaacagaggagatggtggatggctatggagaacctggcggcagcgcaaaagatg

SEQ ID NO: 7281 - DNA, 103 bp, Artificial Sequence
  Synthetic Polynucleotide
taatacgactcactatagggatcggtgtgtgttacttctaagttacagttaacagaggagaaactgtatgttagaagtaaacctggcggcagcgcaaaagatg

SEQ ID NO: 7282 - DNA, 103 bp, Artificial Sequence
  Synthetic Polynucleotide
taatacgactcactatagggtagataatctggccatactccatagcccacaacagaggagagtgggcatgggagtatggaacctggcggcagcgcaaaagatg

SEQ ID NO: 7283 - DNA, 103 bp, Artificial Sequence
  Synthetic Polynucleotide
taatacgactcactatagggtcctttagataatctggccatactccatagaacagaggagactatggatgatggccagaaacctggcggcagcgcaaaagatg

SEQ ID NO: 7284 - DNA, 103 bp, Artificial Sequence
  Synthetic Polynucleotide
taatacgactcactatagggcactatcctttagataatctggccatactcaacagaggagagagtatatgcagattatcaacctggcggcagcgcaaaagatg

SEQ ID NO: 7285 - DNA, 103 bp, Artificial Sequence
  Synthetic Polynucleotide
taatacgactcactatagggtgcctcactatcctttagataatctggccaaacagaggagatggccaatgtatctaaagaacctggcggcagcgcaaaagatg

SEQ ID NO: 7286 - DNA, 103 bp, Artificial Sequence
  Synthetic Polynucleotide
taatacgactcactataggggctgttgcctcactatcctttagataatctaacagaggagaagattaatgaaaggatagaacctggcggcagcgcaaaagatg

SEQ ID NO: 7287 - DNA, 103 bp, Artificial Sequence
  Synthetic Polynucleotide
taatacgactcactatagggcctctgctgttgcctcactatcctttagataacagaggagaatctaaatgatagtgaggaacctggcggcagcgcaaaagatg

SEQ ID NO: 7288 - DNA, 103 bp, Artificial Sequence
  Synthetic Polynucleotide
taatacgactcactatagggttggtcctctgctgttgcctcactatccttaacagaggagaaaggatatggaggcaacaaacctggcggcagcgcaaaagatg

SEQ ID NO: 7289 - DNA, 103 bp, Artificial Sequence
  Synthetic Polynucleotide
taatacgactcactataggggtcggttggtcctctgctgttgcctcactaaacagaggagatagtgaatgaacagcagaaacctggcggcagcgcaaaagatg

SEQ ID NO: 7290 - DNA, 103 bp, Artificial Sequence
  Synthetic Polynucleotide
taatacgactcactataggggttgggtcggttggtcctctgctgttgcctaacagaggagaaggcaaatgcagaggaccaacctggcggcagcgcaaaagatg

SEQ ID NO: 7291 - DNA, 103 bp, Artificial Sequence
  Synthetic Polynucleotide
taatacgactcactataggggtctggttgggtcggttggtcctctgctgtaacagaggagaacagcaatggaccaaccgaacctggcggcagcgcaaaagatg

SEQ ID NO: 7292 - DNA, 103 bp, Artificial Sequence
  Synthetic Polynucleotide
taatacgactcactatagggtgttgatcggtgtgtgttacttctaagttaaacagaggagataacttatgagtaacacaaacctggcggcagcgcaaaagatg

SEQ ID NO: 7293 - DNA, 103 bp, Artificial Sequence
  Synthetic Polynucleotide
taatacgactcactataggggcaacgtctggttgggtcggttggtcctctaacagaggagaagaggaatgaccgacccaaacctggcggcagcgcaaaagatg

SEQ ID NO: 7294 - DNA, 103 bp, Artificial Sequence
  Synthetic Polynucleotide
taatacgactcactatagggatgtggcaacgtctggttgggtcggttggtaacagaggagaaccaacatgcccaaccagaacctggcggcagcgcaaaagatg

SEQ ID NO: 7295 - DNA, 103 bp, Artificial Sequence
  Synthetic Polynucleotide
taatacgactcactatagggcctacatgtggcaacgtctggttgggtcggaacagaggagaccgaccatgccagacgttaacctggcggcagcgcaaaagatg

SEQ ID NO: 7296 - DNA, 103 bp, Artificial Sequence
  Synthetic Polynucleotide
taatacgactcactatagggtagaacctacatgtggcaacgtctggttggaacagaggagaccaaccatgcgttgccacaacctggcggcagcgcaaaagatg

SEQ ID NO: 7297 - DNA, 103 bp, Artificial Sequence
  Synthetic Polynucleotide
taatacgactcactataggggggtatagaacctacatgtggcaacgtctgaacagaggagacagacgatgccacatgtaaacctggcggcagcgcaaaagatg

SEQ ID NO: 7298 - DNA, 103 bp, Artificial Sequence
  Synthetic Polynucleotide
taatacgactcactataggggtcaagggtatagaacctacatgtggcaacaacagaggagagttgccatgtgtaggttcaacctggcggcagcgcaaaagatg

SEQ ID NO: 7299 - DNA, 103 bp, Artificial Sequence
  Synthetic Polynucleotide
taatacgactcactatagggacagagtcaagggtatagaacctacatgtgaacagaggagacacatgatggttctatacaacctggcggcagcgcaaaagatg

SEQ ID NO: 7300 - DNA, 103 bp, Artificial Sequence
  Synthetic Polynucleotide
taatacgactcactatagggattgcacagagtcaagggtatagaacctacaacagaggagagtaggtatgatacccttgaacctggcggcagcgcaaaagatg

SEQ ID NO: 7301 - DNA, 103 bp, Artificial Sequence
  Synthetic Polynucleotide
taatacgactcactatagggctgccattgcacagagtcaagggtatagaaaacagaggagattctatatgcttgactctaacctggcggcagcgcaaaagatg

SEQ ID NO: 7302 - DNA, 103 bp, Artificial Sequence
  Synthetic Polynucleotide
taatacgactcactataggggttttctgccattgcacagagtcaagggtaaacagaggagataccctatgctctgtgcaaacctggcggcagcgcaaaagatg

SEQ ID NO: 7303 - DNA, 103 bp, Artificial Sequence
  Synthetic Polynucleotide
taatacgactcactatagggctgactgttgatcggtgtgtgttacttctaaacagaggagatagaagatgcacacaccgaacctggcggcagcgcaaaagatg

SEQ ID NO: 7304 - DNA, 103 bp, Artificial Sequence
  Synthetic Polynucleotide
taatacgactcactataggggtgaggttttctgccattgcacagagtcaaaacagaggagattgactatgtgcaatggcaacctggcggcagcgcaaaagatg

SEQ ID NO: 7305 - DNA, 103 bp, Artificial Sequence
  Synthetic Polynucleotide
taatacgactcactatagggtcctggtgaggttttctgccattgcacagaaacagaggagatctgtgatgtggcagaaaaacctggcggcagcgcaaaagatg

SEQ ID NO: 7306 - DNA, 103 bp, Artificial Sequence
  Synthetic Polynucleotide
taatacgactcactatagggcaccatcctggtgaggttttctgccattgcaacagaggagagcaatgatggaaaacctcaacctggcggcagcgcaaaagatg

SEQ ID NO: 7307 - DNA, 103 bp, Artificial Sequence
  Synthetic Polynucleotide
taatacgactcactatagggtccaccaccatcctggtgaggttttctgccaacagaggagaggcagaatgcctcaccagaacctggcggcagcgcaaaagatg

SEQ ID NO: 7308 - DNA, 103 bp, Artificial Sequence
  Synthetic Polynucleotide
taatacgactcactatagggcagcttccaccaccatcctggtgaggttttaacagaggagaaaaaccatgccaggatggaacctggcggcagcgcaaaagatg

SEQ ID NO: 7309 - DNA, 103 bp, Artificial Sequence
  Synthetic Polynucleotide
taatacgactcactatagggtcgggcagcttccaccaccatcctggtgagaacagaggagactcaccatgatggtggtgaacctggcggcagcgcaaaagatg

SEQ ID NO: 7310 - DNA, 103 bp, Artificial Sequence
  Synthetic Polynucleotide
taatacgactcactatagggaagcatcgggcagcttccaccaccatcctgaacagaggagacaggatatgggtggaagcaacctggcggcagcgcaaaagatg

SEQ ID NO: 7311 - DNA, 103 bp, Artificial Sequence
  Synthetic Polynucleotide
taatacgactcactatagggcgacaaagcatcgggcagcttccaccaccaaacagaggagatggtggatgaagctgcccaacctggcggcagcgcaaaagatg

SEQ ID NO: 7312 - DNA, 103 bp, Artificial Sequence
  Synthetic Polynucleotide
taatacgactcactatagggaagttcgacaaagcatcgggcagcttccacaacagaggagagtggaaatggcccgatgcaacctggcggcagcgcaaaagatg

SEQ ID NO: 7313 - DNA, 103 bp, Artificial Sequence
  Synthetic Polynucleotide
taatacgactcactataggggtcctaagttcgacaaagcatcgggcagctaacagaggagaagctgcatgatgctttgtaacctggcggcagcgcaaaagatg

SEQ ID NO: 7314 - DNA, 103 bp, Artificial Sequence
  Synthetic Polynucleotide
taatacgactcactatagggccacgctgactgttgatcggtgtgtgttacaacagaggagagtaacaatgaccgatcaaaacctggcggcagcgcaaaagatg

SEQ ID NO: 7315 - DNA, 103 bp, Artificial Sequence
  Synthetic Polynucleotide
taatacgactcactatagggaaacagtcctaagttcgacaaagcatcgggaacagaggagacccgatatgttgtcgaacaacctggcggcagcgcaaaagatg

SEQ ID NO: 7316 - DNA, 103 bp, Artificial Sequence
  Synthetic Polynucleotide
taatacgactcactatagggtgcccaaacagtcctaagttcgacaaagcaaacagaggagatgctttatggaacttaggaacctggcggcagcgcaaaagatg

SEQ ID NO: 7317 - DNA, 103 bp, Artificial Sequence
  Synthetic Polynucleotide
taatacgactcactatagggtgttctgcccaaacagtcctaagttcgacaaacagaggagatgtcgaatgtaggactgtaacctggcggcagcgcaaaagatg

SEQ ID NO: 7318 - DNA, 103 bp, Artificial Sequence
  Synthetic Polynucleotide
taatacgactcactatagggctgcatgttctgcccaaacagtcctaagttaacagaggagaaacttaatgctgtttgggaacctggcggcagcgcaaaagatg

SEQ ID NO: 7319 - DNA, 103 bp, Artificial Sequence
  Synthetic Polynucleotide
taatacgactcactatagggtggtactgcatgttctgcccaaacagtcctaacagaggagaaggactatgtgggcagaaaacctggcggcagcgcaaaagatg

SEQ ID NO: 7320 - DNA, 103 bp, Artificial Sequence
  Synthetic Polynucleotide
taatacgactcactatagggagtagtggtactgcatgttctgcccaaacaaacagaggagatgtttgatgagaacatgcaacctggcggcagcgcaaaagatg

SEQ ID NO: 7321 - DNA, 103 bp, Artificial Sequence
  Synthetic Polynucleotide
taatacgactcactataggggcctaagtagtggtactgcatgttctgcccaacagaggagagggcagatgatgcagtacaacctggcggcagcgcaaaagatg

SEQ ID NO: 7322 - DNA, 103 bp, Artificial Sequence
  Synthetic Polynucleotide
taatacgactcactataggggttcggcctaagtagtggtactgcatgttcaacagaggagagaacatatggtaccactaaacctggcggcagcgcaaaagatg

SEQ ID NO: 7323 - DNA, 103 bp, Artificial Sequence
  Synthetic Polynucleotide
taatacgactcactatagggacccagttcggcctaagtagtggtactgcaaacagaggagatgcagtatgactacttagaacctggcggcagcgcaaaagatg

SEQ ID NO: 7324 - DNA, 103 bp, Artificial Sequence
  Synthetic Polynucleotide
taatacgactcactatagggggtatacccagttcggcctaagtagtggtaaacagaggagataccacatgttaggccgaaacctggcggcagcgcaaaagatg

SEQ ID NO: 7325 - DNA, 103 bp, Artificial Sequence
  Synthetic Polynucleotide
taatacgactcactataggggtgtgccacgctgactgttgatcggtgtgtaacagaggagaacacacatgtcaacagtcaacctggcggcagcgcaaaagatg

SEQ ID NO: 7326 - DNA, 103 bp, Artificial Sequence
  Synthetic Polynucleotide
taatacgactcactatagggtgtacggtatacccagttcggcctaagtagaacagaggagactacttatgccgaactggaacctggcggcagcgcaaaagatg

SEQ ID NO: 7327 - DNA, 103 bp, Artificial Sequence
  Synthetic Polynucleotide
taatacgactcactataggggcacatgtacggtatacccagttcggcctaaacagaggagataggccatgctgggtataaacctggcggcagcgcaaaagatg

SEQ ID NO: 7328 - DNA, 103 bp, Artificial Sequence
  Synthetic Polynucleotide
taatacgactcactataggggcactgcacatgtacggtatacccagttcgaacagaggagacgaactatgtataccgtaaacctggcggcagcgcaaaagatg

SEQ ID NO: 7329 - DNA, 103 bp, Artificial Sequence
  Synthetic Polynucleotide
taatacgactcactataggggcattgcactgcacatgtacggtatacccaaacagaggagatgggtaatgcgtacatgtaacctggcggcagcgcaaaagatg

SEQ ID NO: 7330 - DNA, 103 bp, Artificial Sequence
  Synthetic Polynucleotide
taatacgactcactatagggtagatgcattgcactgcacatgtacggtataacagaggagaataccgatgatgtgcagtaacctggcggcagcgcaaaagatg

SEQ ID NO: 7331 - DNA, 103 bp, Artificial Sequence
  Synthetic Polynucleotide
taatacgactcactataggggaacttagatgcattgcactgcacatgtacaacagaggagagtacatatgcagtgcaataacctggcggcagcgcaaaagatg

SEQ ID NO: 7332 - DNA, 103 bp, Artificial Sequence
  Synthetic Polynucleotide
taatacgactcactatagggtggtggaacttagatgcattgcactgcacaaacagaggagatgtgcaatgcaatgcatcaacctggcggcagcgcaaaagatg

SEQ ID NO: 7333 - DNA, 103 bp, Artificial Sequence
  Synthetic Polynucleotide
taatacgactcactatagggatccttggtggaacttagatgcattgcactaacagaggagaagtgcaatgcatctaagtaacctggcggcagcgcaaaagatg

SEQ ID NO: 7334 - DNA, 103 bp, Artificial Sequence
  Synthetic Polynucleotide
taatacgactcactatagggcaagcatccttggtggaacttagatgcattaacagaggagaaatgcaatgaagttccacaacctggcggcagcgcaaaagatg

SEQ ID NO: 7335 - DNA, 103 bp, Artificial Sequence
  Synthetic Polynucleotide
taatacgactcactatagggactagcaagcatccttggtggaacttagataacagaggagaatctaaatgccaccaaggaacctggcggcagcgcaaaagatg

SEQ ID NO: 7336 - DNA, 103 bp, Artificial Sequence
  Synthetic Polynucleotide
taatacgactcactatagggggctggtgtgccacgctgactgttgatcggaacagaggagaccgatcatgagtcagcgtaacctggcggcagcgcaaaagatg

SEQ ID NO: 7337 - DNA, 103 bp, Artificial Sequence
  Synthetic Polynucleotide
taatacgactcactatagggacactactagcaagcatccttggtggaactaacagaggagaagttccatgaaggatgctaacctggcggcagcgcaaaagatg

SEQ ID NO: 7338 - DNA, 103 bp, Artificial Sequence
  Synthetic Polynucleotide
taatacgactcactatagggtacacacactactagcaagcatccttggtgaacagaggagacaccaaatgtgcttgctaaacctggcggcagcgcaaaagatg

SEQ ID NO: 7339 - DNA, 103 bp, Artificial Sequence
  Synthetic Polynucleotide
taatacgactcactatagggtccggtacacacactactagcaagcatcctaacagaggagaaggatgatggctagtagtaacctggcggcagcgcaaaagatg

SEQ ID NO: 7340 - DNA, 103 bp, Artificial Sequence
  Synthetic Polynucleotide
taatacgactcactatagggcagcttccggtacacacactactagcaagcaacagaggagagcttgcatgtagtgtgtgaacctggcggcagcgcaaaagatg

SEQ ID NO: 7341 - DNA, 103 bp, Artificial Sequence
  Synthetic Polynucleotide
taatacgactcactatagggcatctcagcttccggtacacacactactagaacagaggagactagtaatgtgtgtaccgaacctggcggcagcgcaaaagatg

SEQ ID NO: 7342 - DNA, 103 bp, Artificial Sequence
  Synthetic Polynucleotide
taatacgactcactatagggcaacccatctcagcttccggtacacacactaacagaggagaagtgtgatgaccggaagcaacctggcggcagcgcaaaagatg

SEQ ID NO: 7343 - DNA, 103 bp, Artificial Sequence
  Synthetic Polynucleotide
taatacgactcactatagggttgcgcaacccatctcagcttccggtacacaacagaggagagtgtacatgaagctgagaaacctggcggcagcgcaaaagatg

SEQ ID NO: 7344 - DNA, 103 bp, Artificial Sequence
  Synthetic Polynucleotide
taatacgactcactatagggtagcgttgcgcaacccatctcagcttccggaacagaggagaccggaaatggagatgggtaacctggcggcagcgcaaaagatg

SEQ ID NO: 7345 - DNA, 103 bp, Artificial Sequence
  Synthetic Polynucleotide
taatacgactcactatagggttgtctagcgttgcgcaacccatctcagctaacagaggagaagctgaatggggttgcgcaacctggcggcagcgcaaaagatg

SEQ ID NO: 7346 - DNA, 103 bp, Artificial Sequence
  Synthetic Polynucleotide
taatacgactcactataggggggtgttgtctagcgttgcgcaacccatctaacagaggagaagatggatggcgcaacgcaacctggcggcagcgcaaaagatg

SEQ ID NO: 7347 - DNA, 103 bp, Artificial Sequence
  Synthetic Polynucleotide
taatacgactcactatagggaacgtggctggtgtgccacgctgactgttgaacagaggagacaacagatggcgtggcacaacctggcggcagcgcaaaagatg

SEQ ID NO: 7348 - DNA, 103 bp, Artificial Sequence
  Synthetic Polynucleotide
taatacgactcactatagggggatggggtgttgtctagcgttgcgcaaccaacagaggagaggttgcatgacgctagacaacctggcggcagcgcaaaagatg

SEQ ID NO: 7349 - DNA, 103 bp, Artificial Sequence
  Synthetic Polynucleotide
taatacgactcactataggggcactggatggggtgttgtctagcgttgcgaacagaggagacgcaacatgagacaacacaacctggcggcagcgcaaaagatg

SEQ ID NO: 7350 - DNA, 103 bp, Artificial Sequence
  Synthetic Polynucleotide
taatacgactcactatagggattctgcactggatggggtgttgtctagcgaacagaggagacgctagatgacaccccataacctggcggcagcgcaaaagatg

SEQ ID NO: 7351 - DNA, 103 bp, Artificial Sequence
  Synthetic Polynucleotide
taatacgactcactatagggcagcaattctgcactggatggggtgttgtcaacagaggagagacaacatgccatccagtaacctggcggcagcgcaaaagatg

SEQ ID NO: 7352 - DNA, 103 bp, Artificial Sequence
  Synthetic Polynucleotide
taatacgactcactatagggccccccagcaattctgcactggatggggtgaacagaggagacaccccatgcagtgcagaaacctggcggcagcgcaaaagatg

SEQ ID NO: 7353 - DNA, 103 bp, Artificial Sequence
  Synthetic Polynucleotide
taatacgactcactatagggtatcgccccccagcaattctgcactggatgaacagaggagacatccaatgcagaattgcaacctggcggcagcgcaaaagatg

SEQ ID NO: 7354 - DNA, 103 bp, Artificial Sequence
  Synthetic Polynucleotide
taatacgactcactatagggtgcgctatcgccccccagcaattctgcactaacagaggagaagtgcaatgttgctggggaacctggcggcagcgcaaaagatg

SEQ ID NO: 7355 - DNA, 103 bp, Artificial Sequence
  Synthetic Polynucleotide
taatacgactcactatagggtcttttgcgctatcgccccccagcaattctaacagaggagaagaattatgggggggcgaaacctggcggcagcgcaaaagatg

SEQ ID NO: 7356 - DNA, 103 bp, Artificial Sequence
  Synthetic Polynucleotide
taatacgactcactatagggcaaactcttttgcgctatcgccccccagcaaacagaggagatgctggatggcgatagcgaacctggcggcagcgcaaaagatg

SEQ ID NO: 7357 - DNA, 103 bp, Artificial Sequence
  Synthetic Polynucleotide
taatacgactcactataggggtccgcaaactcttttgcgctatcgcccccaacagaggagagggggcatgagcgcaaaaaacctggcggcagcgcaaaagatg

SEQ ID NO: 7358 - DNA, 103 bp, Artificial Sequence
  Synthetic Polynucleotide
taatacgactcactatagggatcaaaacgtggctggtgtgccacgctgacaacagaggagagtcagcatggcacaccagaacctggcggcagcgcaaaagatg

SEQ ID NO: 7359 - DNA, 103 bp, Artificial Sequence
  Synthetic Polynucleotide
taatacgactcactatagggggtttgtccgcaaactcttttgcgctatcgaacagaggagacgatagatgaaaagagttaacctggcggcagcgcaaaagatg

SEQ ID NO: 7360 - DNA, 103 bp, Artificial Sequence
  Synthetic Polynucleotide
taatacgactcactatagggcgaccggtttgtccgcaaactcttttgcgcaacagaggagagcgcaaatgagtttgcggaacctggcggcagcgcaaaagatg

SEQ ID NO: 7361 - DNA, 103 bp, Artificial Sequence
  Synthetic Polynucleotide
taatacgactcactatagggggatgcgaccggtttgtccgcaaactctttaacagaggagaaaagagatggcggacaaaaacctggcggcagcgcaaaagatg

SEQ ID NO: 7362 - DNA, 103 bp, Artificial Sequence
  Synthetic Polynucleotide
taatacgactcactataggggacccggatgcgaccggtttgtccgcaaacaacagaggagagtttgcatgcaaaccggtaacctggcggcagcgcaaaagatg

SEQ ID NO: 7363 - DNA, 103 bp, Artificial Sequence
  Synthetic Polynucleotide
taatacgactcactatagggtgttggacccggatgcgaccggtttgtccgaacagaggagacggacaatgcggtcgcataacctggcggcagcgcaaaagatg

SEQ ID NO: 7364 - DNA, 103 bp, Artificial Sequence
  Synthetic Polynucleotide
taatacgactcactatagggcaacttgttggacccggatgcgaccggtttaacagaggagaaaaccgatggcatccgggaacctggcggcagcgcaaaagatg

SEQ ID NO: 7365 - DNA, 103 bp, Artificial Sequence
  Synthetic Polynucleotide
taatacgactcactatagggtgtaccaacttgttggacccggatgcgaccaacagaggagaggtcgcatgcgggtccaaaacctggcggcagcgcaaaagatg

SEQ ID NO: 7366 - DNA, 103 bp, Artificial Sequence
  Synthetic Polynucleotide
taatacgactcactatagggccctctgtaccaacttgttggacccggatgaacagaggagacatccgatgccaacaagtaacctggcggcagcgcaaaagatg

SEQ ID NO: 7367 - DNA, 103 bp, Artificial Sequence
  Synthetic Polynucleotide
taatacgactcactatagggcaccaccctctgtaccaacttgttggacccaacagaggagagggtccatgaagttggtaaacctggcggcagcgcaaaagatg

SEQ ID NO: 7368 - DNA, 103 bp, Artificial Sequence
  Synthetic Polynucleotide
taatacgactcactatagggttatacaccaccctctgtaccaacttgttgaacagaggagacaacaaatgggtacagagaacctggcggcagcgcaaaagatg

SEQ ID NO: 7369 - DNA, 103 bp, Artificial Sequence
  Synthetic Polynucleotide
taatacgactcactataggggcttgatcaaaacgtggctggtgtgccacgaacagaggagacgtggcatgccagccacgaacctggcggcagcgcaaaagatg

SEQ ID NO: 7370 - DNA, 103 bp, Artificial Sequence
  Synthetic Polynucleotide
taatacgactcactatagggctgcattatacaccaccctctgtaccaactaacagaggagaagttggatgagagggtggaacctggcggcagcgcaaaagatg

SEQ ID NO: 7371 - DNA, 103 bp, Artificial Sequence
  Synthetic Polynucleotide
taatacgactcactatagggcatgcctgcattatacaccaccctctgtacaacagaggagagtacagatggtggtgtataacctggcggcagcgcaaaagatg

SEQ ID NO: 7372 - DNA, 103 bp, Artificial Sequence
  Synthetic Polynucleotide
taatacgactcactatagggacccccatgcctgcattatacaccaccctcaacagaggagagagggtatggtataatgcaacctggcggcagcgcaaaagatg

SEQ ID NO: 7373 - DNA, 103 bp, Artificial Sequence
  Synthetic Polynucleotide
taatacgactcactatagggcacccacccccatgcctgcattatacaccaaacagaggagatggtgtatgatgcaggcaaacctggcggcagcgcaaaagatg

SEQ ID NO: 7374 - DNA, 103 bp, Artificial Sequence
  Synthetic Polynucleotide
taatacgactcactatagggtccaacacccacccccatgcctgcattataaacagaggagatataatatgggcatggggaacctggcggcagcgcaaaagatg

SEQ ID NO: 7375 - DNA, 103 bp, Artificial Sequence
  Synthetic Polynucleotide
taatacgactcactatagggaggtttccaacacccacccccatgcctgcaaacagaggagatgcaggatggggggtgggaacctggcggcagcgcaaaagatg

SEQ ID NO: 7376 - DNA, 103 bp, Artificial Sequence
  Synthetic Polynucleotide
taatacgactcactatagggtggtgaggtttccaacacccacccccatgcaacagaggagagcatggatgtgggtgttgaacctggcggcagcgcaaaagatg

SEQ ID NO: 7377 - DNA, 103 bp, Artificial Sequence
  Synthetic Polynucleotide
taatacgactcactataggggaaaatggtgaggtttccaacacccaccccaacagaggagaggggtgatggttggaaacaacctggcggcagcgcaaaagatg

SEQ ID NO: 7378 - DNA, 103 bp, Artificial Sequence
  Synthetic Polynucleotide
taatacgactcactatagggtgggggaaaatggtgaggtttccaacacccaacagaggagagggtgtatgaaacctcacaacctggcggcagcgcaaaagatg

SEQ ID NO: 7379 - DNA, 103 bp, Artificial Sequence
  Synthetic Polynucleotide
taatacgactcactatagggattggtgggggaaaatggtgaggtttccaaaacagaggagattggaaatgtcaccatttaacctggcggcagcgcaaaagatg

SEQ ID NO: 7380 - DNA, 103 bp, Artificial Sequence
  Synthetic Polynucleotide
taatacgactcactatagggatgggccctgtgggtgggatcaacccacagaacagaggagactgtggatggatcccaccaacctggcggcagcgcaaaagatg

SEQ ID NO: 7381 - DNA, 103 bp, Artificial Sequence
  Synthetic Polynucleotide
taatacgactcactataggggaagtgcttgatcaaaacgtggctggtgtgaacagaggagacacaccatgcacgttttgaacctggcggcagcgcaaaagatg

SEQ ID NO: 7382 - DNA, 103 bp, Artificial Sequence
  Synthetic Polynucleotide
taatacgactcactataggggatccattggtgggggaaaatggtgaggttaacagaggagaaacctcatgattttccccaacctggcggcagcgcaaaagatg

SEQ ID NO: 7383 - DNA, 103 bp, Artificial Sequence
  Synthetic Polynucleotide
taatacgactcactatagggaggttgatccattggtgggggaaaatggtgaacagaggagacaccatatgcccccaccaaacctggcggcagcgcaaaagatg

SEQ ID NO: 7384 - DNA, 103 bp, Artificial Sequence
  Synthetic Polynucleotide
taatacgactcactatagggtgcgtaggttgatccattggtgggggaaaaaacagaggagattttccatgaccaatggaaacctggcggcagcgcaaaagatg

SEQ ID NO: 7385 - DNA, 103 bp, Artificial Sequence
  Synthetic Polynucleotide
taatacgactcactatagggattggtgcgtaggttgatccattggtggggaacagaggagaccccacatgtggatcaacaacctggcggcagcgcaaaagatg

SEQ ID NO: 7386 - DNA, 103 bp, Artificial Sequence
  Synthetic Polynucleotide
taatacgactcactatagggctattattggtgcgtaggttgatccattggaacagaggagaccaatgatgcaacctacgaacctggcggcagcgcaaaagatg

SEQ ID NO: 7387 - DNA, 103 bp, Artificial Sequence
  Synthetic Polynucleotide
taatacgactcactatagggtagcactattattggtgcgtaggttgatccaacagaggagaggatcaatgtacgcaccaaacctggcggcagcgcaaaagatg

SEQ ID NO: 7388 - DNA, 103 bp, Artificial Sequence
  Synthetic Polynucleotide
taatacgactcactatagggaattgtagcactattattggtgcgtaggttaacagaggagaaacctaatgaccaataataacctggcggcagcgcaaaagatg

SEQ ID NO: 7389 - DNA, 103 bp, Artificial Sequence
  Synthetic Polynucleotide
taatacgactcactatagggatcacaattgtagcactattattggtgcgtaacagaggagaacgcacatgtaatagtgcaacctggcggcagcgcaaaagatg

SEQ ID NO: 7390 - DNA, 103 bp, Artificial Sequence
  Synthetic Polynucleotide
taatacgactcactatagggatggcatcacaattgtagcactattattggaacagaggagaccaataatggtgctacaaaacctggcggcagcgcaaaagatg

SEQ ID NO: 7391 - DNA, 103 bp, Artificial Sequence
  Synthetic Polynucleotide
taatacgactcactatagggggtgtatggcatcacaattgtagcactattaacagaggagaaatagtatgacaattgtgaacctggcggcagcgcaaaagatg

SEQ ID NO: 7392 - DNA, 103 bp, Artificial Sequence
  Synthetic Polynucleotide
taatacgactcactatagggtaacagaagtgcttgatcaaaacgtggctgaacagaggagacagccaatgtttgatcaaaacctggcggcagcgcaaaagatg

SEQ ID NO: 7393 - DNA, 103 bp, Artificial Sequence
  Synthetic Polynucleotide
taatacgactcactatagggctgttggtgtatggcatcacaattgtagcaaacagaggagatgctacatgtgtgatgccaacctggcggcagcgcaaaagatg

SEQ ID NO: 7394 - DNA, 103 bp, Artificial Sequence
  Synthetic Polynucleotide
taatacgactcactataggggtacactgttggtgtatggcatcacaattgaacagaggagacaattgatgtgccatacaaacctggcggcagcgcaaaagatg

SEQ ID NO: 7395 - DNA, 103 bp, Artificial Sequence
  Synthetic Polynucleotide
taatacgactcactatagggcataggtacactgttggtgtatggcatcacaacagaggagagtgatgatgtacaccaacaacctggcggcagcgcaaaagatg

SEQ ID NO: 7396 - DNA, 103 bp, Artificial Sequence
  Synthetic Polynucleotide
taatacgactcactatagggttatccataggtacactgttggtgtatggcaacagaggagagccataatgcaacagtgtaacctggcggcagcgcaaaagatg

SEQ ID NO: 7397 - DNA, 103 bp, Artificial Sequence
  Synthetic Polynucleotide
taatacgactcactatagggacatgttatccataggtacactgttggtgtaacagaggagaacaccaatggtgtacctaaacctggcggcagcgcaaaagatg

SEQ ID NO: 7398 - DNA, 103 bp, Artificial Sequence
  Synthetic Polynucleotide
taatacgactcactatagggcctaaacatgttatccataggtacactgttaacagaggagaaacagtatgcctatggataacctggcggcagcgcaaaagatg

SEQ ID NO: 7399 - DNA, 103 bp, Artificial Sequence
  Synthetic Polynucleotide
taatacgactcactatagggttatgcctaaacatgttatccataggtacaaacagaggagatgtaccatgggataacataacctggcggcagcgcaaaagatg

SEQ ID NO: 7400 - DNA, 103 bp, Artificial Sequence
  Synthetic Polynucleotide
taatacgactcactatagggcgttgttatgcctaaacatgttatccatagaacagaggagactatggatgacatgtttaaacctggcggcagcgcaaaagatg

SEQ ID NO: 7401 - DNA, 103 bp, Artificial Sequence
  Synthetic Polynucleotide
taatacgactcactatagggggtgacgttgttatgcctaaacatgttatcaacagaggagagataacatgtttaggcataacctggcggcagcgcaaaagatg

SEQ ID NO: 7402 - DNA, 103 bp, Artificial Sequence
  Synthetic Polynucleotide
taatacgactcactatagggattagggtgacgttgttatgcctaaacatgaacagaggagacatgttatggcataacaaaacctggcggcagcgcaaaagatg

SEQ ID NO: 7403 - DNA, 103 bp, Artificial Sequence
  Synthetic Polynucleotide
taatacgactcactatagggcggggtaacagaagtgcttgatcaaaacgtaacagaggagaacgtttatgtcaagcactaacctggcggcagcgcaaaagatg

SEQ ID NO: 7404 - DNA, 103 bp, Artificial Sequence
  Synthetic Polynucleotide
taatacgactcactatagggtaaccattagggtgacgttgttatgcctaaaacagaggagattaggcatgacaacgtcaaacctggcggcagcgcaaaagatg

SEQ ID NO: 7405 - DNA, 103 bp, Artificial Sequence
  Synthetic Polynucleotide
taatacgactcactatagggtgggataaccattagggtgacgttgttatgaacagaggagacataacatggtcaccctaaacctggcggcagcgcaaaagatg

SEQ ID NO: 7406 - DNA, 103 bp, Artificial Sequence
  Synthetic Polynucleotide
taatacgactcactatagggacaaatgggataaccattagggtgacgttgaacagaggagacaacgtatgcctaatggtaacctggcggcagcgcaaaagatg

SEQ ID NO: 7407 - DNA, 103 bp, Artificial Sequence
  Synthetic Polynucleotide
taatacgactcactataggggcggtacaaatgggataaccattagggtgaaacagaggagatcacccatgtggttatccaacctggcggcagcgcaaaagatg

SEQ ID NO: 7408 - DNA, 103 bp, Artificial Sequence
  Synthetic Polynucleotide
taatacgactcactatagggatctagcggtacaaatgggataaccattagaacagaggagactaatgatgatcccatttaacctggcggcagcgcaaaagatg

SEQ ID NO: 7409 - DNA, 103 bp, Artificial Sequence
  Synthetic Polynucleotide
taatacgactcactatagggcagtaatctagcggtacaaatgggataaccaacagaggagaggttatatgatttgtaccaacctggcggcagcgcaaaagatg

SEQ ID NO: 7410 - DNA, 103 bp, Artificial Sequence
  Synthetic Polynucleotide
taatacgactcactatagggcagggcagtaatctagcggtacaaatgggaaacagaggagatcccatatgtaccgctagaacctggcggcagcgcaaaagatg

SEQ ID NO: 7411 - DNA, 103 bp, Artificial Sequence
  Synthetic Polynucleotide
taatacgactcactatagggggacccagggcagtaatctagcggtacaaaaacagaggagatttgtaatgctagattacaacctggcggcagcgcaaaagatg

SEQ ID NO: 7412 - DNA, 103 bp, Artificial Sequence
  Synthetic Polynucleotide
taatacgactcactataggggtggtggacccagggcagtaatctagcggtaacagaggagaaccgctatgttactgcccaacctggcggcagcgcaaaagatg

SEQ ID NO: 7413 - DNA, 103 bp, Artificial Sequence
  Synthetic Polynucleotide
taatacgactcactatagggcgtacgtggtggacccagggcagtaatctaaacagaggagatagattatggccctgggtaacctggcggcagcgcaaaagatg

SEQ ID NO: 7414 - DNA, 103 bp, Artificial Sequence
  Synthetic Polynucleotide
taatacgactcactatagggcagtccggggtaacagaagtgcttgatcaaaacagaggagattgatcatgcacttctgtaacctggcggcagcgcaaaagatg

SEQ ID NO: 7415 - DNA, 103 bp, Artificial Sequence
  Synthetic Polynucleotide
taatacgactcactatagggtgggacgtacgtggtggacccagggcagtaaacagaggagatactgcatggggtccaccaacctggcggcagcgcaaaagatg

SEQ ID NO: 7416 - DNA, 103 bp, Artificial Sequence
  Synthetic Polynucleotide
taatacgactcactataggggtaattgggacgtacgtggtggacccagggaacagaggagaccctggatgcaccacgtaaacctggcggcagcgcaaaagatg

SEQ ID NO: 7417 - DNA, 103 bp, Artificial Sequence
  Synthetic Polynucleotide
taatacgactcactatagggtgaccgtaattgggacgtacgtggtggaccaacagaggagaggtccaatgcgtacgtccaacctggcggcagcgcaaaagatg

SEQ ID NO: 7418 - DNA, 103 bp, Artificial Sequence
  Synthetic Polynucleotide
taatacgactcactatagggtatcgtgaccgtaattgggacgtacgtggtaacagaggagaaccacgatggtcccaattaacctggcggcagcgcaaaagatg

SEQ ID NO: 7419 - DNA, 103 bp, Artificial Sequence
  Synthetic Polynucleotide
taatacgactcactatagggggggctatcgtgaccgtaattgggacgtacaacagaggagagtacgtatgaattacggtaacctggcggcagcgcaaaagatg

SEQ ID NO: 7420 - DNA, 103 bp, Artificial Sequence
  Synthetic Polynucleotide
taatacgactcactatagggacattggggctatcgtgaccgtaattgggaaacagaggagatcccaaatgcggtcacgaaacctggcggcagcgcaaaagatg

SEQ ID NO: 7421 - DNA, 103 bp, Artificial Sequence
  Synthetic Polynucleotide
taatacgactcactatagggggcacacattggggctatcgtgaccgtaataacagaggagaattacgatgacgatagccaacctggcggcagcgcaaaagatg

SEQ ID NO: 7422 - DNA, 103 bp, Artificial Sequence
  Synthetic Polynucleotide
taatacgactcactatagggtactcggcacacattggggctatcgtgaccaacagaggagaggtcacatgagccccaataacctggcggcagcgcaaaagatg

SEQ ID NO: 7423 - DNA, 103 bp, Artificial Sequence
  Synthetic Polynucleotide
taatacgactcactatagggcattgtactcggcacacattggggctatcgaacagaggagacgatagatgcaatgtgtgaacctggcggcagcgcaaaagatg

SEQ ID NO: 7424 - DNA, 103 bp, Artificial Sequence
  Synthetic Polynucleotide
taatacgactcactatagggtaacccattgtactcggcacacattggggcaacagaggagagccccaatgtgtgccgagaacctggcggcagcgcaaaagatg

SEQ ID NO: 7425 - DNA, 103 bp, Artificial Sequence
  Synthetic Polynucleotide
taatacgactcactatagggatactcagtccggggtaacagaagtgcttgaacagaggagacaagcaatgctgttacccaacctggcggcagcgcaaaagatg

SEQ ID NO: 7426 - DNA, 103 bp, Artificial Sequence
  Synthetic Polynucleotide
taatacgactcactatagggaaacgtaacccattgtactcggcacacattaacagaggagaaatgtgatgcgagtacaaaacctggcggcagcgcaaaagatg

SEQ ID NO: 7427 - DNA, 103 bp, Artificial Sequence
  Synthetic Polynucleotide
taatacgactcactatagggctgctaaacgtaacccattgtactcggcacaacagaggagagtgccgatgacaatgggtaacctggcggcagcgcaaaagatg

SEQ ID NO: 7428 - DNA, 103 bp, Artificial Sequence
  Synthetic Polynucleotide
taatacgactcactataggggtgccctgctaaacgtaacccattgtactcaacagaggagagagtacatggggttacgtaacctggcggcagcgcaaaagatg

SEQ ID NO: 7429 - DNA, 103 bp, Artificial Sequence
  Synthetic Polynucleotide
taatacgactcactatagggccctggtgccctgctaaacgtaacccattgaacagaggagacaatggatgacgtttagcaacctggcggcagcgcaaaagatg

SEQ ID NO: 7430 - DNA, 103 bp, Artificial Sequence
  Synthetic Polynucleotide
taatacgactcactataggggtaagccctggtgccctgctaaacgtaaccaacagaggagaggttacatgtagcagggcaacctggcggcagcgcaaaagatg

SEQ ID NO: 7431 - DNA, 103 bp, Artificial Sequence
  Synthetic Polynucleotide
taatacgactcactatagggggttggtaagccctggtgccctgctaaacgaacagaggagacgtttaatggggcaccagaacctggcggcagcgcaaaagatg

SEQ ID NO: 7432 - DNA, 103 bp, Artificial Sequence
  Synthetic Polynucleotide
taatacgactcactatagggttcatggttggtaagccctggtgccctgctaacagaggagaagcaggatgccagggcttaacctggcggcagcgcaaaagatg

SEQ ID NO: 7433 - DNA, 103 bp, Artificial Sequence
  Synthetic Polynucleotide
taatacgactcactataggggagtattcatggttggtaagccctggtgccaacagaggagaggcaccatggcttaccaaaacctggcggcagcgcaaaagatg

SEQ ID NO: 7434 - DNA, 103 bp, Artificial Sequence
  Synthetic Polynucleotide
taatacgactcactatagggccccggagtattcatggttggtaagccctgaacagaggagacagggcatgccaaccatgaacctggcggcagcgcaaaagatg

SEQ ID NO: 7435 - DNA, 103 bp, Artificial Sequence
  Synthetic Polynucleotide
taatacgactcactatagggcagctccccggagtattcatggttggtaagaacagaggagacttaccatgcatgaatacaacctggcggcagcgcaaaagatg

SEQ ID NO: 7436 - DNA, 103 bp, Artificial Sequence
  Synthetic Polynucleotide
taatacgactcactatagggtattgatactcagtccggggtaacagaagtaacagaggagaacttctatgaccccggacaacctggcggcagcgcaaaagatg

SEQ ID NO: 7437 - DNA, 103 bp, Artificial Sequence
  Synthetic Polynucleotide
taatacgactcactatagggattgacagctccccggagtattcatggttgaacagaggagacaaccaatgatactccggaacctggcggcagcgcaaaagatg

SEQ ID NO: 7438 - DNA, 103 bp, Artificial Sequence
  Synthetic Polynucleotide
taatacgactcactatagggcagaaattgacagctccccggagtattcataacagaggagaatgaatatgccggggagcaacctggcggcagcgcaaaagatg

SEQ ID NO: 7439 - DNA, 103 bp, Artificial Sequence
  Synthetic Polynucleotide
taatacgactcactataggggatgtcagaaattgacagctccccggagtaaacagaggagatactccatggagctgtcaaacctggcggcagcgcaaaagatg

SEQ ID NO: 7440 - DNA, 103 bp, Artificial Sequence
  Synthetic Polynucleotide
taatacgactcactatagggcgtctgatgtcagaaattgacagctccccgaacagaggagacggggaatggtcaatttcaacctggcggcagcgcaaaagatg

SEQ ID NO: 7441 - DNA, 103 bp, Artificial Sequence
  Synthetic Polynucleotide
taatacgactcactataggggaagtcgtctgatgtcagaaattgacagctaacagaggagaagctgtatgtttctgacaaacctggcggcagcgcaaaagatg

SEQ ID NO: 7442 - DNA, 103 bp, Artificial Sequence
  Synthetic Polynucleotide
taatacgactcactataggggattggaagtcgtctgatgtcagaaattgaaacagaggagatcaattatggacatcagaaacctggcggcagcgcaaaagatg

SEQ ID NO: 7443 - DNA, 103 bp, Artificial Sequence
  Synthetic Polynucleotide
taatacgactcactatagggatggtgattggaagtcgtctgatgtcagaaaacagaggagattctgaatgcagacgactaacctggcggcagcgcaaaagatg

SEQ ID NO: 7444 - DNA, 103 bp, Artificial Sequence
  Synthetic Polynucleotide
taatacgactcactatagggggcggatggtgattggaagtcgtctgatgtaacagaggagaacatcaatggacttccaaaacctggcggcagcgcaaaagatg

SEQ ID NO: 7445 - DNA, 103 bp, Artificial Sequence
  Synthetic Polynucleotide
taatacgactcactatagggggcatggcggatggtgattggaagtcgtctaacagaggagaagacgaatgccaatcaccaacctggcggcagcgcaaaagatg

SEQ ID NO: 7446 - DNA, 103 bp, Artificial Sequence
  Synthetic Polynucleotide
taatacgactcactatagggattgcggcatggcggatggtgattggaagtaacagaggagaacttccatgcaccatccgaacctggcggcagcgcaaaagatg

SEQ ID NO: 7447 - DNA, 103 bp, Artificial Sequence
  Synthetic Polynucleotide
taatacgactcactatagggcagtctattgatactcagtccggggtaacaaacagaggagatgttacatgggactgagtaacctggcggcagcgcaaaagatg

SEQ ID NO: 7448 - DNA, 103 bp, Artificial Sequence
  Synthetic Polynucleotide
taatacgactcactataggggtcatattgcggcatggcggatggtgattgaacagaggagacaatcaatgtccgccatgaacctggcggcagcgcaaaagatg

SEQ ID NO: 7449 - DNA, 103 bp, Artificial Sequence
  Synthetic Polynucleotide
taatacgactcactataggggtgacgtcatattgcggcatggcggatggtaacagaggagaaccatcatgcatgccgcaaacctggcggcagcgcaaaagatg

SEQ ID NO: 7450 - DNA, 103 bp, Artificial Sequence
  Synthetic Polynucleotide
taatacgactcactatagggctggtgtgacgtcatattgcggcatggcggaacagaggagaccgccaatgcgcaatatgaacctggcggcagcgcaaaagatg

SEQ ID NO: 7451 - DNA, 103 bp, Artificial Sequence
  Synthetic Polynucleotide
taatacgactcactatagggcatctctggtgtgacgtcatattgcggcataacagaggagaatgccgatgtatgacgtcaacctggcggcagcgcaaaagatg

SEQ ID NO: 7452 - DNA, 103 bp, Artificial Sequence
  Synthetic Polynucleotide
taatacgactcactatagggatcctcatctctggtgtgacgtcatattgcaacagaggagagcaataatgcgtcacaccaacctggcggcagcgcaaaagatg

SEQ ID NO: 7453 - DNA, 103 bp, Artificial Sequence
  Synthetic Polynucleotide
taatacgactcactatagggcaggtatcctcatctctggtgtgacgtcataacagaggagaatgacgatgcaccagagaaacctggcggcagcgcaaaagatg

SEQ ID NO: 7454 - DNA, 103 bp, Artificial Sequence
  Synthetic Polynucleotide
taatacgactcactatagggctcaccaggtatcctcatctctggtgtgacaacagaggagagtcacaatggagatgaggaacctggcggcagcgcaaaagatg

SEQ ID NO: 7455 - DNA, 103 bp, Artificial Sequence
  Synthetic Polynucleotide
taatacgactcactatagggttcacctcaccaggtatcctcatctctggtaacagaggagaaccagaatggaggataccaacctggcggcagcgcaaaagatg

SEQ ID NO: 7456 - DNA, 103 bp, Artificial Sequence
  Synthetic Polynucleotide
taatacgactcactatagggagtttttcacctcaccaggtatcctcatctaacagaggagaagatgaatgtacctggtgaacctggcggcagcgcaaaagatg

SEQ ID NO: 7457 - DNA, 103 bp, Artificial Sequence
  Synthetic Polynucleotide
taatacgactcactatagggcatcaagtttttcacctcaccaggtatcctaacagaggagaaggataatgggtgaggtgaacctggcggcagcgcaaaagatg

SEQ ID NO: 7458 - DNA, 103 bp, Artificial Sequence
  Synthetic Polynucleotide
taatacgactcactataggggtgagcagtctattgatactcagtccggggaacagaggagaccccggatggagtatcaaaacctggcggcagcgcaaaagatg

SEQ ID NO: 7459 - DNA, 103 bp, Artificial Sequence
  Synthetic Polynucleotide
taatacgactcactatagggatttccatcaagtttttcacctcaccaggtaacagaggagaacctggatgggtgaaaaaaacctggcggcagcgcaaaagatg

SEQ ID NO: 7460 - DNA, 103 bp, Artificial Sequence
  Synthetic Polynucleotide
taatacgactcactatagggcagctatttccatcaagtttttcacctcacaacagaggagagtgaggatgaaaacttgaaacctggcggcagcgcaaaagatg

SEQ ID NO: 7461 - DNA, 103 bp, Artificial Sequence
  Synthetic Polynucleotide
taatacgactcactatagggaacctcagctatttccatcaagtttttcacaacagaggagagtgaaaatgttgatggaaaacctggcggcagcgcaaaagatg

SEQ ID NO: 7462 - DNA, 103 bp, Artificial Sequence
  Synthetic Polynucleotide
taatacgactcactataggggagtcaacctcagctatttccatcaagtttaacagaggagaaaacttatgggaaatagcaacctggcggcagcgcaaaagatg

SEQ ID NO: 7463 - DNA, 103 bp, Artificial Sequence
  Synthetic Polynucleotide
taatacgactcactatagggcaactgagtcaacctcagctatttccatcaaacagaggagatgatggatgtagctgaggaacctggcggcagcgcaaaagatg

SEQ ID NO: 7464 - DNA, 103 bp, Artificial Sequence
  Synthetic Polynucleotide
taatacgactcactatagggtgggacaactgagtcaacctcagctatttcaacagaggagagaaataatggaggttgacaacctggcggcagcgcaaaagatg

SEQ ID NO: 7465 - DNA, 103 bp, Artificial Sequence
  Synthetic Polynucleotide
taatacgactcactatagggtggactgggacaactgagtcaacctcagctaacagaggagaagctgaatgtgactcagtaacctggcggcagcgcaaaagatg

SEQ ID NO: 7466 - DNA, 103 bp, Artificial Sequence
  Synthetic Polynucleotide
taatacgactcactatagggcattttggactgggacaactgagtcaacctaacagaggagaaggttgatgcagttgtccaacctggcggcagcgcaaaagatg

SEQ ID NO: 7467 - DNA, 103 bp, Artificial Sequence
  Synthetic Polynucleotide
taatacgactcactatagggtccaacattttggactgggacaactgagtcaacagaggagagactcaatggtcccagtcaacctggcggcagcgcaaaagatg

SEQ ID NO: 7468 - DNA, 103 bp, Artificial Sequence
  Synthetic Polynucleotide
taatacgactcactatagggttctctccaacattttggactgggacaactaacagaggagaagttgtatgagtccaaaaaacctggcggcagcgcaaaagatg

SEQ ID NO: 7469 - DNA, 103 bp, Artificial Sequence
  Synthetic Polynucleotide
taatacgactcactatagggaccgcgtgagcagtctattgatactcagtcaacagaggagagactgaatgtcaatagacaacctggcggcagcgcaaaagatg

SEQ ID NO: 7470 - DNA, 103 bp, Artificial Sequence
  Synthetic Polynucleotide
taatacgactcactatagggtgaccttctctccaacattttggactgggaaacagaggagatcccagatgaaaatgttgaacctggcggcagcgcaaaagatg

SEQ ID NO: 7471 - DNA, 103 bp, Artificial Sequence
  Synthetic Polynucleotide
taatacgactcactatagggagagttgaccttctctccaacattttggacaacagaggagagtccaaatggttggagagaacctggcggcagcgcaaaagatg

SEQ ID NO: 7472 - DNA, 103 bp, Artificial Sequence
  Synthetic Polynucleotide
taatacgactcactatagggtccatagagttgaccttctctccaacatttaacagaggagaaaatgtatgagagaaggtaacctggcggcagcgcaaaagatg

SEQ ID NO: 7473 - DNA, 103 bp, Artificial Sequence
  Synthetic Polynucleotide
taatacgactcactatagggatgcttccatagagttgaccttctctccaaaacagaggagattggagatgaggtcaactaacctggcggcagcgcaaaagatg

SEQ ID NO: 7474 - DNA, 103 bp, Artificial Sequence
  Synthetic Polynucleotide
taatacgactcactatagggctggtatgcttccatagagttgaccttctcaacagaggagagagaagatgaactctatgaacctggcggcagcgcaaaagatg

SEQ ID NO: 7475 - DNA, 103 bp, Artificial Sequence
  Synthetic Polynucleotide
taatacgactcactatagggggtatctggtatgcttccatagagttgaccaacagaggagaggtcaaatgtatggaagcaacctggcggcagcgcaaaagatg

SEQ ID NO: 7476 - DNA, 103 bp, Artificial Sequence
  Synthetic Polynucleotide
taatacgactcactatagggtcacaggtatctggtatgcttccatagagtaacagaggagaactctaatgaagcataccaacctggcggcagcgcaaaagatg

SEQ ID NO: 7477 - DNA, 103 bp, Artificial Sequence
  Synthetic Polynucleotide
taatacgactcactatagggggatctcacaggtatctggtatgcttccataacagaggagaatggaaatgtaccagataaacctggcggcagcgcaaaagatg

SEQ ID NO: 7478 - DNA, 103 bp, Artificial Sequence
  Synthetic Polynucleotide
taatacgactcactatagggtcattggatctcacaggtatctggtatgctaacagaggagaagcataatggatacctgtaacctggcggcagcgcaaaagatg

SEQ ID NO: 7479 - DNA, 103 bp, Artificial Sequence
  Synthetic Polynucleotide
taatacgactcactatagggatccttcattggatctcacaggtatctggtaacagaggagaaccagaatgctgtgagataacctggcggcagcgcaaaagatg

SEQ ID NO: 7480 - DNA, 103 bp, Artificial Sequence
  Synthetic Polynucleotide
taatacgactcactatagggcttcaaccgcgtgagcagtctattgatactaacagaggagaagtatcatgagactgctcaacctggcggcagcgcaaaagatg

SEQ ID NO: 7481 - DNA, 103 bp, Artificial Sequence
  Synthetic Polynucleotide
taatacgactcactatagggtccagatccttcattggatctcacaggtataacagaggagaatacctatgagatccaataacctggcggcagcgcaaaagatg

SEQ ID NO: 7482 - DNA, 103 bp, Artificial Sequence
  Synthetic Polynucleotide
taatacgactcactatagggtgcgttccagatccttcattggatctcacaaacagaggagatgtgagatgcaatgaaggaacctggcggcagcgcaaaagatg

SEQ ID NO: 7483 - DNA, 103 bp, Artificial Sequence
  Synthetic Polynucleotide
taatacgactcactatagggatacttgcgttccagatccttcattggatcaacagaggagagatccaatgaaggatctgaacctggcggcagcgcaaaagatg

SEQ ID NO: 7484 - DNA, 103 bp, Artificial Sequence
  Synthetic Polynucleotide
taatacgactcactataggggccgaatacttgcgttccagatccttcattaacagaggagaaatgaaatgtctggaacgaacctggcggcagcgcaaaagatg

SEQ ID NO: 7485 - DNA, 103 bp, Artificial Sequence
  Synthetic Polynucleotide
taatacgactcactatagggggaaagccgaatacttgcgttccagatcctaacagaggagaaggatcatgaacgcaagtaacctggcggcagcgcaaaagatg

SEQ ID NO: 7486 - DNA, 103 bp, Artificial Sequence
  Synthetic Polynucleotide
taatacgactcactataggggcagtggaaagccgaatacttgcgttccagaacagaggagactggaaatgaagtattcgaacctggcggcagcgcaaaagatg

SEQ ID NO: 7487 - DNA, 103 bp, Artificial Sequence
  Synthetic Polynucleotide
taatacgactcactatagggtggttgcagtggaaagccgaatacttgcgtaacagaggagaacgcaaatgttcggctttaacctggcggcagcgcaaaagatg

SEQ ID NO: 7488 - DNA, 103 bp, Artificial Sequence
  Synthetic Polynucleotide
taatacgactcactatagggtaccctggttgcagtggaaagccgaatactaacagaggagaagtattatgctttccactaacctggcggcagcgcaaaagatg

SEQ ID NO: 7489 - DNA, 103 bp, Artificial Sequence
  Synthetic Polynucleotide
taatacgactcactatagggtcgagtaccctggttgcagtggaaagccgaaacagaggagatcggctatgcactgcaacaacctggcggcagcgcaaaagatg

SEQ ID NO: 7490 - DNA, 103 bp, Artificial Sequence
  Synthetic Polynucleotide
taatacgactcactatagggaacactcgagtaccctggttgcagtggaaaaacagaggagatttccaatgcaaccagggaacctggcggcagcgcaaaagatg

SEQ ID NO: 7491 - DNA, 103 bp, Artificial Sequence
  Synthetic Polynucleotide
taatacgactcactataggggcccaatgggccctgtgggtgggatcaaccaacagaggagaggttgaatgcacccacagaacctggcggcagcgcaaaagatg

SEQ ID NO: 7492 - DNA, 103 bp, Artificial Sequence
  Synthetic Polynucleotide
taatacgactcactatagggttctccttcaaccgcgtgagcagtctattgaacagaggagacaatagatggctcacgcgaacctggcggcagcgcaaaagatg

SEQ ID NO: 7493 - DNA, 103 bp, Artificial Sequence
  Synthetic Polynucleotide
taatacgactcactatagggctaaaaacactcgagtaccctggttgcagtaacagaggagaactgcaatgagggtactcaacctggcggcagcgcaaaagatg

SEQ ID NO: 7494 - DNA, 103 bp, Artificial Sequence
  Synthetic Polynucleotide
taatacgactcactatagggtccgactaaaaacactcgagtaccctggttaacagaggagaaaccagatgactcgagtgaacctggcggcagcgcaaaagatg

SEQ ID NO: 7495 - DNA, 103 bp, Artificial Sequence
  Synthetic Polynucleotide
taatacgactcactataggggagcgtccgactaaaaacactcgagtacccaacagaggagagggtacatgagtgtttttaacctggcggcagcgcaaaagatg

SEQ ID NO: 7496 - DNA, 103 bp, Artificial Sequence
  Synthetic Polynucleotide
taatacgactcactatagggcctaggagcgtccgactaaaaacactcgagaacagaggagactcgagatgttttagtcgaacctggcggcagcgcaaaagatg

SEQ ID NO: 7497 - DNA, 103 bp, Artificial Sequence
  Synthetic Polynucleotide
taatacgactcactatagggtctctcctaggagcgtccgactaaaaacacaacagaggagagtgtttatggtcggacgcaacctggcggcagcgcaaaagatg

SEQ ID NO: 7498 - DNA, 103 bp, Artificial Sequence
  Synthetic Polynucleotide
taatacgactcactatagggcaagatctctcctaggagcgtccgactaaaaacagaggagatttagtatgacgctcctaaacctggcggcagcgcaaaagatg

SEQ ID NO: 7499 - DNA, 103 bp, Artificial Sequence
  Synthetic Polynucleotide
taatacgactcactatagggtagttcaagatctctcctaggagcgtccgaaacagaggagatcggacatgcctaggagaaacctggcggcagcgcaaaagatg

SEQ ID NO: 7500 - DNA, 103 bp, Artificial Sequence
  Synthetic Polynucleotide
taatacgactcactatagggtataatagttcaagatctctcctaggagcgaacagaggagacgctccatggagagatctaacctggcggcagcgcaaaagatg

SEQ ID NO: 7501 - DNA, 103 bp, Artificial Sequence
  Synthetic Polynucleotide
taatacgactcactatagggatgtgtataatagttcaagatctctcctagaacagaggagactaggaatgatcttgaacaacctggcggcagcgcaaaagatg

SEQ ID NO: 7502 - DNA, 103 bp, Artificial Sequence
  Synthetic Polynucleotide
taatacgactcactataggggaccaatgtgtataatagttcaagatctctaacagaggagaagagatatggaactattaaacctggcggcagcgcaaaagatg

SEQ ID NO: 7503 - DNA, 103 bp, Artificial Sequence
  Synthetic Polynucleotide
taatacgactcactatagggacgctttctccttcaaccgcgtgagcagtcaacagaggagagactgcatgcgcggttgaaacctggcggcagcgcaaaagatg

SEQ ID NO: 7504 - DNA, 103 bp, Artificial Sequence
  Synthetic Polynucleotide
taatacgactcactatagggtgcctgaccaatgtgtataatagttcaagaaacagaggagatcttgaatgattatacacaacctggcggcagcgcaaaagatg

SEQ ID NO: 7505 - DNA, 103 bp, Artificial Sequence
  Synthetic Polynucleotide
taatacgactcactatagggtatgctgcctgaccaatgtgtataatagttaacagaggagaaactatatgacacattggaacctggcggcagcgcaaaagatg

SEQ ID NO: 7506 - DNA, 103 bp, Artificial Sequence
  Synthetic Polynucleotide
taatacgactcactatagggagctttatgctgcctgaccaatgtgtataaaacagaggagattatacatgttggtcaggaacctggcggcagcgcaaaagatg

SEQ ID NO: 7507 - DNA, 103 bp, Artificial Sequence
  Synthetic Polynucleotide
taatacgactcactatagggacgtaagctttatgctgcctgaccaatgtgaacagaggagacacattatgcaggcagcaaacctggcggcagcgcaaaagatg

SEQ ID NO: 7508 - DNA, 103 bp, Artificial Sequence
  Synthetic Polynucleotide
taatacgactcactatagggcataaacgtaagctttatgctgcctgaccaaacagaggagatggtcaatgagcataaagaacctggcggcagcgcaaaagatg

SEQ ID NO: 7509 - DNA, 103 bp, Artificial Sequence
  Synthetic Polynucleotide
taatacgactcactatagggcagaacataaacgtaagctttatgctgcctaacagaggagaaggcagatgaaagcttacaacctggcggcagcgcaaaagatg

SEQ ID NO: 7510 - DNA, 103 bp, Artificial Sequence
  Synthetic Polynucleotide
taatacgactcactatagggaaccacagaacataaacgtaagctttatgcaacagaggagagcataaatgttacgtttaaacctggcggcagcgcaaaagatg

SEQ ID NO: 7511 - DNA, 103 bp, Artificial Sequence
  Synthetic Polynucleotide
taatacgactcactatagggggccgaaccacagaacataaacgtaagcttaacagaggagaaagcttatgtttatgttcaacctggcggcagcgcaaaagatg

SEQ ID NO: 7512 - DNA, 103 bp, Artificial Sequence
  Synthetic Polynucleotide
taatacgactcactataggggccatggccgaaccacagaacataaacgtaaacagaggagatacgttatggttctgtggaacctggcggcagcgcaaaagatg

SEQ ID NO: 7513 - DNA, 103 bp, Artificial Sequence
  Synthetic Polynucleotide
taatacgactcactatagggcagtagccatggccgaaccacagaacataaaacagaggagattatgtatggtggttcggaacctggcggcagcgcaaaagatg

SEQ ID NO: 7514 - DNA, 103 bp, Artificial Sequence
  Synthetic Polynucleotide
taatacgactcactatagggaacgaacgctttctccttcaaccgcgtgagaacagaggagactcacgatgttgaaggagaacctggcggcagcgcaaaagatg

SEQ ID NO: 7515 - DNA, 103 bp, Artificial Sequence
  Synthetic Polynucleotide
taatacgactcactatagggttttccagtagccatggccgaaccacagaaaacagaggagattctgtatgtcggccatgaacctggcggcagcgcaaaagatg

SEQ ID NO: 7516 - DNA, 103 bp, Artificial Sequence
  Synthetic Polynucleotide
taatacgactcactatagggaggaattttccagtagccatggccgaaccaaacagaggagatggttcatgcatggctacaacctggcggcagcgcaaaagatg

SEQ ID NO: 7517 - DNA, 103 bp, Artificial Sequence
  Synthetic Polynucleotide
taatacgactcactatagggccaaaaggaattttccagtagccatggccgaacagaggagacggccaatgctactggaaaacctggcggcagcgcaaaagatg

SEQ ID NO: 7518 - DNA, 103 bp, Artificial Sequence
  Synthetic Polynucleotide
taatacgactcactataggggtatgccaaaaggaattttccagtagccataacagaggagaatggctatgggaaaattcaacctggcggcagcgcaaaagatg

SEQ ID NO: 7519 - DNA, 103 bp, Artificial Sequence
  Synthetic Polynucleotide
taatacgactcactatagggggtgagtatgccaaaaggaattttccagtaaacagaggagatactggatgattccttttaacctggcggcagcgcaaaagatg

SEQ ID NO: 7520 - DNA, 103 bp, Artificial Sequence
  Synthetic Polynucleotide
taatacgactcactatagggctggtggtgagtatgccaaaaggaattttcaacagaggagagaaaatatgttttggcataacctggcggcagcgcaaaagatg

SEQ ID NO: 7521 - DNA, 103 bp, Artificial Sequence
  Synthetic Polynucleotide
taatacgactcactatagggagcacctggtggtgagtatgccaaaaggaaaacagaggagattccttatggcatactcaaacctggcggcagcgcaaaagatg

SEQ ID NO: 7522 - DNA, 103 bp, Artificial Sequence
  Synthetic Polynucleotide
taatacgactcactataggggctccagcacctggtggtgagtatgccaaaaacagaggagatttggcatgctcaccaccaacctggcggcagcgcaaaagatg

SEQ ID NO: 7523 - DNA, 103 bp, Artificial Sequence
  Synthetic Polynucleotide
taatacgactcactatagggtaggagctccagcacctggtggtgagtatgaacagaggagacatactatgcaccaggtgaacctggcggcagcgcaaaagatg

SEQ ID NO: 7524 - DNA, 103 bp, Artificial Sequence
  Synthetic Polynucleotide
taatacgactcactatagggttttgtaggagctccagcacctggtggtgaaacagaggagatcaccaatgggtgctggaaacctggcggcagcgcaaaagatg

SEQ ID NO: 7525 - DNA, 103 bp, Artificial Sequence
  Synthetic Polynucleotide
taatacgactcactatagggcggataacgaacgctttctccttcaaccgcaacagaggagagcggttatgggagaaagcaacctggcggcagcgcaaaagatg

SEQ ID NO: 7526 - DNA, 103 bp, Artificial Sequence
  Synthetic Polynucleotide
taatacgactcactatagggaccctttttgtaggagctccagcacctggtaacagaggagaaccaggatgtggagctccaacctggcggcagcgcaaaagatg

SEQ ID NO: 7527 - DNA, 103 bp, Artificial Sequence
  Synthetic Polynucleotide
taatacgactcactatagggcatcaaccctttttgtaggagctccagcacaacagaggagagtgctgatgctcctacaaaacctggcggcagcgcaaaagatg

SEQ ID NO: 7528 - DNA, 103 bp, Artificial Sequence
  Synthetic Polynucleotide
taatacgactcactatagggcatggcatcaaccctttttgtaggagctccaacagaggagaggagctatgacaaaaaggaacctggcggcagcgcaaaagatg

SEQ ID NO: 7529 - DNA, 103 bp, Artificial Sequence
  Synthetic Polynucleotide
taatacgactcactatagggccaagcatggcatcaaccctttttgtaggaaacagaggagatcctacatgaagggttgaaacctggcggcagcgcaaaagatg

SEQ ID NO: 7530 - DNA, 103 bp, Artificial Sequence
  Synthetic Polynucleotide
taatacgactcactataggggagtaccaagcatggcatcaaccctttttgaacagaggagacaaaaaatgttgatgccaaacctggcggcagcgcaaaagatg

SEQ ID NO: 7531 - DNA, 103 bp, Artificial Sequence
  Synthetic Polynucleotide
taatacgactcactatagggtacatgagtaccaagcatggcatcaaccctaacagaggagaagggttatggccatgcttaacctggcggcagcgcaaaagatg

SEQ ID NO: 7532 - DNA, 103 bp, Artificial Sequence
  Synthetic Polynucleotide
taatacgactcactatagggcaaactacatgagtaccaagcatggcatcaaacagaggagatgatgcatggcttggtacaacctggcggcagcgcaaaagatg

SEQ ID NO: 7533 - DNA, 103 bp, Artificial Sequence
  Synthetic Polynucleotide
taatacgactcactatagggcgtcccaaactacatgagtaccaagcatggaacagaggagaccatgcatggtactcatgaacctggcggcagcgcaaaagatg

SEQ ID NO: 7534 - DNA, 103 bp, Artificial Sequence
  Synthetic Polynucleotide
taatacgactcactatagggccccacgtcccaaactacatgagtaccaagaacagaggagacttggtatgcatgtagttaacctggcggcagcgcaaaagatg

SEQ ID NO: 7535 - DNA, 103 bp, Artificial Sequence
  Synthetic Polynucleotide
taatacgactcactatagggtgtagccccacgtcccaaactacatgagtaaacagaggagatactcaatgagtttgggaaacctggcggcagcgcaaaagatg

SEQ ID NO: 7536 - DNA, 103 bp, Artificial Sequence
  Synthetic Polynucleotide
taatacgactcactatagggttggccggataacgaacgctttctccttcaaacagaggagatgaaggatgaagcgttcgaacctggcggcagcgcaaaagatg

SEQ ID NO: 7537 - DNA, 103 bp, Artificial Sequence
  Synthetic Polynucleotide
taatacgactcactatagggttgattgtagccccacgtcccaaactacataacagaggagaatgtagatggggacgtggaacctggcggcagcgcaaaagatg

SEQ ID NO: 7538 - DNA, 103 bp, Artificial Sequence
  Synthetic Polynucleotide
taatacgactcactataggggcaacttgattgtagccccacgtcccaaacaacagaggagagtttggatggtggggctaaacctggcggcagcgcaaaagatg

SEQ ID NO: 7539 - DNA, 103 bp, Artificial Sequence
  Synthetic Polynucleotide
taatacgactcactatagggagcacgcaacttgattgtagccccacgtccaacagaggagaggacgtatggctacaatcaacctggcggcagcgcaaaagatg

SEQ ID NO: 7540 - DNA, 103 bp, Artificial Sequence
  Synthetic Polynucleotide
taatacgactcactatagggtacacagcacgcaacttgattgtagccccaaacagaggagatggggcatgaatcaagttaacctggcggcagcgcaaaagatg

SEQ ID NO: 7541 - DNA, 103 bp, Artificial Sequence
  Synthetic Polynucleotide
taatacgactcactataggggggtatacacagcacgcaacttgattgtagaacagaggagactacaaatgagttgcgtgaacctggcggcagcgcaaaagatg

SEQ ID NO: 7542 - DNA, 103 bp, Artificial Sequence
  Synthetic Polynucleotide
taatacgactcactatagggatccagggtatacacagcacgcaacttgataacagaggagaatcaagatgcgtgctgtgaacctggcggcagcgcaaaagatg

SEQ ID NO: 7543 - DNA, 103 bp, Artificial Sequence
  Synthetic Polynucleotide
taatacgactcactatagggggcttatccagggtatacacagcacgcaacaacagaggagagttgcgatgtgtgtatacaacctggcggcagcgcaaaagatg

SEQ ID NO: 7544 - DNA, 103 bp, Artificial Sequence
  Synthetic Polynucleotide
taatacgactcactatagggtgtttggcttatccagggtatacacagcacaacagaggagagtgctgatgataccctggaacctggcggcagcgcaaaagatg

SEQ ID NO: 7545 - DNA, 103 bp, Artificial Sequence
  Synthetic Polynucleotide
taatacgactcactatagggtagtgtgtttggcttatccagggtatacacaacagaggagagtgtatatgctggataagaacctggcggcagcgcaaaagatg

SEQ ID NO: 7546 - DNA, 103 bp, Artificial Sequence
  Synthetic Polynucleotide
taatacgactcactatagggaccggtagtgtgtttggcttatccagggtaaacagaggagataccctatgtaagccaaaaacctggcggcagcgcaaaagatg

SEQ ID NO: 7547 - DNA, 103 bp, Artificial Sequence
  Synthetic Polynucleotide
taatacgactcactatagggagtagttggccggataacgaacgctttctcaacagaggagagagaaaatgttcgttatcaacctggcggcagcgcaaaagatg

SEQ ID NO: 7548 - DNA, 103 bp, Artificial Sequence
  Synthetic Polynucleotide
taatacgactcactatagggaacaaaccggtagtgtgtttggcttatccaaacagaggagatggataatgcaaacacacaacctggcggcagcgcaaaagatg

SEQ ID NO: 7549 - DNA, 103 bp, Artificial Sequence
  Synthetic Polynucleotide
taatacgactcactataggggaagcaacaaaccggtagtgtgtttggcttaacagaggagaaagccaatgacactaccgaacctggcggcagcgcaaaagatg

SEQ ID NO: 7550 - DNA, 103 bp, Artificial Sequence
  Synthetic Polynucleotide
taatacgactcactatagggcatctgaagcaacaaaccggtagtgtgtttaacagaggagaaaacacatgaccggtttgaacctggcggcagcgcaaaagatg

SEQ ID NO: 7551 - DNA, 103 bp, Artificial Sequence
  Synthetic Polynucleotide
taatacgactcactatagggatactcatctgaagcaacaaaccggtagtgaacagaggagacactacatgtttgttgctaacctggcggcagcgcaaaagatg

SEQ ID NO: 7552 - DNA, 103 bp, Artificial Sequence
  Synthetic Polynucleotide
taatacgactcactataggggcggtatactcatctgaagcaacaaaccggaacagaggagaccggttatgtgcttcagaaacctggcggcagcgcaaaagatg

SEQ ID NO: 7553 - DNA, 103 bp, Artificial Sequence
  Synthetic Polynucleotide
taatacgactcactatagggcccctgcggtatactcatctgaagcaacaaaacagaggagattgttgatgcagatgagtaacctggcggcagcgcaaaagatg

SEQ ID NO: 7554 - DNA, 103 bp, Artificial Sequence
  Synthetic Polynucleotide
taatacgactcactatagggaaaaccccctgcggtatactcatctgaagcaacagaggagagcttcaatggagtataccaacctggcggcagcgcaaaagatg

SEQ ID NO: 7555 - DNA, 103 bp, Artificial Sequence
  Synthetic Polynucleotide
taatacgactcactataggggtaataaaaccccctgcggtatactcatctaacagaggagaagatgaatgtaccgcaggaacctggcggcagcgcaaaagatg

SEQ ID NO: 7556 - DNA, 103 bp, Artificial Sequence
  Synthetic Polynucleotide
taatacgactcactatagggagcacgtaataaaaccccctgcggtatactaacagaggagaagtataatgcagggggttaacctggcggcagcgcaaaagatg

SEQ ID NO: 7557 - DNA, 103 bp, Artificial Sequence
  Synthetic Polynucleotide
taatacgactcactatagggataccagcacgtaataaaaccccctgcggtaacagaggagaaccgcaatgggttttattaacctggcggcagcgcaaaagatg

SEQ ID NO: 7558 - DNA, 103 bp, Artificial Sequence
  Synthetic Polynucleotide
taatacgactcactatagggttcgaagtagttggccggataacgaacgctaacagaggagaagcgttatgtatccggccaacctggcggcagcgcaaaagatg

SEQ ID NO: 7559 - DNA, 103 bp, Artificial Sequence
  Synthetic Polynucleotide
taatacgactcactataggggtttgataccagcacgtaataaaaccccctaacagaggagaagggggatgtattacgtgaacctggcggcagcgcaaaagatg

SEQ ID NO: 7560 - DNA, 103 bp, Artificial Sequence
  Synthetic Polynucleotide
taatacgactcactatagggtgtttgtttgataccagcacgtaataaaacaacagaggagagttttaatgcgtgctggtaacctggcggcagcgcaaaagatg

SEQ ID NO: 7561 - DNA, 103 bp, Artificial Sequence
  Synthetic Polynucleotide
taatacgactcactatagggcactatgtttgtttgataccagcacgtaataacagaggagaattacgatgtggtatcaaaacctggcggcagcgcaaaagatg

SEQ ID NO: 7562 - DNA, 103 bp, Artificial Sequence
  Synthetic Polynucleotide
taatacgactcactataggggggaccactatgtttgtttgataccagcacaacagaggagagtgctgatgtcaaacaaaaacctggcggcagcgcaaaagatg

SEQ ID NO: 7563 - DNA, 103 bp, Artificial Sequence
  Synthetic Polynucleotide
taatacgactcactatagggccgctgggaccactatgtttgtttgataccaacagaggagaggtatcatgcaaacatagaacctggcggcagcgcaaaagatg

SEQ ID NO: 7564 - DNA, 103 bp, Artificial Sequence
  Synthetic Polynucleotide
taatacgactcactatagggggcatccgctgggaccactatgtttgtttgaacagaggagacaaacaatgatagtggtcaacctggcggcagcgcaaaagatg

SEQ ID NO: 7565 - DNA, 103 bp, Artificial Sequence
  Synthetic Polynucleotide
taatacgactcactatagggctttgggcatccgctgggaccactatgtttaacagaggagaaaacatatgggtcccagcaacctggcggcagcgcaaaagatg

SEQ ID NO: 7566 - DNA, 103 bp, Artificial Sequence
  Synthetic Polynucleotide
taatacgactcactatagggaggagctttgggcatccgctgggaccactaaacagaggagatagtggatgcagcggatgaacctggcggcagcgcaaaagatg

SEQ ID NO: 7567 - DNA, 103 bp, Artificial Sequence
  Synthetic Polynucleotide
taatacgactcactataggggtaacaggagctttgggcatccgctgggacaacagaggagagtcccaatggatgcccaaaacctggcggcagcgcaaaagatg

SEQ ID NO: 7568 - DNA, 103 bp, Artificial Sequence
  Synthetic Polynucleotide
taatacgactcactatagggatgatgtaacaggagctttgggcatccgctaacagaggagaagcggaatgccaaagctcaacctggcggcagcgcaaaagatg

SEQ ID NO: 7569 - DNA, 103 bp, Artificial Sequence
  Synthetic Polynucleotide
taatacgactcactatagggggtttttcgaagtagttggccggataacgaaacagaggagatcgttaatgggccaactaaacctggcggcagcgcaaaagatg

SEQ ID NO: 7570 - DNA, 103 bp, Artificial Sequence
  Synthetic Polynucleotide
taatacgactcactatagggaacacatgatgtaacaggagctttgggcataacagaggagaatgcccatggctcctgttaacctggcggcagcgcaaaagatg

SEQ ID NO: 7571 - DNA, 103 bp, Artificial Sequence
  Synthetic Polynucleotide
taatacgactcactatagggcacgaaacacatgatgtaacaggagctttgaacagaggagacaaagcatgtgttacatcaacctggcggcagcgcaaaagatg

SEQ ID NO: 7572 - DNA, 103 bp, Artificial Sequence
  Synthetic Polynucleotide
taatacgactcactataggggctgacacgaaacacatgatgtaacaggagaacagaggagactcctgatgcatcatgtgaacctggcggcagcgcaaaagatg

SEQ ID NO: 7573 - DNA, 103 bp, Artificial Sequence
  Synthetic Polynucleotide
taatacgactcactatagggtgcatgctgacacgaaacacatgatgtaacaacagaggagagttacaatgtgtgtttcgaacctggcggcagcgcaaaagatg

SEQ ID NO: 7574 - DNA, 103 bp, Artificial Sequence
  Synthetic Polynucleotide
taatacgactcactataggggtcattgcatgctgacacgaaacacatgataacagaggagaatcatgatgttcgtgtcaaacctggcggcagcgcaaaagatg

SEQ ID NO: 7575 - DNA, 103 bp, Artificial Sequence
  Synthetic Polynucleotide
taatacgactcactataggggagaagtcattgcatgctgacacgaaacacaacagaggagagtgtttatggtcagcatgaacctggcggcagcgcaaaagatg

SEQ ID NO: 7576 - DNA, 103 bp, Artificial Sequence
  Synthetic Polynucleotide
taatacgactcactatagggtgacagagaagtcattgcatgctgacacgaaacagaggagatcgtgtatgcatgcaatgaacctggcggcagcgcaaaagatg

SEQ ID NO: 7577 - DNA, 103 bp, Artificial Sequence
  Synthetic Polynucleotide
taatacgactcactatagggtagcctgacagagaagtcattgcatgctgaaacagaggagatcagcaatgaatgacttcaacctggcggcagcgcaaaagatg

SEQ ID NO: 7578 - DNA, 103 bp, Artificial Sequence
  Synthetic Polynucleotide
taatacgactcactatagggttcaatagcctgacagagaagtcattgcataacagaggagaatgcaaatgcttctctgtaacctggcggcagcgcaaaagatg

SEQ ID NO: 7579 - DNA, 103 bp, Artificial Sequence
  Synthetic Polynucleotide
taatacgactcactatagggtgtccttcaatagcctgacagagaagtcataacagaggagaatgactatgctgtcaggcaacctggcggcagcgcaaaagatg

SEQ ID NO: 7580 - DNA, 103 bp, Artificial Sequence
  Synthetic Polynucleotide
taatacgactcactatagggtactaggtttttcgaagtagttggccggataacagaggagaatccggatgactacttcgaacctggcggcagcgcaaaagatg

SEQ ID NO: 7581 - DNA, 103 bp, Artificial Sequence
  Synthetic Polynucleotide
taatacgactcactatagggaggagtgtccttcaatagcctgacagagaaaacagaggagattctctatgaggctattgaacctggcggcagcgcaaaagatg

SEQ ID NO: 7582 - DNA, 103 bp, Artificial Sequence
  Synthetic Polynucleotide
taatacgactcactatagggatgaaaggagtgtccttcaatagcctgacaaacagaggagatgtcagatgattgaaggaaacctggcggcagcgcaaaagatg

SEQ ID NO: 7583 - DNA, 103 bp, Artificial Sequence
  Synthetic Polynucleotide
taatacgactcactataggggcgaaatgaaaggagtgtccttcaatagccaacagaggagaggctatatgaggacactcaacctggcggcagcgcaaaagatg

SEQ ID NO: 7584 - DNA, 103 bp, Artificial Sequence
  Synthetic Polynucleotide
taatacgactcactatagggttgctgcgaaatgaaaggagtgtccttcaaaacagaggagattgaagatgactcctttcaacctggcggcagcgcaaaagatg

SEQ ID NO: 7585 - DNA, 103 bp, Artificial Sequence
  Synthetic Polynucleotide
taatacgactcactatagggaagttttgctgcgaaatgaaaggagtgtccaacagaggagaggacacatgtttcatttcaacctggcggcagcgcaaaagatg

SEQ ID NO: 7586 - DNA, 103 bp, Artificial Sequence
  Synthetic Polynucleotide
taatacgactcactatagggggaaaaagttttgctgcgaaatgaaaggagaacagaggagactccttatgtttcgcagcaacctggcggcagcgcaaaagatg

SEQ ID NO: 7587 - DNA, 103 bp, Artificial Sequence
  Synthetic Polynucleotide
taatacgactcactataggggccctggaaaaagttttgctgcgaaatgaaaacagaggagattcattatgcagcaaaacaacctggcggcagcgcaaaagatg

SEQ ID NO: 7588 - DNA, 103 bp, Artificial Sequence
  Synthetic Polynucleotide
taatacgactcactatagggactgggccctggaaaaagttttgctgcgaaaacagaggagattcgcaatgaaactttttaacctggcggcagcgcaaaagatg

SEQ ID NO: 7589 - DNA, 103 bp, Artificial Sequence
  Synthetic Polynucleotide
taatacgactcactatagggcttccactgggccctggaaaaagttttgctaacagaggagaagcaaaatgttttccaggaacctggcggcagcgcaaaagatg

SEQ ID NO: 7590 - DNA, 103 bp, Artificial Sequence
  Synthetic Polynucleotide
taatacgactcactatagggcgcgtcttccactgggccctggaaaaagttaacagaggagaaactttatgcagggcccaaacctggcggcagcgcaaaagatg

SEQ ID NO: 7591 - DNA, 103 bp, Artificial Sequence
  Synthetic Polynucleotide
taatacgactcactatagggggtgttactaggtttttcgaagtagttggcaacagaggagagccaacatgttcgaaaaaaacctggcggcagcgcaaaagatg

SEQ ID NO: 7592 - DNA, 103 bp, Artificial Sequence
  Synthetic Polynucleotide
taatacgactcactataggggttatcgcgtcttccactgggccctggaaaaacagaggagatttccaatgcccagtggaaacctggcggcagcgcaaaagatg

SEQ ID NO: 7593 - DNA, 103 bp, Artificial Sequence
  Synthetic Polynucleotide
taatacgactcactatagggcggctgttatcgcgtcttccactgggccctaacagaggagaagggccatgtggaagacgaacctggcggcagcgcaaaagatg

SEQ ID NO: 7594 - DNA, 103 bp, Artificial Sequence
  Synthetic Polynucleotide
taatacgactcactatagggtatagcggctgttatcgcgtcttccactggaacagaggagaccagtgatggacgcgataaacctggcggcagcgcaaaagatg

SEQ ID NO: 7595 - DNA, 103 bp, Artificial Sequence
  Synthetic Polynucleotide
taatacgactcactatagggctccctatagcggctgttatcgcgtcttccaacagaggagaggaagaatggataacagcaacctggcggcagcgcaaaagatg

SEQ ID NO: 7596 - DNA, 103 bp, Artificial Sequence
  Synthetic Polynucleotide
taatacgactcactatagggcaactctccctatagcggctgttatcgcgtaacagaggagaacgcgaatgcagccgctaaacctggcggcagcgcaaaagatg

SEQ ID NO: 7597 - DNA, 103 bp, Artificial Sequence
  Synthetic Polynucleotide
taatacgactcactatagggatccgcaactctccctatagcggctgttataacagaggagaataacaatggctatagggaacctggcggcagcgcaaaagatg

SEQ ID NO: 7598 - DNA, 103 bp, Artificial Sequence
  Synthetic Polynucleotide
taatacgactcactatagggacggtatccgcaactctccctatagcggctaacagaggagaagccgcatgagggagagtaacctggcggcagcgcaaaagatg

SEQ ID NO: 7599 - DNA, 103 bp, Artificial Sequence
  Synthetic Polynucleotide
taatacgactcactatagggtacccacggtatccgcaactctccctatagaacagaggagactatagatggagttgcggaacctggcggcagcgcaaaagatg

SEQ ID NO: 7600 - DNA, 103 bp, Artificial Sequence
  Synthetic Polynucleotide
taatacgactcactatagggccctgtacccacggtatccgcaactctcccaacagaggagagggagaatggcggataccaacctggcggcagcgcaaaagatg

SEQ ID NO: 7601 - DNA, 103 bp, Artificial Sequence
  Synthetic Polynucleotide
taatacgactcactataggggttggccctgtacccacggtatccgcaactaacagaggagaagttgcatgtaccgtgggaacctggcggcagcgcaaaagatg

SEQ ID NO: 7602 - DNA, 103 bp, Artificial Sequence
  Synthetic Polynucleotide
taatacgactcactatagggctagcgcccaatgggccctgtgggtgggataacagaggagaatcccaatgacagggcccaacctggcggcagcgcaaaagatg

SEQ ID NO: 7603 - DNA, 103 bp, Artificial Sequence
  Synthetic Polynucleotide
taatacgactcactatagggtccacggtgttactaggtttttcgaagtagaacagaggagactacttatgaaaacctagaacctggcggcagcgcaaaagatg

SEQ ID NO: 7604 - DNA, 103 bp, Artificial Sequence
  Synthetic Polynucleotide
taatacgactcactatagggagttggttggccctgtacccacggtatccgaacagaggagacggataatgtgggtacagaacctggcggcagcgcaaaagatg

SEQ ID NO: 7605 - DNA, 103 bp, Artificial Sequence
  Synthetic Polynucleotide
taatacgactcactatagggttctgagttggttggccctgtacccacggtaacagaggagaaccgtgatgacagggccaaacctggcggcagcgcaaaagatg

SEQ ID NO: 7606 - DNA, 103 bp, Artificial Sequence
  Synthetic Polynucleotide
taatacgactcactatagggatagcttctgagttggttggccctgtacccaacagaggagagggtacatggccaaccaaaacctggcggcagcgcaaaagatg

SEQ ID NO: 7607 - DNA, 103 bp, Artificial Sequence
  Synthetic Polynucleotide
taatacgactcactatagggctggtatagcttctgagttggttggccctgaacagaggagacagggcatgccaactcagaacctggcggcagcgcaaaagatg

SEQ ID NO: 7608 - DNA, 103 bp, Artificial Sequence
  Synthetic Polynucleotide
taatacgactcactataggggagtgctggtatagcttctgagttggttggaacagaggagaccaaccatgtcagaagctaacctggcggcagcgcaaaagatg

SEQ ID NO: 7609 - DNA, 103 bp, Artificial Sequence
  Synthetic Polynucleotide
taatacgactcactataggggcagtgagtgctggtatagcttctgagttgaacagaggagacaactcatgagctataccaacctggcggcagcgcaaaagatg

SEQ ID NO: 7610 - DNA, 103 bp, Artificial Sequence
  Synthetic Polynucleotide
taatacgactcactatagggcagcagcagtgagtgctggtatagcttctgaacagaggagacagaagatgtaccagcacaacctggcggcagcgcaaaagatg

SEQ ID NO: 7611 - DNA, 103 bp, Artificial Sequence
  Synthetic Polynucleotide
taatacgactcactatagggtgtctcagcagcagtgagtgctggtatagcaacagaggagagctataatggcactcactaacctggcggcagcgcaaaagatg

SEQ ID NO: 7612 - DNA, 103 bp, Artificial Sequence
  Synthetic Polynucleotide
taatacgactcactatagggtgacctgtctcagcagcagtgagtgctggtaacagaggagaaccagcatgcactgctgcaacctggcggcagcgcaaaagatg

SEQ ID NO: 7613 - DNA, 103 bp, Artificial Sequence
  Synthetic Polynucleotide
taatacgactcactatagggacgtgtgacctgtctcagcagcagtgagtgaacagaggagacactcaatgctgctgagaaacctggcggcagcgcaaaagatg

SEQ ID NO: 7614 - DNA, 103 bp, Artificial Sequence
  Synthetic Polynucleotide
taatacgactcactatagggcaacttccacggtgttactaggtttttcgaaacagaggagatcgaaaatgctagtaacaaacctggcggcagcgcaaaagatg

SEQ ID NO: 7615 - DNA, 103 bp, Artificial Sequence
  Synthetic Polynucleotide
taatacgactcactatagggttgtgacgtgtgacctgtctcagcagcagtaacagaggagaactgctatggagacaggtaacctggcggcagcgcaaaagatg

SEQ ID NO: 7616 - DNA, 103 bp, Artificial Sequence
  Synthetic Polynucleotide
taatacgactcactatagggactacttgtgacgtgtgacctgtctcagcaaacagaggagatgctgaatgaggtcacacaacctggcggcagcgcaaaagatg

SEQ ID NO: 7617 - DNA, 103 bp, Artificial Sequence
  Synthetic Polynucleotide
taatacgactcactatagggccggcactacttgtgacgtgtgacctgtctaacagaggagaagacagatgacacgtcacaacctggcggcagcgcaaaagatg

SEQ ID NO: 7618 - DNA, 103 bp, Artificial Sequence
  Synthetic Polynucleotide
taatacgactcactataggggtcacccggcactacttgtgacgtgtgaccaacagaggagaggtcacatgtcacaagtaaacctggcggcagcgcaaaagatg

SEQ ID NO: 7619 - DNA, 103 bp, Artificial Sequence
  Synthetic Polynucleotide
taatacgactcactatagggatggtgtcacccggcactacttgtgacgtgaacagaggagacacgtcatgagtagtgccaacctggcggcagcgcaaaagatg

SEQ ID NO: 7620 - DNA, 103 bp, Artificial Sequence
  Synthetic Polynucleotide
taatacgactcactatagggtctgcatggtgtcacccggcactacttgtgaacagaggagacacaagatgtgccgggtgaacctggcggcagcgcaaaagatg

SEQ ID NO: 7621 - DNA, 103 bp, Artificial Sequence
  Synthetic Polynucleotide
taatacgactcactataggggcgtgtctgcatggtgtcacccggcactacaacagaggagagtagtgatgggtgacaccaacctggcggcagcgcaaaagatg

SEQ ID NO: 7622 - DNA, 103 bp, Artificial Sequence
  Synthetic Polynucleotide
taatacgactcactatagggacgtggcgtgtctgcatggtgtcacccggcaacagaggagagccgggatgcaccatgcaaacctggcggcagcgcaaaagatg

SEQ ID NO: 7623 - DNA, 103 bp, Artificial Sequence
  Synthetic Polynucleotide
taatacgactcactatagggtcttaacgtggcgtgtctgcatggtgtcacaacagaggagagtgacaatgtgcagacacaacctggcggcagcgcaaaagatg

SEQ ID NO: 7624 - DNA, 103 bp, Artificial Sequence
  Synthetic Polynucleotide
taatacgactcactataggggtagttcttaacgtggcgtgtctgcatggtaacagaggagaaccatgatgacacgccacaacctggcggcagcgcaaaagatg

SEQ ID NO: 7625 - DNA, 103 bp, Artificial Sequence
  Synthetic Polynucleotide
taatacgactcactatagggctctgcaacttccacggtgttactaggtttaacagaggagaaaacctatgaacaccgtgaacctggcggcagcgcaaaagatg

SEQ ID NO: 7626 - DNA, 103 bp, Artificial Sequence
  Synthetic Polynucleotide
taatacgactcactataggggaatggtagttcttaacgtggcgtgtctgcaacagaggagagcagacatgccacgttaaaacctggcggcagcgcaaaagatg

SEQ ID NO: 7627 - DNA, 103 bp, Artificial Sequence
  Synthetic Polynucleotide
taatacgactcactatagggaccttgaatggtagttcttaacgtggcgtgaacagaggagacacgccatgttaagaactaacctggcggcagcgcaaaagatg

SEQ ID NO: 7628 - DNA, 103 bp, Artificial Sequence
  Synthetic Polynucleotide
taatacgactcactatagggctcagaccttgaatggtagttcttaacgtgaacagaggagacacgttatgaactaccataacctggcggcagcgcaaaagatg

SEQ ID NO: 7629 - DNA, 103 bp, Artificial Sequence
  Synthetic Polynucleotide
taatacgactcactataggggttgactcagaccttgaatggtagttcttaaacagaggagataagaaatgccattcaagaacctggcggcagcgcaaaagatg

SEQ ID NO: 7630 - DNA, 103 bp, Artificial Sequence
  Synthetic Polynucleotide
taatacgactcactatagggctatggttgactcagaccttgaatggtagtaacagaggagaactaccatgcaaggtctgaacctggcggcagcgcaaaagatg

SEQ ID NO: 7631 - DNA, 103 bp, Artificial Sequence
  Synthetic Polynucleotide
taatacgactcactataggggttctctatggttgactcagaccttgaatgaacagaggagacattcaatgtctgagtcaaacctggcggcagcgcaaaagatg

SEQ ID NO: 7632 - DNA, 103 bp, Artificial Sequence
  Synthetic Polynucleotide
taatacgactcactatagggaggaagttctctatggttgactcagaccttaacagaggagaaaggtcatggtcaaccataacctggcggcagcgcaaaagatg

SEQ ID NO: 7633 - DNA, 103 bp, Artificial Sequence
  Synthetic Polynucleotide
taatacgactcactatagggtacataggaagttctctatggttgactcagaacagaggagactgagtatgccatagagaaacctggcggcagcgcaaaagatg

SEQ ID NO: 7634 - DNA, 103 bp, Artificial Sequence
  Synthetic Polynucleotide
taatacgactcactatagggtgacctacataggaagttctctatggttgaaacagaggagatcaaccatggagaacttcaacctggcggcagcgcaaaagatg

SEQ ID NO: 7635 - DNA, 103 bp, Artificial Sequence
  Synthetic Polynucleotide
taatacgactcactatagggcatgctgacctacataggaagttctctatgaacagaggagacatagaatgcttcctatgaacctggcggcagcgcaaaagatg

SEQ ID NO: 7636 - DNA, 103 bp, Artificial Sequence
  Synthetic Polynucleotide
taatacgactcactatagggaaacactctgcaacttccacggtgttactaaacagaggagatagtaaatgcgtggaagtaacctggcggcagcgcaaaagatg

SEQ ID NO: 7637 - DNA, 103 bp, Artificial Sequence
  Synthetic Polynucleotide
taatacgactcactatagggacacgcatgctgacctacataggaagttctaacagaggagaagaactatgtatgtaggtaacctggcggcagcgcaaaagatg

SEQ ID NO: 7638 - DNA, 103 bp, Artificial Sequence
  Synthetic Polynucleotide
taatacgactcactatagggaaagtacacgcatgctgacctacataggaaaacagaggagattcctaatgaggtcagcaaacctggcggcagcgcaaaagatg

SEQ ID NO: 7639 - DNA, 103 bp, Artificial Sequence
  Synthetic Polynucleotide
taatacgactcactatagggtccgtaaagtacacgcatgctgacctacataacagaggagaatgtagatgagcatgcgtaacctggcggcagcgcaaaagatg

SEQ ID NO: 7640 - DNA, 103 bp, Artificial Sequence
  Synthetic Polynucleotide
taatacgactcactatagggtatactccgtaaagtacacgcatgctgaccaacagaggagaggtcagatggcgtgtactaacctggcggcagcgcaaaagatg

SEQ ID NO: 7641 - DNA, 103 bp, Artificial Sequence
  Synthetic Polynucleotide
taatacgactcactataggggtttttatactccgtaaagtacacgcatgcaacagaggagagcatgcatgtactttacgaacctggcggcagcgcaaaagatg

SEQ ID NO: 7642 - DNA, 103 bp, Artificial Sequence
  Synthetic Polynucleotide
taatacgactcactatagggcctgagtttttatactccgtaaagtacacgaacagaggagacgtgtaatgtacggagtaaacctggcggcagcgcaaaagatg

SEQ ID NO: 7643 - DNA, 103 bp, Artificial Sequence
  Synthetic Polynucleotide
taatacgactcactatagggtggcacctgagtttttatactccgtaaagtaacagaggagaactttaatgagtataaaaaacctggcggcagcgcaaaagatg

SEQ ID NO: 7644 - DNA, 103 bp, Artificial Sequence
  Synthetic Polynucleotide
taatacgactcactatagggccgcttggcacctgagtttttatactccgtaacagaggagaacggagatgaaaaactcaaacctggcggcagcgcaaaagatg

SEQ ID NO: 7645 - DNA, 103 bp, Artificial Sequence
  Synthetic Polynucleotide
taatacgactcactataggggcataccgcttggcacctgagtttttatacaacagaggagagtataaatgctcaggtgcaacctggcggcagcgcaaaagatg

SEQ ID NO: 7646 - DNA, 103 bp, Artificial Sequence
  Synthetic Polynucleotide
taatacgactcactatagggattcagcataccgcttggcacctgagttttaacagaggagaaaaactatggtgccaagcaacctggcggcagcgcaaaagatg

SEQ ID NO: 7647 - DNA, 103 bp, Artificial Sequence
  Synthetic Polynucleotide
taatacgactcactataggggagcgaaacactctgcaacttccacggtgtaacagaggagaacaccgatgaagttgcagaacctggcggcagcgcaaaagatg

SEQ ID NO: 7648 - DNA, 103 bp, Artificial Sequence
  Synthetic Polynucleotide
taatacgactcactatagggtacccattcagcataccgcttggcacctgaaacagaggagatcaggtatgaagcggtataacctggcggcagcgcaaaagatg

SEQ ID NO: 7649 - DNA, 103 bp, Artificial Sequence
  Synthetic Polynucleotide
taatacgactcactataggggttaatacccattcagcataccgcttggcaaacagaggagatgccaaatggtatgctgaaacctggcggcagcgcaaaagatg

SEQ ID NO: 7650 - DNA, 103 bp, Artificial Sequence
  Synthetic Polynucleotide
taatacgactcactataggggtggtgttaatacccattcagcataccgctaacagaggagaagcggtatgctgaatgggaacctggcggcagcgcaaaagatg

SEQ ID NO: 7651 - DNA, 103 bp, Artificial Sequence
  Synthetic Polynucleotide
taatacgactcactatagggttgtcgtggtgttaatacccattcagcataaacagaggagatatgctatgtgggtattaaacctggcggcagcgcaaaagatg

SEQ ID NO: 7652 - DNA, 103 bp, Artificial Sequence
  Synthetic Polynucleotide
taatacgactcactataggggctgcttgtcgtggtgttaatacccattcaaacagaggagatgaatgatgattaacaccaacctggcggcagcgcaaaagatg

SEQ ID NO: 7653 - DNA, 103 bp, Artificial Sequence
  Synthetic Polynucleotide
taatacgactcactataggggttgtgctgcttgtcgtggtgttaatacccaacagaggagagggtatatgcaccacgacaacctggcggcagcgcaaaagatg

SEQ ID NO: 7654 - DNA, 103 bp, Artificial Sequence
  Synthetic Polynucleotide
taatacgactcactatagggcctaagttgtgctgcttgtcgtggtgttaaaacagaggagattaacaatgcgacaagcaaacctggcggcagcgcaaaagatg

SEQ ID NO: 7655 - DNA, 103 bp, Artificial Sequence
  Synthetic Polynucleotide
taatacgactcactatagggtttctcctaagttgtgctgcttgtcgtggtaacagaggagaaccacgatgagcagcacaaacctggcggcagcgcaaaagatg

SEQ ID NO: 7656 - DNA, 103 bp, Artificial Sequence
  Synthetic Polynucleotide
taatacgactcactatagggctagctttctcctaagttgtgctgcttgtcaacagaggagagacaagatgcacaacttaaacctggcggcagcgcaaaagatg

SEQ ID NO: 7657 - DNA, 103 bp, Artificial Sequence
  Synthetic Polynucleotide
taatacgactcactataggggaattctagctttctcctaagttgtgctgcaacagaggagagcagcaatgcttaggagaaacctggcggcagcgcaaaagatg

SEQ ID NO: 7658 - DNA, 103 bp, Artificial Sequence
  Synthetic Polynucleotide
taatacgactcactataggggtgctgagcgaaacactctgcaacttccacaacagaggagagtggaaatggcagagtgtaacctggcggcagcgcaaaagatg

SEQ ID NO: 7659 - DNA, 103 bp, Artificial Sequence
  Synthetic Polynucleotide
taatacgactcactataggggtaaagaattctagctttctcctaagttgtaacagaggagaacaactatggagaaagctaacctggcggcagcgcaaaagatg

SEQ ID NO: 7660 - DNA, 103 bp, Artificial Sequence
  Synthetic Polynucleotide
taatacgactcactatagggcgtaggtaaagaattctagctttctcctaaaacagaggagattaggaatgagctagaataacctggcggcagcgcaaaagatg

SEQ ID NO: 7661 - DNA, 103 bp, Artificial Sequence
  Synthetic Polynucleotide
taatacgactcactatagggccggacgtaggtaaagaattctagctttctaacagaggagaagaaagatggaattctttaacctggcggcagcgcaaaagatg

SEQ ID NO: 7662 - DNA, 103 bp, Artificial Sequence
  Synthetic Polynucleotide
taatacgactcactatagggtcgaaccggacgtaggtaaagaattctagcaacagaggagagctagaatgctttacctaaacctggcggcagcgcaaaagatg

SEQ ID NO: 7663 - DNA, 103 bp, Artificial Sequence
  Synthetic Polynucleotide
taatacgactcactatagggccaggtcgaaccggacgtaggtaaagaattaacagaggagaaattctatgcctacgtccaacctggcggcagcgcaaaagatg

SEQ ID NO: 7664 - DNA, 103 bp, Artificial Sequence
  Synthetic Polynucleotide
taatacgactcactatagggcagctccaggtcgaaccggacgtaggtaaaaacagaggagatttaccatggtccggttcaacctggcggcagcgcaaaagatg

SEQ ID NO: 7665 - DNA, 103 bp, Artificial Sequence
  Synthetic Polynucleotide
taatacgactcactatagggaacgtcagctccaggtcgaaccggacgtagaacagaggagactacgtatggttcgacctaacctggcggcagcgcaaaagatg

SEQ ID NO: 7666 - DNA, 103 bp, Artificial Sequence
  Synthetic Polynucleotide
taatacgactcactatagggtgacaaacgtcagctccaggtcgaaccggaaacagaggagatccggtatgacctggagcaacctggcggcagcgcaaaagatg

SEQ ID NO: 7667 - DNA, 103 bp, Artificial Sequence
  Synthetic Polynucleotide
taatacgactcactatagggtgttatgacaaacgtcagctccaggtcgaaaacagaggagattcgacatggagctgacgaacctggcggcagcgcaaaagatg

SEQ ID NO: 7668 - DNA, 103 bp, Artificial Sequence
  Synthetic Polynucleotide
taatacgactcactataggggtacttgttatgacaaacgtcagctccaggaacagaggagacctggaatggacgtttgtaacctggcggcagcgcaaaagatg

SEQ ID NO: 7669 - DNA, 103 bp, Artificial Sequence
  Synthetic Polynucleotide
taatacgactcactataggggggtagtgctgagcgaaacactctgcaactaacagaggagaagttgcatggtgtttcgcaacctggcggcagcgcaaaagatg

SEQ ID NO: 7670 - DNA, 103 bp, Artificial Sequence
  Synthetic Polynucleotide
taatacgactcactataggggttgagtacttgttatgacaaacgtcagctaacagaggagaagctgaatgttgtcataaaacctggcggcagcgcaaaagatg

SEQ ID NO: 7671 - DNA, 103 bp, Artificial Sequence
  Synthetic Polynucleotide
taatacgactcactataggggggctgttgagtacttgttatgacaaacgtaacagaggagaacgtttatgataacaagtaacctggcggcagcgcaaaagatg

SEQ ID NO: 7672 - DNA, 103 bp, Artificial Sequence
  Synthetic Polynucleotide
taatacgactcactataggggttgagggctgttgagtacttgttatgacaaacagaggagatgtcatatgaagtactcaaacctggcggcagcgcaaaagatg

SEQ ID NO: 7673 - DNA, 103 bp, Artificial Sequence
  Synthetic Polynucleotide
taatacgactcactataggggtgtggttgagggctgttgagtacttgttaaacagaggagataacaaatgctcaacagcaacctggcggcagcgcaaaagatg

SEQ ID NO: 7674 - DNA, 103 bp, Artificial Sequence
  Synthetic Polynucleotide
taatacgactcactataggggttctgtgtggttgagggctgttgagtactaacagaggagaagtactatgcagccctcaaacctggcggcagcgcaaaagatg

SEQ ID NO: 7675 - DNA, 103 bp, Artificial Sequence
  Synthetic Polynucleotide
taatacgactcactatagggtcttggttctgtgtggttgagggctgttgaaacagaggagatcaacaatgctcaaccacaacctggcggcagcgcaaaagatg

SEQ ID NO: 7676 - DNA, 103 bp, Artificial Sequence
  Synthetic Polynucleotide
taatacgactcactataggggtgcgtcttggttctgtgtggttgagggctaacagaggagaagccctatgccacacagaaacctggcggcagcgcaaaagatg

SEQ ID NO: 7677 - DNA, 103 bp, Artificial Sequence
  Synthetic Polynucleotide
taatacgactcactataggggatctgtgcgtcttggttctgtgtggttgaaacagaggagatcaaccatgcagaaccaaaacctggcggcagcgcaaaagatg

SEQ ID NO: 7678 - DNA, 103 bp, Artificial Sequence
  Synthetic Polynucleotide
taatacgactcactataggggttaggatctgtgcgtcttggttctgtgtgaacagaggagacacacaatgccaagacgcaacctggcggcagcgcaaaagatg

SEQ ID NO: 7679 - DNA, 103 bp, Artificial Sequence
  Synthetic Polynucleotide
taatacgactcactatagggggtgtgttaggatctgtgcgtcttggttctaacagaggagaagaaccatgacgcacagaaacctggcggcagcgcaaaagatg

SEQ ID NO: 7680 - DNA, 103 bp, Artificial Sequence
  Synthetic Polynucleotide
taatacgactcactatagggcactggggtagtgctgagcgaaacactctgaacagaggagacagagtatgtcgctcagcaacctggcggcagcgcaaaagatg

SEQ ID NO: 7681 - DNA, 103 bp, Artificial Sequence
  Synthetic Polynucleotide
taatacgactcactatagggaatttggtgtgttaggatctgtgcgtcttgaacagaggagacaagacatgcagatcctaaacctggcggcagcgcaaaagatg

SEQ ID NO: 7682 - DNA, 103 bp, Artificial Sequence
  Synthetic Polynucleotide
taatacgactcactatagggtacataatttggtgtgttaggatctgtgcgaacagaggagacgcacaatgcctaacacaaacctggcggcagcgcaaaagatg

SEQ ID NO: 7683 - DNA, 103 bp, Artificial Sequence
  Synthetic Polynucleotide
taatacgactcactataggggtacgtacataatttggtgtgttaggatctaacagaggagaagatccatgcacaccaaaaacctggcggcagcgcaaaagatg

SEQ ID NO: 7684 - DNA, 103 bp, Artificial Sequence
  Synthetic Polynucleotide
taatacgactcactatagggtggtggtacgtacataatttggtgtgttagaacagaggagactaacaatgcaaattatgaacctggcggcagcgcaaaagatg

SEQ ID NO: 7685 - DNA, 103 bp, Artificial Sequence
  Synthetic Polynucleotide
taatacgactcactatagggccacctggtggtacgtacataatttggtgtaacagaggagaacaccaatgtatgtacgtaacctggcggcagcgcaaaagatg

SEQ ID NO: 7686 - DNA, 103 bp, Artificial Sequence
  Synthetic Polynucleotide
taatacgactcactatagggcaggtccacctggtggtacgtacataatttaacagaggagaaaattaatgacgtaccacaacctggcggcagcgcaaaagatg

SEQ ID NO: 7687 - DNA, 103 bp, Artificial Sequence
  Synthetic Polynucleotide
taatacgactcactatagggtggtacaggtccacctggtggtacgtacataacagaggagaatgtacatgccaccaggtaacctggcggcagcgcaaaagatg

SEQ ID NO: 7688 - DNA, 103 bp, Artificial Sequence
  Synthetic Polynucleotide
taatacgactcactatagggttatctggtacaggtccacctggtggtacgaacagaggagacgtaccatgaggtggaccaacctggcggcagcgcaaaagatg

SEQ ID NO: 7689 - DNA, 103 bp, Artificial Sequence
  Synthetic Polynucleotide
taatacgactcactatagggcaactttatctggtacaggtccacctggtgaacagaggagacaccagatggacctgtacaacctggcggcagcgcaaaagatg

SEQ ID NO: 7690 - DNA, 103 bp, Artificial Sequence
  Synthetic Polynucleotide
taatacgactcactatagggtgaatcaactttatctggtacaggtccaccaacagaggagaggtggaatggtaccagataacctggcggcagcgcaaaagatg

SEQ ID NO: 7691 - DNA, 103 bp, Artificial Sequence
  Synthetic Polynucleotide
taatacgactcactatagggatctacactggggtagtgctgagcgaaacaaacagaggagatgtttcatgcagcactacaacctggcggcagcgcaaaagatg

SEQ ID NO: 7692 - DNA, 103 bp, Artificial Sequence
  Synthetic Polynucleotide
taatacgactcactatagggacgtatgaatcaactttatctggtacaggtaacagaggagaacctgtatgagataaagtaacctggcggcagcgcaaaagatg

SEQ ID NO: 7693 - DNA, 103 bp, Artificial Sequence
  Synthetic Polynucleotide
taatacgactcactataggggccacacgtatgaatcaactttatctggtaaacagaggagataccagatgaagttgattaacctggcggcagcgcaaaagatg

SEQ ID NO: 7694 - DNA, 103 bp, Artificial Sequence
  Synthetic Polynucleotide
taatacgactcactatagggtgtttgccacacgtatgaatcaactttatcaacagaggagagataaaatggattcatacaacctggcggcagcgcaaaagatg

SEQ ID NO: 7695 - DNA, 103 bp, Artificial Sequence
  Synthetic Polynucleotide
taatacgactcactataggggtagatgtttgccacacgtatgaatcaactaacagaggagaagttgaatgatacgtgtgaacctggcggcagcgcaaaagatg

SEQ ID NO: 7696 - DNA, 103 bp, Artificial Sequence
  Synthetic Polynucleotide
taatacgactcactataggggattcgtagatgtttgccacacgtatgaataacagaggagaattcatatgtgtggcaaaaacctggcggcagcgcaaaagatg

SEQ ID NO: 7697 - DNA, 103 bp, Artificial Sequence
  Synthetic Polynucleotide
taatacgactcactatagggactgggattcgtagatgtttgccacacgtaaacagaggagatacgtgatgcaaacatctaacctggcggcagcgcaaaagatg

SEQ ID NO: 7698 - DNA, 103 bp, Artificial Sequence
  Synthetic Polynucleotide
taatacgactcactatagggaacacactgggattcgtagatgtttgccacaacagaggagagtggcaatgatctacgaaaacctggcggcagcgcaaaagatg

SEQ ID NO: 7699 - DNA, 103 bp, Artificial Sequence
  Synthetic Polynucleotide
taatacgactcactatagggtccaaaacacactgggattcgtagatgtttaacagaggagaaaacatatgcgaatcccaaacctggcggcagcgcaaaagatg

SEQ ID NO: 7700 - DNA, 103 bp, Artificial Sequence
  Synthetic Polynucleotide
taatacgactcactatagggctcggtccaaaacacactgggattcgtagaaacagaggagatctacgatgcccagtgtgaacctggcggcagcgcaaaagatg

SEQ ID NO: 7701 - DNA, 103 bp, Artificial Sequence
  Synthetic Polynucleotide
taatacgactcactatagggtttccctcggtccaaaacacactgggattcaacagaggagagaatccatgtgtgttttgaacctggcggcagcgcaaaagatg

SEQ ID NO: 7702 - DNA, 103 bp, Artificial Sequence
  Synthetic Polynucleotide
taatacgactcactatagggacctgatctacactggggtagtgctgagcgaacagaggagacgctcaatgctaccccagaacctggcggcagcgcaaaagatg

SEQ ID NO: 7703 - DNA, 103 bp, Artificial Sequence
  Synthetic Polynucleotide
taatacgactcactataggggggcgtttccctcggtccaaaacacactggaacagaggagaccagtgatgtttggaccgaacctggcggcagcgcaaaagatg

SEQ ID NO: 7704 - DNA, 103 bp, Artificial Sequence
  Synthetic Polynucleotide
taatacgactcactatagggcggcggggcgtttccctcggtccaaaacacaacagaggagagtgtttatgaccgagggaaacctggcggcagcgcaaaagatg

SEQ ID NO: 7705 - DNA, 103 bp, Artificial Sequence
  Synthetic Polynucleotide
taatacgactcactatagggatgcgcggcggggcgtttccctcggtccaaaacagaggagattggacatggggaaacgcaacctggcggcagcgcaaaagatg

SEQ ID NO: 7706 - DNA, 103 bp, Artificial Sequence
  Synthetic Polynucleotide
taatacgactcactatagggtggacatgcgcggcggggcgtttccctcggaacagaggagaccgaggatgacgccccgcaacctggcggcagcgcaaaagatg

SEQ ID NO: 7707 - DNA, 103 bp, Artificial Sequence
  Synthetic Polynucleotide
taatacgactcactatagggcggtatggacatgcgcggcggggcgtttccaacagaggagaggaaacatgccgccgcgcaacctggcggcagcgcaaaagatg

SEQ ID NO: 7708 - DNA, 103 bp, Artificial Sequence
  Synthetic Polynucleotide
taatacgactcactatagggaaaaacggtatggacatgcgcggcggggcgaacagaggagacgccccatggcgcatgtcaacctggcggcagcgcaaaagatg

SEQ ID NO: 7709 - DNA, 103 bp, Artificial Sequence
  Synthetic Polynucleotide
taatacgactcactatagggtgctcaaaaacggtatggacatgcgcggcgaacagaggagacgccgcatgtgtccatacaacctggcggcagcgcaaaagatg

SEQ ID NO: 7710 - DNA, 103 bp, Artificial Sequence
  Synthetic Polynucleotide
taatacgactcactataggggccaatgctcaaaaacggtatggacatgcgaacagaggagacgcatgatgataccgtttaacctggcggcagcgcaaaagatg

SEQ ID NO: 7711 - DNA, 103 bp, Artificial Sequence
  Synthetic Polynucleotide
taatacgactcactataggggcgttgccaatgctcaaaaacggtatggacaacagaggagagtccatatggtttttgagaacctggcggcagcgcaaaagatg

SEQ ID NO: 7712 - DNA, 103 bp, Artificial Sequence
  Synthetic Polynucleotide
taatacgactcactatagggaataggcgttgccaatgctcaaaaacggtaaacagaggagataccgtatgtgagcattgaacctggcggcagcgcaaaagatg

SEQ ID NO: 7713 - DNA, 103 bp, Artificial Sequence
  Synthetic Polynucleotide
taatacgactcactataggggagtgctagcgcccaatgggccctgtgggtaacagaggagaacccacatggcccattggaacctggcggcagcgcaaaagatg

SEQ ID NO: 7714 - DNA, 103 bp, Artificial Sequence
  Synthetic Polynucleotide
taatacgactcactatagggcatcgacctgatctacactggggtagtgctaacagaggagaagcactatgccagtgtagaacctggcggcagcgcaaaagatg

SEQ ID NO: 7715 - DNA, 103 bp, Artificial Sequence
  Synthetic Polynucleotide
taatacgactcactatagggatttgaataggcgttgccaatgctcaaaaaaacagaggagatttttgatgattggcaacaacctggcggcagcgcaaaagatg

SEQ ID NO: 7716 - DNA, 103 bp, Artificial Sequence
  Synthetic Polynucleotide
taatacgactcactatagggtagaaatttgaataggcgttgccaatgctcaacagaggagagagcatatgcaacgcctaaacctggcggcagcgcaaaagatg

SEQ ID NO: 7717 - DNA, 103 bp, Artificial Sequence
  Synthetic Polynucleotide
taatacgactcactatagggcgtcatagaaatttgaataggcgttgccaaaacagaggagattggcaatgcctattcaaaacctggcggcagcgcaaaagatg

SEQ ID NO: 7718 - DNA, 103 bp, Artificial Sequence
  Synthetic Polynucleotide
taatacgactcactatagggccatccgtcatagaaatttgaataggcgttaacagaggagaaacgccatgtcaaatttcaacctggcggcagcgcaaaagatg

SEQ ID NO: 7719 - DNA, 103 bp, Artificial Sequence
  Synthetic Polynucleotide
taatacgactcactatagggtcagaccatccgtcatagaaatttgaatagaacagaggagactattcatgtttctatgaaacctggcggcagcgcaaaagatg

SEQ ID NO: 7720 - DNA, 103 bp, Artificial Sequence
  Synthetic Polynucleotide
taatacgactcactatagggaaaattcagaccatccgtcatagaaatttgaacagaggagacaaattatgatgacggataacctggcggcagcgcaaaagatg

SEQ ID NO: 7721 - DNA, 103 bp, Artificial Sequence
  Synthetic Polynucleotide
taatacgactcactatagggcctggaaaattcagaccatccgtcatagaaaacagaggagattctatatgggatggtctaacctggcggcagcgcaaaagatg

SEQ ID NO: 7722 - DNA, 103 bp, Artificial Sequence
  Synthetic Polynucleotide
taatacgactcactatagggccgttcctggaaaattcagaccatccgtcaaacagaggagatgacggatggtctgaattaacctggcggcagcgcaaaagatg

SEQ ID NO: 7723 - DNA, 103 bp, Artificial Sequence
  Synthetic Polynucleotide
taatacgactcactatagggaaactccgttcctggaaaattcagaccatcaacagaggagagatggtatgaattttccaaacctggcggcagcgcaaaagatg

SEQ ID NO: 7724 - DNA, 103 bp, Artificial Sequence
  Synthetic Polynucleotide
taatacgactcactataggggccgtaaactccgttcctggaaaattcagaaacagaggagatctgaaatgtccaggaacaacctggcggcagcgcaaaagatg

SEQ ID NO: 7725 - DNA, 103 bp, Artificial Sequence
  Synthetic Polynucleotide
taatacgactcactatagggtgactcatcgacctgatctacactggggtaaacagaggagataccccatggtagatcagaacctggcggcagcgcaaaagatg

SEQ ID NO: 7726 - DNA, 103 bp, Artificial Sequence
  Synthetic Polynucleotide
taatacgactcactatagggttgatgccgtaaactccgttcctggaaaataacagaggagaattttcatggaacggagtaacctggcggcagcgcaaaagatg

SEQ ID NO: 7727 - DNA, 103 bp, Artificial Sequence
  Synthetic Polynucleotide
taatacgactcactataggggcgtgttgatgccgtaaactccgttcctggaacagaggagaccaggaatggagtttacgaacctggcggcagcgcaaaagatg

SEQ ID NO: 7728 - DNA, 103 bp, Artificial Sequence
  Synthetic Polynucleotide
taatacgactcactataggggtttagcgtgttgatgccgtaaactccgttaacagaggagaaacggaatgtacggcatcaacctggcggcagcgcaaaagatg

SEQ ID NO: 7729 - DNA, 103 bp, Artificial Sequence
  Synthetic Polynucleotide
taatacgactcactatagggatgttgtttagcgtgttgatgccgtaaactaacagaggagaagtttaatgcatcaacacaacctggcggcagcgcaaaagatg

SEQ ID NO: 7730 - DNA, 103 bp, Artificial Sequence
  Synthetic Polynucleotide
taatacgactcactatagggtgcccatgttgtttagcgtgttgatgccgtaacagaggagaacggcaatgacacgctaaaacctggcggcagcgcaaaagatg

SEQ ID NO: 7731 - DNA, 103 bp, Artificial Sequence
  Synthetic Polynucleotide
taatacgactcactatagggtagcgtgcccatgttgtttagcgtgttgataacagaggagaatcaacatgctaaacaacaacctggcggcagcgcaaaagatg

SEQ ID NO: 7732 - DNA, 103 bp, Artificial Sequence
  Synthetic Polynucleotide
taatacgactcactataggggcatatagcgtgcccatgttgtttagcgtgaacagaggagacacgctatgcaacatgggaacctggcggcagcgcaaaagatg

SEQ ID NO: 7733 - DNA, 103 bp, Artificial Sequence
  Synthetic Polynucleotide
taatacgactcactataggggtcttgcatatagcgtgcccatgttgtttaaacagaggagataaacaatgtgggcacgcaacctggcggcagcgcaaaagatg

SEQ ID NO: 7734 - DNA, 103 bp, Artificial Sequence
  Synthetic Polynucleotide
taatacgactcactataggggacatgtcttgcatatagcgtgcccatgttaacagaggagaaacatgatgacgctatataacctggcggcagcgcaaaagatg

SEQ ID NO: 7735 - DNA, 103 bp, Artificial Sequence
  Synthetic Polynucleotide
taatacgactcactataggggcgttgacatgtcttgcatatagcgtgcccaacagaggagagggcacatgatatgcaagaacctggcggcagcgcaaaagatg

SEQ ID NO: 7736 - DNA, 103 bp, Artificial Sequence
  Synthetic Polynucleotide
taatacgactcactatagggtgcggtgactcatcgacctgatctacactgaacagaggagacagtgtatgtcaggtcgaaacctggcggcagcgcaaaagatg

SEQ ID NO: 7737 - DNA, 103 bp, Artificial Sequence
  Synthetic Polynucleotide
taatacgactcactatagggttccagcgttgacatgtcttgcatatagcgaacagaggagacgctatatgcaagacatgaacctggcggcagcgcaaaagatg

SEQ ID NO: 7738 - DNA, 103 bp, Artificial Sequence
  Synthetic Polynucleotide
taatacgactcactatagggcgtgcttccagcgttgacatgtcttgcataaacagaggagatatgcaatgcatgtcaacaacctggcggcagcgcaaaagatg

SEQ ID NO: 7739 - DNA, 103 bp, Artificial Sequence
  Synthetic Polynucleotide
taatacgactcactatagggggacccgtgcttccagcgttgacatgtcttaacagaggagaaagacaatgcaacgctggaacctggcggcagcgcaaaagatg

SEQ ID NO: 7740 - DNA, 103 bp, Artificial Sequence
  Synthetic Polynucleotide
taatacgactcactatagggttattggacccgtgcttccagcgttgacataacagaggagaatgtcaatgctggaagcaaacctggcggcagcgcaaaagatg

SEQ ID NO: 7741 - DNA, 103 bp, Artificial Sequence
  Synthetic Polynucleotide
taatacgactcactataggggctttttattggacccgtgcttccagcgttaacagaggagaaacgctatgagcacgggtaacctggcggcagcgcaaaagatg

SEQ ID NO: 7742 - DNA, 103 bp, Artificial Sequence
  Synthetic Polynucleotide
taatacgactcactatagggatggtgctttttattggacccgtgcttccaaacagaggagatggaagatggggtccaataacctggcggcagcgcaaaagatg

SEQ ID NO: 7743 - DNA, 103 bp, Artificial Sequence
  Synthetic Polynucleotide
taatacgactcactatagggttctaatggtgctttttattggacccgtgcaacagaggagagcacggatgcaataaaaaaacctggcggcagcgcaaaagatg

SEQ ID NO: 7744 - DNA, 103 bp, Artificial Sequence
  Synthetic Polynucleotide
taatacgactcactataggggtagattctaatggtgctttttattggaccaacagaggagaggtccaatgaaaagcaccaacctggcggcagcgcaaaagatg

SEQ ID NO: 7745 - DNA, 103 bp, Artificial Sequence
  Synthetic Polynucleotide
taatacgactcactatagggttgaagtagattctaatggtgctttttattaacagaggagaaataaaatgcaccattagaacctggcggcagcgcaaaagatg

SEQ ID NO: 7746 - DNA, 103 bp, Artificial Sequence
  Synthetic Polynucleotide
taatacgactcactatagggtcggtttgaagtagattctaatggtgctttaacagaggagaaaagcaatgttagaatctaacctggcggcagcgcaaaagatg

SEQ ID NO: 7747 - DNA, 103 bp, Artificial Sequence
  Synthetic Polynucleotide
taatacgactcactataggggggaatgcggtgactcatcgacctgatctaaacagaggagatagatcatgtcgatgagtaacctggcggcagcgcaaaagatg

SEQ ID NO: 7748 - DNA, 103 bp, Artificial Sequence
  Synthetic Polynucleotide
taatacgactcactatagggatgcttcggtttgaagtagattctaatggtaacagaggagaaccattatgatctacttcaacctggcggcagcgcaaaagatg

SEQ ID NO: 7749 - DNA, 103 bp, Artificial Sequence
  Synthetic Polynucleotide
taatacgactcactatagggttgacatgcttcggtttgaagtagattctaaacagaggagatagaatatgcttcaaaccaacctggcggcagcgcaaaagatg

SEQ ID NO: 7750 - DNA, 103 bp, Artificial Sequence
  Synthetic Polynucleotide
taatacgactcactatagggacgctttgacatgcttcggtttgaagtagaaacagaggagatctactatgaaccgaagcaacctggcggcagcgcaaaagatg

SEQ ID NO: 7751 - DNA, 103 bp, Artificial Sequence
  Synthetic Polynucleotide
taatacgactcactatagggtatccacgctttgacatgcttcggtttgaaaacagaggagattcaaaatgaagcatgtcaacctggcggcagcgcaaaagatg

SEQ ID NO: 7752 - DNA, 103 bp, Artificial Sequence
  Synthetic Polynucleotide
taatacgactcactatagggctaggtatccacgctttgacatgcttcggtaacagaggagaaccgaaatgtgtcaaagcaacctggcggcagcgcaaaagatg

SEQ ID NO: 7753 - DNA, 103 bp, Artificial Sequence
  Synthetic Polynucleotide
taatacgactcactataggggtggtctaggtatccacgctttgacatgctaacagaggagaagcatgatgaagcgtggaaacctggcggcagcgcaaaagatg

SEQ ID NO: 7754 - DNA, 103 bp, Artificial Sequence
  Synthetic Polynucleotide
taatacgactcactatagggtctaggtggtctaggtatccacgctttgacaacagaggagagtcaaaatgtggatacctaacctggcggcagcgcaaaagatg

SEQ ID NO: 7755 - DNA, 103 bp, Artificial Sequence
  Synthetic Polynucleotide
taatacgactcactatagggcagagtctaggtggtctaggtatccacgctaacagaggagaagcgtgatgacctagaccaacctggcggcagcgcaaaagatg

SEQ ID NO: 7756 - DNA, 103 bp, Artificial Sequence
  Synthetic Polynucleotide
taatacgactcactatagggattggcagagtctaggtggtctaggtatccaacagaggagaggatacatggaccacctaaacctggcggcagcgcaaaagatg

SEQ ID NO: 7757 - DNA, 103 bp, Artificial Sequence
  Synthetic Polynucleotide
taatacgactcactatagggctcgtattggcagagtctaggtggtctaggaacagaggagacctagaatgcctagactcaacctggcggcagcgcaaaagatg

SEQ ID NO: 7758 - DNA, 103 bp, Artificial Sequence
  Synthetic Polynucleotide
taatacgactcactatagggccgtggggaatgcggtgactcatcgacctgaacagaggagacaggtcatggagtcaccgaacctggcggcagcgcaaaagatg

SEQ ID NO: 7759 - DNA, 103 bp, Artificial Sequence
  Synthetic Polynucleotide
taatacgactcactataggggccttctcgtattggcagagtctaggtggtaacagaggagaaccaccatgactctgccaaacctggcggcagcgcaaaagatg

SEQ ID NO: 7760 - DNA, 103 bp, Artificial Sequence
  Synthetic Polynucleotide
taatacgactcactatagggtctttgccttctcgtattggcagagtctagaacagaggagactagacatggccaatacgaacctggcggcagcgcaaaagatg

SEQ ID NO: 7761 - DNA, 103 bp, Artificial Sequence
  Synthetic Polynucleotide
taatacgactcactatagggcacgttctttgccttctcgtattggcagagaacagaggagactctgcatgtacgagaagaacctggcggcagcgcaaaagatg

SEQ ID NO: 7762 - DNA, 103 bp, Artificial Sequence
  Synthetic Polynucleotide
taatacgactcactatagggaagttcacgttctttgccttctcgtattggaacagaggagaccaataatggaaggcaaaaacctggcggcagcgcaaaagatg

SEQ ID NO: 7763 - DNA, 103 bp, Artificial Sequence
  Synthetic Polynucleotide
taatacgactcactataggggtcggaagttcacgttctttgccttctcgtaacagaggagaacgagaatgcaaagaacgaacctggcggcagcgcaaaagatg

SEQ ID NO: 7764 - DNA, 103 bp, Artificial Sequence
  Synthetic Polynucleotide
taatacgactcactataggggctgggtcggaagttcacgttctttgccttaacagaggagaaaggcaatgaacgtgaacaacctggcggcagcgcaaaagatg

SEQ ID NO: 7765 - DNA, 103 bp, Artificial Sequence
  Synthetic Polynucleotide
taatacgactcactatagggactccgctgggtcggaagttcacgttctttaacagaggagaaaagaaatggaacttccgaacctggcggcagcgcaaaagatg

SEQ ID NO: 7766 - DNA, 103 bp, Artificial Sequence
  Synthetic Polynucleotide
taatacgactcactatagggtggtaactccgctgggtcggaagttcacgtaacagaggagaacgtgaatgtccgacccaaacctggcggcagcgcaaaagatg

SEQ ID NO: 7767 - DNA, 103 bp, Artificial Sequence
  Synthetic Polynucleotide
taatacgactcactatagggagtagtggtaactccgctgggtcggaagttaacagaggagaaacttcatgcccagcggaaacctggcggcagcgcaaaagatg

SEQ ID NO: 7768 - DNA, 103 bp, Artificial Sequence
  Synthetic Polynucleotide
taatacgactcactatagggtgcctagtagtggtaactccgctgggtcggaacagaggagaccgaccatgcggagttacaacctggcggcagcgcaaaagatg

SEQ ID NO: 7769 - DNA, 103 bp, Artificial Sequence
  Synthetic Polynucleotide
taatacgactcactataggggtcgcccgtggggaatgcggtgactcatcgaacagaggagacgatgaatgaccgcattcaacctggcggcagcgcaaaagatg

SEQ ID NO: 7770 - DNA, 103 bp, Artificial Sequence
  Synthetic Polynucleotide
taatacgactcactatagggtgctttgcctagtagtggtaactccgctggaacagaggagaccagcgatgttaccactaaacctggcggcagcgcaaaagatg

SEQ ID NO: 7771 - DNA, 103 bp, Artificial Sequence
  Synthetic Polynucleotide
taatacgactcactatagggagtgatgctttgcctagtagtggtaactccaacagaggagaggagttatgactactaggaacctggcggcagcgcaaaagatg

SEQ ID NO: 7772 - DNA, 103 bp, Artificial Sequence
  Synthetic Polynucleotide
taatacgactcactatagggattgtagtgatgctttgcctagtagtggtaaacagaggagataccacatgtaggcaaagaacctggcggcagcgcaaaagatg

SEQ ID NO: 7773 - DNA, 103 bp, Artificial Sequence
  Synthetic Polynucleotide
taatacgactcactatagggttgtcattgtagtgatgctttgcctagtagaacagaggagactactaatgaaagcatcaaacctggcggcagcgcaaaagatg

SEQ ID NO: 7774 - DNA, 103 bp, Artificial Sequence
  Synthetic Polynucleotide
taatacgactcactatagggcgtatttgtcattgtagtgatgctttgcctaacagaggagaaggcaaatgatcactacaaacctggcggcagcgcaaaagatg

SEQ ID NO: 7775 - DNA, 103 bp, Artificial Sequence
  Synthetic Polynucleotide
taatacgactcactataggggcgcccgtatttgtcattgtagtgatgcttaacagaggagaaagcatatgtacaatgacaacctggcggcagcgcaaaagatg

SEQ ID NO: 7776 - DNA, 103 bp, Artificial Sequence
  Synthetic Polynucleotide
taatacgactcactatagggcaaatgcgcccgtatttgtcattgtagtgaaacagaggagatcactaatgtgacaaataaacctggcggcagcgcaaaagatg

SEQ ID NO: 7777 - DNA, 103 bp, Artificial Sequence
  Synthetic Polynucleotide
taatacgactcactatagggttgtccaaatgcgcccgtatttgtcattgtaacagaggagaacaatgatgaatacgggcaacctggcggcagcgcaaaagatg

SEQ ID NO: 7778 - DNA, 103 bp, Artificial Sequence
  Synthetic Polynucleotide
taatacgactcactataggggattgttgtccaaatgcgcccgtatttgtcaacagaggagagacaaaatggggcgcattaacctggcggcagcgcaaaagatg

SEQ ID NO: 7779 - DNA, 103 bp, Artificial Sequence
  Synthetic Polynucleotide
taatacgactcactatagggcccctgattgttgtccaaatgcgcccgtataacagaggagaatacggatgcatttggacaacctggcggcagcgcaaaagatg

SEQ ID NO: 7780 - DNA, 103 bp, Artificial Sequence
  Synthetic Polynucleotide
taatacgactcactatagggccacggtcgcccgtggggaatgcggtgactaacagaggagaagtcacatgattccccacaacctggcggcagcgcaaaagatg

SEQ ID NO: 7781 - DNA, 103 bp, Artificial Sequence
  Synthetic Polynucleotide
taatacgactcactatagggcactgcccctgattgttgtccaaatgcgccaacagaggagaggcgcaatgggacaacaaaacctggcggcagcgcaaaagatg

SEQ ID NO: 7782 - DNA, 103 bp, Artificial Sequence
  Synthetic Polynucleotide
taatacgactcactatagggacatacactgcccctgattgttgtccaaataacagaggagaatttggatgacaatcaggaacctggcggcagcgcaaaagatg

SEQ ID NO: 7783 - DNA, 103 bp, Artificial Sequence
  Synthetic Polynucleotide
taatacgactcactatagggtccccacatacactgcccctgattgttgtcaacagaggagagacaacatgcaggggcagaacctggcggcagcgcaaaagatg

SEQ ID NO: 7784 - DNA, 103 bp, Artificial Sequence
  Synthetic Polynucleotide
taatacgactcactataggggtagttccccacatacactgcccctgattgaacagaggagacaatcaatggcagtgtataacctggcggcagcgcaaaagatg

SEQ ID NO: 7785 - DNA, 103 bp, Artificial Sequence
  Synthetic Polynucleotide
taatacgactcactatagggaccctgtagttccccacatacactgcccctaacagaggagaaggggcatggtatgtgggaacctggcggcagcgcaaaagatg

SEQ ID NO: 7786 - DNA, 103 bp, Artificial Sequence
  Synthetic Polynucleotide
taatacgactcactatagggttactaccctgtagttccccacatacactgaacagaggagacagtgtatgtggggaactaacctggcggcagcgcaaaagatg

SEQ ID NO: 7787 - DNA, 103 bp, Artificial Sequence
  Synthetic Polynucleotide
taatacgactcactatagggtctatttactaccctgtagttccccacataaacagaggagatatgtgatgaactacaggaacctggcggcagcgcaaaagatg

SEQ ID NO: 7788 - DNA, 103 bp, Artificial Sequence
  Synthetic Polynucleotide
taatacgactcactatagggagatgtctatttactaccctgtagttccccaacagaggagaggggaaatgcagggtagtaacctggcggcagcgcaaaagatg

SEQ ID NO: 7789 - DNA, 103 bp, Artificial Sequence
  Synthetic Polynucleotide
taatacgactcactatagggtagctagatgtctatttactaccctgtagtaacagaggagaactacaatgtagtaaataaacctggcggcagcgcaaaagatg

SEQ ID NO: 7790 - DNA, 103 bp, Artificial Sequence
  Synthetic Polynucleotide
taatacgactcactatagggactggtagctagatgtctatttactaccctaacagaggagaagggtaatgaatagacataacctggcggcagcgcaaaagatg

SEQ ID NO: 7791 - DNA, 103 bp, Artificial Sequence
  Synthetic Polynucleotide
taatacgactcactatagggcaccgccacggtcgcccgtggggaatgcggaacagaggagaccgcatatgccacgggcgaacctggcggcagcgcaaaagatg

SEQ ID NO: 7792 - DNA, 103 bp, Artificial Sequence
  Synthetic Polynucleotide
taatacgactcactatagggtcagcactggtagctagatgtctatttactaacagaggagaagtaaaatgacatctagcaacctggcggcagcgcaaaagatg

SEQ ID NO: 7793 - DNA, 103 bp, Artificial Sequence
  Synthetic Polynucleotide
taatacgactcactataggggccagtcagcactggtagctagatgtctataacagaggagaatagacatgtagctaccaaacctggcggcagcgcaaaagatg

SEQ ID NO: 7794 - DNA, 103 bp, Artificial Sequence
  Synthetic Polynucleotide
taatacgactcactataggggttttgccagtcagcactggtagctagatgaacagaggagacatctaatgaccagtgctaacctggcggcagcgcaaaagatg

SEQ ID NO: 7795 - DNA, 103 bp, Artificial Sequence
  Synthetic Polynucleotide
taatacgactcactatagggacacagttttgccagtcagcactggtagctaacagaggagaagctacatgtgctgactgaacctggcggcagcgcaaaagatg

SEQ ID NO: 7796 - DNA, 103 bp, Artificial Sequence
  Synthetic Polynucleotide
taatacgactcactatagggcccacacacagttttgccagtcagcactggaacagaggagaccagtgatgactggcaaaaacctggcggcagcgcaaaagatg

SEQ ID NO: 7797 - DNA, 103 bp, Artificial Sequence
  Synthetic Polynucleotide
taatacgactcactatagggactttcccacacacagttttgccagtcagcaacagaggagagctgacatgcaaaactgtaacctggcggcagcgcaaaagatg

SEQ ID NO: 7798 - DNA, 103 bp, Artificial Sequence
  Synthetic Polynucleotide
taatacgactcactatagggttgtaactttcccacacacagttttgccagaacagaggagactggcaatgctgtgtgtgaacctggcggcagcgcaaaagatg

SEQ ID NO: 7799 - DNA, 103 bp, Artificial Sequence
  Synthetic Polynucleotide
taatacgactcactatagggctctgttgtaactttcccacacacagttttaacagaggagaaaaactatgtgtgggaaaaacctggcggcagcgcaaaagatg

SEQ ID NO: 7800 - DNA, 103 bp, Artificial Sequence
  Synthetic Polynucleotide
taatacgactcactataggggaggtctctgttgtaactttcccacacacaaacagaggagatgtgtgatggaaagttacaacctggcggcagcgcaaaagatg

SEQ ID NO: 7801 - DNA, 103 bp, Artificial Sequence
  Synthetic Polynucleotide
taatacgactcactatagggactaagaggtctctgttgtaactttcccacaacagaggagagtgggaatgttacaacagaacctggcggcagcgcaaaagatg

SEQ ID NO: 7802 - DNA, 103 bp, Artificial Sequence
  Synthetic Polynucleotide
taatacgactcactataggggcagccaccgccacggtcgcccgtggggaaaacagaggagattccccatgggcgaccgtaacctggcggcagcgcaaaagatg

SEQ ID NO: 7803 - DNA, 103 bp, Artificial Sequence
  Synthetic Polynucleotide
taatacgactcactatagggtgctcactaagaggtctctgttgtaactttaacagaggagaaaagttatgacagagaccaacctggcggcagcgcaaaagatg

SEQ ID NO: 7804 - DNA, 103 bp, Artificial Sequence
  Synthetic Polynucleotide
taatacgactcactatagggggtcgtgctcactaagaggtctctgttgtaaacagaggagatacaacatggacctcttaaacctggcggcagcgcaaaagatg

SEQ ID NO: 7805 - DNA, 103 bp, Artificial Sequence
  Synthetic Polynucleotide
taatacgactcactataggggttgtggtcgtgctcactaagaggtctctgaacagaggagacagagaatgcttagtgagaacctggcggcagcgcaaaagatg

SEQ ID NO: 7806 - DNA, 103 bp, Artificial Sequence
  Synthetic Polynucleotide
taatacgactcactatagggcatgtgttgtggtcgtgctcactaagaggtaacagaggagaacctctatgtgagcacgaaacctggcggcagcgcaaaagatg

SEQ ID NO: 7807 - DNA, 103 bp, Artificial Sequence
  Synthetic Polynucleotide
taatacgactcactatagggacatccatgtgttgtggtcgtgctcactaaaacagaggagattagtgatgacgaccacaaacctggcggcagcgcaaaagatg

SEQ ID NO: 7808 - DNA, 103 bp, Artificial Sequence
  Synthetic Polynucleotide
taatacgactcactatagggatatcacatccatgtgttgtggtcgtgctcaacagaggagagagcacatgcacaacacaaacctggcggcagcgcaaaagatg

SEQ ID NO: 7809 - DNA, 103 bp, Artificial Sequence
  Synthetic Polynucleotide
taatacgactcactatagggctataatatcacatccatgtgttgtggtcgaacagaggagacgaccaatgcacatggataacctggcggcagcgcaaaagatg

SEQ ID NO: 7810 - DNA, 103 bp, Artificial Sequence
  Synthetic Polynucleotide
taatacgactcactatagggtctggctataatatcacatccatgtgttgtaacagaggagaacaacaatgggatgtgataacctggcggcagcgcaaaagatg

SEQ ID NO: 7811 - DNA, 103 bp, Artificial Sequence
  Synthetic Polynucleotide
taatacgactcactatagggtgacatctggctataatatcacatccatgtaacagaggagaacatggatgtgatattataacctggcggcagcgcaaaagatg

SEQ ID NO: 7812 - DNA, 103 bp, Artificial Sequence
  Synthetic Polynucleotide
taatacgactcactatagggtgcactgacatctggctataatatcacatcaacagaggagagatgtgatgttatagccaaacctggcggcagcgcaaaagatg

SEQ ID NO: 7813 - DNA, 103 bp, Artificial Sequence
  Synthetic Polynucleotide
taatacgactcactatagggccaacgcagccaccgccacggtcgcccgtgaacagaggagacacgggatgccgtggcggaacctggcggcagcgcaaaagatg

SEQ ID NO: 7814 - DNA, 103 bp, Artificial Sequence
  Synthetic Polynucleotide
taatacgactcactatagggcgttgtgcactgacatctggctataatatcaacagaggagagatattatggccagatgtaacctggcggcagcgcaaaagatg

SEQ ID NO: 7815 - DNA, 103 bp, Artificial Sequence
  Synthetic Polynucleotide
taatacgactcactatagggactcccgttgtgcactgacatctggctataaacagaggagatatagcatgatgtcagtgaacctggcggcagcgcaaaagatg

SEQ ID NO: 7816 - DNA, 103 bp, Artificial Sequence
  Synthetic Polynucleotide
taatacgactcactatagggagtacactcccgttgtgcactgacatctggaacagaggagaccagatatgagtgcacaaaacctggcggcagcgcaaaagatg

SEQ ID NO: 7817 - DNA, 103 bp, Artificial Sequence
  Synthetic Polynucleotide
taatacgactcactatagggacaaaagtacactcccgttgtgcactgacaaacagaggagatgtcagatgacaacgggaaacctggcggcagcgcaaaagatg

SEQ ID NO: 7818 - DNA, 103 bp, Artificial Sequence
  Synthetic Polynucleotide
taatacgactcactataggggacgcacaaaagtacactcccgttgtgcacaacagaggagagtgcacatggggagtgtaaacctggcggcagcgcaaaagatg

SEQ ID NO: 7819 - DNA, 103 bp, Artificial Sequence
  Synthetic Polynucleotide
taatacgactcactatagggttttggacgcacaaaagtacactcccgttgaacagaggagacaacggatgtgtacttttaacctggcggcagcgcaaaagatg

SEQ ID NO: 7820 - DNA, 103 bp, Artificial Sequence
  Synthetic Polynucleotide
taatacgactcactatagggcttgtttttggacgcacaaaagtacactccaacagaggagaggagtgatgttttgtgcgaacctggcggcagcgcaaaagatg

SEQ ID NO: 7821 - DNA, 103 bp, Artificial Sequence
  Synthetic Polynucleotide
taatacgactcactatagggtagtgcttgtttttggacgcacaaaagtacaacagaggagagtacttatgtgcgtccaaaacctggcggcagcgcaaaagatg

SEQ ID NO: 7822 - DNA, 103 bp, Artificial Sequence
  Synthetic Polynucleotide
taatacgactcactatagggttgggtagtgcttgtttttggacgcacaaaaacagaggagatttgtgatgccaaaaacaaacctggcggcagcgcaaaagatg

SEQ ID NO: 7823 - DNA, 103 bp, Artificial Sequence
  Synthetic Polynucleotide
taatacgactcactatagggcgaaattgggtagtgcttgtttttggacgcaacagaggagagcgtccatgaacaagcacaacctggcggcagcgcaaaagatg

SEQ ID NO: 7824 - DNA, 103 bp, Artificial Sequence
  Synthetic Polynucleotide
taatacgactcactatagggtaccagagtgctagcgcccaatgggccctgaacagaggagacagggcatgttgggcgctaacctggcggcagcgcaaaagatg

SEQ ID NO: 7825 - DNA, 103 bp, Artificial Sequence
  Synthetic Polynucleotide
taatacgactcactatagggggccgccaacgcagccaccgccacggtcgcaacagaggagagcgaccatggcggtggctaacctggcggcagcgcaaaagatg

SEQ ID NO: 7826 - DNA, 103 bp, Artificial Sequence
  Synthetic Polynucleotide
taatacgactcactatagggtcaaacgaaattgggtagtgcttgtttttgaacagaggagacaaaaaatggcactacccaacctggcggcagcgcaaaagatg

SEQ ID NO: 7827 - DNA, 103 bp, Artificial Sequence
  Synthetic Polynucleotide
taatacgactcactataggggtccttcaaacgaaattgggtagtgcttgtaacagaggagaacaagcatgacccaatttaacctggcggcagcgcaaaagatg

SEQ ID NO: 7828 - DNA, 103 bp, Artificial Sequence
  Synthetic Polynucleotide
taatacgactcactatagggacctggtccttcaaacgaaattgggtagtgaacagaggagacactacatgatttcgtttaacctggcggcagcgcaaaagatg

SEQ ID NO: 7829 - DNA, 103 bp, Artificial Sequence
  Synthetic Polynucleotide
taatacgactcactatagggactagacctggtccttcaaacgaaattgggaacagaggagacccaatatggtttgaaggaacctggcggcagcgcaaaagatg

SEQ ID NO: 7830 - DNA, 103 bp, Artificial Sequence
  Synthetic Polynucleotide
taatacgactcactatagggcctctactagacctggtccttcaaacgaaaaacagaggagatttcgtatgaaggaccagaacctggcggcagcgcaaaagatg

SEQ ID NO: 7831 - DNA, 103 bp, Artificial Sequence
  Synthetic Polynucleotide
taatacgactcactatagggttggacctctactagacctggtccttcaaaaacagaggagatttgaaatgccaggtctaaacctggcggcagcgcaaaagatg

SEQ ID NO: 7832 - DNA, 103 bp, Artificial Sequence
  Synthetic Polynucleotide
taatacgactcactatagggctctcttggacctctactagacctggtcctaacagaggagaaggaccatgtctagtagaaacctggcggcagcgcaaaagatg

SEQ ID NO: 7833 - DNA, 103 bp, Artificial Sequence
  Synthetic Polynucleotide
taatacgactcactatagggattcactctcttggacctctactagacctgaacagaggagacaggtcatgtagaggtccaacctggcggcagcgcaaaagatg

SEQ ID NO: 7834 - DNA, 103 bp, Artificial Sequence
  Synthetic Polynucleotide
taatacgactcactataggggtagtattcactctcttggacctctactagaacagaggagactagtaatggtccaagagaacctggcggcagcgcaaaagatg

SEQ ID NO: 7835 - DNA, 103 bp, Artificial Sequence
  Synthetic Polynucleotide
taatacgactcactatagggctggggtagtattcactctcttggacctctaacagaggagaagaggtatgagagagtgaaacctggcggcagcgcaaaagatg

SEQ ID NO: 7836 - DNA, 103 bp, Artificial Sequence
  Synthetic Polynucleotide
taatacgactcactataggggggcaggccgccaacgcagccaccgccacgaacagaggagacgtggcatgggctgcgttaacctggcggcagcgcaaaagatg

SEQ ID NO: 7837 - DNA, 103 bp, Artificial Sequence
  Synthetic Polynucleotide
taatacgactcactatagggatctcctggggtagtattcactctcttggaaacagaggagatccaagatggtgaatactaacctggcggcagcgcaaaagatg

SEQ ID NO: 7838 - DNA, 103 bp, Artificial Sequence
  Synthetic Polynucleotide
taatacgactcactatagggttggtatctcctggggtagtattcactctcaacagaggagagagagtatgtactaccccaacctggcggcagcgcaaaagatg

SEQ ID NO: 7839 - DNA, 103 bp, Artificial Sequence
  Synthetic Polynucleotide
taatacgactcactatagggtgggattggtatctcctggggtagtattcaaacagaggagatgaataatgccccaggagaacctggcggcagcgcaaaagatg

SEQ ID NO: 7840 - DNA, 103 bp, Artificial Sequence
  Synthetic Polynucleotide
taatacgactcactataggggcacatgggattggtatctcctggggtagtaacagaggagaactaccatgggagataccaacctggcggcagcgcaaaagatg

SEQ ID NO: 7841 - DNA, 103 bp, Artificial Sequence
  Synthetic Polynucleotide
taatacgactcactatagggtaaaagcacatgggattggtatctcctgggaacagaggagacccaggatgtaccaatccaacctggcggcagcgcaaaagatg

SEQ ID NO: 7842 - DNA, 103 bp, Artificial Sequence
  Synthetic Polynucleotide
taatacgactcactataggggctgctaaaagcacatgggattggtatctcaacagaggagagagataatgatcccatgtaacctggcggcagcgcaaaagatg

SEQ ID NO: 7843 - DNA, 103 bp, Artificial Sequence
  Synthetic Polynucleotide
taatacgactcactatagggatccagctgctaaaagcacatgggattggtaacagaggagaaccaatatgatgtgctttaacctggcggcagcgcaaaagatg

SEQ ID NO: 7844 - DNA, 103 bp, Artificial Sequence
  Synthetic Polynucleotide
taatacgactcactatagggggaaaatccagctgctaaaagcacatgggaaacagaggagatcccatatgcttttagcaaacctggcggcagcgcaaaagatg

SEQ ID NO: 7845 - DNA, 103 bp, Artificial Sequence
  Synthetic Polynucleotide
taatacgactcactatagggggttcggaaaatccagctgctaaaagcacaaacagaggagatgtgctatgagcagctggaacctggcggcagcgcaaaagatg

SEQ ID NO: 7846 - DNA, 103 bp, Artificial Sequence
  Synthetic Polynucleotide
taatacgactcactatagggcacctggttcggaaaatccagctgctaaaaaacagaggagattttagatgctggattttaacctggcggcagcgcaaaagatg

SEQ ID NO: 7847 - DNA, 103 bp, Artificial Sequence
  Synthetic Polynucleotide
taatacgactcactatagggcccatgggcaggccgccaacgcagccaccgaacagaggagacggtggatgcgttggcggaacctggcggcagcgcaaaagatg

SEQ ID NO: 7848 - DNA, 103 bp, Artificial Sequence
  Synthetic Polynucleotide
taatacgactcactatagggacagtcacctggttcggaaaatccagctgcaacagaggagagcagctatgttttccgaaaacctggcggcagcgcaaaagatg

SEQ ID NO: 7849 - DNA, 103 bp, Artificial Sequence
  Synthetic Polynucleotide
taatacgactcactatagggccgccacagtcacctggttcggaaaatccaaacagaggagatggattatgcgaaccaggaacctggcggcagcgcaaaagatg

SEQ ID NO: 7850 - DNA, 103 bp, Artificial Sequence
  Synthetic Polynucleotide
taatacgactcactatagggggataccgccacagtcacctggttcggaaaaacagaggagatttccgatgcaggtgactaacctggcggcagcgcaaaagatg

SEQ ID NO: 7851 - DNA, 103 bp, Artificial Sequence
  Synthetic Polynucleotide
taatacgactcactatagggccttaggataccgccacagtcacctggttcaacagaggagagaaccaatggactgtggcaacctggcggcagcgcaaaagatg

SEQ ID NO: 7852 - DNA, 103 bp, Artificial Sequence
  Synthetic Polynucleotide
taatacgactcactatagggtcacaccttaggataccgccacagtcacctaacagaggagaaggtgaatgtggcggtataacctggcggcagcgcaaaagatg

SEQ ID NO: 7853 - DNA, 103 bp, Artificial Sequence
  Synthetic Polynucleotide
taatacgactcactatagggcatgctcacaccttaggataccgccacagtaacagaggagaactgtgatggtatcctaaaacctggcggcagcgcaaaagatg

SEQ ID NO: 7854 - DNA, 103 bp, Artificial Sequence
  Synthetic Polynucleotide
taatacgactcactataggggacaccatgctcacaccttaggataccgccaacagaggagaggcggtatgctaaggtgtaacctggcggcagcgcaaaagatg

SEQ ID NO: 7855 - DNA, 103 bp, Artificial Sequence
  Synthetic Polynucleotide
taatacgactcactatagggccaatgacaccatgctcacaccttaggataaacagaggagatatcctatggtgtgagcaaacctggcggcagcgcaaaagatg

SEQ ID NO: 7856 - DNA, 103 bp, Artificial Sequence
  Synthetic Polynucleotide
taatacgactcactatagggcaatgccaatgacaccatgctcacaccttaaacagaggagataaggtatgagcatggtgaacctggcggcagcgcaaaagatg

SEQ ID NO: 7857 - DNA, 103 bp, Artificial Sequence
  Synthetic Polynucleotide
taatacgactcactatagggggtcacaatgccaatgacaccatgctcacaaacagaggagatgtgagatgggtgtcattaacctggcggcagcgcaaaagatg

SEQ ID NO: 7858 - DNA, 103 bp, Artificial Sequence
  Synthetic Polynucleotide
taatacgactcactataggggtttccccatgggcaggccgccaacgcagcaacagaggagagctgcgatggcggcctgcaacctggcggcagcgcaaaagatg

SEQ ID NO: 7859 - DNA, 103 bp, Artificial Sequence
  Synthetic Polynucleotide
taatacgactcactatagggcccatggtcacaatgccaatgacaccatgcaacagaggagagcatggatgcattggcataacctggcggcagcgcaaaagatg

SEQ ID NO: 7860 - DNA, 103 bp, Artificial Sequence
  Synthetic Polynucleotide
taatacgactcactatagggcaccccccatggtcacaatgccaatgacacaacagaggagagtgtcaatggcattgtgaaacctggcggcagcgcaaaagatg

SEQ ID NO: 7861 - DNA, 103 bp, Artificial Sequence
  Synthetic Polynucleotide
taatacgactcactataggggccttcaccccccatggtcacaatgccaataacagaggagaattggcatggtgaccatgaacctggcggcagcgcaaaagatg

SEQ ID NO: 7862 - DNA, 103 bp, Artificial Sequence
  Synthetic Polynucleotide
taatacgactcactatagggaccacgccttcaccccccatggtcacaatgaacagaggagacattgtatgcatggggggaacctggcggcagcgcaaaagatg

SEQ ID NO: 7863 - DNA, 103 bp, Artificial Sequence
  Synthetic Polynucleotide
taatacgactcactatagggagccgaccacgccttcaccccccatggtcaaacagaggagatgaccaatgggggtgaagaacctggcggcagcgcaaaagatg

SEQ ID NO: 7864 - DNA, 103 bp, Artificial Sequence
  Synthetic Polynucleotide
taatacgactcactatagggtgcaaagccgaccacgccttcaccccccataacagaggagaatggggatggaaggcgtgaacctggcggcagcgcaaaagatg

SEQ ID NO: 7865 - DNA, 103 bp, Artificial Sequence
  Synthetic Polynucleotide
taatacgactcactatagggatgtctgcaaagccgaccacgccttcacccaacagaggagagggtgaatgcgtggtcggaacctggcggcagcgcaaaagatg

SEQ ID NO: 7866 - DNA, 103 bp, Artificial Sequence
  Synthetic Polynucleotide
taatacgactcactatagggcacggatgtctgcaaagccgaccacgccttaacagaggagaaaggcgatgtcggctttgaacctggcggcagcgcaaaagatg

SEQ ID NO: 7867 - DNA, 103 bp, Artificial Sequence
  Synthetic Polynucleotide
taatacgactcactataggggagatcacggatgtctgcaaagccgaccacaacagaggagagtggtcatgtttgcagacaacctggcggcagcgcaaaagatg

SEQ ID NO: 7868 - DNA, 103 bp, Artificial Sequence
  Synthetic Polynucleotide
taatacgactcactatagggcacaggagatcacggatgtctgcaaagccgaacagaggagacggcttatgagacatccgaacctggcggcagcgcaaaagatg

SEQ ID NO: 7869 - DNA, 103 bp, Artificial Sequence
  Synthetic Polynucleotide
taatacgactcactatagggcatgggtttccccatgggcaggccgccaacaacagaggagagttggcatgctgcccatgaacctggcggcagcgcaaaagatg

SEQ ID NO: 7870 - DNA, 103 bp, Artificial Sequence
  Synthetic Polynucleotide
taatacgactcactatagggccagccacaggagatcacggatgtctgcaaaacagaggagattgcagatgtccgtgatcaacctggcggcagcgcaaaagatg

SEQ ID NO: 7871 - DNA, 103 bp, Artificial Sequence
  Synthetic Polynucleotide
taatacgactcactatagggatcttccagccacaggagatcacggatgtcaacagaggagagacatcatggatctcctgaacctggcggcagcgcaaaagatg

SEQ ID NO: 7872 - DNA, 103 bp, Artificial Sequence
  Synthetic Polynucleotide
taatacgactcactataggggcatcatcttccagccacaggagatcacggaacagaggagaccgtgaatgcctgtggctaacctggcggcagcgcaaaagatg

SEQ ID NO: 7873 - DNA, 103 bp, Artificial Sequence
  Synthetic Polynucleotide
taatacgactcactatagggccattgcatcatcttccagccacaggagataacagaggagaatctccatgggctggaagaacctggcggcagcgcaaaagatg

SEQ ID NO: 7874 - DNA, 103 bp, Artificial Sequence
  Synthetic Polynucleotide
taatacgactcactatagggctgttccattgcatcatcttccagccacagaacagaggagactgtggatggaagatgataacctggcggcagcgcaaaagatg

SEQ ID NO: 7875 - DNA, 103 bp, Artificial Sequence
  Synthetic Polynucleotide
taatacgactcactatagggactccctgttccattgcatcatcttccagcaacagaggagagctggaatgtgatgcaataacctggcggcagcgcaaaagatg

SEQ ID NO: 7876 - DNA, 103 bp, Artificial Sequence
  Synthetic Polynucleotide
taatacgactcactatagggccttcactccctgttccattgcatcatcttaacagaggagaaagatgatgcaatggaacaacctggcggcagcgcaaaagatg

SEQ ID NO: 7877 - DNA, 103 bp, Artificial Sequence
  Synthetic Polynucleotide
taatacgactcactatagggatagtccttcactccctgttccattgcatcaacagaggagagatgcaatggaacagggaaacctggcggcagcgcaaaagatg

SEQ ID NO: 7878 - DNA, 103 bp, Artificial Sequence
  Synthetic Polynucleotide
taatacgactcactatagggtccacatagtccttcactccctgttccattaacagaggagaaatggaatggggagtgaaaacctggcggcagcgcaaaagatg

SEQ ID NO: 7879 - DNA, 103 bp, Artificial Sequence
  Synthetic Polynucleotide
taatacgactcactataggggctgttccacatagtccttcactccctgttaacagaggagaaacaggatgtgaaggactaacctggcggcagcgcaaaagatg

SEQ ID NO: 7880 - DNA, 103 bp, Artificial Sequence
  Synthetic Polynucleotide
taatacgactcactatagggcgtcccatgggtttccccatgggcaggccgaacagaggagacggcctatgcatggggaaaacctggcggcagcgcaaaagatg

SEQ ID NO: 7881 - DNA, 103 bp, Artificial Sequence
  Synthetic Polynucleotide
taatacgactcactatagggtccaagctgttccacatagtccttcactccaacagaggagaggagtgatggactatgtgaacctggcggcagcgcaaaagatg

SEQ ID NO: 7882 - DNA, 103 bp, Artificial Sequence
  Synthetic Polynucleotide
taatacgactcactataggggcatttccaagctgttccacatagtccttcaacagaggagagaaggaatgtgtggaacaaacctggcggcagcgcaaaagatg

SEQ ID NO: 7883 - DNA, 103 bp, Artificial Sequence
  Synthetic Polynucleotide
taatacgactcactatagggcgagtgcatttccaagctgttccacatagtaacagaggagaactatgatgaacagcttgaacctggcggcagcgcaaaagatg

SEQ ID NO: 7884 - DNA, 103 bp, Artificial Sequence
  Synthetic Polynucleotide
taatacgactcactatagggggagccgagtgcatttccaagctgttccacaacagaggagagtggaaatgcttggaaataacctggcggcagcgcaaaagatg

SEQ ID NO: 7885 - DNA, 103 bp, Artificial Sequence
  Synthetic Polynucleotide
taatacgactcactatagggaagccggagccgagtgcatttccaagctgtaacagaggagaacagctatgaaatgcactaacctggcggcagcgcaaaagatg

SEQ ID NO: 7886 - DNA, 103 bp, Artificial Sequence
  Synthetic Polynucleotide
taatacgactcactatagggtagtaaagccggagccgagtgcatttccaaaacagaggagattggaaatgcactcggctaacctggcggcagcgcaaaagatg

SEQ ID NO: 7887 - DNA, 103 bp, Artificial Sequence
  Synthetic Polynucleotide
taatacgactcactatagggttggttagtaaagccggagccgagtgcattaacagaggagaaatgcaatgggctccggcaacctggcggcagcgcaaaagatg

SEQ ID NO: 7888 - DNA, 103 bp, Artificial Sequence
  Synthetic Polynucleotide
taatacgactcactatagggcatatttggttagtaaagccggagccgagtaacagaggagaactcggatgcggctttacaacctggcggcagcgcaaaagatg

SEQ ID NO: 7889 - DNA, 103 bp, Artificial Sequence
  Synthetic Polynucleotide
taatacgactcactataggggctcacatatttggttagtaaagccggagcaacagaggagagctccgatgttactaaccaacctggcggcagcgcaaaagatg

SEQ ID NO: 7890 - DNA, 103 bp, Artificial Sequence
  Synthetic Polynucleotide
taatacgactcactataggggacttgctcacatatttggttagtaaagccaacagaggagaggctttatgaaccaaataaacctggcggcagcgcaaaagatg

SEQ ID NO: 7891 - DNA, 103 bp, Artificial Sequence
  Synthetic Polynucleotide
taatacgactcactatagggtagagcgtcccatgggtttccccatgggcaaacagaggagatgcccaatgggaaacccaaacctggcggcagcgcaaaagatg

SEQ ID NO: 7892 - DNA, 103 bp, Artificial Sequence
  Synthetic Polynucleotide
taatacgactcactatagggaggttgacttgctcacatatttggttagtaaacagaggagatactaaatgaatatgtgaaacctggcggcagcgcaaaagatg

SEQ ID NO: 7893 - DNA, 103 bp, Artificial Sequence
  Synthetic Polynucleotide
taatacgactcactatagggtcaggaggttgacttgctcacatatttggtaacagaggagaaccaaaatggtgagcaagaacctggcggcagcgcaaaagatg

SEQ ID NO: 7894 - DNA, 103 bp, Artificial Sequence
  Synthetic Polynucleotide
taatacgactcactatagggttctttcaggaggttgacttgctcacatataacagaggagaatatgtatgcaagtcaacaacctggcggcagcgcaaaagatg

SEQ ID NO: 7895 - DNA, 103 bp, Artificial Sequence
  Synthetic Polynucleotide
taatacgactcactatagggagtgattctttcaggaggttgacttgctcaaacagaggagatgagcaatgcaacctcctaacctggcggcagcgcaaaagatg

SEQ ID NO: 7896 - DNA, 103 bp, Artificial Sequence
  Synthetic Polynucleotide
taatacgactcactatagggccactagtgattctttcaggaggttgacttaacagaggagaaagtcaatgtcctgaaagaacctggcggcagcgcaaaagatg

SEQ ID NO: 7897 - DNA, 103 bp, Artificial Sequence
  Synthetic Polynucleotide
taatacgactcactatagggttgacccactagtgattctttcaggaggttaacagaggagaaacctcatgaaagaatcaaacctggcggcagcgcaaaagatg

SEQ ID NO: 7898 - DNA, 103 bp, Artificial Sequence
  Synthetic Polynucleotide
taatacgactcactataggggagtcttgacccactagtgattctttcaggaacagaggagacctgaaatgatcactagtaacctggcggcagcgcaaaagatg

SEQ ID NO: 7899 - DNA, 103 bp, Artificial Sequence
  Synthetic Polynucleotide
taatacgactcactatagggagatggagtcttgacccactagtgattcttaacagaggagaaagaatatgtagtgggtcaacctggcggcagcgcaaaagatg

SEQ ID NO: 7900 - DNA, 103 bp, Artificial Sequence
  Synthetic Polynucleotide
taatacgactcactatagggctctaagatggagtcttgacccactagtgaaacagaggagatcactaatgggtcaagacaacctggcggcagcgcaaaagatg

SEQ ID NO: 7901 - DNA, 103 bp, Artificial Sequence
  Synthetic Polynucleotide
taatacgactcactataggggatttctctaagatggagtcttgacccactaacagaggagaagtgggatgagactccataacctggcggcagcgcaaaagatg

SEQ ID NO: 7902 - DNA, 103 bp, Artificial Sequence
  Synthetic Polynucleotide
taatacgactcactatagggtgtattagagcgtcccatgggtttccccataacagaggagaatggggatgcccatgggaaacctggcggcagcgcaaaagatg

SEQ ID NO: 7903 - DNA, 103 bp, Artificial Sequence
  Synthetic Polynucleotide
taatacgactcactatagggttagagatttctctaagatggagtcttgacaacagaggagagtcaagatgccatcttagaacctggcggcagcgcaaaagatg

SEQ ID NO: 7904 - DNA, 103 bp, Artificial Sequence
  Synthetic Polynucleotide
taatacgactcactatagggggcttttagagatttctctaagatggagtcaacagaggagagactccatgttagagaaaaacctggcggcagcgcaaaagatg

SEQ ID NO: 7905 - DNA, 103 bp, Artificial Sequence
  Synthetic Polynucleotide
taatacgactcactatagggactaaggcttttagagatttctctaagatgaacagaggagacatcttatggaaatctctaacctggcggcagcgcaaaagatg

SEQ ID NO: 7906 - DNA, 103 bp, Artificial Sequence
  Synthetic Polynucleotide
taatacgactcactatagggtcttaactaaggcttttagagatttctctaaacagaggagatagagaatgctctaaaagaacctggcggcagcgcaaaagatg

SEQ ID NO: 7907 - DNA, 103 bp, Artificial Sequence
  Synthetic Polynucleotide
taatacgactcactatagggtattatcttaactaaggcttttagagatttaacagaggagaaaatctatgaaagccttaaacctggcggcagcgcaaaagatg

SEQ ID NO: 7908 - DNA, 103 bp, Artificial Sequence
  Synthetic Polynucleotide
taatacgactcactataggggctgatattatcttaactaaggcttttagaaacagaggagatctaaaatgcttagttaaaacctggcggcagcgcaaaagatg

SEQ ID NO: 7909 - DNA, 103 bp, Artificial Sequence
  Synthetic Polynucleotide
taatacgactcactatagggctaaggctgatattatcttaactaaggcttaacagaggagaaagcctatgttaagataaaacctggcggcagcgcaaaagatg

SEQ ID NO: 7910 - DNA, 103 bp, Artificial Sequence
  Synthetic Polynucleotide
taatacgactcactatagggaattactaaggctgatattatcttaactaaaacagaggagattagttatgataatatcaaacctggcggcagcgcaaaagatg

SEQ ID NO: 7911 - DNA, 103 bp, Artificial Sequence
  Synthetic Polynucleotide
taatacgactcactatagggaccacaattactaaggctgatattatcttaaacagaggagataagatatgatcagccttaacctggcggcagcgcaaaagatg

SEQ ID NO: 7912 - DNA, 103 bp, Artificial Sequence
  Synthetic Polynucleotide
taatacgactcactatagggtcctcaccacaattactaaggctgatattaaacagaggagataatatatgccttagtaaaacctggcggcagcgcaaaagatg

SEQ ID NO: 7913 - DNA, 103 bp, Artificial Sequence
  Synthetic Polynucleotide
taatacgactcactatagggatgtctgtattagagcgtcccatgggtttcaacagaggagagaaaccatggggacgctcaacctggcggcagcgcaaaagatg

SEQ ID NO: 7914 - DNA, 103 bp, Artificial Sequence
  Synthetic Polynucleotide
taatacgactcactataggggtggttcctcaccacaattactaaggctgaaacagaggagatcagccatggtaattgtgaacctggcggcagcgcaaaagatg

SEQ ID NO: 7915 - DNA, 103 bp, Artificial Sequence
  Synthetic Polynucleotide
taatacgactcactatagggtcatcgtggttcctcaccacaattactaagaacagaggagacttagtatgtgtggtgagaacctggcggcagcgcaaaagatg

SEQ ID NO: 7916 - DNA, 103 bp, Artificial Sequence
  Synthetic Polynucleotide
taatacgactcactatagggtcaggtcatcgtggttcctcaccacaattaaacagaggagataattgatgtgaggaaccaacctggcggcagcgcaaaagatg

SEQ ID NO: 7917 - DNA, 103 bp, Artificial Sequence
  Synthetic Polynucleotide
taatacgactcactatagggagtgatcaggtcatcgtggttcctcaccacaacagaggagagtggtgatgaaccacgataacctggcggcagcgcaaaagatg

SEQ ID NO: 7918 - DNA, 103 bp, Artificial Sequence
  Synthetic Polynucleotide
taatacgactcactataggggtcacagtgatcaggtcatcgtggttcctcaacagaggagagaggaaatgcgatgacctaacctggcggcagcgcaaaagatg

SEQ ID NO: 7919 - DNA, 103 bp, Artificial Sequence
  Synthetic Polynucleotide
taatacgactcactatagggtggcagtcacagtgatcaggtcatcgtggtaacagaggagaaccacgatgacctgatcaaacctggcggcagcgcaaaagatg

SEQ ID NO: 7920 - DNA, 103 bp, Artificial Sequence
  Synthetic Polynucleotide
taatacgactcactatagggtagtgtggcagtcacagtgatcaggtcatcaacagaggagagatgacatgatcactgtgaacctggcggcagcgcaaaagatg

SEQ ID NO: 7921 - DNA, 103 bp, Artificial Sequence
  Synthetic Polynucleotide
taatacgactcactatagggagggctagtgtggcagtcacagtgatcaggaacagaggagacctgatatgtgtgactgcaacctggcggcagcgcaaaagatg

SEQ ID NO: 7922 - DNA, 103 bp, Artificial Sequence
  Synthetic Polynucleotide
taatacgactcactatagggcgataagggctagtgtggcagtcacagtgaaacagaggagatcactgatgctgccacacaacctggcggcagcgcaaaagatg

SEQ ID NO: 7923 - DNA, 103 bp, Artificial Sequence
  Synthetic Polynucleotide
taatacgactcactatagggacaaccgataagggctagtgtggcagtcacaacagaggagagtgactatgacactagccaacctggcggcagcgcaaaagatg

SEQ ID NO: 7924 - DNA, 103 bp, Artificial Sequence
  Synthetic Polynucleotide
taatacgactcactataggggcaccatgtctgtattagagcgtcccatggaacagaggagaccatggatggctctaataaacctggcggcagcgcaaaagatg

SEQ ID NO: 7925 - DNA, 103 bp, Artificial Sequence
  Synthetic Polynucleotide
taatacgactcactataggggaggtacaaccgataagggctagtgtggcaaacagaggagatgccacatgagcccttataacctggcggcagcgcaaaagatg

SEQ ID NO: 7926 - DNA, 103 bp, Artificial Sequence
  Synthetic Polynucleotide
taatacgactcactataggggggacgaggtacaaccgataagggctagtgaacagaggagacactagatgttatcggttaacctggcggcagcgcaaaagatg

SEQ ID NO: 7927 - DNA, 103 bp, Artificial Sequence
  Synthetic Polynucleotide
taatacgactcactatagggccacggggacgaggtacaaccgataagggcaacagaggagagcccttatgggttgtaccaacctggcggcagcgcaaaagatg

SEQ ID NO: 7928 - DNA, 103 bp, Artificial Sequence
  Synthetic Polynucleotide
taatacgactcactatagggcaccgccacggggacgaggtacaaccgataaacagaggagatatcggatgtacctcgtcaacctggcggcagcgcaaaagatg

SEQ ID NO: 7929 - DNA, 103 bp, Artificial Sequence
  Synthetic Polynucleotide
taatacgactcactatagggtgagccaccgccacggggacgaggtacaacaacagaggagagttgtaatgcgtccccgtaacctggcggcagcgcaaaagatg

SEQ ID NO: 7930 - DNA, 103 bp, Artificial Sequence
  Synthetic Polynucleotide
taatacgactcactatagggctgtttgagccaccgccacggggacgaggtaacagaggagaacctcgatgccgtggcggaacctggcggcagcgcaaaagatg

SEQ ID NO: 7931 - DNA, 103 bp, Artificial Sequence
  Synthetic Polynucleotide
taatacgactcactatagggaccttctgtttgagccaccgccacggggacaacagaggagagtccccatggcggtggctaacctggcggcagcgcaaaagatg

SEQ ID NO: 7932 - DNA, 103 bp, Artificial Sequence
  Synthetic Polynucleotide
taatacgactcactataggggtgacaccttctgtttgagccaccgccacgaacagaggagacgtggcatgggctcaaacaacctggcggcagcgcaaaagatg

SEQ ID NO: 7933 - DNA, 103 bp, Artificial Sequence
  Synthetic Polynucleotide
taatacgactcactatagggatattgtgacaccttctgtttgagccaccgaacagaggagacggtggatgaaacagaagaacctggcggcagcgcaaaagatg

SEQ ID NO: 7934 - DNA, 103 bp, Artificial Sequence
  Synthetic Polynucleotide
taatacgactcactatagggccgtaatattgtgacaccttctgtttgagcaacagaggagagctcaaatggaaggtgtcaacctggcggcagcgcaaaagatg

SEQ ID NO: 7935 - DNA, 103 bp, Artificial Sequence
  Synthetic Polynucleotide
taatacgactcactatagggcgtgataccagagtgctagcgcccaatgggaacagaggagacccattatgcgctagcacaacctggcggcagcgcaaaagatg

SEQ ID NO: 7936 - DNA, 103 bp, Artificial Sequence
  Synthetic Polynucleotide
taatacgactcactatagggtcttcgcaccatgtctgtattagagcgtccaacagaggagaggacgcatgaatacagacaacctggcggcagcgcaaaagatg

SEQ ID NO: 7937 - DNA, 103 bp, Artificial Sequence
  Synthetic Polynucleotide
taatacgactcactatagggggattccgtaatattgtgacaccttctgttaacagaggagaaacagaatgtgtcacaataacctggcggcagcgcaaaagatg

SEQ ID NO: 7938 - DNA, 103 bp, Artificial Sequence
  Synthetic Polynucleotide
taatacgactcactatagggcatagggattccgtaatattgtgacaccttaacagaggagaaaggtgatgcaatattacaacctggcggcagcgcaaaagatg

SEQ ID NO: 7939 - DNA, 103 bp, Artificial Sequence
  Synthetic Polynucleotide
taatacgactcactatagggtcagccatagggattccgtaatattgtgacaacagaggagagtcacaatgttacggaataacctggcggcagcgcaaaagatg

SEQ ID NO: 7940 - DNA, 103 bp, Artificial Sequence
  Synthetic Polynucleotide
taatacgactcactatagggggcgttcagccatagggattccgtaatattaacagaggagaaatattatggaatccctaaacctggcggcagcgcaaaagatg

SEQ ID NO: 7941 - DNA, 103 bp, Artificial Sequence
  Synthetic Polynucleotide
taatacgactcactataggggttttggcgttcagccatagggattccgtaaacagaggagatacggaatgcctatggctaacctggcggcagcgcaaaagatg

SEQ ID NO: 7942 - DNA, 103 bp, Artificial Sequence
  Synthetic Polynucleotide
taatacgactcactatagggctattgttttggcgttcagccatagggattaacagaggagaaatcccatgggctgaacgaacctggcggcagcgcaaaagatg

SEQ ID NO: 7943 - DNA, 103 bp, Artificial Sequence
  Synthetic Polynucleotide
taatacgactcactataggggccagctattgttttggcgttcagccatagaacagaggagactatggatgaacgccaaaaacctggcggcagcgcaaaagatg

SEQ ID NO: 7944 - DNA, 103 bp, Artificial Sequence
  Synthetic Polynucleotide
taatacgactcactatagggcttaagccagctattgttttggcgttcagcaacagaggagagctgaaatgcaaaacaataacctggcggcagcgcaaaagatg

SEQ ID NO: 7945 - DNA, 103 bp, Artificial Sequence
  Synthetic Polynucleotide
taatacgactcactatagggaatttcttaagccagctattgttttggcgtaacagaggagaacgccaatgcaatagctgaacctggcggcagcgcaaaagatg

SEQ ID NO: 7946 - DNA, 103 bp, Artificial Sequence
  Synthetic Polynucleotide
taatacgactcactatagggcagtaaatttcttaagccagctattgttttaacagaggagaaaaacaatggctggcttaaacctggcggcagcgcaaaagatg

SEQ ID NO: 7947 - DNA, 103 bp, Artificial Sequence
  Synthetic Polynucleotide
taatacgactcactatagggtagactcttcgcaccatgtctgtattagagaacagaggagactctaaatgagacatggtaacctggcggcagcgcaaaagatg

SEQ ID NO: 7948 - DNA, 103 bp, Artificial Sequence
  Synthetic Polynucleotide
taatacgactcactatagggcatttcagtaaatttcttaagccagctattaacagaggagaaatagcatgcttaagaaaaacctggcggcagcgcaaaagatg

SEQ ID NO: 7949 - DNA, 103 bp, Artificial Sequence
  Synthetic Polynucleotide
taatacgactcactatagggttcgtcatttcagtaaatttcttaagccagaacagaggagactggctatggaaatttacaacctggcggcagcgcaaaagatg

SEQ ID NO: 7950 - DNA, 103 bp, Artificial Sequence
  Synthetic Polynucleotide
taatacgactcactatagggaagcattcgtcatttcagtaaatttcttaaaacagaggagattaagaatgttactgaaaaacctggcggcagcgcaaaagatg

SEQ ID NO: 7951 - DNA, 103 bp, Artificial Sequence
  Synthetic Polynucleotide
taatacgactcactatagggcttgcaagcattcgtcatttcagtaaatttaacagaggagaaaatttatggaaatgacgaacctggcggcagcgcaaaagatg

SEQ ID NO: 7952 - DNA, 103 bp, Artificial Sequence
  Synthetic Polynucleotide
taatacgactcactatagggatacccttgcaagcattcgtcatttcagtaaacagaggagatactgaatggacgaatgcaacctggcggcagcgcaaaagatg

SEQ ID NO: 7953 - DNA, 103 bp, Artificial Sequence
  Synthetic Polynucleotide
taatacgactcactatagggattccatacccttgcaagcattcgtcatttaacagaggagaaaatgaatgatgcttgcaaacctggcggcagcgcaaaagatg

SEQ ID NO: 7954 - DNA, 103 bp, Artificial Sequence
  Synthetic Polynucleotide
taatacgactcactatagggtatccattccatacccttgcaagcattcgtaacagaggagaacgaatatgtgcaagggtaacctggcggcagcgcaaaagatg

SEQ ID NO: 7955 - DNA, 103 bp, Artificial Sequence
  Synthetic Polynucleotide
taatacgactcactatagggacagctatccattccatacccttgcaagcaaacagaggagatgcttgatggggtatggaaacctggcggcagcgcaaaagatg

SEQ ID NO: 7956 - DNA, 103 bp, Artificial Sequence
  Synthetic Polynucleotide
taatacgactcactatagggttttgacagctatccattccatacccttgcaacagaggagagcaaggatgtggaatggaaacctggcggcagcgcaaaagatg

SEQ ID NO: 7957 - DNA, 103 bp, Artificial Sequence
  Synthetic Polynucleotide
taatacgactcactatagggctgaattttgacagctatccattccataccaacagaggagaggtatgatgtggatagctaacctggcggcagcgcaaaagatg

SEQ ID NO: 7958 - DNA, 103 bp, Artificial Sequence
  Synthetic Polynucleotide
taatacgactcactatagggctcaatagactcttcgcaccatgtctgtataacagaggagaatacagatgtggtgcgaaaacctggcggcagcgcaaaagatg

SEQ ID NO: 7959 - DNA, 103 bp, Artificial Sequence
  Synthetic Polynucleotide
taatacgactcactatagggaatttctgaattttgacagctatccattccaacagaggagaggaatgatgagctgtcaaaacctggcggcagcgcaaaagatg

SEQ ID NO: 7960 - DNA, 103 bp, Artificial Sequence
  Synthetic Polynucleotide
taatacgactcactatagggcaatgaatttctgaattttgacagctatccaacagaggagaggatagatgtcaaaattcaacctggcggcagcgcaaaagatg

SEQ ID NO: 7961 - DNA, 103 bp, Artificial Sequence
  Synthetic Polynucleotide
taatacgactcactatagggccattcaatgaatttctgaattttgacagcaacagaggagagctgtcatgattcagaaaaacctggcggcagcgcaaaagatg

SEQ ID NO: 7962 - DNA, 103 bp, Artificial Sequence
  Synthetic Polynucleotide
taatacgactcactatagggttgagccattcaatgaatttctgaattttgaacagaggagacaaaatatggaaattcataacctggcggcagcgcaaaagatg

SEQ ID NO: 7963 - DNA, 103 bp, Artificial Sequence
  Synthetic Polynucleotide
taatacgactcactatagggttactttgagccattcaatgaatttctgaaaacagaggagattcagaatgtcattgaataacctggcggcagcgcaaaagatg

SEQ ID NO: 7964 - DNA, 103 bp, Artificial Sequence
  Synthetic Polynucleotide
taatacgactcactatagggaatttttactttgagccattcaatgaatttaacagaggagaaaattcatggaatggctcaacctggcggcagcgcaaaagatg

SEQ ID NO: 7965 - DNA, 103 bp, Artificial Sequence
  Synthetic Polynucleotide
taatacgactcactatagggggcaaaatttttactttgagccattcaatgaacagaggagacattgaatggctcaaagtaacctggcggcagcgcaaaagatg

SEQ ID NO: 7966 - DNA, 103 bp, Artificial Sequence
  Synthetic Polynucleotide
taatacgactcactatagggcctctggcaaaatttttactttgagccattaacagaggagaaatggcatgaagtaaaaaaacctggcggcagcgcaaaagatg

SEQ ID NO: 7967 - DNA, 103 bp, Artificial Sequence
  Synthetic Polynucleotide
taatacgactcactatagggcctgacctctggcaaaatttttactttgagaacagaggagactcaaaatgaaaattttgaacctggcggcagcgcaaaagatg

SEQ ID NO: 7968 - DNA, 103 bp, Artificial Sequence
  Synthetic Polynucleotide
taatacgactcactatagggttttccctgacctctggcaaaatttttactaacagaggagaagtaaaatgtttgccagaaacctggcggcagcgcaaaagatg

SEQ ID NO: 7969 - DNA, 103 bp, Artificial Sequence
  Synthetic Polynucleotide
taatacgactcactatagggactagctcaatagactcttcgcaccatgtcaacagaggagagacatgatgcgaagagtcaacctggcggcagcgcaaaagatg

SEQ ID NO: 7970 - DNA, 103 bp, Artificial Sequence
  Synthetic Polynucleotide
taatacgactcactatagggcgtgtttttccctgacctctggcaaaatttaacagaggagaaaatttatgcagaggtcaaacctggcggcagcgcaaaagatg

SEQ ID NO: 7971 - DNA, 103 bp, Artificial Sequence
  Synthetic Polynucleotide
taatacgactcactataggggaattcgtgtttttccctgacctctggcaaaacagaggagattgccaatggtcagggaaaacctggcggcagcgcaaaagatg

SEQ ID NO: 7972 - DNA, 103 bp, Artificial Sequence
  Synthetic Polynucleotide
taatacgactcactatagggttcaggaattcgtgtttttccctgacctctaacagaggagaagaggtatgggaaaaacaaacctggcggcagcgcaaaagatg

SEQ ID NO: 7973 - DNA, 103 bp, Artificial Sequence
  Synthetic Polynucleotide
taatacgactcactataggggtctgttcaggaattcgtgtttttccctgaaacagaggagatcagggatgaacacgaataacctggcggcagcgcaaaagatg

SEQ ID NO: 7974 - DNA, 103 bp, Artificial Sequence
  Synthetic Polynucleotide
taatacgactcactatagggtttaagtctgttcaggaattcgtgtttttcaacagaggagagaaaaaatggaattcctgaacctggcggcagcgcaaaagatg

SEQ ID NO: 7975 - DNA, 103 bp, Artificial Sequence
  Synthetic Polynucleotide
taatacgactcactatagggagttgtttaagtctgttcaggaattcgtgtaacagaggagaacacgaatgcctgaacagaacctggcggcagcgcaaaagatg

SEQ ID NO: 7976 - DNA, 103 bp, Artificial Sequence
  Synthetic Polynucleotide
taatacgactcactatagggaggggagttgtttaagtctgttcaggaattaacagaggagaaattccatgacagacttaaacctggcggcagcgcaaaagatg

SEQ ID NO: 7977 - DNA, 103 bp, Artificial Sequence
  Synthetic Polynucleotide
taatacgactcactatagggtaataaggggagttgtttaagtctgttcagaacagaggagactgaacatgcttaaacaaaacctggcggcagcgcaaaagatg

SEQ ID NO: 7978 - DNA, 103 bp, Artificial Sequence
  Synthetic Polynucleotide
taatacgactcactatagggctttctaataaggggagttgtttaagtctgaacagaggagacagactatgacaactcccaacctggcggcagcgcaaaagatg

SEQ ID NO: 7979 - DNA, 103 bp, Artificial Sequence
  Synthetic Polynucleotide
taatacgactcactatagggtctgactttctaataaggggagttgtttaaaacagaggagattaaacatgtccccttataacctggcggcagcgcaaaagatg

SEQ ID NO: 7980 - DNA, 103 bp, Artificial Sequence
  Synthetic Polynucleotide
taatacgactcactatagggtaccaactagctcaatagactcttcgcaccaacagaggagaggtgcgatgagtctattgaacctggcggcagcgcaaaagatg

SEQ ID NO: 7981 - DNA, 103 bp, Artificial Sequence
  Synthetic Polynucleotide
taatacgactcactatagggggcgatctgactttctaataaggggagttgaacagaggagacaactcatgttattagaaaacctggcggcagcgcaaaagatg

SEQ ID NO: 7982 - DNA, 103 bp, Artificial Sequence
  Synthetic Polynucleotide
taatacgactcactatagggattgtggcgatctgactttctaataaggggaacagaggagaccccttatgagaaagtcaaacctggcggcagcgcaaaagatg

SEQ ID NO: 7983 - DNA, 103 bp, Artificial Sequence
  Synthetic Polynucleotide
taatacgactcactataggggctcgattgtggcgatctgactttctaataaacagaggagatattagatggtcagatcgaacctggcggcagcgcaaaagatg

SEQ ID NO: 7984 - DNA, 103 bp, Artificial Sequence
  Synthetic Polynucleotide
taatacgactcactataggggctctgctcgattgtggcgatctgactttcaacagaggagagaaagtatgatcgccacaaacctggcggcagcgcaaaagatg

SEQ ID NO: 7985 - DNA, 103 bp, Artificial Sequence
  Synthetic Polynucleotide
taatacgactcactatagggggcgcgctctgctcgattgtggcgatctgaaacagaggagatcagatatgcacaatcgaaacctggcggcagcgcaaaagatg

SEQ ID NO: 7986 - DNA, 103 bp, Artificial Sequence
  Synthetic Polynucleotide
taatacgactcactataggggggatggcgcgctctgctcgattgtggcgaaacagaggagatcgccaatgtcgagcagaaacctggcggcagcgcaaaagatg

SEQ ID NO: 7987 - DNA, 103 bp, Artificial Sequence
  Synthetic Polynucleotide
taatacgactcactatagggactttgggatggcgcgctctgctcgattgtaacagaggagaacaatcatgcagagcgcgaacctggcggcagcgcaaaagatg

SEQ ID NO: 7988 - DNA, 103 bp, Artificial Sequence
  Synthetic Polynucleotide
taatacgactcactatagggtggtcactttgggatggcgcgctctgctcgaacagaggagacgagcaatgcgcgccatcaacctggcggcagcgcaaaagatg

SEQ ID NO: 7989 - DNA, 103 bp, Artificial Sequence
  Synthetic Polynucleotide
taatacgactcactataggggttcctggtcactttgggatggcgcgctctaacagaggagaagagcgatgcatcccaaaaacctggcggcagcgcaaaagatg

SEQ ID NO: 7990 - DNA, 103 bp, Artificial Sequence
  Synthetic Polynucleotide
taatacgactcactatagggtaattgttcctggtcactttgggatggcgcaacagaggagagcgccaatgcaaagtgacaacctggcggcagcgcaaaagatg

SEQ ID NO: 7991 - DNA, 103 bp, Artificial Sequence
  Synthetic Polynucleotide
taatacgactcactatagggaggactaccaactagctcaatagactcttcaacagaggagagaagagatgattgagctaaacctggcggcagcgcaaaagatg

SEQ ID NO: 7992 - DNA, 103 bp, Artificial Sequence
  Synthetic Polynucleotide
taatacgactcactataggggaaaataattgttcctggtcactttgggataacagaggagaatcccaatgtgaccaggaaacctggcggcagcgcaaaagatg

SEQ ID NO: 7993 - DNA, 103 bp, Artificial Sequence
  Synthetic Polynucleotide
taatacgactcactatagggcattggaaaataattgttcctggtcactttaacagaggagaaaagtgatgaggaacaataacctggcggcagcgcaaaagatg

SEQ ID NO: 7994 - DNA, 103 bp, Artificial Sequence
  Synthetic Polynucleotide
taatacgactcactatagggttggacattggaaaataattgttcctggtcaacagaggagagaccagatgcaattatttaacctggcggcagcgcaaaagatg

SEQ ID NO: 7995 - DNA, 103 bp, Artificial Sequence
  Synthetic Polynucleotide
taatacgactcactatagggaagtattggacattggaaaataattgttccaacagaggagaggaacaatgattttccaaaacctggcggcagcgcaaaagatg

SEQ ID NO: 7996 - DNA, 103 bp, Artificial Sequence
  Synthetic Polynucleotide
taatacgactcactataggggggcaaagtattggacattggaaaataattaacagaggagaaattatatgccaatgtccaacctggcggcagcgcaaaagatg

SEQ ID NO: 7997 - DNA, 103 bp, Artificial Sequence
  Synthetic Polynucleotide
taatacgactcactatagggatagtgggcaaagtattggacattggaaaaaacagaggagattttccatggtccaatacaacctggcggcagcgcaaaagatg

SEQ ID NO: 7998 - DNA, 103 bp, Artificial Sequence
  Synthetic Polynucleotide
taatacgactcactatagggctgcaatagtgggcaaagtattggacattgaacagaggagacaatgtatgatactttgcaacctggcggcagcgcaaaagatg

SEQ ID NO: 7999 - DNA, 103 bp, Artificial Sequence
  Synthetic Polynucleotide
taatacgactcactatagggactttctgcaatagtgggcaaagtattggaaacagaggagatccaatatgttgcccactaacctggcggcagcgcaaaagatg

SEQ ID NO: 8000 - DNA, 103 bp, Artificial Sequence
  Synthetic Polynucleotide
taatacgactcactatagggagcgtactttctgcaatagtgggcaaagtaaacagaggagatactttatgcactattgcaacctggcggcagcgcaaaagatg

SEQ ID NO: 8001 - DNA, 103 bp, Artificial Sequence
  Synthetic Polynucleotide
taatacgactcactatagggaggggagcgtactttctgcaatagtgggcaaacagaggagatgcccaatgttgcagaaaaacctggcggcagcgcaaaagatg

SEQ ID NO: 8002 - DNA, 103 bp, Artificial Sequence
  Synthetic Polynucleotide
taatacgactcactataggggccggaggactaccaactagctcaatagacaacagaggagagtctatatggctagttggaacctggcggcagcgcaaaagatg

SEQ ID NO: 8003 - DNA, 103 bp, Artificial Sequence
  Synthetic Polynucleotide
taatacgactcactatagggcgtagaggggagcgtactttctgcaatagtaacagaggagaactattatggaaagtacgaacctggcggcagcgcaaaagatg

SEQ ID NO: 8004 - DNA, 103 bp, Artificial Sequence
  Synthetic Polynucleotide
taatacgactcactatagggagctgcgtagaggggagcgtactttctgcaaacagaggagatgcagaatgtacgctcccaacctggcggcagcgcaaaagatg

SEQ ID NO: 8005 - DNA, 103 bp, Artificial Sequence
  Synthetic Polynucleotide
taatacgactcactataggggcttcagctgcgtagaggggagcgtactttaacagaggagaaaagtaatgtcccctctaaacctggcggcagcgcaaaagatg

SEQ ID NO: 8006 - DNA, 103 bp, Artificial Sequence
  Synthetic Polynucleotide
taatacgactcactatagggtctttgcttcagctgcgtagaggggagcgtaacagaggagaacgctcatgtctacgcagaacctggcggcagcgcaaaagatg

SEQ ID NO: 8007 - DNA, 103 bp, Artificial Sequence
  Synthetic Polynucleotide
taatacgactcactatagggcaccctctttgcttcagctgcgtagaggggaacagaggagacccctcatggcagctgaaaacctggcggcagcgcaaaagatg

SEQ ID NO: 8008 - DNA, 103 bp, Artificial Sequence
  Synthetic Polynucleotide
taatacgactcactataggggagaacaccctctttgcttcagctgcgtagaacagaggagactacgcatgtgaagcaaaaacctggcggcagcgcaaaagatg

SEQ ID NO: 8009 - DNA, 103 bp, Artificial Sequence
  Synthetic Polynucleotide
taatacgactcactatagggcaagggagaacaccctctttgcttcagctgaacagaggagacagctgatgcaaagagggaacctggcggcagcgcaaaagatg

SEQ ID NO: 8010 - DNA, 103 bp, Artificial Sequence
  Synthetic Polynucleotide
taatacgactcactatagggcttctcaagggagaacaccctctttgcttcaacagaggagagaagcaatgagggtgttcaacctggcggcagcgcaaaagatg

SEQ ID NO: 8011 - DNA, 103 bp, Artificial Sequence
  Synthetic Polynucleotide
taatacgactcactatagggatcttcttctcaagggagaacaccctctttaacagaggagaaaagagatggttctccctaacctggcggcagcgcaaaagatg

SEQ ID NO: 8012 - DNA, 103 bp, Artificial Sequence
  Synthetic Polynucleotide
taatacgactcactatagggtgctcatcttcttctcaagggagaacacccaacagaggagagggtgtatgcccttgagaaacctggcggcagcgcaaaagatg

SEQ ID NO: 8013 - DNA, 103 bp, Artificial Sequence
  Synthetic Polynucleotide
taatacgactcactatagggcaggggccggaggactaccaactagctcaaaacagaggagattgagcatgttggtagtcaacctggcggcagcgcaaaagatg

SEQ ID NO: 8014 - DNA, 103 bp, Artificial Sequence
  Synthetic Polynucleotide
taatacgactcactataggggtaattgctcatcttcttctcaagggagaaaacagaggagattctccatggagaagaagaacctggcggcagcgcaaaagatg

SEQ ID NO: 8015 - DNA, 103 bp, Artificial Sequence
  Synthetic Polynucleotide
taatacgactcactatagggtgtatgtaattgctcatcttcttctcaaggaacagaggagaccttgaatggaagatgagaacctggcggcagcgcaaaagatg

SEQ ID NO: 8016 - DNA, 103 bp, Artificial Sequence
  Synthetic Polynucleotide
taatacgactcactatagggtgaactgtatgtaattgctcatcttcttctaacagaggagaagaagaatgtgagcaattaacctggcggcagcgcaaaagatg

SEQ ID NO: 8017 - DNA, 103 bp, Artificial Sequence
  Synthetic Polynucleotide
taatacgactcactatagggggacttgaactgtatgtaattgctcatcttaacagaggagaaagatgatgaattacataaacctggcggcagcgcaaaagatg

SEQ ID NO: 8018 - DNA, 103 bp, Artificial Sequence
  Synthetic Polynucleotide
taatacgactcactatagggcatttggacttgaactgtatgtaattgctcaacagaggagagagcaaatgcatacagttaacctggcggcagcgcaaaagatg

SEQ ID NO: 8019 - DNA, 103 bp, Artificial Sequence
  Synthetic Polynucleotide
taatacgactcactatagggtacggcatttggacttgaactgtatgtaataacagaggagaattacaatgagttcaagtaacctggcggcagcgcaaaagatg

SEQ ID NO: 8020 - DNA, 103 bp, Artificial Sequence
  Synthetic Polynucleotide
taatacgactcactatagggttcaatacggcatttggacttgaactgtataacagaggagaatacagatgaagtccaaaaacctggcggcagcgcaaaagatg

SEQ ID NO: 8021 - DNA, 103 bp, Artificial Sequence
  Synthetic Polynucleotide
taatacgactcactatagggacaggttcaatacggcatttggacttgaacaacagaggagagttcaaatgcaaatgccgaacctggcggcagcgcaaaagatg

SEQ ID NO: 8022 - DNA, 103 bp, Artificial Sequence
  Synthetic Polynucleotide
taatacgactcactatagggaacatacaggttcaatacggcatttggactaacagaggagaagtccaatggccgtattgaacctggcggcagcgcaaaagatg

SEQ ID NO: 8023 - DNA, 103 bp, Artificial Sequence
  Synthetic Polynucleotide
taatacgactcactataggggagcaaacatacaggttcaatacggcatttaacagaggagaaaatgcatgattgaacctaacctggcggcagcgcaaaagatg

SEQ ID NO: 8024 - DNA, 103 bp, Artificial Sequence
  Synthetic Polynucleotide
taatacgactcactataggggcattcaggggccggaggactaccaactagaacagaggagactagttatgagtcctccgaacctggcggcagcgcaaaagatg

SEQ ID NO: 8025 - DNA, 103 bp, Artificial Sequence
  Synthetic Polynucleotide
taatacgactcactatagggtgcaggagcaaacatacaggttcaatacggaacagaggagaccgtatatgacctgtatgaacctggcggcagcgcaaaagatg

SEQ ID NO: 8026 - DNA, 103 bp, Artificial Sequence
  Synthetic Polynucleotide
taatacgactcactatagggtcccgtgcaggagcaaacatacaggttcaaaacagaggagattgaacatgtatgtttgcaacctggcggcagcgcaaaagatg

SEQ ID NO: 8027 - DNA, 103 bp, Artificial Sequence
  Synthetic Polynucleotide
taatacgactcactatagggagggctcccgtgcaggagcaaacatacaggaacagaggagacctgtaatgttgctcctgaacctggcggcagcgcaaaagatg

SEQ ID NO: 8028 - DNA, 103 bp, Artificial Sequence
  Synthetic Polynucleotide
taatacgactcactataggggcaccagggctcccgtgcaggagcaaacataacagaggagaatgtttatgcctgcacggaacctggcggcagcgcaaaagatg

SEQ ID NO: 8029 - DNA, 103 bp, Artificial Sequence
  Synthetic Polynucleotide
taatacgactcactatagggtgccggcaccagggctcccgtgcaggagcaaacagaggagatgctccatgacgggagccaacctggcggcagcgcaaaagatg

SEQ ID NO: 8030 - DNA, 103 bp, Artificial Sequence
  Synthetic Polynucleotide
taatacgactcactatagggcgacttgccggcaccagggctcccgtgcagaacagaggagactgcacatgagccctggtaacctggcggcagcgcaaaagatg

SEQ ID NO: 8031 - DNA, 103 bp, Artificial Sequence
  Synthetic Polynucleotide
taatacgactcactataggggccaccgacttgccggcaccagggctcccgaacagaggagacgggagatgtggtgccggaacctggcggcagcgcaaaagatg

SEQ ID NO: 8032 - DNA, 103 bp, Artificial Sequence
  Synthetic Polynucleotide
taatacgactcactatagggttgttgccaccgacttgccggcaccagggcaacagaggagagccctgatgccggcaagtaacctggcggcagcgcaaaagatg

SEQ ID NO: 8033 - DNA, 103 bp, Artificial Sequence
  Synthetic Polynucleotide
taatacgactcactatagggtaagtttgttgccaccgacttgccggcaccaacagaggagaggtgccatgaagtcggtgaacctggcggcagcgcaaaagatg

SEQ ID NO: 8034 - DNA, 103 bp, Artificial Sequence
  Synthetic Polynucleotide
taatacgactcactatagggccaattaagtttgttgccaccgacttgccgaacagaggagacggcaaatgggtggcaacaacctggcggcagcgcaaaagatg

SEQ ID NO: 8035 - DNA, 103 bp, Artificial Sequence
  Synthetic Polynucleotide
taatacgactcactatagggtagccgcattcaggggccggaggactaccaaacagaggagatggtagatgtccggccccaacctggcggcagcgcaaaagatg

SEQ ID NO: 8036 - DNA, 103 bp, Artificial Sequence
  Synthetic Polynucleotide
taatacgactcactatagggaccttccaattaagtttgttgccaccgactaacagaggagaagtcggatgcaacaaactaacctggcggcagcgcaaaagatg

SEQ ID NO: 8037 - DNA, 103 bp, Artificial Sequence
  Synthetic Polynucleotide
taatacgactcactatagggaagcgaccttccaattaagtttgttgccacaacagaggagagtggcaatgaacttaattaacctggcggcagcgcaaaagatg

SEQ ID NO: 8038 - DNA, 103 bp, Artificial Sequence
  Synthetic Polynucleotide
taatacgactcactatagggtcagcaagcgaccttccaattaagtttgttaacagaggagaaacaaaatgaattggaagaacctggcggcagcgcaaaagatg

SEQ ID NO: 8039 - DNA, 103 bp, Artificial Sequence
  Synthetic Polynucleotide
taatacgactcactataggggtttctcagcaagcgaccttccaattaagtaacagaggagaacttaaatggaaggtcgcaacctggcggcagcgcaaaagatg

SEQ ID NO: 8040 - DNA, 103 bp, Artificial Sequence
  Synthetic Polynucleotide
taatacgactcactataggggttgagtttctcagcaagcgaccttccaataacagaggagaattggaatgtcgcttgctaacctggcggcagcgcaaaagatg

SEQ ID NO: 8041 - DNA, 103 bp, Artificial Sequence
  Synthetic Polynucleotide
taatacgactcactataggggagctgttgagtttctcagcaagcgaccttaacagaggagaaaggtcatgtgctgagaaaacctggcggcagcgcaaaagatg

SEQ ID NO: 8042 - DNA, 103 bp, Artificial Sequence
  Synthetic Polynucleotide
taatacgactcactatagggacactgagctgttgagtttctcagcaagcgaacagaggagacgcttgatgagaaactcaaacctggcggcagcgcaaaagatg

SEQ ID NO: 8043 - DNA, 103 bp, Artificial Sequence
  Synthetic Polynucleotide
taatacgactcactatagggtgagtacactgagctgttgagtttctcagcaacagaggagagctgagatgctcaacagcaacctggcggcagcgcaaaagatg

SEQ ID NO: 8044 - DNA, 103 bp, Artificial Sequence
  Synthetic Polynucleotide
taatacgactcactatagggggtagtgagtacactgagctgttgagtttcaacagaggagagaaactatgcagctcagtaacctggcggcagcgcaaaagatg

SEQ ID NO: 8045 - DNA, 103 bp, Artificial Sequence
  Synthetic Polynucleotide
taatacgactcactatagggctggcggtagtgagtacactgagctgttgaaacagaggagatcaacaatgcagtgtactaacctggcggcagcgcaaaagatg

SEQ ID NO: 8046 - DNA, 103 bp, Artificial Sequence
  Synthetic Polynucleotide
taatacgactcactatagggggtaccgtgataccagagtgctagcgcccaaacagaggagatgggcgatggcactctggaacctggcggcagcgcaaaagatg

SEQ ID NO: 8047 - DNA, 103 bp, Artificial Sequence
  Synthetic Polynucleotide
taatacgactcactatagggaggattagccgcattcaggggccggaggacaacagaggagagtcctcatgcccctgaataacctggcggcagcgcaaaagatg

SEQ ID NO: 8048 - DNA, 103 bp, Artificial Sequence
  Synthetic Polynucleotide
taatacgactcactatagggtgggtctggcggtagtgagtacactgagctaacagaggagaagctcaatgtactcactaaacctggcggcagcgcaaaagatg

SEQ ID NO: 8049 - DNA, 103 bp, Artificial Sequence
  Synthetic Polynucleotide
taatacgactcactatagggtgatctgggtctggcggtagtgagtacactaacagaggagaagtgtaatgactaccgccaacctggcggcagcgcaaaagatg

SEQ ID NO: 8050 - DNA, 103 bp, Artificial Sequence
  Synthetic Polynucleotide
taatacgactcactatagggcgaagtgatctgggtctggcggtagtgagtaacagaggagaactcacatgcgccagaccaacctggcggcagcgcaaaagatg

SEQ ID NO: 8051 - DNA, 103 bp, Artificial Sequence
  Synthetic Polynucleotide
taatacgactcactatagggtccgtcgaagtgatctgggtctggcggtagaacagaggagactaccgatggacccagataacctggcggcagcgcaaaagatg

SEQ ID NO: 8052 - DNA, 103 bp, Artificial Sequence
  Synthetic Polynucleotide
taatacgactcactatagggttgtatccgtcgaagtgatctgggtctggcaacagaggagagccagaatgagatcacttaacctggcggcagcgcaaaagatg

SEQ ID NO: 8053 - DNA, 103 bp, Artificial Sequence
  Synthetic Polynucleotide
taatacgactcactataggggctgtttgtatccgtcgaagtgatctgggtaacagaggagaacccagatgacttcgacgaacctggcggcagcgcaaaagatg

SEQ ID NO: 8054 - DNA, 103 bp, Artificial Sequence
  Synthetic Polynucleotide
taatacgactcactatagggggcctgctgtttgtatccgtcgaagtgatcaacagaggagagatcacatggacggatacaacctggcggcagcgcaaaagatg

SEQ ID NO: 8055 - DNA, 103 bp, Artificial Sequence
  Synthetic Polynucleotide
taatacgactcactatagggaccacggcctgctgtttgtatccgtcgaagaacagaggagacttcgaatgatacaaacaaacctggcggcagcgcaaaagatg

SEQ ID NO: 8056 - DNA, 103 bp, Artificial Sequence
  Synthetic Polynucleotide
taatacgactcactatagggtaatcaccacggcctgctgtttgtatccgtaacagaggagaacggatatgaacagcaggaacctggcggcagcgcaaaagatg

SEQ ID NO: 8057 - DNA, 103 bp, Artificial Sequence
  Synthetic Polynucleotide
taatacgactcactataggggtccataatcaccacggcctgctgtttgtaaacagaggagatacaaaatgcaggccgtgaacctggcggcagcgcaaaagatg

SEQ ID NO: 8058 - DNA, 103 bp, Artificial Sequence
  Synthetic Polynucleotide
taatacgactcactatagggcagttaggattagccgcattcaggggccggaacagaggagaccggccatggaatgcggcaacctggcggcagcgcaaaagatg

SEQ ID NO: 8059 - DNA, 103 bp, Artificial Sequence
  Synthetic Polynucleotide
taatacgactcactatagggagatcgtccataatcaccacggcctgctgtaacagaggagaacagcaatgcgtggtgataacctggcggcagcgcaaaagatg

SEQ ID NO: 8060 - DNA, 103 bp, Artificial Sequence
  Synthetic Polynucleotide
taatacgactcactatagggggcatagatcgtccataatcaccacggcctaacagaggagaaggccgatgtgattatggaacctggcggcagcgcaaaagatg

SEQ ID NO: 8061 - DNA, 103 bp, Artificial Sequence
  Synthetic Polynucleotide
taatacgactcactataggggttctggcatagatcgtccataatcaccacaacagaggagagtggtgatgatggacgataacctggcggcagcgcaaaagatg

SEQ ID NO: 8062 - DNA, 103 bp, Artificial Sequence
  Synthetic Polynucleotide
taatacgactcactatagggtcagggttctggcatagatcgtccataatcaacagaggagagattatatgcgatctatgaacctggcggcagcgcaaaagatg

SEQ ID NO: 8063 - DNA, 103 bp, Artificial Sequence
  Synthetic Polynucleotide
taatacgactcactatagggtcccatcagggttctggcatagatcgtccaaacagaggagatggacgatgtatgccagaaacctggcggcagcgcaaaagatg

SEQ ID NO: 8064 - DNA, 103 bp, Artificial Sequence
  Synthetic Polynucleotide
taatacgactcactataggggtctttcccatcagggttctggcatagatcaacagaggagagatctaatgcagaaccctaacctggcggcagcgcaaaagatg

SEQ ID NO: 8065 - DNA, 103 bp, Artificial Sequence
  Synthetic Polynucleotide
taatacgactcactataggggagacgtctttcccatcagggttctggcataacagaggagaatgccaatgccctgatggaacctggcggcagcgcaaaagatg

SEQ ID NO: 8066 - DNA, 103 bp, Artificial Sequence
  Synthetic Polynucleotide
taatacgactcactatagggacaaggagacgtctttcccatcagggttctaacagaggagaagaaccatgatgggaaagaacctggcggcagcgcaaaagatg

SEQ ID NO: 8067 - DNA, 103 bp, Artificial Sequence
  Synthetic Polynucleotide
taatacgactcactataggggcagaacaaggagacgtctttcccatcaggaacagaggagacctgatatgaaagacgtcaacctggcggcagcgcaaaagatg

SEQ ID NO: 8068 - DNA, 103 bp, Artificial Sequence
  Synthetic Polynucleotide
taatacgactcactatagggatttggcagaacaaggagacgtctttcccaaacagaggagatgggaaatgcgtctccttaacctggcggcagcgcaaaagatg

SEQ ID NO: 8069 - DNA, 103 bp, Artificial Sequence
  Synthetic Polynucleotide
taatacgactcactatagggctccgcagttaggattagccgcattcagggaacagaggagaccctgaatgcggctaatcaacctggcggcagcgcaaaagatg

SEQ ID NO: 8070 - DNA, 103 bp, Artificial Sequence
  Synthetic Polynucleotide
taatacgactcactatagggaaaccatttggcagaacaaggagacgtcttaacagaggagaaagacgatgccttgttctaacctggcggcagcgcaaaagatg

SEQ ID NO: 8071 - DNA, 103 bp, Artificial Sequence
  Synthetic Polynucleotide
taatacgactcactatagggactggaaaccatttggcagaacaaggagacaacagaggagagtctccatgttctgccaaaacctggcggcagcgcaaaagatg

SEQ ID NO: 8072 - DNA, 103 bp, Artificial Sequence
  Synthetic Polynucleotide
taatacgactcactatagggtctacactggaaaccatttggcagaacaagaacagaggagacttgttatgccaaatggtaacctggcggcagcgcaaaagatg

SEQ ID NO: 8073 - DNA, 103 bp, Artificial Sequence
  Synthetic Polynucleotide
taatacgactcactatagggcaaaatctacactggaaaccatttggcagaaacagaggagatctgccatgtggtttccaaacctggcggcagcgcaaaagatg

SEQ ID NO: 8074 - DNA, 103 bp, Artificial Sequence
  Synthetic Polynucleotide
taatacgactcactatagggtggtacaaaatctacactggaaaccatttgaacagaggagacaaatgatgtccagtgtaaacctggcggcagcgcaaaagatg

SEQ ID NO: 8075 - DNA, 103 bp, Artificial Sequence
  Synthetic Polynucleotide
taatacgactcactatagggatgggtggtacaaaatctacactggaaaccaacagaggagaggtttcatgtgtagatttaacctggcggcagcgcaaaagatg

SEQ ID NO: 8076 - DNA, 103 bp, Artificial Sequence
  Synthetic Polynucleotide
taatacgactcactatagggcagccatgggtggtacaaaatctacactggaacagaggagaccagtgatgattttgtacaacctggcggcagcgcaaaagatg

SEQ ID NO: 8077 - DNA, 103 bp, Artificial Sequence
  Synthetic Polynucleotide
taatacgactcactatagggtagggcagccatgggtggtacaaaatctacaacagaggagagtagatatggtaccacccaacctggcggcagcgcaaaagatg

SEQ ID NO: 8078 - DNA, 103 bp, Artificial Sequence
  Synthetic Polynucleotide
taatacgactcactatagggtcttctagggcagccatgggtggtacaaaaaacagaggagattttgtatgacccatggcaacctggcggcagcgcaaaagatg

SEQ ID NO: 8079 - DNA, 103 bp, Artificial Sequence
  Synthetic Polynucleotide
taatacgactcactatagggctttctcttctagggcagccatgggtggtaaacagaggagataccacatgtggctgcccaacctggcggcagcgcaaaagatg

SEQ ID NO: 8080 - DNA, 103 bp, Artificial Sequence
  Synthetic Polynucleotide
taatacgactcactataggggtgtgctccgcagttaggattagccgcattaacagaggagaaatgcgatgaatcctaacaacctggcggcagcgcaaaagatg

SEQ ID NO: 8081 - DNA, 103 bp, Artificial Sequence
  Synthetic Polynucleotide
taatacgactcactatagggaatgcctttctcttctagggcagccatgggaacagaggagacccatgatggccctagaaaacctggcggcagcgcaaaagatg

SEQ ID NO: 8082 - DNA, 103 bp, Artificial Sequence
  Synthetic Polynucleotide
taatacgactcactatagggaacagaatgcctttctcttctagggcagccaacagaggagaggctgcatgagaagagaaaacctggcggcagcgcaaaagatg

SEQ ID NO: 8083 - DNA, 103 bp, Artificial Sequence
  Synthetic Polynucleotide
taatacgactcactatagggaggtgaacagaatgcctttctcttctagggaacagaggagaccctagatgagaaaggcaaacctggcggcagcgcaaaagatg

SEQ ID NO: 8084 - DNA, 103 bp, Artificial Sequence
  Synthetic Polynucleotide
taatacgactcactatagggcggtgaggtgaacagaatgcctttctcttcaacagaggagagaagagatgggcattctgaacctggcggcagcgcaaaagatg

SEQ ID NO: 8085 - DNA, 103 bp, Artificial Sequence
  Synthetic Polynucleotide
taatacgactcactatagggacaaacggtgaggtgaacagaatgcctttcaacagaggagagaaaggatgtctgttcacaacctggcggcagcgcaaaagatg

SEQ ID NO: 8086 - DNA, 103 bp, Artificial Sequence
  Synthetic Polynucleotide
taatacgactcactatagggccaagacaaacggtgaggtgaacagaatgcaacagaggagagcattcatgtcacctcacaacctggcggcagcgcaaaagatg

SEQ ID NO: 8087 - DNA, 103 bp, Artificial Sequence
  Synthetic Polynucleotide
taatacgactcactatagggcgatgccaagacaaacggtgaggtgaacagaacagaggagactgttcatgtcaccgtttaacctggcggcagcgcaaaagatg

SEQ ID NO: 8088 - DNA, 103 bp, Artificial Sequence
  Synthetic Polynucleotide
taatacgactcactatagggttggtcgatgccaagacaaacggtgaggtgaacagaggagacacctcatggtttgtcttaacctggcggcagcgcaaaagatg

SEQ ID NO: 8089 - DNA, 103 bp, Artificial Sequence
  Synthetic Polynucleotide
taatacgactcactatagggctgcattggtcgatgccaagacaaacggtgaacagaggagacaccgtatgtcttggcataacctggcggcagcgcaaaagatg

SEQ ID NO: 8090 - DNA, 103 bp, Artificial Sequence
  Synthetic Polynucleotide
taatacgactcactatagggagatcctgcattggtcgatgccaagacaaaaacagaggagatttgtcatggcatcgaccaacctggcggcagcgcaaaagatg

SEQ ID NO: 8091 - DNA, 103 bp, Artificial Sequence
  Synthetic Polynucleotide
taatacgactcactatagggagggtgtgtgctccgcagttaggattagccaacagaggagaggctaaatgtaactgcggaacctggcggcagcgcaaaagatg

SEQ ID NO: 8092 - DNA, 103 bp, Artificial Sequence
  Synthetic Polynucleotide
taatacgactcactatagggttaatagatcctgcattggtcgatgccaagaacagaggagacttggcatggaccaatgcaacctggcggcagcgcaaaagatg

SEQ ID NO: 8093 - DNA, 103 bp, Artificial Sequence
  Synthetic Polynucleotide
taatacgactcactataggggagcattaatagatcctgcattggtcgatgaacagaggagacatcgaatgatgcaggataacctggcggcagcgcaaaagatg

SEQ ID NO: 8094 - DNA, 103 bp, Artificial Sequence
  Synthetic Polynucleotide
taatacgactcactatagggggttggagcattaatagatcctgcattggtaacagaggagaaccaatatgggatctattaacctggcggcagcgcaaaagatg

SEQ ID NO: 8095 - DNA, 103 bp, Artificial Sequence
  Synthetic Polynucleotide
taatacgactcactataggggacacggttggagcattaatagatcctgcaaacagaggagatgcaggatgtattaatgcaacctggcggcagcgcaaaagatg

SEQ ID NO: 8096 - DNA, 103 bp, Artificial Sequence
  Synthetic Polynucleotide
taatacgactcactatagggtatctgacacggttggagcattaatagatcaacagaggagagatctaatgatgctccaaaacctggcggcagcgcaaaagatg

SEQ ID NO: 8097 - DNA, 103 bp, Artificial Sequence
  Synthetic Polynucleotide
taatacgactcactatagggtctgctatctgacacggttggagcattaataacagaggagaattaatatgccaaccgtgaacctggcggcagcgcaaaagatg

SEQ ID NO: 8098 - DNA, 103 bp, Artificial Sequence
  Synthetic Polynucleotide
taatacgactcactatagggaaggctctgctatctgacacggttggagcaaacagaggagatgctccatgcgtgtcagaaacctggcggcagcgcaaaagatg

SEQ ID NO: 8099 - DNA, 103 bp, Artificial Sequence
  Synthetic Polynucleotide
taatacgactcactatagggttgccaaggctctgctatctgacacggttgaacagaggagacaaccgatgcagatagcaaacctggcggcagcgcaaaagatg

SEQ ID NO: 8100 - DNA, 103 bp, Artificial Sequence
  Synthetic Polynucleotide
taatacgactcactatagggtctccttgccaaggctctgctatctgacacaacagaggagagtgtcaatgagcagagccaacctggcggcagcgcaaaagatg

SEQ ID NO: 8101 - DNA, 103 bp, Artificial Sequence
  Synthetic Polynucleotide
taatacgactcactatagggtgaaatctccttgccaaggctctgctatctaacagaggagaagatagatgagccttggcaacctggcggcagcgcaaaagatg

SEQ ID NO: 8102 - DNA, 103 bp, Artificial Sequence
  Synthetic Polynucleotide
taatacgactcactataggggcttgagggtgtgtgctccgcagttaggataacagaggagaatcctaatggcggagcacaacctggcggcagcgcaaaagatg

SEQ ID NO: 8103 - DNA, 103 bp, Artificial Sequence
  Synthetic Polynucleotide
taatacgactcactatagggcaaagtgaaatctccttgccaaggctctgcaacagaggagagcagagatgtggcaaggaaacctggcggcagcgcaaaagatg

SEQ ID NO: 8104 - DNA, 103 bp, Artificial Sequence
  Synthetic Polynucleotide
taatacgactcactatagggcatgtcaaagtgaaatctccttgccaaggcaacagaggagagccttgatgaggagatttaacctggcggcagcgcaaaagatg

SEQ ID NO: 8105 - DNA, 103 bp, Artificial Sequence
  Synthetic Polynucleotide
taatacgactcactatagggatgttcatgtcaaagtgaaatctccttgccaacagaggagaggcaagatgatttcacttaacctggcggcagcgcaaaagatg

SEQ ID NO: 8106 - DNA, 103 bp, Artificial Sequence
  Synthetic Polynucleotide
taatacgactcactatagggcctcgatgttcatgtcaaagtgaaatctccaacagaggagaggagatatgactttgacaaacctggcggcagcgcaaaagatg

SEQ ID NO: 8107 - DNA, 103 bp, Artificial Sequence
  Synthetic Polynucleotide
taatacgactcactatagggaataacctcgatgttcatgtcaaagtgaaaaacagaggagatttcacatggacatgaacaacctggcggcagcgcaaaagatg

SEQ ID NO: 8108 - DNA, 103 bp, Artificial Sequence
  Synthetic Polynucleotide
taatacgactcactatagggatggaaataacctcgatgttcatgtcaaagaacagaggagactttgaatggaacatcgaaacctggcggcagcgcaaaagatg

SEQ ID NO: 8109 - DNA, 103 bp, Artificial Sequence
  Synthetic Polynucleotide
taatacgactcactatagggtgtacatggaaataacctcgatgttcatgtaacagaggagaacatgaatgtcgaggttaaacctggcggcagcgcaaaagatg

SEQ ID NO: 8110 - DNA, 103 bp, Artificial Sequence
  Synthetic Polynucleotide
taatacgactcactatagggctgactgtacatggaaataacctcgatgttaacagaggagaaacatcatggttatttccaacctggcggcagcgcaaaagatg

SEQ ID NO: 8111 - DNA, 103 bp, Artificial Sequence
  Synthetic Polynucleotide
taatacgactcactatagggccattctgactgtacatggaaataacctcgaacagaggagacgaggtatgttccatgtaaacctggcggcagcgcaaaagatg

SEQ ID NO: 8112 - DNA, 103 bp, Artificial Sequence
  Synthetic Polynucleotide
taatacgactcactatagggtcttgccattctgactgtacatggaaataaaacagaggagattatttatgtgtacagtcaacctggcggcagcgcaaaagatg

SEQ ID NO: 8113 - DNA, 103 bp, Artificial Sequence
  Synthetic Polynucleotide
taatacgactcactatagggctctggcttgagggtgtgtgctccgcagttaacagaggagaaactgcatggcacacaccaacctggcggcagcgcaaaagatg

SEQ ID NO: 8114 - DNA, 103 bp, Artificial Sequence
  Synthetic Polynucleotide
taatacgactcactataggggtttatcttgccattctgactgtacatggaaacagaggagatccatgatgagtcagaataacctggcggcagcgcaaaagatg

SEQ ID NO: 8115 - DNA, 103 bp, Artificial Sequence
  Synthetic Polynucleotide
taatacgactcactatagggggcatgtttatcttgccattctgactgtacaacagaggagagtacagatggaatggcaaaacctggcggcagcgcaaaagatg

SEQ ID NO: 8116 - DNA, 103 bp, Artificial Sequence
  Synthetic Polynucleotide
taatacgactcactatagggacatgggcatgtttatcttgccattctgacaacagaggagagtcagaatggcaagataaaacctggcggcagcgcaaaagatg

SEQ ID NO: 8117 - DNA, 103 bp, Artificial Sequence
  Synthetic Polynucleotide
taatacgactcactataggggactgacatgggcatgtttatcttgccattaacagaggagaaatggcatgataaacatgaacctggcggcagcgcaaaagatg

SEQ ID NO: 8118 - DNA, 103 bp, Artificial Sequence
  Synthetic Polynucleotide
taatacgactcactataggggtcttgactgacatgggcatgtttatcttgaacagaggagacaagatatgcatgcccataacctggcggcagcgcaaaagatg

SEQ ID NO: 8119 - DNA, 103 bp, Artificial Sequence
  Synthetic Polynucleotide
taatacgactcactatagggcacaagtcttgactgacatgggcatgtttaaacagaggagataaacaatgccatgtcagaacctggcggcagcgcaaaagatg

SEQ ID NO: 8120 - DNA, 103 bp, Artificial Sequence
  Synthetic Polynucleotide
taatacgactcactatagggatcgtcacaagtcttgactgacatgggcataacagaggagaatgcccatgtcagtcaagaacctggcggcagcgcaaaagatg

SEQ ID NO: 8121 - DNA, 103 bp, Artificial Sequence
  Synthetic Polynucleotide
taatacgactcactatagggcactcatcgtcacaagtcttgactgacatgaacagaggagacatgtcatgcaagacttgaacctggcggcagcgcaaaagatg

SEQ ID NO: 8122 - DNA, 103 bp, Artificial Sequence
  Synthetic Polynucleotide
taatacgactcactatagggggcaacactcatcgtcacaagtcttgactgaacagaggagacagtcaatgcttgtgacgaacctggcggcagcgcaaaagatg

SEQ ID NO: 8123 - DNA, 103 bp, Artificial Sequence
  Synthetic Polynucleotide
taatacgactcactataggggaccgggcaacactcatcgtcacaagtcttaacagaggagaaagactatggacgatgagaacctggcggcagcgcaaaagatg

SEQ ID NO: 8124 - DNA, 103 bp, Artificial Sequence
  Synthetic Polynucleotide
taatacgactcactatagggctgccctctggcttgagggtgtgtgctccgaacagaggagacggagcatgcaccctcaaaacctggcggcagcgcaaaagatg

SEQ ID NO: 8125 - DNA, 103 bp, Artificial Sequence
  Synthetic Polynucleotide
taatacgactcactatagggaaattgaccgggcaacactcatcgtcacaaaacagaggagattgtgaatgtgagtgttgaacctggcggcagcgcaaaagatg

SEQ ID NO: 8126 - DNA, 103 bp, Artificial Sequence
  Synthetic Polynucleotide
taatacgactcactatagggttttaaaattgaccgggcaacactcatcgtaacagaggagaacgatgatggttgcccggaacctggcggcagcgcaaaagatg

SEQ ID NO: 8127 - DNA, 103 bp, Artificial Sequence
  Synthetic Polynucleotide
taatacgactcactataggggcactttttaaaattgaccgggcaacactcaacagaggagagagtgtatgccggtcaataacctggcggcagcgcaaaagatg

SEQ ID NO: 8128 - DNA, 103 bp, Artificial Sequence
  Synthetic Polynucleotide
taatacgactcactataggggggcagcactttttaaaattgaccgggcaaaacagaggagattgcccatgcaattttaaaacctggcggcagcgcaaaagatg

SEQ ID NO: 8129 - DNA, 103 bp, Artificial Sequence
  Synthetic Polynucleotide
taatacgactcactatagggcaagagggcagcactttttaaaattgaccgaacagaggagacggtcaatgttaaaaagtaacctggcggcagcgcaaaagatg

SEQ ID NO: 8130 - DNA, 103 bp, Artificial Sequence
  Synthetic Polynucleotide
taatacgactcactatagggacacacaagagggcagcactttttaaaattaacagaggagaaattttatgaagtgctgcaacctggcggcagcgcaaaagatg

SEQ ID NO: 8131 - DNA, 103 bp, Artificial Sequence
  Synthetic Polynucleotide
taatacgactcactatagggttcccacacacaagagggcagcactttttaaacagaggagataaaaaatgctgccctctaacctggcggcagcgcaaaagatg

SEQ ID NO: 8132 - DNA, 103 bp, Artificial Sequence
  Synthetic Polynucleotide
taatacgactcactatagggtagccttcccacacacaagagggcagcactaacagaggagaagtgctatgctcttgtgtaacctggcggcagcgcaaaagatg

SEQ ID NO: 8133 - DNA, 103 bp, Artificial Sequence
  Synthetic Polynucleotide
taatacgactcactatagggttgtatagccttcccacacacaagagggcaaacagaggagatgccctatggtgtgtgggaacctggcggcagcgcaaaagatg

SEQ ID NO: 8134 - DNA, 103 bp, Artificial Sequence
  Synthetic Polynucleotide
taatacgactcactatagggatgaattgtatagccttcccacacacaagaaacagaggagatcttgtatgtgggaaggcaacctggcggcagcgcaaaagatg

SEQ ID NO: 8135 - DNA, 103 bp, Artificial Sequence
  Synthetic Polynucleotide
taatacgactcactatagggacacactgccctctggcttgagggtgtgtgaacagaggagacacacaatgtcaagccagaacctggcggcagcgcaaaagatg

SEQ ID NO: 8136 - DNA, 103 bp, Artificial Sequence
  Synthetic Polynucleotide
taatacgactcactatagggtatcaatgaattgtatagccttcccacacaaacagaggagatgtgtgatgaggctatacaacctggcggcagcgcaaaagatg

SEQ ID NO: 8137 - DNA, 103 bp, Artificial Sequence
  Synthetic Polynucleotide
taatacgactcactatagggtcttctatcaatgaattgtatagccttcccaacagaggagagggaagatgatacaattcaacctggcggcagcgcaaaagatg

SEQ ID NO: 8138 - DNA, 103 bp, Artificial Sequence
  Synthetic Polynucleotide
taatacgactcactatagggtgtgttcttctatcaatgaattgtatagccaacagaggagaggctatatgattcattgaaacctggcggcagcgcaaaagatg

SEQ ID NO: 8139 - DNA, 103 bp, Artificial Sequence
  Synthetic Polynucleotide
taatacgactcactatagggtgacctgtgttcttctatcaatgaattgtaaacagaggagatacaatatgttgatagaaaacctggcggcagcgcaaaagatg

SEQ ID NO: 8140 - DNA, 103 bp, Artificial Sequence
  Synthetic Polynucleotide
taatacgactcactataggggtatctgacctgtgttcttctatcaatgaaaacagaggagattcattatgagaagaacaaacctggcggcagcgcaaaagatg

SEQ ID NO: 8141 - DNA, 103 bp, Artificial Sequence
  Synthetic Polynucleotide
taatacgactcactatagggagagagtatctgacctgtgttcttctatcaaacagaggagatgatagatgaacacaggtaacctggcggcagcgcaaaagatg

SEQ ID NO: 8142 - DNA, 103 bp, Artificial Sequence
  Synthetic Polynucleotide
taatacgactcactatagggtgtctagagagtatctgacctgtgttcttcaacagaggagagaagaaatgaggtcagataacctggcggcagcgcaaaagatg

SEQ ID NO: 8143 - DNA, 103 bp, Artificial Sequence
  Synthetic Polynucleotide
taatacgactcactatagggtagcatgtctagagagtatctgacctgtgtaacagaggagaacacagatgagatactctaacctggcggcagcgcaaaagatg

SEQ ID NO: 8144 - DNA, 103 bp, Artificial Sequence
  Synthetic Polynucleotide
taatacgactcactataggggtgactagcatgtctagagagtatctgaccaacagaggagaggtcagatgctctctagaaacctggcggcagcgcaaaagatg

SEQ ID NO: 8145 - DNA, 103 bp, Artificial Sequence
  Synthetic Polynucleotide
taatacgactcactatagggtctcggtgactagcatgtctagagagtatcaacagaggagagatactatgtagacatgcaacctggcggcagcgcaaaagatg

SEQ ID NO: 8146 - DNA, 103 bp, Artificial Sequence
  Synthetic Polynucleotide
taatacgactcactatagggttacgacacactgccctctggcttgagggtaacagaggagaaccctcatgccagagggcaacctggcggcagcgcaaaagatg

SEQ ID NO: 8147 - DNA, 103 bp, Artificial Sequence
  Synthetic Polynucleotide
taatacgactcactatagggaaacatctcggtgactagcatgtctagagaaacagaggagatctctaatgatgctagtcaacctggcggcagcgcaaaagatg

SEQ ID NO: 8148 - DNA, 103 bp, Artificial Sequence
  Synthetic Polynucleotide
taatacgactcactatagggtccctaaacatctcggtgactagcatgtctaacagaggagaagacatatgagtcaccgaaacctggcggcagcgcaaaagatg

SEQ ID NO: 8149 - DNA, 103 bp, Artificial Sequence
  Synthetic Polynucleotide
taatacgactcactatagggtgtactccctaaacatctcggtgactagcaaacagaggagatgctagatgccgagatgtaacctggcggcagcgcaaaagatg

SEQ ID NO: 8150 - DNA, 103 bp, Artificial Sequence
  Synthetic Polynucleotide
taatacgactcactatagggatgattgtactccctaaacatctcggtgacaacagaggagagtcaccatgatgtttaggaacctggcggcagcgcaaaagatg

SEQ ID NO: 8151 - DNA, 103 bp, Artificial Sequence
  Synthetic Polynucleotide
taatacgactcactatagggtgtctatgattgtactccctaaacatctcgaacagaggagacgagatatgtagggagtaaacctggcggcagcgcaaaagatg

SEQ ID NO: 8152 - DNA, 103 bp, Artificial Sequence
  Synthetic Polynucleotide
taatacgactcactatagggcgctatgtctatgattgtactccctaaacaaacagaggagatgtttaatgagtacaatcaacctggcggcagcgcaaaagatg

SEQ ID NO: 8153 - DNA, 103 bp, Artificial Sequence
  Synthetic Polynucleotide
taatacgactcactatagggccccacgctatgtctatgattgtactccctaacagaggagaagggagatgaatcatagaaacctggcggcagcgcaaaagatg

SEQ ID NO: 8154 - DNA, 103 bp, Artificial Sequence
  Synthetic Polynucleotide
taatacgactcactataggggtggtccccacgctatgtctatgattgtacaacagaggagagtacaaatgtagacatagaacctggcggcagcgcaaaagatg

SEQ ID NO: 8155 - DNA, 103 bp, Artificial Sequence
  Synthetic Polynucleotide
taatacgactcactatagggcaagcgtggtccccacgctatgtctatgataacagaggagaatcataatgatagcgtggaacctggcggcagcgcaaaagatg

SEQ ID NO: 8156 - DNA, 103 bp, Artificial Sequence
  Synthetic Polynucleotide
taatacgactcactatagggtgcctcaagcgtggtccccacgctatgtctaacagaggagaagacatatggtggggaccaacctggcggcagcgcaaaagatg

SEQ ID NO: 8157 - DNA, 103 bp, Artificial Sequence
  Synthetic Polynucleotide
taatacgactcactataggggttcttgtcggtccacgtagactaacaactaacagaggagaagttgtatgtctacgtggaacctggcggcagcgcaaaagatg

SEQ ID NO: 8158 - DNA, 103 bp, Artificial Sequence
  Synthetic Polynucleotide
taatacgactcactatagggaaaaaactgttagaactacgttaagcaagcaacagaggagagcttgcatgacgtagttcaacctggcggcagcgcaaaagatg

SEQ ID NO: 8159 - DNA, 103 bp, Artificial Sequence
  Synthetic Polynucleotide
taatacgactcactatagggcctgcagaggtcttaaacaaaagtgattttaacagaggagaaaaatcatgtttgtttaaaacctggcggcagcgcaaaagatg

SEQ ID NO: 8160 - DNA, 103 bp, Artificial Sequence
  Synthetic Polynucleotide
taatacgactcactatagggttagcttgagctatggcactgacgtaggtaaacagaggagatacctaatgcagtgccataacctggcggcagcgcaaaagatg

SEQ ID NO: 8161 - DNA, 103 bp, Artificial Sequence
  Synthetic Polynucleotide
taatacgactcactatagggatgctttagcttgagctatggcactgacgtaacagaggagaacgtcaatgccatagctcaacctggcggcagcgcaaaagatg

SEQ ID NO: 8162 - DNA, 103 bp, Artificial Sequence
  Synthetic Polynucleotide
taatacgactcactatagggttgtgatgctttagcttgagctatggcactaacagaggagaagtgccatggctcaagctaacctggcggcagcgcaaaagatg

SEQ ID NO: 8163 - DNA, 103 bp, Artificial Sequence
  Synthetic Polynucleotide
taatacgactcactatagggccttcttgtgatgctttagcttgagctatgaacagaggagacatagcatgagctaaagcaacctggcggcagcgcaaaagatg

SEQ ID NO: 8164 - DNA, 103 bp, Artificial Sequence
  Synthetic Polynucleotide
taatacgactcactataggggaggcccttcttgtgatgctttagcttgagaacagaggagactcaagatgaagcatcacaacctggcggcagcgcaaaagatg

SEQ ID NO: 8165 - DNA, 103 bp, Artificial Sequence
  Synthetic Polynucleotide
taatacgactcactatagggtggtagaggcccttcttgtgatgctttagcaacagaggagagctaaaatgtcacaagaaaacctggcggcagcgcaaaagatg

SEQ ID NO: 8166 - DNA, 103 bp, Artificial Sequence
  Synthetic Polynucleotide
taatacgactcactatagggatctctggtagaggcccttcttgtgatgctaacagaggagaagcatcatgagaagggccaacctggcggcagcgcaaaagatg

SEQ ID NO: 8167 - DNA, 103 bp, Artificial Sequence
  Synthetic Polynucleotide
taatacgactcactatagggcctcaatctctggtagaggcccttcttgtgaacagaggagacacaagatgggcctctacaacctggcggcagcgcaaaagatg

SEQ ID NO: 8168 - DNA, 103 bp, Artificial Sequence
  Synthetic Polynucleotide
taatacgactcactatagggctcgtcctcaatctctggtagaggcccttcaacagaggagagaagggatgctaccagagaacctggcggcagcgcaaaagatg

SEQ ID NO: 8169 - DNA, 103 bp, Artificial Sequence
  Synthetic Polynucleotide
taatacgactcactatagggaacacctcgtcctcaatctctggtagaggcaacagaggagagcctctatgagagattgaaacctggcggcagcgcaaaagatg

SEQ ID NO: 8170 - DNA, 103 bp, Artificial Sequence
  Synthetic Polynucleotide
taatacgactcactatagggtgacacctgcagaggtcttaaacaaaagtgaacagaggagacactttatgttaagacctaacctggcggcagcgcaaaagatg

SEQ ID NO: 8171 - DNA, 103 bp, Artificial Sequence
  Synthetic Polynucleotide
taatacgactcactatagggtcctaaacacctcgtcctcaatctctggtaaacagaggagataccagatgttgaggacgaacctggcggcagcgcaaaagatg

SEQ ID NO: 8172 - DNA, 103 bp, Artificial Sequence
  Synthetic Polynucleotide
taatacgactcactatagggtcttttcctaaacacctcgtcctcaatctcaacagaggagagagattatggacgaggtgaacctggcggcagcgcaaaagatg

SEQ ID NO: 8173 - DNA, 103 bp, Artificial Sequence
  Synthetic Polynucleotide
taatacgactcactatagggaagtttcttttcctaaacacctcgtcctcaaacagaggagatgaggaatgggtgtttagaacctggcggcagcgcaaaagatg

SEQ ID NO: 8174 - DNA, 103 bp, Artificial Sequence
  Synthetic Polynucleotide
taatacgactcactatagggttgttaagtttcttttcctaaacacctcgtaacagaggagaacgaggatgttaggaaaaaacctggcggcagcgcaaaagatg

SEQ ID NO: 8175 - DNA, 103 bp, Artificial Sequence
  Synthetic Polynucleotide
taatacgactcactatagggcattattgttaagtttcttttcctaaacacaacagaggagagtgtttatgaaaagaaacaacctggcggcagcgcaaaagatg

SEQ ID NO: 8176 - DNA, 103 bp, Artificial Sequence
  Synthetic Polynucleotide
taatacgactcactatagggaggtccattattgttaagtttcttttcctaaacagaggagataggaaatgaaacttaacaacctggcggcagcgcaaaagatg

SEQ ID NO: 8177 - DNA, 103 bp, Artificial Sequence
  Synthetic Polynucleotide
taatacgactcactataggggatgtaggtccattattgttaagtttctttaacagaggagaaaagaaatgtaacaataaaacctggcggcagcgcaaaagatg

SEQ ID NO: 8178 - DNA, 103 bp, Artificial Sequence
  Synthetic Polynucleotide
taatacgactcactatagggtcctggatgtaggtccattattgttaagttaacagaggagaaacttaatgataatggacaacctggcggcagcgcaaaagatg

SEQ ID NO: 8179 - DNA, 103 bp, Artificial Sequence
  Synthetic Polynucleotide
taatacgactcactatagggcccgatcctggatgtaggtccattattgttaacagaggagaaacaatatgggacctacaaacctggcggcagcgcaaaagatg

SEQ ID NO: 8180 - DNA, 103 bp, Artificial Sequence
  Synthetic Polynucleotide
taatacgactcactatagggtttttcccgatcctggatgtaggtccattaaacagaggagataatggatgtacatccagaacctggcggcagcgcaaaagatg

SEQ ID NO: 8181 - DNA, 103 bp, Artificial Sequence
  Synthetic Polynucleotide
taatacgactcactatagggcatgttgacacctgcagaggtcttaaacaaaacagaggagattgtttatgacctctgcaaacctggcggcagcgcaaaagatg

SEQ ID NO: 8182 - DNA, 103 bp, Artificial Sequence
  Synthetic Polynucleotide
taatacgactcactatagggtcttgtttttcccgatcctggatgtaggtcaacagaggagagacctaatgccaggatcgaacctggcggcagcgcaaaagatg

SEQ ID NO: 8183 - DNA, 103 bp, Artificial Sequence
  Synthetic Polynucleotide
taatacgactcactatagggtatcttcttgtttttcccgatcctggatgtaacagaggagaacatccatgatcgggaaaaacctggcggcagcgcaaaagatg

SEQ ID NO: 8184 - DNA, 103 bp, Artificial Sequence
  Synthetic Polynucleotide
taatacgactcactataggggaaggtatcttcttgtttttcccgatcctgaacagaggagacaggatatggaaaaacaaaacctggcggcagcgcaaaagatg

SEQ ID NO: 8185 - DNA, 103 bp, Artificial Sequence
  Synthetic Polynucleotide
taatacgactcactatagggggctggaaggtatcttcttgtttttcccgaaacagaggagatcgggaatgacaagaagaaacctggcggcagcgcaaaagatg

SEQ ID NO: 8186 - DNA, 103 bp, Artificial Sequence
  Synthetic Polynucleotide
taatacgactcactatagggactatggctggaaggtatcttcttgtttttaacagaggagaaaaaacatgaagatacctaacctggcggcagcgcaaaagatg

SEQ ID NO: 8187 - DNA, 103 bp, Artificial Sequence
  Synthetic Polynucleotide
taatacgactcactatagggcacggactatggctggaaggtatcttcttgaacagaggagacaagaaatgaccttccagaacctggcggcagcgcaaaagatg

SEQ ID NO: 8188 - DNA, 103 bp, Artificial Sequence
  Synthetic Polynucleotide
taatacgactcactatagggggcctcacggactatggctggaaggtatctaacagaggagaagatacatgccagccataaacctggcggcagcgcaaaagatg

SEQ ID NO: 8189 - DNA, 103 bp, Artificial Sequence
  Synthetic Polynucleotide
taatacgactcactatagggtttatggcctcacggactatggctggaaggaacagaggagaccttccatgcatagtccgaacctggcggcagcgcaaaagatg

SEQ ID NO: 8190 - DNA, 103 bp, Artificial Sequence
  Synthetic Polynucleotide
taatacgactcactatagggttctttttatggcctcacggactatggctgaacagaggagacagccaatgtccgtgaggaacctggcggcagcgcaaaagatg

SEQ ID NO: 8191 - DNA, 103 bp, Artificial Sequence
  Synthetic Polynucleotide
taatacgactcactatagggcagctttctttttatggcctcacggactataacagaggagaatagtcatggaggccataaacctggcggcagcgcaaaagatg

SEQ ID NO: 8192 - DNA, 103 bp, Artificial Sequence
  Synthetic Polynucleotide
taatacgactcactataggggtgcacatgttgacacctgcagaggtcttaaacagaggagataagacatgtgcaggtgtaacctggcggcagcgcaaaagatg

SEQ ID NO: 8193 - DNA, 103 bp, Artificial Sequence
  Synthetic Polynucleotide
taatacgactcactataggggtgcgcagctttctttttatggcctcacggaacagaggagaccgtgaatgcataaaaagaacctggcggcagcgcaaaagatg

SEQ ID NO: 8194 - DNA, 103 bp, Artificial Sequence
  Synthetic Polynucleotide
taatacgactcactatagggctagcgtgcgcagctttctttttatggcctaacagaggagaaggccaatgaaagaaagcaacctggcggcagcgcaaaagatg

SEQ ID NO: 8195 - DNA, 103 bp, Artificial Sequence
  Synthetic Polynucleotide
taatacgactcactatagggtaagactagcgtgcgcagctttctttttataacagaggagaataaaaatgaagctgcgcaacctggcggcagcgcaaaagatg

SEQ ID NO: 8196 - DNA, 103 bp, Artificial Sequence
  Synthetic Polynucleotide
taatacgactcactatagggggagctaagactagcgtgcgcagctttcttaacagaggagaaagaaaatggcgcacgctaacctggcggcagcgcaaaagatg

SEQ ID NO: 8197 - DNA, 103 bp, Artificial Sequence
  Synthetic Polynucleotide
taatacgactcactatagggttgtgggagctaagactagcgtgcgcagctaacagaggagaagctgcatgcgctagtctaacctggcggcagcgcaaaagatg

SEQ ID NO: 8198 - DNA, 103 bp, Artificial Sequence
  Synthetic Polynucleotide
taatacgactcactatagggaactcttgtgggagctaagactagcgtgcgaacagaggagacgcacgatggtcttagctaacctggcggcagcgcaaaagatg

SEQ ID NO: 8199 - DNA, 103 bp, Artificial Sequence
  Synthetic Polynucleotide
taatacgactcactataggggcgacaactcttgtgggagctaagactagcaacagaggagagctagtatgagctcccacaacctggcggcagcgcaaaagatg

SEQ ID NO: 8200 - DNA, 103 bp, Artificial Sequence
  Synthetic Polynucleotide
taatacgactcactatagggcagaagcgacaactcttgtgggagctaagaaacagaggagatcttagatgccacaagagaacctggcggcagcgcaaaagatg

SEQ ID NO: 8201 - DNA, 103 bp, Artificial Sequence
  Synthetic Polynucleotide
taatacgactcactatagggcatttcagaagcgacaactcttgtgggagcaacagaggagagctcccatgagagttgtcaacctggcggcagcgcaaaagatg

SEQ ID NO: 8202 - DNA, 103 bp, Artificial Sequence
  Synthetic Polynucleotide
taatacgactcactatagggtctgccatttcagaagcgacaactcttgtgaacagaggagacacaagatgtgtcgcttcaacctggcggcagcgcaaaagatg

SEQ ID NO: 8203 - DNA, 103 bp, Artificial Sequence
  Synthetic Polynucleotide
taatacgactcactatagggtaagggtgcacatgttgacacctgcagaggaacagaggagacctctgatggtgtcaacaaacctggcggcagcgcaaaagatg

SEQ ID NO: 8204 - DNA, 103 bp, Artificial Sequence
  Synthetic Polynucleotide
taatacgactcactataggggcgcctctgccatttcagaagcgacaactcaacagaggagagagttgatgcttctgaaaaacctggcggcagcgcaaaagatg

SEQ ID NO: 8205 - DNA, 103 bp, Artificial Sequence
  Synthetic Polynucleotide
taatacgactcactatagggcttgagcgcctctgccatttcagaagcgacaacagaggagagtcgctatggaaatggcaaacctggcggcagcgcaaaagatg

SEQ ID NO: 8206 - DNA, 103 bp, Artificial Sequence
  Synthetic Polynucleotide
taatacgactcactatagggattcccttgagcgcctctgccatttcagaaaacagaggagattctgaatgggcagaggcaacctggcggcagcgcaaaagatg

SEQ ID NO: 8207 - DNA, 103 bp, Artificial Sequence
  Synthetic Polynucleotide
taatacgactcactatagggttggcattcccttgagcgcctctgccatttaacagaggagaaaatggatgaggcgctcaaacctggcggcagcgcaaaagatg

SEQ ID NO: 8208 - DNA, 103 bp, Artificial Sequence
  Synthetic Polynucleotide
taatacgactcactatagggccttattggcattcccttgagcgcctctgcaacagaggagagcagagatgctcaagggaaacctggcggcagcgcaaaagatg

SEQ ID NO: 8209 - DNA, 103 bp, Artificial Sequence
  Synthetic Polynucleotide
taatacgactcactatagggtgataccttattggcattcccttgagcgccaacagaggagaggcgctatggggaatgccaacctggcggcagcgcaaaagatg

SEQ ID NO: 8210 - DNA, 103 bp, Artificial Sequence
  Synthetic Polynucleotide
taatacgactcactatagggttgtctgataccttattggcattcccttgaaacagaggagatcaaggatgtgccaataaaacctggcggcagcgcaaaagatg

SEQ ID NO: 8211 - DNA, 103 bp, Artificial Sequence
  Synthetic Polynucleotide
taatacgactcactatagggtgctgttgtctgataccttattggcattccaacagaggagaggaatgatgataaggtataacctggcggcagcgcaaaagatg

SEQ ID NO: 8212 - DNA, 103 bp, Artificial Sequence
  Synthetic Polynucleotide
taatacgactcactatagggttcactgctgttgtctgataccttattggcaacagaggagagccaatatggtatcagacaacctggcggcagcgcaaaagatg

SEQ ID NO: 8213 - DNA, 103 bp, Artificial Sequence
  Synthetic Polynucleotide
taatacgactcactatagggcactcttcactgctgttgtctgataccttaaacagaggagataaggtatgagacaacagaacctggcggcagcgcaaaagatg

SEQ ID NO: 8214 - DNA, 103 bp, Artificial Sequence
  Synthetic Polynucleotide
taatacgactcactatagggtgcaataagggtgcacatgttgacacctgcaacagaggagagcaggtatgaacatgtgcaacctggcggcagcgcaaaagatg

SEQ ID NO: 8215 - DNA, 103 bp, Artificial Sequence
  Synthetic Polynucleotide
taatacgactcactataggggtgttcactcttcactgctgttgtctgataaacagaggagatatcagatgacagcagtgaacctggcggcagcgcaaaagatg

SEQ ID NO: 8216 - DNA, 103 bp, Artificial Sequence
  Synthetic Polynucleotide
taatacgactcactatagggcccgtgtgttcactcttcactgctgttgtcaacagaggagagacaacatgagtgaagagaacctggcggcagcgcaaaagatg

SEQ ID NO: 8217 - DNA, 103 bp, Artificial Sequence
  Synthetic Polynucleotide
taatacgactcactatagggcctttcccgtgtgttcactcttcactgctgaacagaggagacagcagatgagagtgaacaacctggcggcagcgcaaaagatg

SEQ ID NO: 8218 - DNA, 103 bp, Artificial Sequence
  Synthetic Polynucleotide
taatacgactcactatagggtatctcctttcccgtgtgttcactcttcacaacagaggagagtgaagatggaacacacgaacctggcggcagcgcaaaagatg

SEQ ID NO: 8219 - DNA, 103 bp, Artificial Sequence
  Synthetic Polynucleotide
taatacgactcactatagggtcaactatctcctttcccgtgtgttcactcaacagaggagagagtgaatgcacgggaaaaacctggcggcagcgcaaaagatg

SEQ ID NO: 8220 - DNA, 103 bp, Artificial Sequence
  Synthetic Polynucleotide
taatacgactcactatagggtaaggtcaactatctcctttcccgtgtgttaacagaggagaaacacaatggaaaggagaaacctggcggcagcgcaaaagatg

SEQ ID NO: 8221 - DNA, 103 bp, Artificial Sequence
  Synthetic Polynucleotide
taatacgactcactatagggacacataaggtcaactatctcctttcccgtaacagaggagaacgggaatggagatagttaacctggcggcagcgcaaaagatg

SEQ ID NO: 8222 - DNA, 103 bp, Artificial Sequence
  Synthetic Polynucleotide
taatacgactcactataggggcgtgacacataaggtcaactatctcctttaacagaggagaaaaggaatgagttgacctaacctggcggcagcgcaaaagatg

SEQ ID NO: 8223 - DNA, 103 bp, Artificial Sequence
  Synthetic Polynucleotide
taatacgactcactatagggaagtggcgtgacacataaggtcaactatctaacagaggagaagatagatgaccttatgtaacctggcggcagcgcaaaagatg

SEQ ID NO: 8224 - DNA, 103 bp, Artificial Sequence
  Synthetic Polynucleotide
taatacgactcactatagggagtgaaagtggcgtgacacataaggtcaacaacagaggagagttgacatgatgtgtcacaacctggcggcagcgcaaaagatg

SEQ ID NO: 8225 - DNA, 103 bp, Artificial Sequence
  Synthetic Polynucleotide
taatacgactcactatagggtccattgcaataagggtgcacatgttgacaaacagaggagatgtcaaatggtgcaccctaacctggcggcagcgcaaaagatg

SEQ ID NO: 8226 - DNA, 103 bp, Artificial Sequence
  Synthetic Polynucleotide
taatacgactcactatagggcgcatagtgaaagtggcgtgacacataaggaacagaggagaccttatatgtcacgccacaacctggcggcagcgcaaaagatg

SEQ ID NO: 8227 - DNA, 103 bp, Artificial Sequence
  Synthetic Polynucleotide
taatacgactcactatagggggagacgcatagtgaaagtggcgtgacacaaacagaggagatgtgtcatgccactttcaaacctggcggcagcgcaaaagatg

SEQ ID NO: 8228 - DNA, 103 bp, Artificial Sequence
  Synthetic Polynucleotide
taatacgactcactatagggagacaggagacgcatagtgaaagtggcgtgaacagaggagacacgccatgttcactatgaacctggcggcagcgcaaaagatg

SEQ ID NO: 8229 - DNA, 103 bp, Artificial Sequence
  Synthetic Polynucleotide
taatacgactcactatagggacaggagacaggagacgcatagtgaaagtgaacagaggagacactttatgtatgcgtctaacctggcggcagcgcaaaagatg

SEQ ID NO: 8230 - DNA, 103 bp, Artificial Sequence
  Synthetic Polynucleotide
taatacgactcactatagggctctcacaggagacaggagacgcatagtgaaacagaggagatcactaatggtctcctgtaacctggcggcagcgcaaaagatg

SEQ ID NO: 8231 - DNA, 103 bp, Artificial Sequence
  Synthetic Polynucleotide
taatacgactcactataggggggaactctcacaggagacaggagacgcataacagaggagaatgcgtatgctgtctcctaacctggcggcagcgcaaaagatg

SEQ ID NO: 8232 - DNA, 103 bp, Artificial Sequence
  Synthetic Polynucleotide
taatacgactcactatagggtaattgggaactctcacaggagacaggagaaacagaggagatctcctatgtcctgtgagaacctggcggcagcgcaaaagatg

SEQ ID NO: 8233 - DNA, 103 bp, Artificial Sequence
  Synthetic Polynucleotide
taatacgactcactatagggtattataattgggaactctcacaggagacaaacagaggagatgtctcatgtgagagttcaacctggcggcagcgcaaaagatg

SEQ ID NO: 8234 - DNA, 103 bp, Artificial Sequence
  Synthetic Polynucleotide
taatacgactcactatagggaatcatattataattgggaactctcacaggaacagaggagacctgtgatggttcccaataacctggcggcagcgcaaaagatg

SEQ ID NO: 8235 - DNA, 103 bp, Artificial Sequence
  Synthetic Polynucleotide
taatacgactcactatagggatgataatcatattataattgggaactctcaacagaggagagagagtatgcaattataaaacctggcggcagcgcaaaagatg

SEQ ID NO: 8236 - DNA, 103 bp, Artificial Sequence
  Synthetic Polynucleotide
taatacgactcactatagggccaaatccattgcaataagggtgcacatgtaacagaggagaacatgtatgcccttattgaacctggcggcagcgcaaaagatg

SEQ ID NO: 8237 - DNA, 103 bp, Artificial Sequence
  Synthetic Polynucleotide
taatacgactcactatagggcatccatgataatcatattataattgggaaaacagaggagattcccaatgataatatgaaacctggcggcagcgcaaaagatg

SEQ ID NO: 8238 - DNA, 103 bp, Artificial Sequence
  Synthetic Polynucleotide
taatacgactcactatagggtgcttcatccatgataatcatattataattaacagaggagaaattatatgatgattatcaacctggcggcagcgcaaaagatg

SEQ ID NO: 8239 - DNA, 103 bp, Artificial Sequence
  Synthetic Polynucleotide
taatacgactcactatagggaaatgtgcttcatccatgataatcatattaaacagaggagataatatatgtatcatggaaacctggcggcagcgcaaaagatg

SEQ ID NO: 8240 - DNA, 103 bp, Artificial Sequence
  Synthetic Polynucleotide
taatacgactcactatagggcggtaaaatgtgcttcatccatgataatcaaacagaggagatgattaatgtggatgaagaacctggcggcagcgcaaaagatg

SEQ ID NO: 8241 - DNA, 103 bp, Artificial Sequence
  Synthetic Polynucleotide
taatacgactcactatagggtggatcggtaaaatgtgcttcatccatgataacagaggagaatcatgatggaagcacataacctggcggcagcgcaaaagatg

SEQ ID NO: 8242 - DNA, 103 bp, Artificial Sequence
  Synthetic Polynucleotide
taatacgactcactatagggctggctggatcggtaaaatgtgcttcatccaacagaggagaggatgaatgacattttacaacctggcggcagcgcaaaagatg

SEQ ID NO: 8243 - DNA, 103 bp, Artificial Sequence
  Synthetic Polynucleotide
taatacgactcactatagggctatgctggctggatcggtaaaatgtgcttaacagaggagaaagcacatgttaccgatcaacctggcggcagcgcaaaagatg

SEQ ID NO: 8244 - DNA, 103 bp, Artificial Sequence
  Synthetic Polynucleotide
taatacgactcactatagggggctgctatgctggctggatcggtaaaatgaacagaggagacattttatggatccagccaacctggcggcagcgcaaaagatg

SEQ ID NO: 8245 - DNA, 103 bp, Artificial Sequence
  Synthetic Polynucleotide
taatacgactcactatagggcctctggctgctatgctggctggatcggtaaacagaggagataccgaatgagccagcataacctggcggcagcgcaaaagatg

SEQ ID NO: 8246 - DNA, 103 bp, Artificial Sequence
  Synthetic Polynucleotide
taatacgactcactatagggtataccctctggctgctatgctggctggataacagaggagaatccagatggcatagcagaacctggcggcagcgcaaaagatg

SEQ ID NO: 8247 - DNA, 103 bp, Artificial Sequence
  Synthetic Polynucleotide
taatacgactcactatagggctctcccaaatccattgcaataagggtgcaaacagaggagatgcaccatgattgcaatgaacctggcggcagcgcaaaagatg

SEQ ID NO: 8248 - DNA, 103 bp, Artificial Sequence
  Synthetic Polynucleotide
taatacgactcactatagggtgagatataccctctggctgctatgctggcaacagaggagagccagcatggcagccagaaacctggcggcagcgcaaaagatg

SEQ ID NO: 8249 - DNA, 103 bp, Artificial Sequence
  Synthetic Polynucleotide
taatacgactcactatagggcgggttgagatataccctctggctgctatgaacagaggagacatagcatgcagagggtaaacctggcggcagcgcaaaagatg

SEQ ID NO: 8250 - DNA, 103 bp, Artificial Sequence
  Synthetic Polynucleotide
taatacgactcactatagggccactcgggttgagatataccctctggctgaacagaggagacagccaatgggtatatctaacctggcggcagcgcaaaagatg

SEQ ID NO: 8251 - DNA, 103 bp, Artificial Sequence
  Synthetic Polynucleotide
taatacgactcactatagggcatacccactcgggttgagatataccctctaacagaggagaagagggatgatctcaaccaacctggcggcagcgcaaaagatg

SEQ ID NO: 8252 - DNA, 103 bp, Artificial Sequence
  Synthetic Polynucleotide
taatacgactcactatagggtcacccatacccactcgggttgagatatacaacagaggagagtatatatgaacccgagtaacctggcggcagcgcaaaagatg

SEQ ID NO: 8253 - DNA, 103 bp, Artificial Sequence
  Synthetic Polynucleotide
taatacgactcactatagggctgcttcacccatacccactcgggttgagaaacagaggagatctcaaatggagtgggtaaacctggcggcagcgcaaaagatg

SEQ ID NO: 8254 - DNA, 103 bp, Artificial Sequence
  Synthetic Polynucleotide
taatacgactcactatagggcgcagctgcttcacccatacccactcgggtaacagaggagaacccgaatgggtatgggtaacctggcggcagcgcaaaagatg

SEQ ID NO: 8255 - DNA, 103 bp, Artificial Sequence
  Synthetic Polynucleotide
taatacgactcactatagggaaaatcgcagctgcttcacccatacccactaacagaggagaagtgggatggggtgaagcaacctggcggcagcgcaaaagatg

SEQ ID NO: 8256 - DNA, 103 bp, Artificial Sequence
  Synthetic Polynucleotide
taatacgactcactatagggtcatgaaaatcgcagctgcttcacccatacaacagaggagagtatggatgaagcagctgaacctggcggcagcgcaaaagatg

SEQ ID NO: 8257 - DNA, 103 bp, Artificial Sequence
  Synthetic Polynucleotide
taatacgactcactatagggggctgtcatgaaaatcgcagctgcttcaccaacagaggagaggtgaaatggctgcgattaacctggcggcagcgcaaaagatg

SEQ ID NO: 8258 - DNA, 103 bp, Artificial Sequence
  Synthetic Polynucleotide
taatacgactcactatagggcataactctcccaaatccattgcaataaggaacagaggagaccttatatgaatggatttaacctggcggcagcgcaaaagatg

SEQ ID NO: 8259 - DNA, 103 bp, Artificial Sequence
  Synthetic Polynucleotide
taatacgactcactatagggggagtggctgtcatgaaaatcgcagctgctaacagaggagaagcagcatggattttcataacctggcggcagcgcaaaagatg

SEQ ID NO: 8260 - DNA, 103 bp, Artificial Sequence
  Synthetic Polynucleotide
taatacgactcactatagggcggggggagtggctgtcatgaaaatcgcagaacagaggagactgcgaatgtcatgacagaacctggcggcagcgcaaaagatg

SEQ ID NO: 8261 - DNA, 103 bp, Artificial Sequence
  Synthetic Polynucleotide
taatacgactcactatagggcgatccggggggagtggctgtcatgaaaataacagaggagaattttcatgacagccactaacctggcggcagcgcaaaagatg

SEQ ID NO: 8262 - DNA, 103 bp, Artificial Sequence
  Synthetic Polynucleotide
taatacgactcactatagggtccaccgatccggggggagtggctgtcatgaacagaggagacatgacatgcactcccccaacctggcggcagcgcaaaagatg

SEQ ID NO: 8263 - DNA, 103 bp, Artificial Sequence
  Synthetic Polynucleotide
taatacgactcactatagggaggcctccaccgatccggggggagtggctgaacagaggagacagccaatgcccccggataacctggcggcagcgcaaaagatg

SEQ ID NO: 8264 - DNA, 103 bp, Artificial Sequence
  Synthetic Polynucleotide
taatacgactcactatagggtggaaaggcctccaccgatccggggggagtaacagaggagaactcccatgggatcggtgaacctggcggcagcgcaaaagatg

SEQ ID NO: 8265 - DNA, 103 bp, Artificial Sequence
  Synthetic Polynucleotide
taatacgactcactatagggctctgtggaaaggcctccaccgatccggggaacagaggagaccccggatgggtggaggcaacctggcggcagcgcaaaagatg

SEQ ID NO: 8266 - DNA, 103 bp, Artificial Sequence
  Synthetic Polynucleotide
taatacgactcactatagggcattgctctgtggaaaggcctccaccgatcaacagaggagagatcggatgaggcctttcaacctggcggcagcgcaaaagatg

SEQ ID NO: 8267 - DNA, 103 bp, Artificial Sequence
  Synthetic Polynucleotide
taatacgactcactatagggaactgcattgctctgtggaaaggcctccacaacagaggagagtggagatgtttccacagaacctggcggcagcgcaaaagatg

SEQ ID NO: 8268 - DNA, 103 bp, Artificial Sequence
  Synthetic Polynucleotide
taatacgactcactatagggtggataactgcattgctctgtggaaaggccaacagaggagaggccttatgacagagcaaaacctggcggcagcgcaaaagatg

SEQ ID NO: 8269 - DNA, 103 bp, Artificial Sequence
  Synthetic Polynucleotide
taatacgactcactatagggctaataaaaaactgttagaactacgttaagaacagaggagacttaacatggttctaacaaacctggcggcagcgcaaaagatg

SEQ ID NO: 8270 - DNA, 103 bp, Artificial Sequence
  Synthetic Polynucleotide
taatacgactcactatagggcctcacataactctcccaaatccattgcaaaacagaggagattgcaaatgatttgggagaacctggcggcagcgcaaaagatg

SEQ ID NO: 8271 - DNA, 103 bp, Artificial Sequence
  Synthetic Polynucleotide
taatacgactcactatagggcatcttggataactgcattgctctgtggaaaacagaggagattccacatggcaatgcagaacctggcggcagcgcaaaagatg

SEQ ID NO: 8272 - DNA, 103 bp, Artificial Sequence
  Synthetic Polynucleotide
taatacgactcactatagggttcctcatcttggataactgcattgctctgaacagaggagacagagcatggcagttatcaacctggcggcagcgcaaaagatg

SEQ ID NO: 8273 - DNA, 103 bp, Artificial Sequence
  Synthetic Polynucleotide
taatacgactcactatagggtctctttcctcatcttggataactgcattgaacagaggagacaatgcatgtatccaagaaacctggcggcagcgcaaaagatg

SEQ ID NO: 8274 - DNA, 103 bp, Artificial Sequence
  Synthetic Polynucleotide
taatacgactcactataggggaatgtctctttcctcatcttggataactgaacagaggagacagttaatgaagatgaggaacctggcggcagcgcaaaagatg

SEQ ID NO: 8275 - DNA, 103 bp, Artificial Sequence
  Synthetic Polynucleotide
taatacgactcactatagggttcaggaatgtctctttcctcatcttggataacagaggagaatccaaatggaggaaagaaacctggcggcagcgcaaaagatg

SEQ ID NO: 8276 - DNA, 103 bp, Artificial Sequence
  Synthetic Polynucleotide
taatacgactcactataggggatctttcaggaatgtctctttcctcatctaacagaggagaagatgaatgaagagacataacctggcggcagcgcaaaagatg

SEQ ID NO: 8277 - DNA, 103 bp, Artificial Sequence
  Synthetic Polynucleotide
taatacgactcactatagggtccatgatctttcaggaatgtctctttcctaacagaggagaaggaaaatgacattcctgaacctggcggcagcgcaaaagatg

SEQ ID NO: 8278 - DNA, 103 bp, Artificial Sequence
  Synthetic Polynucleotide
taatacgactcactatagggtgagttccatgatctttcaggaatgtctctaacagaggagaagagacatgcctgaaagaaacctggcggcagcgcaaaagatg

SEQ ID NO: 8279 - DNA, 103 bp, Artificial Sequence
  Synthetic Polynucleotide
taatacgactcactatagggtagcctgagttccatgatctttcaggaatgaacagaggagacattccatgaagatcatgaacctggcggcagcgcaaaagatg

SEQ ID NO: 8280 - DNA, 103 bp, Artificial Sequence
  Synthetic Polynucleotide
taatacgactcactatagggagtcatagcctgagttccatgatctttcagaacagaggagactgaaaatgcatggaactaacctggcggcagcgcaaaagatg

SEQ ID NO: 8281 - DNA, 103 bp, Artificial Sequence
  Synthetic Polynucleotide
taatacgactcactatagggtgtgtcctcacataactctcccaaatccataacagaggagaatggatatgggagagttaaacctggcggcagcgcaaaagatg

SEQ ID NO: 8282 - DNA, 103 bp, Artificial Sequence
  Synthetic Polynucleotide
taatacgactcactataggggatccagtcatagcctgagttccatgatctaacagaggagaagatcaatgaactcaggcaacctggcggcagcgcaaaagatg

SEQ ID NO: 8283 - DNA, 103 bp, Artificial Sequence
  Synthetic Polynucleotide
taatacgactcactatagggtcagtgatccagtcatagcctgagttccataacagaggagaatggaaatgaggctatgaaacctggcggcagcgcaaaagatg

SEQ ID NO: 8284 - DNA, 103 bp, Artificial Sequence
  Synthetic Polynucleotide
taatacgactcactatagggggaaatcagtgatccagtcatagcctgagtaacagaggagaactcagatgatgactggaaacctggcggcagcgcaaaagatg

SEQ ID NO: 8285 - DNA, 103 bp, Artificial Sequence
  Synthetic Polynucleotide
taatacgactcactatagggacctgggaaatcagtgatccagtcatagccaacagaggagaggctatatgtggatcactaacctggcggcagcgcaaaagatg

SEQ ID NO: 8286 - DNA, 103 bp, Artificial Sequence
  Synthetic Polynucleotide
taatacgactcactataggggttttacctgggaaatcagtgatccagtcaaacagaggagatgactgatgcactgatttaacctggcggcagcgcaaaagatg

SEQ ID NO: 8287 - DNA, 103 bp, Artificial Sequence
  Synthetic Polynucleotide
taatacgactcactatagggagactgttttacctgggaaatcagtgatccaacagaggagaggatcaatgatttcccagaacctggcggcagcgcaaaagatg

SEQ ID NO: 8288 - DNA, 103 bp, Artificial Sequence
  Synthetic Polynucleotide
taatacgactcactatagggaaaccagactgttttacctgggaaatcagtaacagaggagaactgatatgccaggtaaaaacctggcggcagcgcaaaagatg

SEQ ID NO: 8289 - DNA, 103 bp, Artificial Sequence
  Synthetic Polynucleotide
taatacgactcactatagggggaacaaaccagactgttttacctgggaaaaacagaggagatttcccatgtaaaacagtaacctggcggcagcgcaaaagatg

SEQ ID NO: 8290 - DNA, 103 bp, Artificial Sequence
  Synthetic Polynucleotide
taatacgactcactatagggtgcttggaacaaaccagactgttttacctgaacagaggagacaggtaatgcagtctggtaacctggcggcagcgcaaaagatg

SEQ ID NO: 8291 - DNA, 103 bp, Artificial Sequence
  Synthetic Polynucleotide
taatacgactcactatagggtttgatgcttggaacaaaccagactgttttaacagaggagaaaaacaatgtggtttgttaacctggcggcagcgcaaaagatg

SEQ ID NO: 8292 - DNA, 103 bp, Artificial Sequence
  Synthetic Polynucleotide
taatacgactcactataggggtcattgtgtcctcacataactctcccaaaaacagaggagatttgggatggttatgtgaaacctggcggcagcgcaaaagatg

SEQ ID NO: 8293 - DNA, 103 bp, Artificial Sequence
  Synthetic Polynucleotide
taatacgactcactatagggcctgatttgatgcttggaacaaaccagactaacagaggagaagtctgatgtgttccaagaacctggcggcagcgcaaaagatg

SEQ ID NO: 8294 - DNA, 103 bp, Artificial Sequence
  Synthetic Polynucleotide
taatacgactcactatagggcatttcctgatttgatgcttggaacaaaccaacagaggagaggtttgatgcaagcatcaaacctggcggcagcgcaaaagatg

SEQ ID NO: 8295 - DNA, 103 bp, Artificial Sequence
  Synthetic Polynucleotide
taatacgactcactatagggaatgtcatttcctgatttgatgcttggaacaacagaggagagttccaatgatcaaatcaaacctggcggcagcgcaaaagatg

SEQ ID NO: 8296 - DNA, 103 bp, Artificial Sequence
  Synthetic Polynucleotide
taatacgactcactatagggttggcaatgtcatttcctgatttgatgcttaacagaggagaaagcatatgatcaggaaaaacctggcggcagcgcaaaagatg

SEQ ID NO: 8297 - DNA, 103 bp, Artificial Sequence
  Synthetic Polynucleotide
taatacgactcactatagggaacagttggcaatgtcatttcctgatttgaaacagaggagatcaaatatggaaatgacaaacctggcggcagcgcaaaagatg

SEQ ID NO: 8298 - DNA, 103 bp, Artificial Sequence
  Synthetic Polynucleotide
taatacgactcactatagggtcttaaacagttggcaatgtcatttcctgaaacagaggagatcaggaatggacattgccaacctggcggcagcgcaaaagatg

SEQ ID NO: 8299 - DNA, 103 bp, Artificial Sequence
  Synthetic Polynucleotide
taatacgactcactatagggttctttcttaaacagttggcaatgtcatttaacagaggagaaaatgaatgtgccaactgaacctggcggcagcgcaaaagatg

SEQ ID NO: 8300 - DNA, 103 bp, Artificial Sequence
  Synthetic Polynucleotide
taatacgactcactatagggtcccattctttcttaaacagttggcaatgtaacagaggagaacattgatgactgtttaaaacctggcggcagcgcaaaagatg

SEQ ID NO: 8301 - DNA, 103 bp, Artificial Sequence
  Synthetic Polynucleotide
taatacgactcactatagggccgtttcccattctttcttaaacagttggcaacagaggagagccaacatgttaagaaagaacctggcggcagcgcaaaagatg

SEQ ID NO: 8302 - DNA, 103 bp, Artificial Sequence
  Synthetic Polynucleotide
taatacgactcactatagggaccacccgtttcccattctttcttaaacagaacagaggagactgtttatgaaagaatggaacctggcggcagcgcaaaagatg

SEQ ID NO: 8303 - DNA, 103 bp, Artificial Sequence
  Synthetic Polynucleotide
taatacgactcactatagggtgtaggtcattgtgtcctcacataactctcaacagaggagagagagtatggtgaggacaaacctggcggcagcgcaaaagatg

SEQ ID NO: 8304 - DNA, 103 bp, Artificial Sequence
  Synthetic Polynucleotide
taatacgactcactatagggattggaccacccgtttcccattctttcttaaacagaggagataagaaatgatgggaaacaacctggcggcagcgcaaaagatg

SEQ ID NO: 8305 - DNA, 103 bp, Artificial Sequence
  Synthetic Polynucleotide
taatacgactcactataggggctcaattggaccacccgtttcccattcttaacagaggagaaagaatatgaaacgggtgaacctggcggcagcgcaaaagatg

SEQ ID NO: 8306 - DNA, 103 bp, Artificial Sequence
  Synthetic Polynucleotide
taatacgactcactatagggtttctgctcaattggaccacccgtttcccaaacagaggagatgggaaatgggtggtccaaacctggcggcagcgcaaaagatg

SEQ ID NO: 8307 - DNA, 103 bp, Artificial Sequence
  Synthetic Polynucleotide
taatacgactcactatagggaagtttttctgctcaattggaccacccgttaacagaggagaaacgggatgtccaattgaaacctggcggcagcgcaaaagatg

SEQ ID NO: 8308 - DNA, 103 bp, Artificial Sequence
  Synthetic Polynucleotide
taatacgactcactataggggtcaaaagtttttctgctcaattggaccacaacagaggagagtggtcatgttgagcagaaacctggcggcagcgcaaaagatg

SEQ ID NO: 8309 - DNA, 103 bp, Artificial Sequence
  Synthetic Polynucleotide
taatacgactcactatagggtcagtgtcaaaagtttttctgctcaattggaacagaggagaccaattatgcagaaaaacaacctggcggcagcgcaaaagatg

SEQ ID NO: 8310 - DNA, 103 bp, Artificial Sequence
  Synthetic Polynucleotide
taatacgactcactatagggggtactcagtgtcaaaagtttttctgctcaaacagaggagatgagcaatgaaacttttgaacctggcggcagcgcaaaagatg

SEQ ID NO: 8311 - DNA, 103 bp, Artificial Sequence
  Synthetic Polynucleotide
taatacgactcactatagggtttctggtactcagtgtcaaaagtttttctaacagaggagaagaaaaatgtttgacactaacctggcggcagcgcaaaagatg

SEQ ID NO: 8312 - DNA, 103 bp, Artificial Sequence
  Synthetic Polynucleotide
taatacgactcactatagggtttgttttctggtactcagtgtcaaaagttaacagaggagaaactttatgcactgagtaaacctggcggcagcgcaaaagatg

SEQ ID NO: 8313 - DNA, 103 bp, Artificial Sequence
  Synthetic Polynucleotide
taatacgactcactatagggtattttttgttttctggtactcagtgtcaaaacagaggagattgacaatgagtaccagaaacctggcggcagcgcaaaagatg

SEQ ID NO: 8314 - DNA, 103 bp, Artificial Sequence
  Synthetic Polynucleotide
taatacgactcactataggggcatttgtaggtcattgtgtcctcacataaaacagaggagattatgtatggacacaatgaacctggcggcagcgcaaaagatg

SEQ ID NO: 8315 - DNA, 103 bp, Artificial Sequence
  Synthetic Polynucleotide
taatacgactcactataggggtcgttattttttgttttctggtactcagtaacagaggagaactgagatgcagaaaacaaacctggcggcagcgcaaaagatg

SEQ ID NO: 8316 - DNA, 103 bp, Artificial Sequence
  Synthetic Polynucleotide
taatacgactcactatagggtcccagtcgttattttttgttttctggtacaacagaggagagtaccaatgaacaaaaaaaacctggcggcagcgcaaaagatg

SEQ ID NO: 8317 - DNA, 103 bp, Artificial Sequence
  Synthetic Polynucleotide
taatacgactcactatagggcatagtcccagtcgttattttttgttttctaacagaggagaagaaaaatgaaaataacgaacctggcggcagcgcaaaagatg

SEQ ID NO: 8318 - DNA, 103 bp, Artificial Sequence
  Synthetic Polynucleotide
taatacgactcactataggggacaacatagtcccagtcgttattttttgtaacagaggagaacaaaaatgaacgactggaacctggcggcagcgcaaaagatg

SEQ ID NO: 8319 - DNA, 103 bp, Artificial Sequence
  Synthetic Polynucleotide
taatacgactcactataggggttgtgacaacatagtcccagtcgttatttaacagaggagaaaataaatgctgggactaaacctggcggcagcgcaaaagatg

SEQ ID NO: 8320 - DNA, 103 bp, Artificial Sequence
  Synthetic Polynucleotide
taatacgactcactatagggtgtctgttgtgacaacatagtcccagtcgtaacagaggagaacgactatgactatgttgaacctggcggcagcgcaaaagatg

SEQ ID NO: 8321 - DNA, 103 bp, Artificial Sequence
  Synthetic Polynucleotide
taatacgactcactatagggggatatgtctgttgtgacaacatagtcccaaacagaggagatgggacatggttgtcacaaacctggcggcagcgcaaaagatg

SEQ ID NO: 8322 - DNA, 103 bp, Artificial Sequence
  Synthetic Polynucleotide
taatacgactcactatagggatttcggatatgtctgttgtgacaacatagaacagaggagactatgtatgcacaacagaaacctggcggcagcgcaaaagatg

SEQ ID NO: 8323 - DNA, 103 bp, Artificial Sequence
  Synthetic Polynucleotide
taatacgactcactatagggctcccatttcggatatgtctgttgtgacaaaacagaggagattgtcaatgcagacatataacctggcggcagcgcaaaagatg

SEQ ID NO: 8324 - DNA, 103 bp, Artificial Sequence
  Synthetic Polynucleotide
taatacgactcactataggggtttgctcccatttcggatatgtctgttgtaacagaggagaacaacaatgatatccgaaaacctggcggcagcgcaaaagatg

SEQ ID NO: 8325 - DNA, 103 bp, Artificial Sequence
  Synthetic Polynucleotide
taatacgactcactatagggcgggggcatttgtaggtcattgtgtcctcaaacagaggagatgaggaatgaatgacctaaacctggcggcagcgcaaaagatg

SEQ ID NO: 8326 - DNA, 103 bp, Artificial Sequence
  Synthetic Polynucleotide
taatacgactcactatagggcggaagtttgctcccatttcggatatgtctaacagaggagaagacatatgcgaaatgggaacctggcggcagcgcaaaagatg

SEQ ID NO: 8327 - DNA, 103 bp, Artificial Sequence
  Synthetic Polynucleotide
taatacgactcactatagggcggctcggaagtttgctcccatttcggataaacagaggagatatccgatgtgggagcaaaacctggcggcagcgcaaaagatg

SEQ ID NO: 8328 - DNA, 103 bp, Artificial Sequence
  Synthetic Polynucleotide
taatacgactcactatagggcctgtcggctcggaagtttgctcccatttcaacagaggagagaaatgatggcaaacttcaacctggcggcagcgcaaaagatg

SEQ ID NO: 8329 - DNA, 103 bp, Artificial Sequence
  Synthetic Polynucleotide
taatacgactcactatagggattaccctgtcggctcggaagtttgctcccaacagaggagagggagcatgcttccgagcaacctggcggcagcgcaaaagatg

SEQ ID NO: 8330 - DNA, 103 bp, Artificial Sequence
  Synthetic Polynucleotide
taatacgactcactatagggggtctattaccctgtcggctcggaagtttgaacagaggagacaaactatggagccgacaaacctggcggcagcgcaaaagatg

SEQ ID NO: 8331 - DNA, 103 bp, Artificial Sequence
  Synthetic Polynucleotide
taatacgactcactatagggcctcgggtctattaccctgtcggctcggaaaacagaggagattccgaatggacagggtaaacctggcggcagcgcaaaagatg

SEQ ID NO: 8332 - DNA, 103 bp, Artificial Sequence
  Synthetic Polynucleotide
taatacgactcactatagggcaccgcctcgggtctattaccctgtcggctaacagaggagaagccgaatgggtaatagaaacctggcggcagcgcaaaagatg

SEQ ID NO: 8333 - DNA, 103 bp, Artificial Sequence
  Synthetic Polynucleotide
taatacgactcactatagggtcaggcaccgcctcgggtctattaccctgtaacagaggagaacagggatgtagacccgaaacctggcggcagcgcaaaagatg

SEQ ID NO: 8334 - DNA, 103 bp, Artificial Sequence
  Synthetic Polynucleotide
taatacgactcactatagggcggtttcaggcaccgcctcgggtctattacaacagaggagagtaataatgccgaggcggaacctggcggcagcgcaaaagatg

SEQ ID NO: 8335 - DNA, 103 bp, Artificial Sequence
  Synthetic Polynucleotide
taatacgactcactatagggattaccggtttcaggcaccgcctcgggtctaacagaggagaagacccatggcggtgcctaacctggcggcagcgcaaaagatg

SEQ ID NO: 8336 - DNA, 103 bp, Artificial Sequence
  Synthetic Polynucleotide
taatacgactcactatagggtgatccgggggcatttgtaggtcattgtgtaacagaggagaacacaaatgcctacaaataacctggcggcagcgcaaaagatg

SEQ ID NO: 8337 - DNA, 103 bp, Artificial Sequence
  Synthetic Polynucleotide
taatacgactcactatagggttagtattaccggtttcaggcaccgcctcgaacagaggagacgaggcatggcctgaaacaacctggcggcagcgcaaaagatg

SEQ ID NO: 8338 - DNA, 103 bp, Artificial Sequence
  Synthetic Polynucleotide
taatacgactcactatagggatcttttagtattaccggtttcaggcaccgaacagaggagacggtgcatgaaaccggtaaacctggcggcagcgcaaaagatg

SEQ ID NO: 8339 - DNA, 103 bp, Artificial Sequence
  Synthetic Polynucleotide
taatacgactcactataggggggccatcttttagtattaccggtttcaggaacagaggagacctgaaatgggtaatactaacctggcggcagcgcaaaagatg

SEQ ID NO: 8340 - DNA, 103 bp, Artificial Sequence
  Synthetic Polynucleotide
taatacgactcactataggggctctgggccatcttttagtattaccggttaacagaggagaaaccggatgtactaaaagaacctggcggcagcgcaaaagatg

SEQ ID NO: 8341 - DNA, 103 bp, Artificial Sequence
  Synthetic Polynucleotide
taatacgactcactataggggacacgctctgggccatcttttagtattacaacagaggagagtaataatgaaagatggcaacctggcggcagcgcaaaagatg

SEQ ID NO: 8342 - DNA, 103 bp, Artificial Sequence
  Synthetic Polynucleotide
taatacgactcactatagggagaatgacacgctctgggccatcttttagtaacagaggagaactaaaatgtggcccagaaacctggcggcagcgcaaaagatg

SEQ ID NO: 8343 - DNA, 103 bp, Artificial Sequence
  Synthetic Polynucleotide
taatacgactcactatagggcggctagaatgacacgctctgggccatcttaacagaggagaaagatgatgcagagcgtgaacctggcggcagcgcaaaagatg

SEQ ID NO: 8344 - DNA, 103 bp, Artificial Sequence
  Synthetic Polynucleotide
taatacgactcactatagggcggtccggctagaatgacacgctctgggccaacagaggagaggcccaatgcgtgtcattaacctggcggcagcgcaaaagatg

SEQ ID NO: 8345 - DNA, 103 bp, Artificial Sequence
  Synthetic Polynucleotide
taatacgactcactatagggggcatcggtccggctagaatgacacgctctaacagaggagaagagcgatgcattctagcaacctggcggcagcgcaaaagatg

SEQ ID NO: 8346 - DNA, 103 bp, Artificial Sequence
  Synthetic Polynucleotide
taatacgactcactatagggtcactggcatcggtccggctagaatgacacaacagaggagagtgtcaatgtagccggacaacctggcggcagcgcaaaagatg

SEQ ID NO: 8347 - DNA, 103 bp, Artificial Sequence
  Synthetic Polynucleotide
taatacgactcactatagggctcagtgatccgggggcatttgtaggtcataacagaggagaatgaccatgaaatgccccaacctggcggcagcgcaaaagatg

SEQ ID NO: 8348 - DNA, 103 bp, Artificial Sequence
  Synthetic Polynucleotide
taatacgactcactatagggcacagtcactggcatcggtccggctagaataacagaggagaattctaatgggaccgatgaacctggcggcagcgcaaaagatg

SEQ ID NO: 8349 - DNA, 103 bp, Artificial Sequence
  Synthetic Polynucleotide
taatacgactcactatagggctagccacagtcactggcatcggtccggctaacagaggagaagccggatggatgccagtaacctggcggcagcgcaaaagatg

SEQ ID NO: 8350 - DNA, 103 bp, Artificial Sequence
  Synthetic Polynucleotide
taatacgactcactatagggcggcgctagccacagtcactggcatcggtcaacagaggagagaccgaatgcagtgactgaacctggcggcagcgcaaaagatg

SEQ ID NO: 8351 - DNA, 103 bp, Artificial Sequence
  Synthetic Polynucleotide
taatacgactcactatagggctgggcggcgctagccacagtcactggcataacagaggagaatgccaatgactgtggctaacctggcggcagcgcaaaagatg

SEQ ID NO: 8352 - DNA, 103 bp, Artificial Sequence
  Synthetic Polynucleotide
taatacgactcactatagggctcctctgggcggcgctagccacagtcactaacagaggagaagtgacatgggctagcgcaacctggcggcagcgcaaaagatg

SEQ ID NO: 8353 - DNA, 103 bp, Artificial Sequence
  Synthetic Polynucleotide
taatacgactcactatagggttcctctcctctgggcggcgctagccacagaacagaggagactgtggatggcgccgcccaacctggcggcagcgcaaaagatg

SEQ ID NO: 8354 - DNA, 103 bp, Artificial Sequence
  Synthetic Polynucleotide
taatacgactcactatagggaattcttcctctcctctgggcggcgctagcaacagaggagagctagcatggcccagaggaacctggcggcagcgcaaaagatg

SEQ ID NO: 8355 - DNA, 103 bp, Artificial Sequence
  Synthetic Polynucleotide
taatacgactcactatagggcttccaattcttcctctcctctgggcggcgaacagaggagacgccgcatggaggagaggaacctggcggcagcgcaaaagatg

SEQ ID NO: 8356 - DNA, 103 bp, Artificial Sequence
  Synthetic Polynucleotide
taatacgactcactatagggggttccttccaattcttcctctcctctgggaacagaggagacccagaatggaggaagaaaacctggcggcagcgcaaaagatg

SEQ ID NO: 8357 - DNA, 103 bp, Artificial Sequence
  Synthetic Polynucleotide
taatacgactcactatagggattttggttccttccaattcttcctctcctaacagaggagaaggagaatgagaattggaaacctggcggcagcgcaaaagatg

SEQ ID NO: 8358 - DNA, 103 bp, Artificial Sequence
  Synthetic Polynucleotide
taatacgactcactatagggtccgtctcagtgatccgggggcatttgtagaacagaggagactacaaatgcccccggataacctggcggcagcgcaaaagatg

SEQ ID NO: 8359 - DNA, 103 bp, Artificial Sequence
  Synthetic Polynucleotide
taatacgactcactatagggtccttattttggttccttccaattcttcctaacagaggagaaggaagatgtggaaggaaaacctggcggcagcgcaaaagatg

SEQ ID NO: 8360 - DNA, 103 bp, Artificial Sequence
  Synthetic Polynucleotide
taatacgactcactatagggcgccttccttattttggttccttccaattcaacagaggagagaattgatgggaaccaaaaacctggcggcagcgcaaaagatg

SEQ ID NO: 8361 - DNA, 103 bp, Artificial Sequence
  Synthetic Polynucleotide
taatacgactcactatagggctgatcgccttccttattttggttccttccaacagaggagaggaaggatgcaaaataagaacctggcggcagcgcaaaagatg

SEQ ID NO: 8362 - DNA, 103 bp, Artificial Sequence
  Synthetic Polynucleotide
taatacgactcactatagggatatactgatcgccttccttattttggttcaacagaggagagaaccaatgtaaggaaggaacctggcggcagcgcaaaagatg

SEQ ID NO: 8363 - DNA, 103 bp, Artificial Sequence
  Synthetic Polynucleotide
taatacgactcactatagggtgtaaatatactgatcgccttccttattttaacagaggagaaaaataatgaaggcgatcaacctggcggcagcgcaaaagatg

SEQ ID NO: 8364 - DNA, 103 bp, Artificial Sequence
  Synthetic Polynucleotide
taatacgactcactatagggtcccatgtaaatatactgatcgccttccttaacagaggagaaaggaaatggatcagtataacctggcggcagcgcaaaagatg

SEQ ID NO: 8365 - DNA, 103 bp, Artificial Sequence
  Synthetic Polynucleotide
taatacgactcactatagggggctgtcccatgtaaatatactgatcgcctaacagaggagaaggcgaatggtatatttaaacctggcggcagcgcaaaagatg

SEQ ID NO: 8366 - DNA, 103 bp, Artificial Sequence
  Synthetic Polynucleotide
taatacgactcactatagggttagaggctgtcccatgtaaatatactgataacagaggagaatcagtatgtttacatggaacctggcggcagcgcaaaagatg

SEQ ID NO: 8367 - DNA, 103 bp, Artificial Sequence
  Synthetic Polynucleotide
taatacgactcactatagggattgtttagaggctgtcccatgtaaatataaacagaggagatatattatgatgggacagaacctggcggcagcgcaaaagatg

SEQ ID NO: 8368 - DNA, 103 bp, Artificial Sequence
  Synthetic Polynucleotide
taatacgactcactatagggtcatcattgtttagaggctgtcccatgtaaaacagaggagattacatatgacagcctctaacctggcggcagcgcaaaagatg

SEQ ID NO: 8369 - DNA, 103 bp, Artificial Sequence
  Synthetic Polynucleotide
taatacgactcactatagggctggttccgtctcagtgatccgggggcattaacagaggagaaatgccatgggatcactgaacctggcggcagcgcaaaagatg

SEQ ID NO: 8370 - DNA, 103 bp, Artificial Sequence
  Synthetic Polynucleotide
taatacgactcactatagggggtcctcatcattgtttagaggctgtcccaaacagaggagatgggacatgctctaaacaaacctggcggcagcgcaaaagatg

SEQ ID NO: 8371 - DNA, 103 bp, Artificial Sequence
  Synthetic Polynucleotide
taatacgactcactatagggggcgtggtcctcatcattgtttagaggctgaacagaggagacagcctatgaacaatgataacctggcggcagcgcaaaagatg

SEQ ID NO: 8372 - DNA, 103 bp, Artificial Sequence
  Synthetic Polynucleotide
taatacgactcactatagggcaatgggcgtggtcctcatcattgtttagaaacagaggagatctaaaatgtgatgaggaaacctggcggcagcgcaaaagatg

SEQ ID NO: 8373 - DNA, 103 bp, Artificial Sequence
  Synthetic Polynucleotide
taatacgactcactatagggctgtccaatgggcgtggtcctcatcattgtaacagaggagaacaatgatgaggaccacgaacctggcggcagcgcaaaagatg

SEQ ID NO: 8374 - DNA, 103 bp, Artificial Sequence
  Synthetic Polynucleotide
taatacgactcactatagggtgcttctgtccaatgggcgtggtcctcatcaacagaggagagatgagatgcacgcccataacctggcggcagcgcaaaagatg

SEQ ID NO: 8375 - DNA, 103 bp, Artificial Sequence
  Synthetic Polynucleotide
taatacgactcactatagggatttttgcttctgtccaatgggcgtggtccaacagaggagaggaccaatgccattggacaacctggcggcagcgcaaaagatg

SEQ ID NO: 8376 - DNA, 103 bp, Artificial Sequence
  Synthetic Polynucleotide
taatacgactcactatagggggagcatttttgcttctgtccaatgggcgtaacagaggagaacgcccatgggacagaagaacctggcggcagcgcaaaagatg

SEQ ID NO: 8377 - DNA, 103 bp, Artificial Sequence
  Synthetic Polynucleotide
taatacgactcactataggggtcaaggagcatttttgcttctgtccaatgaacagaggagacattggatggaagcaaaaaacctggcggcagcgcaaaagatg

SEQ ID NO: 8378 - DNA, 103 bp, Artificial Sequence
  Synthetic Polynucleotide
taatacgactcactatagggatgttgtcaaggagcatttttgcttctgtcaacagaggagagacagaatgaaaaatgctaacctggcggcagcgcaaaagatg

SEQ ID NO: 8379 - DNA, 103 bp, Artificial Sequence
  Synthetic Polynucleotide
taatacgactcactatagggtgtttatgttgtcaaggagcatttttgcttaacagaggagaaagcaaatgtgctccttgaacctggcggcagcgcaaaagatg

SEQ ID NO: 8380 - DNA, 103 bp, Artificial Sequence
  Synthetic Polynucleotide
taatacgactcactataggggctctctaataaaaaactgttagaactacgaacagaggagacgtagtatgaacagttttaacctggcggcagcgcaaaagatg

SEQ ID NO: 8381 - DNA, 103 bp, Artificial Sequence
  Synthetic Polynucleotide
taatacgactcactataggggtcatctggttccgtctcagtgatccggggaacagaggagaccccggatgactgagacgaacctggcggcagcgcaaaagatg

SEQ ID NO: 8382 - DNA, 103 bp, Artificial Sequence
  Synthetic Polynucleotide
taatacgactcactatagggtggtgtgtttatgttgtcaaggagcattttaacagaggagaaaaatgatgcttgacaacaacctggcggcagcgcaaaagatg

SEQ ID NO: 8383 - DNA, 103 bp, Artificial Sequence
  Synthetic Polynucleotide
taatacgactcactatagggccttctggtgtgtttatgttgtcaaggagcaacagaggagagctcctatgcaacataaaaacctggcggcagcgcaaaagatg

SEQ ID NO: 8384 - DNA, 103 bp, Artificial Sequence
  Synthetic Polynucleotide
taatacgactcactatagggtaatcccttctggtgtgtttatgttgtcaaaacagaggagattgacaatgtaaacacacaacctggcggcagcgcaaaagatg

SEQ ID NO: 8385 - DNA, 103 bp, Artificial Sequence
  Synthetic Polynucleotide
taatacgactcactatagggtgggataatcccttctggtgtgtttatgttaacagaggagaaacataatgacaccagaaaacctggcggcagcgcaaaagatg

SEQ ID NO: 8386 - DNA, 103 bp, Artificial Sequence
  Synthetic Polynucleotide
taatacgactcactatagggagggctgggataatcccttctggtgtgtttaacagaggagaaaacacatgagaagggataacctggcggcagcgcaaaagatg

SEQ ID NO: 8387 - DNA, 103 bp, Artificial Sequence
  Synthetic Polynucleotide
taatacgactcactatagggcaaagagggctgggataatcccttctggtgaacagaggagacaccagatgggattatccaacctggcggcagcgcaaaagatg

SEQ ID NO: 8388 - DNA, 103 bp, Artificial Sequence
  Synthetic Polynucleotide
taatacgactcactatagggcggctcaaagagggctgggataatcccttcaacagaggagagaagggatgatcccagccaacctggcggcagcgcaaaagatg

SEQ ID NO: 8389 - DNA, 103 bp, Artificial Sequence
  Synthetic Polynucleotide
taatacgactcactatagggctctccggctcaaagagggctgggataatcaacagaggagagattatatgagccctcttaacctggcggcagcgcaaaagatg

SEQ ID NO: 8390 - DNA, 103 bp, Artificial Sequence
  Synthetic Polynucleotide
taatacgactcactatagggtttctctctccggctcaaagagggctgggaaacagaggagatcccagatgtctttgagcaacctggcggcagcgcaaaagatg

SEQ ID NO: 8391 - DNA, 103 bp, Artificial Sequence
  Synthetic Polynucleotide
taatacgactcactatagggactcttttctctctccggctcaaagagggcaacagaggagagccctcatggagccggagaacctggcggcagcgcaaaagatg

SEQ ID NO: 8392 - DNA, 103 bp, Artificial Sequence
  Synthetic Polynucleotide
taatacgactcactatagggtcaacgtcatctggttccgtctcagtgatcaacagaggagagatcacatggacggaaccaacctggcggcagcgcaaaagatg

SEQ ID NO: 8393 - DNA, 103 bp, Artificial Sequence
  Synthetic Polynucleotide
taatacgactcactataggggctgcactcttttctctctccggctcaaagaacagaggagactttgaatgggagagagaaacctggcggcagcgcaaaagatg

SEQ ID NO: 8394 - DNA, 103 bp, Artificial Sequence
  Synthetic Polynucleotide
taatacgactcactatagggctattgctgcactcttttctctctccggctaacagaggagaagccggatggagaaaagaaacctggcggcagcgcaaaagatg

SEQ ID NO: 8395 - DNA, 103 bp, Artificial Sequence
  Synthetic Polynucleotide
taatacgactcactatagggcccgtctattgctgcactcttttctctctcaacagaggagagagagaatgaagagtgcaaacctggcggcagcgcaaaagatg

SEQ ID NO: 8396 - DNA, 103 bp, Artificial Sequence
  Synthetic Polynucleotide
taatacgactcactatagggtattccccgtctattgctgcactcttttctaacagaggagaagaaaaatgtgcagcaataacctggcggcagcgcaaaagatg

SEQ ID NO: 8397 - DNA, 103 bp, Artificial Sequence
  Synthetic Polynucleotide
taatacgactcactataggggtctgtattccccgtctattgctgcactctaacagaggagaagagtgatgcaatagacgaacctggcggcagcgcaaaagatg

SEQ ID NO: 8398 - DNA, 103 bp, Artificial Sequence
  Synthetic Polynucleotide
taatacgactcactatagggccgtagtctgtattccccgtctattgctgcaacagaggagagcagcaatggacggggaaaacctggcggcagcgcaaaagatg

SEQ ID NO: 8399 - DNA, 103 bp, Artificial Sequence
  Synthetic Polynucleotide
taatacgactcactatagggtcaccccgtagtctgtattccccgtctattaacagaggagaaatagaatgggaatacagaacctggcggcagcgcaaaagatg

SEQ ID NO: 8400 - DNA, 103 bp, Artificial Sequence
  Synthetic Polynucleotide
taatacgactcactatagggtcgcttcaccccgtagtctgtattccccgtaacagaggagaacggggatgacagactacaacctggcggcagcgcaaaagatg

SEQ ID NO: 8401 - DNA, 103 bp, Artificial Sequence
  Synthetic Polynucleotide
taatacgactcactatagggtttcctcgcttcaccccgtagtctgtattcaacagaggagagaatacatgctacggggtaacctggcggcagcgcaaaagatg

SEQ ID NO: 8402 - DNA, 103 bp, Artificial Sequence
  Synthetic Polynucleotide
taatacgactcactatagggaacgttttcctcgcttcaccccgtagtctgaacagaggagacagactatggggtgaagcaacctggcggcagcgcaaaagatg

SEQ ID NO: 8403 - DNA, 103 bp, Artificial Sequence
  Synthetic Polynucleotide
taatacgactcactatagggaacagtcaacgtcatctggttccgtctcagaacagaggagactgagaatgaaccagatgaacctggcggcagcgcaaaagatg

SEQ ID NO: 8404 - DNA, 103 bp, Artificial Sequence
  Synthetic Polynucleotide
taatacgactcactatagggccacgaacgttttcctcgcttcaccccgtaaacagaggagatacgggatgaagcgaggaaacctggcggcagcgcaaaagatg

SEQ ID NO: 8405 - DNA, 103 bp, Artificial Sequence
  Synthetic Polynucleotide
taatacgactcactataggggagctccacgaacgttttcctcgcttcaccaacagaggagaggtgaaatgaggaaaacgaacctggcggcagcgcaaaagatg

SEQ ID NO: 8406 - DNA, 103 bp, Artificial Sequence
  Synthetic Polynucleotide
taatacgactcactatagggctcatgagctccacgaacgttttcctcgctaacagaggagaagcgagatgaacgttcgtaacctggcggcagcgcaaaagatg

SEQ ID NO: 8407 - DNA, 103 bp, Artificial Sequence
  Synthetic Polynucleotide
taatacgactcactatagggctcttctcatgagctccacgaacgttttccaacagaggagaggaaaaatgtcgtggagcaacctggcggcagcgcaaaagatg

SEQ ID NO: 8408 - DNA, 103 bp, Artificial Sequence
  Synthetic Polynucleotide
taatacgactcactatagggatctcctcttctcatgagctccacgaacgtaacagaggagaacgttcatggagctcatgaacctggcggcagcgcaaaagatg

SEQ ID NO: 8409 - DNA, 103 bp, Artificial Sequence
  Synthetic Polynucleotide
taatacgactcactatagggggtagatctcctcttctcatgagctccacgaacagaggagacgtggaatgcatgagaagaacctggcggcagcgcaaaagatg

SEQ ID NO: 8410 - DNA, 103 bp, Artificial Sequence
  Synthetic Polynucleotide
taatacgactcactatagggagacaggtagatctcctcttctcatgagctaacagaggagaagctcaatggaagaggagaacctggcggcagcgcaaaagatg

SEQ ID NO: 8411 - DNA, 103 bp, Artificial Sequence
  Synthetic Polynucleotide
taatacgactcactatagggtagccagacaggtagatctcctcttctcataacagaggagaatgagaatgggagatctaaacctggcggcagcgcaaaagatg

SEQ ID NO: 8412 - DNA, 103 bp, Artificial Sequence
  Synthetic Polynucleotide
taatacgactcactatagggtaggatagccagacaggtagatctcctcttaacagaggagaaagaggatgtctacctgtaacctggcggcagcgcaaaagatg

SEQ ID NO: 8413 - DNA, 103 bp, Artificial Sequence
  Synthetic Polynucleotide
taatacgactcactatagggctttgtaggatagccagacaggtagatctcaacagaggagagagatcatgctgtctggcaacctggcggcagcgcaaaagatg

SEQ ID NO: 8414 - DNA, 103 bp, Artificial Sequence
  Synthetic Polynucleotide
taatacgactcactataggggcaccaacagtcaacgtcatctggttccgtaacagaggagaacggaaatggatgacgttaacctggcggcagcgcaaaagatg

SEQ ID NO: 8415 - DNA, 103 bp, Artificial Sequence
  Synthetic Polynucleotide
taatacgactcactatagggggcaactttgtaggatagccagacaggtagaacagaggagactacctatgtggctatccaacctggcggcagcgcaaaagatg

SEQ ID NO: 8416 - DNA, 103 bp, Artificial Sequence
  Synthetic Polynucleotide
taatacgactcactatagggtctgaggcaactttgtaggatagccagacaaacagaggagatgtctgatgatcctacaaaacctggcggcagcgcaaaagatg

SEQ ID NO: 8417 - DNA, 103 bp, Artificial Sequence
  Synthetic Polynucleotide
taatacgactcactatagggagccttctgaggcaactttgtaggatagccaacagaggagaggctatatgacaaagttgaacctggcggcagcgcaaaagatg

SEQ ID NO: 8418 - DNA, 103 bp, Artificial Sequence
  Synthetic Polynucleotide
taatacgactcactatagggctggaagccttctgaggcaactttgtaggaaacagaggagatcctacatggttgcctcaaacctggcggcagcgcaaaagatg

SEQ ID NO: 8419 - DNA, 103 bp, Artificial Sequence
  Synthetic Polynucleotide
taatacgactcactataggggagtactggaagccttctgaggcaactttgaacagaggagacaaagtatgctcagaaggaacctggcggcagcgcaaaagatg

SEQ ID NO: 8420 - DNA, 103 bp, Artificial Sequence
  Synthetic Polynucleotide
taatacgactcactatagggtgtcggagtactggaagccttctgaggcaaaacagaggagattgcctatgaaggcttccaacctggcggcagcgcaaaagatg

SEQ ID NO: 8421 - DNA, 103 bp, Artificial Sequence
  Synthetic Polynucleotide
taatacgactcactatagggccttctgtcggagtactggaagccttctgaaacagaggagatcagaaatgttccagtacaacctggcggcagcgcaaaagatg

SEQ ID NO: 8422 - DNA, 103 bp, Artificial Sequence
  Synthetic Polynucleotide
taatacgactcactatagggcaccaccttctgtcggagtactggaagcctaacagaggagaaggcttatggtactccgaaacctggcggcagcgcaaaagatg

SEQ ID NO: 8423 - DNA, 103 bp, Artificial Sequence
  Synthetic Polynucleotide
taatacgactcactatagggcaaagcaccaccttctgtcggagtactggaaacagaggagatccagtatgccgacagaaaacctggcggcagcgcaaaagatg

SEQ ID NO: 8424 - DNA, 103 bp, Artificial Sequence
  Synthetic Polynucleotide
taatacgactcactatagggcccatcaaagcaccaccttctgtcggagtaaacagaggagatactccatgagaaggtggaacctggcggcagcgcaaaagatg

SEQ ID NO: 8425 - DNA, 103 bp, Artificial Sequence
  Synthetic Polynucleotide
taatacgactcactataggggcattgcaccaacagtcaacgtcatctggtaacagaggagaaccagaatgcgttgactgaacctggcggcagcgcaaaagatg

SEQ ID NO: 8426 - DNA, 103 bp, Artificial Sequence
  Synthetic Polynucleotide
taatacgactcactatagggctttccccatcaaagcaccaccttctgtcgaacagaggagacgacagatggtggtgcttaacctggcggcagcgcaaaagatg

SEQ ID NO: 8427 - DNA, 103 bp, Artificial Sequence
  Synthetic Polynucleotide
taatacgactcactatagggtgttcctttccccatcaaagcaccaccttcaacagaggagagaaggtatggctttgatgaacctggcggcagcgcaaaagatg

SEQ ID NO: 8428 - DNA, 103 bp, Artificial Sequence
  Synthetic Polynucleotide
taatacgactcactatagggctggttgttcctttccccatcaaagcaccaaacagaggagatggtgcatggatggggaaaacctggcggcagcgcaaaagatg

SEQ ID NO: 8429 - DNA, 103 bp, Artificial Sequence
  Synthetic Polynucleotide
taatacgactcactatagggaacacctggttgttcctttccccatcaaagaacagaggagactttgaatgggaaaggaaaacctggcggcagcgcaaaagatg

SEQ ID NO: 8430 - DNA, 103 bp, Artificial Sequence
  Synthetic Polynucleotide
taatacgactcactatagggcctccaacacctggttgttcctttccccataacagaggagaatggggatgggaacaaccaacctggcggcagcgcaaaagatg

SEQ ID NO: 8431 - DNA, 103 bp, Artificial Sequence
  Synthetic Polynucleotide
taatacgactcactataggggttctcctccaacacctggttgttcctttcaacagaggagagaaaggatgaaccaggtgaacctggcggcagcgcaaaagatg

SEQ ID NO: 8432 - DNA, 103 bp, Artificial Sequence
  Synthetic Polynucleotide
taatacgactcactatagggtccatgttctcctccaacacctggttgttcaacagaggagagaacaaatgggtgttggaaacctggcggcagcgcaaaagatg

SEQ ID NO: 8433 - DNA, 103 bp, Artificial Sequence
  Synthetic Polynucleotide
taatacgactcactatagggccacgtccatgttctcctccaacacctggtaacagaggagaaccaggatgtggaggagaaacctggcggcagcgcaaaagatg

SEQ ID NO: 8434 - DNA, 103 bp, Artificial Sequence
  Synthetic Polynucleotide
taatacgactcactataggggatctccacgtccatgttctcctccaacacaacagaggagagtgttgatggagaacatgaacctggcggcagcgcaaaagatg

SEQ ID NO: 8435 - DNA, 103 bp, Artificial Sequence
  Synthetic Polynucleotide
taatacgactcactataggggtccagatctccacgtccatgttctcctccaacagaggagaggaggaatgcatggacgtaacctggcggcagcgcaaaagatg

SEQ ID NO: 8436 - DNA, 103 bp, Artificial Sequence
  Synthetic Polynucleotide
taatacgactcactatagggccgtggcattgcaccaacagtcaacgtcataacagaggagaatgacgatgactgttggtaacctggcggcagcgcaaaagatg

SEQ ID NO: 8437 - DNA, 103 bp, Artificial Sequence
  Synthetic Polynucleotide
taatacgactcactatagggcttttgtccagatctccacgtccatgttctaacagaggagaagaacaatgacgtggagaaacctggcggcagcgcaaaagatg

SEQ ID NO: 8438 - DNA, 103 bp, Artificial Sequence
  Synthetic Polynucleotide
taatacgactcactatagggtccttcttttgtccagatctccacgtccataacagaggagaatggacatggagatctggaacctggcggcagcgcaaaagatg

SEQ ID NO: 8439 - DNA, 103 bp, Artificial Sequence
  Synthetic Polynucleotide
taatacgactcactatagggctttctccttcttttgtccagatctccacgaacagaggagacgtggaatgctggacaaaaacctggcggcagcgcaaaagatg

SEQ ID NO: 8440 - DNA, 103 bp, Artificial Sequence
  Synthetic Polynucleotide
taatacgactcactatagggtctttctttctccttcttttgtccagatctaacagaggagaagatctatgcaaaagaagaacctggcggcagcgcaaaagatg

SEQ ID NO: 8441 - DNA, 103 bp, Artificial Sequence
  Synthetic Polynucleotide
taatacgactcactatagggtagtttctttctttctccttcttttgtccaaacagaggagatggacaatggaaggagaaaacctggcggcagcgcaaaagatg

SEQ ID NO: 8442 - DNA, 103 bp, Artificial Sequence
  Synthetic Polynucleotide
taatacgactcactatagggggtcgtagtttctttctttctccttcttttaacagaggagaaaaagaatgagaaagaaaaacctggcggcagcgcaaaagatg

SEQ ID NO: 8443 - DNA, 103 bp, Artificial Sequence
  Synthetic Polynucleotide
taatacgactcactatagggagcggggtcgtagtttctttctttctccttaacagaggagaaaggagatggaaagaaacaacctggcggcagcgcaaaagatg

SEQ ID NO: 8444 - DNA, 103 bp, Artificial Sequence
  Synthetic Polynucleotide
taatacgactcactatagggcagccagcggggtcgtagtttctttctttcaacagaggagagaaagaatgaaactacgaaacctggcggcagcgcaaaagatg

SEQ ID NO: 8445 - DNA, 103 bp, Artificial Sequence
  Synthetic Polynucleotide
taatacgactcactataggggcatccagccagcggggtcgtagtttctttaacagaggagaaaagaaatgacgaccccgaacctggcggcagcgcaaaagatg

SEQ ID NO: 8446 - DNA, 103 bp, Artificial Sequence
  Synthetic Polynucleotide
taatacgactcactatagggttctggcatccagccagcggggtcgtagttaacagaggagaaactacatgcccgctggcaacctggcggcagcgcaaaagatg

SEQ ID NO: 8447 - DNA, 103 bp, Artificial Sequence
  Synthetic Polynucleotide
taatacgactcactatagggtgtctccgtggcattgcaccaacagtcaacaacagaggagagttgacatgtggtgcaataacctggcggcagcgcaaaagatg

SEQ ID NO: 8448 - DNA, 103 bp, Artificial Sequence
  Synthetic Polynucleotide
taatacgactcactataggggtatgttctggcatccagccagcggggtcgaacagaggagacgacccatgtggctggataacctggcggcagcgcaaaagatg

SEQ ID NO: 8449 - DNA, 103 bp, Artificial Sequence
  Synthetic Polynucleotide
taatacgactcactatagggtcagagtatgttctggcatccagccagcggaacagaggagaccgctgatgggatgccagaacctggcggcagcgcaaaagatg

SEQ ID NO: 8450 - DNA, 103 bp, Artificial Sequence
  Synthetic Polynucleotide
taatacgactcactataggggtgggtcagagtatgttctggcatccagccaacagaggagaggctggatgccagaacataacctggcggcagcgcaaaagatg

SEQ ID NO: 8451 - DNA, 103 bp, Artificial Sequence
  Synthetic Polynucleotide
taatacgactcactatagggagccagtgggtcagagtatgttctggcatcaacagaggagagatgccatgacatactctaacctggcggcagcgcaaaagatg

SEQ ID NO: 8452 - DNA, 103 bp, Artificial Sequence
  Synthetic Polynucleotide
taatacgactcactatagggcgcagagccagtgggtcagagtatgttctgaacagaggagacagaacatgctctgacccaacctggcggcagcgcaaaagatg

SEQ ID NO: 8453 - DNA, 103 bp, Artificial Sequence
  Synthetic Polynucleotide
taatacgactcactatagggattcgcgcagagccagtgggtcagagtatgaacagaggagacatactatgacccactggaacctggcggcagcgcaaaagatg

SEQ ID NO: 8454 - DNA, 103 bp, Artificial Sequence
  Synthetic Polynucleotide
taatacgactcactatagggtttgaattcgcgcagagccagtgggtcagaaacagaggagatctgacatgctggctctgaacctggcggcagcgcaaaagatg

SEQ ID NO: 8455 - DNA, 103 bp, Artificial Sequence
  Synthetic Polynucleotide
taatacgactcactatagggaactctttgaattcgcgcagagccagtgggaacagaggagacccactatgtctgcgcgaaacctggcggcagcgcaaaagatg

SEQ ID NO: 8456 - DNA, 103 bp, Artificial Sequence
  Synthetic Polynucleotide
taatacgactcactatagggctgcgaactctttgaattcgcgcagagccaaacagaggagatggctcatggcgaattcaaacctggcggcagcgcaaaagatg

SEQ ID NO: 8457 - DNA, 103 bp, Artificial Sequence
  Synthetic Polynucleotide
taatacgactcactatagggtcctgctgcgaactctttgaattcgcgcagaacagaggagactgcgcatgttcaaagagaacctggcggcagcgcaaaagatg

SEQ ID NO: 8458 - DNA, 103 bp, Artificial Sequence
  Synthetic Polynucleotide
taatacgactcactatagggacccatgtctccgtggcattgcaccaacagaacagaggagactgttgatgcaatgccacaacctggcggcagcgcaaaagatg

SEQ ID NO: 8459 - DNA, 103 bp, Artificial Sequence
  Synthetic Polynucleotide
taatacgactcactatagggcttcttcctgctgcgaactctttgaattcgaacagaggagacgaattatgagagttcgcaacctggcggcagcgcaaaagatg

SEQ ID NO: 8460 - DNA, 103 bp, Artificial Sequence
  Synthetic Polynucleotide
taatacgactcactatagggcgcttcttcttcctgctgcgaactctttgaaacagaggagatcaaagatgtcgcagcagaacctggcggcagcgcaaaagatg

SEQ ID NO: 8461 - DNA, 103 bp, Artificial Sequence
  Synthetic Polynucleotide
taatacgactcactatagggtgagacgcttcttcttcctgctgcgaactcaacagaggagagagttcatggcaggaagaaacctggcggcagcgcaaaagatg

SEQ ID NO: 8462 - DNA, 103 bp, Artificial Sequence
  Synthetic Polynucleotide
taatacgactcactatagggtcacctgagacgcttcttcttcctgctgcgaacagaggagacgcagcatgaagaagaagaacctggcggcagcgcaaaagatg

SEQ ID NO: 8463 - DNA, 103 bp, Artificial Sequence
  Synthetic Polynucleotide
taatacgactcactatagggttaggtcacctgagacgcttcttcttcctgaacagaggagacaggaaatggaagcgtctaacctggcggcagcgcaaaagatg

SEQ ID NO: 8464 - DNA, 103 bp, Artificial Sequence
  Synthetic Polynucleotide
taatacgactcactatagggtaatattaggtcacctgagacgcttcttctaacagaggagaagaagaatggtctcaggtaacctggcggcagcgcaaaagatg

SEQ ID NO: 8465 - DNA, 103 bp, Artificial Sequence
  Synthetic Polynucleotide
taatacgactcactatagggatttctaatattaggtcacctgagacgcttaacagaggagaaagcgtatgaggtgacctaacctggcggcagcgcaaaagatg

SEQ ID NO: 8466 - DNA, 103 bp, Artificial Sequence
  Synthetic Polynucleotide
taatacgactcactatagggtccctatttctaatattaggtcacctgagaaacagaggagatctcagatgacctaatataacctggcggcagcgcaaaagatg

SEQ ID NO: 8467 - DNA, 103 bp, Artificial Sequence
  Synthetic Polynucleotide
taatacgactcactatagggaagtttccctatttctaatattaggtcaccaacagaggagaggtgacatgatattagaaaacctggcggcagcgcaaaagatg

SEQ ID NO: 8468 - DNA, 103 bp, Artificial Sequence
  Synthetic Polynucleotide
taatacgactcactatagggtgtggaagtttccctatttctaatattaggaacagaggagacctaatatgagaaataggaacctggcggcagcgcaaaagatg

SEQ ID NO: 8469 - DNA, 103 bp, Artificial Sequence
  Synthetic Polynucleotide
taatacgactcactatagggaggtcacccatgtctccgtggcattgcaccaacagaggagaggtgcaatgccacggagaaacctggcggcagcgcaaaagatg

SEQ ID NO: 8470 - DNA, 103 bp, Artificial Sequence
  Synthetic Polynucleotide
taatacgactcactatagggaatgttgtggaagtttccctatttctaataaacagaggagatattagatgtagggaaacaacctggcggcagcgcaaaagatg

SEQ ID NO: 8471 - DNA, 103 bp, Artificial Sequence
  Synthetic Polynucleotide
taatacgactcactatagggcgttaaatgttgtggaagtttccctatttcaacagaggagagaaataatgaaacttccaaacctggcggcagcgcaaaagatg

SEQ ID NO: 8472 - DNA, 103 bp, Artificial Sequence
  Synthetic Polynucleotide
taatacgactcactatagggctttgcgttaaatgttgtggaagtttccctaacagaggagaagggaaatgtccacaacaaacctggcggcagcgcaaaagatg

SEQ ID NO: 8473 - DNA, 103 bp, Artificial Sequence
  Synthetic Polynucleotide
taatacgactcactataggggggccctttgcgttaaatgttgtggaagttaacagaggagaaacttcatgaacatttaaaacctggcggcagcgcaaaagatg

SEQ ID NO: 8474 - DNA, 103 bp, Artificial Sequence
  Synthetic Polynucleotide
taatacgactcactataggggttctgggccctttgcgttaaatgttgtggaacagaggagaccacaaatgttaacgcaaaacctggcggcagcgcaaaagatg

SEQ ID NO: 8475 - DNA, 103 bp, Artificial Sequence
  Synthetic Polynucleotide
taatacgactcactatagggaaggcgttctgggccctttgcgttaaatgtaacagaggagaacatttatggcaaagggcaacctggcggcagcgcaaaagatg

SEQ ID NO: 8476 - DNA, 103 bp, Artificial Sequence
  Synthetic Polynucleotide
taatacgactcactatagggtgtccaaggcgttctgggccctttgcgttaaacagaggagataacgcatggggcccagaaacctggcggcagcgcaaaagatg

SEQ ID NO: 8477 - DNA, 103 bp, Artificial Sequence
  Synthetic Polynucleotide
taatacgactcactatagggcagattgtccaaggcgttctgggccctttgaacagaggagacaaaggatgcagaacgccaacctggcggcagcgcaaaagatg

SEQ ID NO: 8478 - DNA, 103 bp, Artificial Sequence
  Synthetic Polynucleotide
taatacgactcactatagggataaccagattgtccaaggcgttctgggccaacagaggagaggcccaatgcgccttggaaacctggcggcagcgcaaaagatg

SEQ ID NO: 8479 - DNA, 103 bp, Artificial Sequence
  Synthetic Polynucleotide
taatacgactcactataggggcaacataaccagattgtccaaggcgttctaacagaggagaagaacgatgtggacaatcaacctggcggcagcgcaaaagatg

SEQ ID NO: 8480 - DNA, 103 bp, Artificial Sequence
  Synthetic Polynucleotide
taatacgactcactatagggtccataggtcacccatgtctccgtggcattaacagaggagaaatgccatggagacatggaacctggcggcagcgcaaaagatg

SEQ ID NO: 8481 - DNA, 103 bp, Artificial Sequence
  Synthetic Polynucleotide
taatacgactcactataggggttgtgcaacataaccagattgtccaaggcaacagaggagagccttgatgaatctggttaacctggcggcagcgcaaaagatg

SEQ ID NO: 8482 - DNA, 103 bp, Artificial Sequence
  Synthetic Polynucleotide
taatacgactcactatagggtcagagttgtgcaacataaccagattgtccaacagaggagaggacaaatgggttatgttaacctggcggcagcgcaaaagatg

SEQ ID NO: 8483 - DNA, 103 bp, Artificial Sequence
  Synthetic Polynucleotide
taatacgactcactatagggcttgttcagagttgtgcaacataaccagataacagaggagaatctggatgtgttgcacaaacctggcggcagcgcaaaagatg

SEQ ID NO: 8484 - DNA, 103 bp, Artificial Sequence
  Synthetic Polynucleotide
taatacgactcactatagggtcctccttgttcagagttgtgcaacataacaacagaggagagttatgatgcacaactctaacctggcggcagcgcaaaagatg

SEQ ID NO: 8485 - DNA, 103 bp, Artificial Sequence
  Synthetic Polynucleotide
taatacgactcactataggggcttttcctccttgttcagagttgtgcaacaacagaggagagttgcaatgctctgaacaaacctggcggcagcgcaaaagatg

SEQ ID NO: 8486 - DNA, 103 bp, Artificial Sequence
  Synthetic Polynucleotide
taatacgactcactatagggtataggcttttcctccttgttcagagttgtaacagaggagaacaactatgaacaaggagaacctggcggcagcgcaaaagatg

SEQ ID NO: 8487 - DNA, 103 bp, Artificial Sequence
  Synthetic Polynucleotide
taatacgactcactataggggtgtctataggcttttcctccttgttcagaaacagaggagatctgaaatgggaggaaaaaacctggcggcagcgcaaaagatg

SEQ ID NO: 8488 - DNA, 103 bp, Artificial Sequence
  Synthetic Polynucleotide
taatacgactcactatagggatggcgtgtctataggcttttcctccttgtaacagaggagaacaaggatgaaaagcctaaacctggcggcagcgcaaaagatg

SEQ ID NO: 8489 - DNA, 103 bp, Artificial Sequence
  Synthetic Polynucleotide
taatacgactcactatagggcttccatggcgtgtctataggcttttcctcaacagaggagagaggaaatgcctatagacaacctggcggcagcgcaaaagatg

SEQ ID NO: 8490 - DNA, 103 bp, Artificial Sequence
  Synthetic Polynucleotide
taatacgactcactatagggtagttcttccatggcgtgtctataggctttaacagaggagaaaagccatgagacacgccaacctggcggcagcgcaaaagatg

SEQ ID NO: 8491 - DNA, 103 bp, Artificial Sequence
  Synthetic Polynucleotide
taatacgactcactataggggatctgctctctaataaaaaactgttagaaaacagaggagattctaaatgttttttattaacctggcggcagcgcaaaagatg

SEQ ID NO: 8492 - DNA, 103 bp, Artificial Sequence
  Synthetic Polynucleotide
taatacgactcactatagggcatgttccataggtcacccatgtctccgtgaacagaggagacacggaatgatgggtgacaacctggcggcagcgcaaaagatg

SEQ ID NO: 8493 - DNA, 103 bp, Artificial Sequence
  Synthetic Polynucleotide
taatacgactcactatagggtctggtagttcttccatggcgtgtctatagaacagaggagactatagatgcgccatggaaacctggcggcagcgcaaaagatg

SEQ ID NO: 8494 - DNA, 103 bp, Artificial Sequence
  Synthetic Polynucleotide
taatacgactcactatagggtggtgtctggtagttcttccatggcgtgtcaacagaggagagacacgatgtggaagaacaacctggcggcagcgcaaaagatg

SEQ ID NO: 8495 - DNA, 103 bp, Artificial Sequence
  Synthetic Polynucleotide
taatacgactcactatagggttctatggtgtctggtagttcttccatggcaacagaggagagccatgatggaactaccaaacctggcggcagcgcaaaagatg

SEQ ID NO: 8496 - DNA, 103 bp, Artificial Sequence
  Synthetic Polynucleotide
taatacgactcactatagggaacgtttctatggtgtctggtagttcttccaacagaggagaggaagaatgaccagacacaacctggcggcagcgcaaaagatg

SEQ ID NO: 8497 - DNA, 103 bp, Artificial Sequence
  Synthetic Polynucleotide
taatacgactcactataggggcattaacgtttctatggtgtctggtagttaacagaggagaaactacatgacaccatagaacctggcggcagcgcaaaagatg

SEQ ID NO: 8498 - DNA, 103 bp, Artificial Sequence
  Synthetic Polynucleotide
taatacgactcactatagggtaggagcattaacgtttctatggtgtctggaacagaggagaccagacatgatagaaacgaacctggcggcagcgcaaaagatg

SEQ ID NO: 8499 - DNA, 103 bp, Artificial Sequence
  Synthetic Polynucleotide
taatacgactcactatagggaaagctaggagcattaacgtttctatggtgaacagaggagacaccatatgaacgttaataacctggcggcagcgcaaaagatg

SEQ ID NO: 8500 - DNA, 103 bp, Artificial Sequence
  Synthetic Polynucleotide
taatacgactcactatagggctatcaaagctaggagcattaacgtttctaaacagaggagatagaaaatgtaatgctccaacctggcggcagcgcaaaagatg

SEQ ID NO: 8501 - DNA, 103 bp, Artificial Sequence
  Synthetic Polynucleotide
taatacgactcactatagggcacagctatcaaagctaggagcattaacgtaacagaggagaacgttaatgctcctagctaacctggcggcagcgcaaaagatg

SEQ ID NO: 8502 - DNA, 103 bp, Artificial Sequence
  Synthetic Polynucleotide
taatacgactcactataggggtcagcacagctatcaaagctaggagcattaacagaggagaaatgctatgagctttgataacctggcggcagcgcaaaagatg

SEQ ID NO: 8503 - DNA, 103 bp, Artificial Sequence
  Synthetic Polynucleotide
taatacgactcactataggggagaacatgttccataggtcacccatgtctaacagaggagaagacatatgtgacctatgaacctggcggcagcgcaaaagatg

SEQ ID NO: 8504 - DNA, 103 bp, Artificial Sequence
  Synthetic Polynucleotide
taatacgactcactatagggcaccagtcagcacagctatcaaagctaggaaacagaggagatcctagatgtgatagctgaacctggcggcagcgcaaaagatg

SEQ ID NO: 8505 - DNA, 103 bp, Artificial Sequence
  Synthetic Polynucleotide
taatacgactcactatagggcactccaccagtcagcacagctatcaaagcaacagaggagagctttgatggctgtgctgaacctggcggcagcgcaaaagatg

SEQ ID NO: 8506 - DNA, 103 bp, Artificial Sequence
  Synthetic Polynucleotide
taatacgactcactatagggaacgtcactccaccagtcagcacagctatcaacagaggagagatagcatggctgactggaacctggcggcagcgcaaaagatg

SEQ ID NO: 8507 - DNA, 103 bp, Artificial Sequence
  Synthetic Polynucleotide
taatacgactcactatagggagaacaacgtcactccaccagtcagcacagaacagaggagactgtgcatgctggtggagaacctggcggcagcgcaaaagatg

SEQ ID NO: 8508 - DNA, 103 bp, Artificial Sequence
  Synthetic Polynucleotide
taatacgactcactatagggtaggaagaacaacgtcactccaccagtcagaacagaggagactgactatgggagtgacgaacctggcggcagcgcaaaagatg

SEQ ID NO: 8509 - DNA, 103 bp, Artificial Sequence
  Synthetic Polynucleotide
taatacgactcactatagggcctgataggaagaacaacgtcactccaccaaacagaggagatggtggatggacgttgttaacctggcggcagcgcaaaagatg

SEQ ID NO: 8510 - DNA, 103 bp, Artificial Sequence
  Synthetic Polynucleotide
taatacgactcactatagggcccttcctgataggaagaacaacgtcactcaacagaggagagagtgaatgtgttcttccaacctggcggcagcgcaaaagatg

SEQ ID NO: 8511 - DNA, 103 bp, Artificial Sequence
  Synthetic Polynucleotide
taatacgactcactatagggtagaccccttcctgataggaagaacaacgtaacagaggagaacgttgatgttcctatcaaacctggcggcagcgcaaaagatg

SEQ ID NO: 8512 - DNA, 103 bp, Artificial Sequence
  Synthetic Polynucleotide
taatacgactcactatagggtttcctagaccccttcctgataggaagaacaacagaggagagttcttatgatcaggaagaacctggcggcagcgcaaaagatg

SEQ ID NO: 8513 - DNA, 103 bp, Artificial Sequence
  Synthetic Polynucleotide
taatacgactcactatagggatgtttttcctagaccccttcctgataggaaacagaggagatcctatatggaaggggtcaacctggcggcagcgcaaaagatg

SEQ ID NO: 8514 - DNA, 103 bp, Artificial Sequence
  Synthetic Polynucleotide
taatacgactcactatagggagtttgagaacatgttccataggtcacccaaacagaggagatgggtgatgtatggaacaaacctggcggcagcgcaaaagatg

SEQ ID NO: 8515 - DNA, 103 bp, Artificial Sequence
  Synthetic Polynucleotide
taatacgactcactatagggaatggatgtttttcctagaccccttcctgaaacagaggagatcaggaatgggtctaggaaacctggcggcagcgcaaaagatg

SEQ ID NO: 8516 - DNA, 103 bp, Artificial Sequence
  Synthetic Polynucleotide
taatacgactcactatagggaggccaatggatgtttttcctagaccccttaacagaggagaaaggggatgaggaaaaacaacctggcggcagcgcaaaagatg

SEQ ID NO: 8517 - DNA, 103 bp, Artificial Sequence
  Synthetic Polynucleotide
taatacgactcactatagggagagtaggccaatggatgtttttcctagacaacagaggagagtctagatgaaacatccaaacctggcggcagcgcaaaagatg

SEQ ID NO: 8518 - DNA, 103 bp, Artificial Sequence
  Synthetic Polynucleotide
taatacgactcactatagggcacgcagagtaggccaatggatgtttttccaacagaggagaggaaaaatgtccattggcaacctggcggcagcgcaaaagatg

SEQ ID NO: 8519 - DNA, 103 bp, Artificial Sequence
  Synthetic Polynucleotide
taatacgactcactataggggcaatcacgcagagtaggccaatggatgttaacagaggagaaacatcatgtggcctactaacctggcggcagcgcaaaagatg

SEQ ID NO: 8520 - DNA, 103 bp, Artificial Sequence
  Synthetic Polynucleotide
taatacgactcactatagggttgaggcaatcacgcagagtaggccaatggaacagaggagaccattgatgtactctgcgaacctggcggcagcgcaaaagatg

SEQ ID NO: 8521 - DNA, 103 bp, Artificial Sequence
  Synthetic Polynucleotide
taatacgactcactatagggtgcacttgaggcaatcacgcagagtaggccaacagaggagaggcctaatgtgcgtgattaacctggcggcagcgcaaaagatg

SEQ ID NO: 8522 - DNA, 103 bp, Artificial Sequence
  Synthetic Polynucleotide
taatacgactcactatagggaacagtgcacttgaggcaatcacgcagagtaacagaggagaactctgatggattgcctcaacctggcggcagcgcaaaagatg

SEQ ID NO: 8523 - DNA, 103 bp, Artificial Sequence
  Synthetic Polynucleotide
taatacgactcactatagggtccataacagtgcacttgaggcaatcacgcaacagaggagagcgtgaatgcctcaagtgaacctggcggcagcgcaaaagatg

SEQ ID NO: 8524 - DNA, 103 bp, Artificial Sequence
  Synthetic Polynucleotide
taatacgactcactatagggggccatccataacagtgcacttgaggcaataacagaggagaattgccatgagtgcactgaacctggcggcagcgcaaaagatg

SEQ ID NO: 8525 - DNA, 103 bp, Artificial Sequence
  Synthetic Polynucleotide
taatacgactcactatagggtcaccagtttgagaacatgttccataggtcaacagaggagagacctaatgaacatgttcaacctggcggcagcgcaaaagatg

SEQ ID NO: 8526 - DNA, 103 bp, Artificial Sequence
  Synthetic Polynucleotide
taatacgactcactatagggacactggccatccataacagtgcacttgagaacagaggagactcaagatgactgttatgaacctggcggcagcgcaaaagatg

SEQ ID NO: 8527 - DNA, 103 bp, Artificial Sequence
  Synthetic Polynucleotide
taatacgactcactataggggttccacactggccatccataacagtgcacaacagaggagagtgcacatgtatggatggaacctggcggcagcgcaaaagatg

SEQ ID NO: 8528 - DNA, 103 bp, Artificial Sequence
  Synthetic Polynucleotide
taatacgactcactatagggatggggttccacactggccatccataacagaacagaggagactgttaatgatggccagtaacctggcggcagcgcaaaagatg

SEQ ID NO: 8529 - DNA, 103 bp, Artificial Sequence
  Synthetic Polynucleotide
taatacgactcactatagggatccaatggggttccacactggccatccataacagaggagaatggatatgcagtgtggaaacctggcggcagcgcaaaagatg

SEQ ID NO: 8530 - DNA, 103 bp, Artificial Sequence
  Synthetic Polynucleotide
taatacgactcactatagggccgctatccaatggggttccacactggccaaacagaggagatggccaatgtggaaccccaacctggcggcagcgcaaaagatg

SEQ ID NO: 8531 - DNA, 103 bp, Artificial Sequence
  Synthetic Polynucleotide
taatacgactcactatagggagaggccgctatccaatggggttccacactaacagaggagaagtgtgatgccccattggaacctggcggcagcgcaaaagatg

SEQ ID NO: 8532 - DNA, 103 bp, Artificial Sequence
  Synthetic Polynucleotide
taatacgactcactatagggatgatagaggccgctatccaatggggttccaacagaggagaggaaccatgttggatagcaacctggcggcagcgcaaaagatg

SEQ ID NO: 8533 - DNA, 103 bp, Artificial Sequence
  Synthetic Polynucleotide
taatacgactcactatagggccagtatgatagaggccgctatccaatgggaacagaggagacccattatgtagcggcctaacctggcggcagcgcaaaagatg

SEQ ID NO: 8534 - DNA, 103 bp, Artificial Sequence
  Synthetic Polynucleotide
taatacgactcactataggggaactccagtatgatagaggccgctatccaaacagaggagatggataatggcctctatcaacctggcggcagcgcaaaagatg

SEQ ID NO: 8535 - DNA, 103 bp, Artificial Sequence
  Synthetic Polynucleotide
taatacgactcactatagggagaaagaactccagtatgatagaggccgctaacagaggagaagcggcatgtatcatactaacctggcggcagcgcaaaagatg

SEQ ID NO: 8536 - DNA, 103 bp, Artificial Sequence
  Synthetic Polynucleotide
taatacgactcactatagggggtgttcaccagtttgagaacatgttccataacagaggagaatggaaatggttctcaaaaacctggcggcagcgcaaaagatg

SEQ ID NO: 8537 - DNA, 103 bp, Artificial Sequence
  Synthetic Polynucleotide
taatacgactcactatagggccatcagaaagaactccagtatgatagaggaacagaggagacctctaatgtactggagtaacctggcggcagcgcaaaagatg

SEQ ID NO: 8538 - DNA, 103 bp, Artificial Sequence
  Synthetic Polynucleotide
taatacgactcactatagggcaacaccatcagaaagaactccagtatgataacagaggagaatcataatggagttctttaacctggcggcagcgcaaaagatg

SEQ ID NO: 8539 - DNA, 103 bp, Artificial Sequence
  Synthetic Polynucleotide
taatacgactcactatagggataagcaacaccatcagaaagaactccagtaacagaggagaactggaatgctttctgataacctggcggcagcgcaaaagatg

SEQ ID NO: 8540 - DNA, 103 bp, Artificial Sequence
  Synthetic Polynucleotide
taatacgactcactatagggctggaataagcaacaccatcagaaagaactaacagaggagaagttctatgtgatggtgtaacctggcggcagcgcaaaagatg

SEQ ID NO: 8541 - DNA, 103 bp, Artificial Sequence
  Synthetic Polynucleotide
taatacgactcactatagggcggctctggaataagcaacaccatcagaaaaacagaggagatttctgatggtgttgcttaacctggcggcagcgcaaaagatg

SEQ ID NO: 8542 - DNA, 103 bp, Artificial Sequence
  Synthetic Polynucleotide
taatacgactcactatagggctgtccggctctggaataagcaacaccatcaacagaggagagatggtatggcttattccaacctggcggcagcgcaaaagatg

SEQ ID NO: 8543 - DNA, 103 bp, Artificial Sequence
  Synthetic Polynucleotide
taatacgactcactataggggctgtctgtccggctctggaataagcaacaaacagaggagatgttgcatgttccagagcaacctggcggcagcgcaaaagatg

SEQ ID NO: 8544 - DNA, 103 bp, Artificial Sequence
  Synthetic Polynucleotide
taatacgactcactatagggagtgcgctgtctgtccggctctggaataagaacagaggagacttattatggagccggacaacctggcggcagcgcaaaagatg

SEQ ID NO: 8545 - DNA, 103 bp, Artificial Sequence
  Synthetic Polynucleotide
taatacgactcactatagggtgtggagtgcgctgtctgtccggctctggaaacagaggagatccagaatgggacagacaaacctggcggcagcgcaaaagatg

SEQ ID NO: 8546 - DNA, 103 bp, Artificial Sequence
  Synthetic Polynucleotide
taatacgactcactatagggtgtcttgtggagtgcgctgtctgtccggctaacagaggagaagccggatggacagcgcaaacctggcggcagcgcaaaagatg

SEQ ID NO: 8547 - DNA, 103 bp, Artificial Sequence
  Synthetic Polynucleotide
taatacgactcactatagggtcgtcggtgttcaccagtttgagaacatgtaacagaggagaacatgtatgcaaactggtaacctggcggcagcgcaaaagatg

SEQ ID NO: 8548 - DNA, 103 bp, Artificial Sequence
  Synthetic Polynucleotide
taatacgactcactatagggctggttgtcttgtggagtgcgctgtctgtcaacagaggagagacagaatgcgcactccaaacctggcggcagcgcaaaagatg

SEQ ID NO: 8549 - DNA, 103 bp, Artificial Sequence
  Synthetic Polynucleotide
taatacgactcactataggggctagctggttgtcttgtggagtgcgctgtaacagaggagaacagcgatgtccacaagaaacctggcggcagcgcaaaagatg

SEQ ID NO: 8550 - DNA, 103 bp, Artificial Sequence
  Synthetic Polynucleotide
taatacgactcactatagggcgtatgctagctggttgtcttgtggagtgcaacagaggagagcactcatgaagacaaccaacctggcggcagcgcaaaagatg

SEQ ID NO: 8551 - DNA, 103 bp, Artificial Sequence
  Synthetic Polynucleotide
taatacgactcactatagggcaccacgtatgctagctggttgtcttgtggaacagaggagaccacaaatgaaccagctaaacctggcggcagcgcaaaagatg

SEQ ID NO: 8552 - DNA, 103 bp, Artificial Sequence
  Synthetic Polynucleotide
taatacgactcactatagggcctatcaccacgtatgctagctggttgtctaacagaggagaagacaaatggctagcataaacctggcggcagcgcaaaagatg

SEQ ID NO: 8553 - DNA, 103 bp, Artificial Sequence
  Synthetic Polynucleotide
taatacgactcactatagggacagacctatcaccacgtatgctagctggtaacagaggagaaccagcatgcatacgtggaacctggcggcagcgcaaaagatg

SEQ ID NO: 8554 - DNA, 103 bp, Artificial Sequence
  Synthetic Polynucleotide
taatacgactcactataggggaataacagacctatcaccacgtatgctagaacagaggagactagcaatggtggtgataaacctggcggcagcgcaaaagatg

SEQ ID NO: 8555 - DNA, 103 bp, Artificial Sequence
  Synthetic Polynucleotide
taatacgactcactatagggatcatgaataacagacctatcaccacgtataacagaggagaatacgtatggataggtctaacctggcggcagcgcaaaagatg

SEQ ID NO: 8556 - DNA, 103 bp, Artificial Sequence
  Synthetic Polynucleotide
taatacgactcactatagggtcaatatcatgaataacagacctatcaccaaacagaggagatggtgaatggtctgttataacctggcggcagcgcaaaagatg

SEQ ID NO: 8557 - DNA, 103 bp, Artificial Sequence
  Synthetic Polynucleotide
taatacgactcactatagggcactgtcaatatcatgaataacagacctataacagaggagaataggtatgttattcatgaacctggcggcagcgcaaaagatg

SEQ ID NO: 8558 - DNA, 103 bp, Artificial Sequence
  Synthetic Polynucleotide
taatacgactcactatagggttgtctcgtcggtgttcaccagtttgagaaaacagaggagattctcaatgtggtgaacaaacctggcggcagcgcaaaagatg

SEQ ID NO: 8559 - DNA, 103 bp, Artificial Sequence
  Synthetic Polynucleotide
taatacgactcactataggggctgccactgtcaatatcatgaataacagaaacagaggagatctgttatgcatgatattaacctggcggcagcgcaaaagatg

SEQ ID NO: 8560 - DNA, 103 bp, Artificial Sequence
  Synthetic Polynucleotide
taatacgactcactatagggcattggctgccactgtcaatatcatgaataaacagaggagatattcaatgtattgacagaacctggcggcagcgcaaaagatg

SEQ ID NO: 8561 - DNA, 103 bp, Artificial Sequence
  Synthetic Polynucleotide
taatacgactcactatagggcatctcattggctgccactgtcaatatcataacagaggagaatgataatgacagtggcaaacctggcggcagcgcaaaagatg

SEQ ID NO: 8562 - DNA, 103 bp, Artificial Sequence
  Synthetic Polynucleotide
taatacgactcactatagggaatcccatctcattggctgccactgtcaataacagaggagaattgacatgggcagccaaaacctggcggcagcgcaaaagatg

SEQ ID NO: 8563 - DNA, 103 bp, Artificial Sequence
  Synthetic Polynucleotide
taatacgactcactatagggccagtaatcccatctcattggctgccactgaacagaggagacagtggatgccaatgagaaacctggcggcagcgcaaaagatg

SEQ ID NO: 8564 - DNA, 103 bp, Artificial Sequence
  Synthetic Polynucleotide
taatacgactcactatagggggtttccagtaatcccatctcattggctgcaacagaggagagcagccatggagatgggaaacctggcggcagcgcaaaagatg

SEQ ID NO: 8565 - DNA, 103 bp, Artificial Sequence
  Synthetic Polynucleotide
taatacgactcactatagggtttgtggtttccagtaatcccatctcattgaacagaggagacaatgaatggggattactaacctggcggcagcgcaaaagatg

SEQ ID NO: 8566 - DNA, 103 bp, Artificial Sequence
  Synthetic Polynucleotide
taatacgactcactatagggccttctttgtggtttccagtaatcccatctaacagaggagaagatggatgtactggaaaaacctggcggcagcgcaaaagatg

SEQ ID NO: 8567 - DNA, 103 bp, Artificial Sequence
  Synthetic Polynucleotide
taatacgactcactatagggcaggtccttctttgtggtttccagtaatccaacagaggagaggattaatggaaaccacaaacctggcggcagcgcaaaagatg

SEQ ID NO: 8568 - DNA, 103 bp, Artificial Sequence
  Synthetic Polynucleotide
taatacgactcactatagggatccccaggtccttctttgtggtttccagtaacagaggagaactggaatgcacaaagaaaacctggcggcagcgcaaaagatg

SEQ ID NO: 8569 - DNA, 103 bp, Artificial Sequence
  Synthetic Polynucleotide
taatacgactcactatagggaacgtttgtctcgtcggtgttcaccagtttaacagaggagaaaactgatgaacaccgacaacctggcggcagcgcaaaagatg

SEQ ID NO: 8570 - DNA, 103 bp, Artificial Sequence
  Synthetic Polynucleotide
taatacgactcactataggggaccaatccccaggtccttctttgtggtttaacagaggagaaaaccaatgagaaggaccaacctggcggcagcgcaaaagatg

SEQ ID NO: 8571 - DNA, 103 bp, Artificial Sequence
  Synthetic Polynucleotide
taatacgactcactatagggtgcatgaccaatccccaggtccttctttgtaacagaggagaacaaagatggacctggggaacctggcggcagcgcaaaagatg

SEQ ID NO: 8572 - DNA, 103 bp, Artificial Sequence
  Synthetic Polynucleotide
taatacgactcactataggggcagctgcatgaccaatccccaggtccttcaacagaggagagaaggaatgggggattggaacctggcggcagcgcaaaagatg

SEQ ID NO: 8573 - DNA, 103 bp, Artificial Sequence
  Synthetic Polynucleotide
taatacgactcactatagggtttcagcagctgcatgaccaatccccaggtaacagaggagaacctggatgttggtcatgaacctggcggcagcgcaaaagatg

SEQ ID NO: 8574 - DNA, 103 bp, Artificial Sequence
  Synthetic Polynucleotide
taatacgactcactataggggtggttttcagcagctgcatgaccaatcccaacagaggagagggattatgcatgcagctaacctggcggcagcgcaaaagatg

SEQ ID NO: 8575 - DNA, 103 bp, Artificial Sequence
  Synthetic Polynucleotide
taatacgactcactatagggtgatggtggttttcagcagctgcatgaccaaacagaggagatggtcaatgagctgctgaaacctggcggcagcgcaaaagatg

SEQ ID NO: 8576 - DNA, 103 bp, Artificial Sequence
  Synthetic Polynucleotide
taatacgactcactatagggcagcatgatggtggttttcagcagctgcataacagaggagaatgcagatgctgaaaaccaacctggcggcagcgcaaaagatg

SEQ ID NO: 8577 - DNA, 103 bp, Artificial Sequence
  Synthetic Polynucleotide
taatacgactcactatagggcattgcagcatgatggtggttttcagcagcaacagaggagagctgctatgaaccaccataacctggcggcagcgcaaaagatg

SEQ ID NO: 8578 - DNA, 103 bp, Artificial Sequence
  Synthetic Polynucleotide
taatacgactcactatagggtccagcattgcagcatgatggtggttttcaaacagaggagatgaaaaatgccatcatgcaacctggcggcagcgcaaaagatg

SEQ ID NO: 8579 - DNA, 103 bp, Artificial Sequence
  Synthetic Polynucleotide
taatacgactcactatagggctacgtccagcattgcagcatgatggtggtaacagaggagaaccaccatgatgctgcaaaacctggcggcagcgcaaaagatg

SEQ ID NO: 8580 - DNA, 103 bp, Artificial Sequence
  Synthetic Polynucleotide
taatacgactcactataggggacggaacgtttgtctcgtcggtgttcaccaacagaggagaggtgaaatgcgacgagacaacctggcggcagcgcaaaagatg

SEQ ID NO: 8581 - DNA, 103 bp, Artificial Sequence
  Synthetic Polynucleotide
taatacgactcactatagggtaggtctacgtccagcattgcagcatgatgaacagaggagacatcatatggcaatgctgaacctggcggcagcgcaaaagatg

SEQ ID NO: 8582 - DNA, 103 bp, Artificial Sequence
  Synthetic Polynucleotide
taatacgactcactatagggggatgtaggtctacgtccagcattgcagcaaacagaggagatgctgcatggctggacgtaacctggcggcagcgcaaaagatg

SEQ ID NO: 8583 - DNA, 103 bp, Artificial Sequence
  Synthetic Polynucleotide
taatacgactcactatagggaagctggatgtaggtctacgtccagcattgaacagaggagacaatgcatgacgtagaccaacctggcggcagcgcaaaagatg

SEQ ID NO: 8584 - DNA, 103 bp, Artificial Sequence
  Synthetic Polynucleotide
taatacgactcactatagggggctgaagctggatgtaggtctacgtccagaacagaggagactggacatggacctacataacctggcggcagcgcaaaagatg

SEQ ID NO: 8585 - DNA, 103 bp, Artificial Sequence
  Synthetic Polynucleotide
taatacgactcactataggggtccaggctgaagctggatgtaggtctacgaacagaggagacgtagaatgacatccagcaacctggcggcagcgcaaaagatg

SEQ ID NO: 8586 - DNA, 103 bp, Artificial Sequence
  Synthetic Polynucleotide
taatacgactcactatagggagagagtccaggctgaagctggatgtaggtaacagaggagaacctacatgcagcttcagaacctggcggcagcgcaaaagatg

SEQ ID NO: 8587 - DNA, 103 bp, Artificial Sequence
  Synthetic Polynucleotide
taatacgactcactatagggtgcatagagagtccaggctgaagctggatgaacagaggagacatccaatgtcagcctggaacctggcggcagcgcaaaagatg

SEQ ID NO: 8588 - DNA, 103 bp, Artificial Sequence
  Synthetic Polynucleotide
taatacgactcactataggggccactgcatagagagtccaggctgaagctaacagaggagaagcttcatgctggactctaacctggcggcagcgcaaaagatg

SEQ ID NO: 8589 - DNA, 103 bp, Artificial Sequence
  Synthetic Polynucleotide
taatacgactcactatagggttgtggccactgcatagagagtccaggctgaacagaggagacagcctatgctctctatgaacctggcggcagcgcaaaagatg

SEQ ID NO: 8590 - DNA, 103 bp, Artificial Sequence
  Synthetic Polynucleotide
taatacgactcactatagggaattgttgtggccactgcatagagagtccaaacagaggagatggactatgtatgcagtgaacctggcggcagcgcaaaagatg

SEQ ID NO: 8591 - DNA, 103 bp, Artificial Sequence
  Synthetic Polynucleotide
taatacgactcactatagggagtgcgacggaacgtttgtctcgtcggtgtaacagaggagaacaccgatgagacaaacgaacctggcggcagcgcaaaagatg

SEQ ID NO: 8592 - DNA, 103 bp, Artificial Sequence
  Synthetic Polynucleotide
taatacgactcactataggggtgataattgttgtggccactgcatagagaaacagaggagatctctaatgagtggccacaacctggcggcagcgcaaaagatg

SEQ ID NO: 8593 - DNA, 103 bp, Artificial Sequence
  Synthetic Polynucleotide
taatacgactcactatagggtgggagtgataattgttgtggccactgcataacagaggagaatgcagatgccacaacaaaacctggcggcagcgcaaaagatg

SEQ ID NO: 8594 - DNA, 103 bp, Artificial Sequence
  Synthetic Polynucleotide
taatacgactcactatagggcatcatgggagtgataattgttgtggccacaacagaggagagtggccatgacaattatcaacctggcggcagcgcaaaagatg

SEQ ID NO: 8595 - DNA, 103 bp, Artificial Sequence
  Synthetic Polynucleotide
taatacgactcactatagggtgtctcatcatgggagtgataattgttgtgaacagaggagacacaacatgtatcactccaacctggcggcagcgcaaaagatg

SEQ ID NO: 8596 - DNA, 103 bp, Artificial Sequence
  Synthetic Polynucleotide
taatacgactcactatagggttgtgtgtctcatcatgggagtgataattgaacagaggagacaattaatgctcccatgaaacctggcggcagcgcaaaagatg

SEQ ID NO: 8597 - DNA, 103 bp, Artificial Sequence
  Synthetic Polynucleotide
taatacgactcactatagggttcaattgtgtgtctcatcatgggagtgataacagaggagaatcactatgatgatgagaaacctggcggcagcgcaaaagatg

SEQ ID NO: 8598 - DNA, 103 bp, Artificial Sequence
  Synthetic Polynucleotide
taatacgactcactataggggtgttttcaattgtgtgtctcatcatgggaaacagaggagatcccatatggagacacacaacctggcggcagcgcaaaagatg

SEQ ID NO: 8599 - DNA, 103 bp, Artificial Sequence
  Synthetic Polynucleotide
taatacgactcactatagggccgttgtgttttcaattgtgtgtctcatcaaacagaggagatgatgaatgacacaattgaacctggcggcagcgcaaaagatg

SEQ ID NO: 8600 - DNA, 103 bp, Artificial Sequence
  Synthetic Polynucleotide
taatacgactcactatagggatttgccgttgtgttttcaattgtgtgtctaacagaggagaagacacatgattgaaaacaacctggcggcagcgcaaaagatg

SEQ ID NO: 8601 - DNA, 103 bp, Artificial Sequence
  Synthetic Polynucleotide
taatacgactcactataggggaaatatttgccgttgtgttttcaattgtgaacagaggagacacaatatgaaacacaacaacctggcggcagcgcaaaagatg

SEQ ID NO: 8602 - DNA, 103 bp, Artificial Sequence
  Synthetic Polynucleotide
taatacgactcactatagggtcagagatctgctctctaataaaaaactgtaacagaggagaacagttatgtattagagaaacctggcggcagcgcaaaagatg

SEQ ID NO: 8603 - DNA, 103 bp, Artificial Sequence
  Synthetic Polynucleotide
taatacgactcactataggggtgccagtgcgacggaacgtttgtctcgtcaacagaggagagacgagatgaacgttccgaacctggcggcagcgcaaaagatg

SEQ ID NO: 8604 - DNA, 103 bp, Artificial Sequence
  Synthetic Polynucleotide
taatacgactcactatagggtcagggaaatatttgccgttgtgttttcaaaacagaggagattgaaaatgcaacggcaaaacctggcggcagcgcaaaagatg

SEQ ID NO: 8605 - DNA, 103 bp, Artificial Sequence
  Synthetic Polynucleotide
taatacgactcactatagggagctgtcagggaaatatttgccgttgtgttaacagaggagaaacacaatggcaaatattaacctggcggcagcgcaaaagatg

SEQ ID NO: 8606 - DNA, 103 bp, Artificial Sequence
  Synthetic Polynucleotide
taatacgactcactataggggcaatagctgtcagggaaatatttgccgttaacagaggagaaacggcatgtatttccctaacctggcggcagcgcaaaagatg

SEQ ID NO: 8607 - DNA, 103 bp, Artificial Sequence
  Synthetic Polynucleotide
taatacgactcactatagggggtttgcaatagctgtcagggaaatatttgaacagaggagacaaataatgccctgacagaacctggcggcagcgcaaaagatg

SEQ ID NO: 8608 - DNA, 103 bp, Artificial Sequence
  Synthetic Polynucleotide
taatacgactcactatagggtgcctggtttgcaatagctgtcagggaaataacagaggagaatttccatgacagctattaacctggcggcagcgcaaaagatg

SEQ ID NO: 8609 - DNA, 103 bp, Artificial Sequence
  Synthetic Polynucleotide
taatacgactcactatagggatagctgcctggtttgcaatagctgtcaggaacagaggagacctgacatgtattgcaaaaacctggcggcagcgcaaaagatg

SEQ ID NO: 8610 - DNA, 103 bp, Artificial Sequence
  Synthetic Polynucleotide
taatacgactcactatagggtcaatatagctgcctggtttgcaatagctgaacagaggagacagctaatgcaaaccaggaacctggcggcagcgcaaaagatg

SEQ ID NO: 8611 - DNA, 103 bp, Artificial Sequence
  Synthetic Polynucleotide
taatacgactcactatagggtcccatcaatatagctgcctggtttgcaataacagaggagaattgcaatgcaggcagctaacctggcggcagcgcaaaagatg

SEQ ID NO: 8612 - DNA, 103 bp, Artificial Sequence
  Synthetic Polynucleotide
taatacgactcactatagggtcaagtcccatcaatatagctgcctggtttaacagaggagaaaaccaatgagctatattaacctggcggcagcgcaaaagatg

SEQ ID NO: 8613 - DNA, 103 bp, Artificial Sequence
  Synthetic Polynucleotide
taatacgactcactatagggccttgtcaagtcccatcaatatagctgcctaacagaggagaaggcagatgtattgatggaacctggcggcagcgcaaaagatg

SEQ ID NO: 8614 - DNA, 103 bp, Artificial Sequence
  Synthetic Polynucleotide
taatacgactcactataggggtgtggtgccagtgcgacggaacgtttgtcaacagaggagagacaaaatgtccgtcgcaaacctggcggcagcgcaaaagatg

SEQ ID NO: 8615 - DNA, 103 bp, Artificial Sequence
  Synthetic Polynucleotide
taatacgactcactatagggccatcccttgtcaagtcccatcaatatagcaacagaggagagctataatgatgggacttaacctggcggcagcgcaaaagatg

SEQ ID NO: 8616 - DNA, 103 bp, Artificial Sequence
  Synthetic Polynucleotide
taatacgactcactatagggattggccatcccttgtcaagtcccatcaataacagaggagaattgatatgacttgacaaaacctggcggcagcgcaaaagatg

SEQ ID NO: 8617 - DNA, 103 bp, Artificial Sequence
  Synthetic Polynucleotide
taatacgactcactatagggttgatattggccatcccttgtcaagtcccaaacagaggagatgggacatgacaagggataacctggcggcagcgcaaaagatg

SEQ ID NO: 8618 - DNA, 103 bp, Artificial Sequence
  Synthetic Polynucleotide
taatacgactcactatagggcatctttgatattggccatcccttgtcaagaacagaggagacttgacatgggatggccaaacctggcggcagcgcaaaagatg

SEQ ID NO: 8619 - DNA, 103 bp, Artificial Sequence
  Synthetic Polynucleotide
taatacgactcactatagggatgtccatctttgatattggccatcccttgaacagaggagacaagggatggccaatatcaacctggcggcagcgcaaaagatg

SEQ ID NO: 8620 - DNA, 103 bp, Artificial Sequence
  Synthetic Polynucleotide
taatacgactcactatagggctcctatgtccatctttgatattggccatcaacagaggagagatggcatgtatcaaagaaacctggcggcagcgcaaaagatg

SEQ ID NO: 8621 - DNA, 103 bp, Artificial Sequence
  Synthetic Polynucleotide
taatacgactcactatagggtggaactcctatgtccatctttgatattggaacagaggagaccaataatgaagatggacaacctggcggcagcgcaaaagatg

SEQ ID NO: 8622 - DNA, 103 bp, Artificial Sequence
  Synthetic Polynucleotide
taatacgactcactatagggagaagtggaactcctatgtccatctttgataacagaggagaatcaaaatgggacataggaacctggcggcagcgcaaaagatg

SEQ ID NO: 8623 - DNA, 103 bp, Artificial Sequence
  Synthetic Polynucleotide
taatacgactcactatagggaggcgagaagtggaactcctatgtccatctaacagaggagaagatggatgtaggagttcaacctggcggcagcgcaaaagatg

SEQ ID NO: 8624 - DNA, 103 bp, Artificial Sequence
  Synthetic Polynucleotide
taatacgactcactatagggccccaaggcgagaagtggaactcctatgtcaacagaggagagacataatggttccacttaacctggcggcagcgcaaaagatg

SEQ ID NO: 8625 - DNA, 103 bp, Artificial Sequence
  Synthetic Polynucleotide
taatacgactcactatagggcctacgtgtggtgccagtgcgacggaacgtaacagaggagaacgttcatgcgcactggcaacctggcggcagcgcaaaagatg

SEQ ID NO: 8626 - DNA, 103 bp, Artificial Sequence
  Synthetic Polynucleotide
taatacgactcactatagggtagcaccccaaggcgagaagtggaactcctaacagaggagaaggagtatgacttctcgcaacctggcggcagcgcaaaagatg

SEQ ID NO: 8627 - DNA, 103 bp, Artificial Sequence
  Synthetic Polynucleotide
taatacgactcactataggggagaatagcaccccaaggcgagaagtggaaaacagaggagattccacatgtcgccttggaacctggcggcagcgcaaaagatg

SEQ ID NO: 8628 - DNA, 103 bp, Artificial Sequence
  Synthetic Polynucleotide
taatacgactcactatagggcacctgagaatagcaccccaaggcgagaagaacagaggagacttctcatgttggggtgcaacctggcggcagcgcaaaagatg

SEQ ID NO: 8629 - DNA, 103 bp, Artificial Sequence
  Synthetic Polynucleotide
taatacgactcactataggggggttcacctgagaatagcaccccaaggcgaacagaggagacgccttatggtgctattcaacctggcggcagcgcaaaagatg

SEQ ID NO: 8630 - DNA, 103 bp, Artificial Sequence
  Synthetic Polynucleotide
taatacgactcactatagggtcagcgggttcacctgagaatagcaccccaaacagaggagatggggtatgattctcaggaacctggcggcagcgcaaaagatg

SEQ ID NO: 8631 - DNA, 103 bp, Artificial Sequence
  Synthetic Polynucleotide
taatacgactcactatagggcagcgtcagcgggttcacctgagaatagcaaacagaggagatgctatatgcaggtgaacaacctggcggcagcgcaaaagatg

SEQ ID NO: 8632 - DNA, 103 bp, Artificial Sequence
  Synthetic Polynucleotide
taatacgactcactataggggctgtcagcgtcagcgggttcacctgagaaaacagaggagattctcaatggaacccgctaacctggcggcagcgcaaaagatg

SEQ ID NO: 8633 - DNA, 103 bp, Artificial Sequence
  Synthetic Polynucleotide
taatacgactcactatagggccgccgctgtcagcgtcagcgggttcacctaacagaggagaaggtgaatgcgctgacgcaacctggcggcagcgcaaaagatg

SEQ ID NO: 8634 - DNA, 103 bp, Artificial Sequence
  Synthetic Polynucleotide
taatacgactcactatagggcaataccgccgctgtcagcgtcagcgggttaacagaggagaaacccgatgacgctgacaaacctggcggcagcgcaaaagatg

SEQ ID NO: 8635 - DNA, 103 bp, Artificial Sequence
  Synthetic Polynucleotide
taatacgactcactatagggagcatcaataccgccgctgtcagcgtcagcaacagaggagagctgacatggacagcggcaacctggcggcagcgcaaaagatg

SEQ ID NO: 8636 - DNA, 103 bp, Artificial Sequence
  Synthetic Polynucleotide
taatacgactcactatagggcaagccctacgtgtggtgccagtgcgacggaacagaggagaccgtcgatgtggcaccacaacctggcggcagcgcaaaagatg

SEQ ID NO: 8637 - DNA, 103 bp, Artificial Sequence
  Synthetic Polynucleotide
taatacgactcactatagggccactagcatcaataccgccgctgtcagcgaacagaggagacgctgaatgcggcggtataacctggcggcagcgcaaaagatg

SEQ ID NO: 8638 - DNA, 103 bp, Artificial Sequence
  Synthetic Polynucleotide
taatacgactcactatagggatgagccactagcatcaataccgccgctgtaacagaggagaacagcgatggtattgatgaacctggcggcagcgcaaaagatg

SEQ ID NO: 8639 - DNA, 103 bp, Artificial Sequence
  Synthetic Polynucleotide
taatacgactcactataggggcataatgagccactagcatcaataccgccaacagaggagaggcggtatggatgctagtaacctggcggcagcgcaaaagatg

SEQ ID NO: 8640 - DNA, 103 bp, Artificial Sequence
  Synthetic Polynucleotide
taatacgactcactatagggttatggcataatgagccactagcatcaataaacagaggagatattgaatgtagtggctcaacctggcggcagcgcaaaagatg

SEQ ID NO: 8641 - DNA, 103 bp, Artificial Sequence
  Synthetic Polynucleotide
taatacgactcactatagggtccaattatggcataatgagccactagcataacagaggagaatgctaatggctcattataacctggcggcagcgcaaaagatg

SEQ ID NO: 8642 - DNA, 103 bp, Artificial Sequence
  Synthetic Polynucleotide
taatacgactcactatagggccgggtccaattatggcataatgagccactaacagaggagaagtggcatgttatgccataacctggcggcagcgcaaaagatg

SEQ ID NO: 8643 - DNA, 103 bp, Artificial Sequence
  Synthetic Polynucleotide
taatacgactcactataggggcagtccgggtccaattatggcataatgagaacagaggagactcattatgccataattgaacctggcggcagcgcaaaagatg

SEQ ID NO: 8644 - DNA, 103 bp, Artificial Sequence
  Synthetic Polynucleotide
taatacgactcactatagggtgcttgcagtccgggtccaattatggcataaacagaggagatatgccatgattggacccaacctggcggcagcgcaaaagatg

SEQ ID NO: 8645 - DNA, 103 bp, Artificial Sequence
  Synthetic Polynucleotide
taatacgactcactataggggcttttgcttgcagtccgggtccaattatgaacagaggagacataatatgacccggactaacctggcggcagcgcaaaagatg

SEQ ID NO: 8646 - DNA, 103 bp, Artificial Sequence
  Synthetic Polynucleotide
taatacgactcactatagggtagtagcttttgcttgcagtccgggtccaaaacagaggagattggacatggactgcaagaacctggcggcagcgcaaaagatg

SEQ ID NO: 8647 - DNA, 103 bp, Artificial Sequence
  Synthetic Polynucleotide
taatacgactcactatagggtagaccaagccctacgtgtggtgccagtgcaacagaggagagcactgatgccacacgtaaacctggcggcagcgcaaaagatg

SEQ ID NO: 8648 - DNA, 103 bp, Artificial Sequence
  Synthetic Polynucleotide
taatacgactcactatagggttctctagtagcttttgcttgcagtccgggaacagaggagacccggaatgcaagcaaaaaacctggcggcagcgcaaaagatg

SEQ ID NO: 8649 - DNA, 103 bp, Artificial Sequence
  Synthetic Polynucleotide
taatacgactcactatagggtgagcttctctagtagcttttgcttgcagtaacagaggagaactgcaatgaaaagctacaacctggcggcagcgcaaaagatg

SEQ ID NO: 8650 - DNA, 103 bp, Artificial Sequence
  Synthetic Polynucleotide
taatacgactcactatagggttttttgagcttctctagtagcttttgcttaacagaggagaaagcaaatgctactagagaacctggcggcagcgcaaaagatg

SEQ ID NO: 8651 - DNA, 103 bp, Artificial Sequence
  Synthetic Polynucleotide
taatacgactcactatagggtgtccttttttgagcttctctagtagctttaacagaggagaaaagctatgagagaagctaacctggcggcagcgcaaaagatg

SEQ ID NO: 8652 - DNA, 103 bp, Artificial Sequence
  Synthetic Polynucleotide
taatacgactcactataggggctgctgtccttttttgagcttctctagtaaacagaggagatactagatgagctcaaaaaacctggcggcagcgcaaaagatg

SEQ ID NO: 8653 - DNA, 103 bp, Artificial Sequence
  Synthetic Polynucleotide
taatacgactcactatagggttccggctgctgtccttttttgagcttctcaacagaggagagagaagatgaaaaaaggaaacctggcggcagcgcaaaagatg

SEQ ID NO: 8654 - DNA, 103 bp, Artificial Sequence
  Synthetic Polynucleotide
taatacgactcactatagggcattattccggctgctgtccttttttgagcaacagaggagagctcaaatgaggacagcaaacctggcggcagcgcaaaagatg

SEQ ID NO: 8655 - DNA, 103 bp, Artificial Sequence
  Synthetic Polynucleotide
taatacgactcactatagggtttttcattattccggctgctgtcctttttaacagaggagaaaaaagatgagcagccggaacctggcggcagcgcaaaagatg

SEQ ID NO: 8656 - DNA, 103 bp, Artificial Sequence
  Synthetic Polynucleotide
taatacgactcactatagggttgggtttttcattattccggctgctgtccaacagaggagaggacagatgccggaataaaacctggcggcagcgcaaaagatg

SEQ ID NO: 8657 - DNA, 103 bp, Artificial Sequence
  Synthetic Polynucleotide
taatacgactcactataggggacagttgggtttttcattattccggctgcaacagaggagagcagccatgataatgaaaaacctggcggcagcgcaaaagatg

SEQ ID NO: 8658 - DNA, 103 bp, Artificial Sequence
  Synthetic Polynucleotide
taatacgactcactataggggtttctagaccaagccctacgtgtggtgccaacagaggagaggcaccatgcgtagggctaacctggcggcagcgcaaaagatg

SEQ ID NO: 8659 - DNA, 103 bp, Artificial Sequence
  Synthetic Polynucleotide
taatacgactcactatagggccgtcgacagttgggtttttcattattccgaacagaggagacggaatatggaaaaacccaacctggcggcagcgcaaaagatg

SEQ ID NO: 8660 - DNA, 103 bp, Artificial Sequence
  Synthetic Polynucleotide
taatacgactcactatagggcgatcccgtcgacagttgggtttttcattaaacagaggagataatgaatgacccaactgaacctggcggcagcgcaaaagatg

SEQ ID NO: 8661 - DNA, 103 bp, Artificial Sequence
  Synthetic Polynucleotide
taatacgactcactatagggtgcaacgatcccgtcgacagttgggtttttaacagaggagaaaaaacatgactgtcgacaacctggcggcagcgcaaaagatg

SEQ ID NO: 8662 - DNA, 103 bp, Artificial Sequence
  Synthetic Polynucleotide
taatacgactcactatagggtctattgcaacgatcccgtcgacagttgggaacagaggagacccaacatgcgacgggataacctggcggcagcgcaaaagatg

SEQ ID NO: 8663 - DNA, 103 bp, Artificial Sequence
  Synthetic Polynucleotide
taatacgactcactatagggccaaatctattgcaacgatcccgtcgacagaacagaggagactgtcgatgggatcgttgaacctggcggcagcgcaaaagatg

SEQ ID NO: 8664 - DNA, 103 bp, Artificial Sequence
  Synthetic Polynucleotide
taatacgactcactatagggagggtccaaatctattgcaacgatcccgtcaacagaggagagacgggatggttgcaataaacctggcggcagcgcaaaagatg

SEQ ID NO: 8665 - DNA, 103 bp, Artificial Sequence
  Synthetic Polynucleotide
taatacgactcactatagggaccacagggtccaaatctattgcaacgatcaacagaggagagatcgtatgaatagatttaacctggcggcagcgcaaaagatg

SEQ ID NO: 8666 - DNA, 103 bp, Artificial Sequence
  Synthetic Polynucleotide
taatacgactcactatagggcgtaaaccacagggtccaaatctattgcaaaacagaggagattgcaaatgatttggaccaacctggcggcagcgcaaaagatg

SEQ ID NO: 8667 - DNA, 103 bp, Artificial Sequence
  Synthetic Polynucleotide
taatacgactcactatagggtgcatcgtaaaccacagggtccaaatctataacagaggagaatagatatggaccctgtgaacctggcggcagcgcaaaagatg

SEQ ID NO: 8668 - DNA, 103 bp, Artificial Sequence
  Synthetic Polynucleotide
taatacgactcactatagggaattttgcatcgtaaaccacagggtccaaaaacagaggagatttggaatgtgtggtttaaacctggcggcagcgcaaaagatg

SEQ ID NO: 8669 - DNA, 103 bp, Artificial Sequence
  Synthetic Polynucleotide
taatacgactcactatagggttcttgtttctagaccaagccctacgtgtgaacagaggagacacacgatgggcttggtcaacctggcggcagcgcaaaagatg

SEQ ID NO: 8670 - DNA, 103 bp, Artificial Sequence
  Synthetic Polynucleotide
taatacgactcactatagggtttcaaattttgcatcgtaaaccacagggtaacagaggagaaccctgatgtttacgatgaacctggcggcagcgcaaaagatg

SEQ ID NO: 8671 - DNA, 103 bp, Artificial Sequence
  Synthetic Polynucleotide
taatacgactcactatagggctgtttttcaaattttgcatcgtaaaccacaacagaggagagtggttatggatgcaaaaaacctggcggcagcgcaaaagatg

SEQ ID NO: 8672 - DNA, 103 bp, Artificial Sequence
  Synthetic Polynucleotide
taatacgactcactatagggcctagctgtttttcaaattttgcatcgtaaaacagaggagattacgaatgaaaatttgaaacctggcggcagcgcaaaagatg

SEQ ID NO: 8673 - DNA, 103 bp, Artificial Sequence
  Synthetic Polynucleotide
taatacgactcactatagggtttggcctagctgtttttcaaattttgcataacagaggagaatgcaaatgttgaaaaacaacctggcggcagcgcaaaagatg

SEQ ID NO: 8674 - DNA, 103 bp, Artificial Sequence
  Synthetic Polynucleotide
taatacgactcactatagggcattatttggcctagctgtttttcaaatttaacagaggagaaaatttatgaaacagctaaacctggcggcagcgcaaaagatg

SEQ ID NO: 8675 - DNA, 103 bp, Artificial Sequence
  Synthetic Polynucleotide
taatacgactcactatagggaacaacattatttggcctagctgtttttcaaacagaggagatgaaaaatggctaggccaaacctggcggcagcgcaaaagatg

SEQ ID NO: 8676 - DNA, 103 bp, Artificial Sequence
  Synthetic Polynucleotide
taatacgactcactataggggtatcaacaacattatttggcctagctgttaacagaggagaaacagcatggccaaataaaacctggcggcagcgcaaaagatg

SEQ ID NO: 8677 - DNA, 103 bp, Artificial Sequence
  Synthetic Polynucleotide
taatacgactcactataggggcaaagtatcaacaacattatttggcctagaacagaggagactaggcatgataatgttgaacctggcggcagcgcaaaagatg

SEQ ID NO: 8678 - DNA, 103 bp, Artificial Sequence
  Synthetic Polynucleotide
taatacgactcactataggggatgtgcaaagtatcaacaacattatttggaacagaggagaccaaatatggttgttgataacctggcggcagcgcaaaagatg

SEQ ID NO: 8679 - DNA, 103 bp, Artificial Sequence
  Synthetic Polynucleotide
taatacgactcactatagggtctgtgatgtgcaaagtatcaacaacattaaacagaggagataatgtatgtgatactttaacctggcggcagcgcaaaagatg

SEQ ID NO: 8680 - DNA, 103 bp, Artificial Sequence
  Synthetic Polynucleotide
taatacgactcactatagggttcggttcttgtttctagaccaagccctacaacagaggagagtagggatgggtctagaaaacctggcggcagcgcaaaagatg

SEQ ID NO: 8681 - DNA, 103 bp, Artificial Sequence
  Synthetic Polynucleotide
taatacgactcactataggggaggatctgtgatgtgcaaagtatcaacaaaacagaggagattgttgatgctttgcacaaacctggcggcagcgcaaaagatg

SEQ ID NO: 8682 - DNA, 103 bp, Artificial Sequence
  Synthetic Polynucleotide
taatacgactcactatagggatcaggaggatctgtgatgtgcaaagtatcaacagaggagagatactatgcacatcacaaacctggcggcagcgcaaaagatg

SEQ ID NO: 8683 - DNA, 103 bp, Artificial Sequence
  Synthetic Polynucleotide
taatacgactcactatagggtccgcatcaggaggatctgtgatgtgcaaaaacagaggagatttgcaatgcacagatccaacctggcggcagcgcaaaagatg

SEQ ID NO: 8684 - DNA, 103 bp, Artificial Sequence
  Synthetic Polynucleotide
taatacgactcactatagggtgtggtccgcatcaggaggatctgtgatgtaacagaggagaacatcaatgatcctcctgaacctggcggcagcgcaaaagatg

SEQ ID NO: 8685 - DNA, 103 bp, Artificial Sequence
  Synthetic Polynucleotide
taatacgactcactataggggcccatgtggtccgcatcaggaggatctgtaacagaggagaacagatatgcctgatgcgaacctggcggcagcgcaaaagatg

SEQ ID NO: 8686 - DNA, 103 bp, Artificial Sequence
  Synthetic Polynucleotide
taatacgactcactatagggacaaggcccatgtggtccgcatcaggaggaaacagaggagatcctccatgtgcggaccaaacctggcggcagcgcaaaagatg

SEQ ID NO: 8687 - DNA, 103 bp, Artificial Sequence
  Synthetic Polynucleotide
taatacgactcactatagggttcacacaaggcccatgtggtccgcatcagaacagaggagactgatgatgaccacatggaacctggcggcagcgcaaaagatg

SEQ ID NO: 8688 - DNA, 103 bp, Artificial Sequence
  Synthetic Polynucleotide
taatacgactcactatagggatggattcacacaaggcccatgtggtccgcaacagaggagagcggacatgatgggccttaacctggcggcagcgcaaaagatg

SEQ ID NO: 8689 - DNA, 103 bp, Artificial Sequence
  Synthetic Polynucleotide
taatacgactcactataggggtgtgatggattcacacaaggcccatgtggaacagaggagaccacatatgccttgtgtgaacctggcggcagcgcaaaagatg

SEQ ID NO: 8690 - DNA, 103 bp, Artificial Sequence
  Synthetic Polynucleotide
taatacgactcactatagggggctagtgtgatggattcacacaaggcccaaacagaggagatgggccatgtgtgaatccaacctggcggcagcgcaaaagatg

SEQ ID NO: 8691 - DNA, 103 bp, Artificial Sequence
  Synthetic Polynucleotide
taatacgactcactatagggcacgtttcggttcttgtttctagaccaagcaacagaggagagcttggatgagaaacaagaacctggcggcagcgcaaaagatg

SEQ ID NO: 8692 - DNA, 103 bp, Artificial Sequence
  Synthetic Polynucleotide
taatacgactcactatagggccagtggctagtgtgatggattcacacaagaacagaggagacttgtgatgatccatcacaacctggcggcagcgcaaaagatg

SEQ ID NO: 8693 - DNA, 103 bp, Artificial Sequence
  Synthetic Polynucleotide
taatacgactcactataggggaggtccagtggctagtgtgatggattcacaacagaggagagtgaatatgtcacactagaacctggcggcagcgcaaaagatg

SEQ ID NO: 8694 - DNA, 103 bp, Artificial Sequence
  Synthetic Polynucleotide
taatacgactcactatagggagtcagaggtccagtggctagtgtgatggaaacagaggagatccatcatgctagccactaacctggcggcagcgcaaaagatg

SEQ ID NO: 8695 - DNA, 103 bp, Artificial Sequence
  Synthetic Polynucleotide
taatacgactcactatagggagcgtagtcagaggtccagtggctagtgtgaacagaggagacacactatgcactggaccaacctggcggcagcgcaaaagatg

SEQ ID NO: 8696 - DNA, 103 bp, Artificial Sequence
  Synthetic Polynucleotide
taatacgactcactatagggcccaaagcgtagtcagaggtccagtggctaaacagaggagatagccaatggacctctgaaacctggcggcagcgcaaaagatg

SEQ ID NO: 8697 - DNA, 103 bp, Artificial Sequence
  Synthetic Polynucleotide
taatacgactcactatagggtccctcccaaagcgtagtcagaggtccagtaacagaggagaactggaatgctgactacgaacctggcggcagcgcaaaagatg

SEQ ID NO: 8698 - DNA, 103 bp, Artificial Sequence
  Synthetic Polynucleotide
taatacgactcactatagggggagatccctcccaaagcgtagtcagaggtaacagaggagaacctctatgtacgctttgaacctggcggcagcgcaaaagatg

SEQ ID NO: 8699 - DNA, 103 bp, Artificial Sequence
  Synthetic Polynucleotide
taatacgactcactatagggttcctggagatccctcccaaagcgtagtcaaacagaggagatgactaatgtttgggaggaacctggcggcagcgcaaaagatg

SEQ ID NO: 8700 - DNA, 103 bp, Artificial Sequence
  Synthetic Polynucleotide
taatacgactcactataggggaattttcctggagatccctcccaaagcgtaacagaggagaacgcttatggagggatctaacctggcggcagcgcaaaagatg

SEQ ID NO: 8701 - DNA, 103 bp, Artificial Sequence
  Synthetic Polynucleotide
taatacgactcactatagggttccagaattttcctggagatccctcccaaaacagaggagattgggaatgatctccaggaacctggcggcagcgcaaaagatg

SEQ ID NO: 8702 - DNA, 103 bp, Artificial Sequence
  Synthetic Polynucleotide
taatacgactcactatagggacatccacgtttcggttcttgtttctagacaacagaggagagtctagatgcaagaaccgaacctggcggcagcgcaaaagatg

SEQ ID NO: 8703 - DNA, 103 bp, Artificial Sequence
  Synthetic Polynucleotide
taatacgactcactatagggtggtgttccagaattttcctggagatccctaacagaggagaagggatatgcaggaaaataacctggcggcagcgcaaaagatg

SEQ ID NO: 8704 - DNA, 103 bp, Artificial Sequence
  Synthetic Polynucleotide
taatacgactcactatagggtatcgtggtgttccagaattttcctggagaaacagaggagatctccaatgaaattctggaacctggcggcagcgcaaaagatg

SEQ ID NO: 8705 - DNA, 103 bp, Artificial Sequence
  Synthetic Polynucleotide
taatacgactcactatagggaccgctatcgtggtgttccagaattttcctaacagaggagaaggaaaatgctggaacacaacctggcggcagcgcaaaagatg

SEQ ID NO: 8706 - DNA, 103 bp, Artificial Sequence
  Synthetic Polynucleotide
taatacgactcactatagggtggacaccgctatcgtggtgttccagaattaacagaggagaaattctatgacaccacgaaacctggcggcagcgcaaaagatg

SEQ ID NO: 8707 - DNA, 103 bp, Artificial Sequence
  Synthetic Polynucleotide
taatacgactcactatagggtgccatggacaccgctatcgtggtgttccaaacagaggagatggaacatgacgatagcgaacctggcggcagcgcaaaagatg

SEQ ID NO: 8708 - DNA, 103 bp, Artificial Sequence
  Synthetic Polynucleotide
taatacgactcactatagggatgtttgccatggacaccgctatcgtggtgaacagaggagacaccacatgagcggtgtcaacctggcggcagcgcaaaagatg

SEQ ID NO: 8709 - DNA, 103 bp, Artificial Sequence
  Synthetic Polynucleotide
taatacgactcactatagggtaaaaatgtttgccatggacaccgctatcgaacagaggagacgatagatgtgtccatggaacctggcggcagcgcaaaagatg

SEQ ID NO: 8710 - DNA, 103 bp, Artificial Sequence
  Synthetic Polynucleotide
taatacgactcactatagggtcccctaaaaatgtttgccatggacaccgcaacagaggagagcggtgatgatggcaaacaacctggcggcagcgcaaaagatg

SEQ ID NO: 8711 - DNA, 103 bp, Artificial Sequence
  Synthetic Polynucleotide
taatacgactcactatagggtaacttcccctaaaaatgtttgccatggacaacagaggagagtccatatgaaacattttaacctggcggcagcgcaaaagatg

SEQ ID NO: 8712 - DNA, 103 bp, Artificial Sequence
  Synthetic Polynucleotide
taatacgactcactatagggctagataacttcccctaaaaatgtttgccaaacagaggagatggcaaatgtttttagggaacctggcggcagcgcaaaagatg

SEQ ID NO: 8713 - DNA, 103 bp, Artificial Sequence
  Synthetic Polynucleotide
taatacgactcactataggggttcatcagagatctgctctctaataaaaaaacagaggagatttttaatggagagcagaaacctggcggcagcgcaaaagatg

SEQ ID NO: 8714 - DNA, 103 bp, Artificial Sequence
  Synthetic Polynucleotide
taatacgactcactatagggagaggacatccacgtttcggttcttgtttcaacagaggagagaaacaatgaccgaaacgaacctggcggcagcgcaaaagatg

SEQ ID NO: 8715 - DNA, 103 bp, Artificial Sequence
  Synthetic Polynucleotide
taatacgactcactatagggtcctgctagataacttcccctaaaaatgttaacagaggagaaacattatgaggggaagtaacctggcggcagcgcaaaagatg

SEQ ID NO: 8716 - DNA, 103 bp, Artificial Sequence
  Synthetic Polynucleotide
taatacgactcactatagggcctgctcctgctagataacttcccctaaaaaacagaggagattttagatgaagttatctaacctggcggcagcgcaaaagatg

SEQ ID NO: 8717 - DNA, 103 bp, Artificial Sequence
  Synthetic Polynucleotide
taatacgactcactatagggccagacctgctcctgctagataacttccccaacagaggagaggggaaatgatctagcagaacctggcggcagcgcaaaagatg

SEQ ID NO: 8718 - DNA, 103 bp, Artificial Sequence
  Synthetic Polynucleotide
taatacgactcactatagggaaaggccagacctgctcctgctagataactaacagaggagaagttatatggcaggagcaaacctggcggcagcgcaaaagatg

SEQ ID NO: 8719 - DNA, 103 bp, Artificial Sequence
  Synthetic Polynucleotide
taatacgactcactatagggaatgaaaaggccagacctgctcctgctagaaacagaggagatctagcatgagcaggtctaacctggcggcagcgcaaaagatg

SEQ ID NO: 8720 - DNA, 103 bp, Artificial Sequence
  Synthetic Polynucleotide
taatacgactcactatagggtcattaatgaaaaggccagacctgctcctgaacagaggagacaggagatggtctggcctaacctggcggcagcgcaaaagatg

SEQ ID NO: 8721 - DNA, 103 bp, Artificial Sequence
  Synthetic Polynucleotide
taatacgactcactatagggagatttcattaatgaaaaggccagacctgcaacagaggagagcaggtatggccttttcaaacctggcggcagcgcaaaagatg

SEQ ID NO: 8722 - DNA, 103 bp, Artificial Sequence
  Synthetic Polynucleotide
taatacgactcactatagggcctagagatttcattaatgaaaaggccagaaacagaggagatctggcatgttcattaataacctggcggcagcgcaaaagatg

SEQ ID NO: 8723 - DNA, 103 bp, Artificial Sequence
  Synthetic Polynucleotide
taatacgactcactatagggctcctcctagagatttcattaatgaaaaggaacagaggagaccttttatgtaatgaaataacctggcggcagcgcaaaagatg

SEQ ID NO: 8724 - DNA, 103 bp, Artificial Sequence
  Synthetic Polynucleotide
taatacgactcactatagggcctacctcctcctagagatttcattaatgaaacagaggagatcattaatgaaatctctaaacctggcggcagcgcaaaagatg

SEQ ID NO: 8725 - DNA, 103 bp, Artificial Sequence
  Synthetic Polynucleotide
taatacgactcactatagggccttcagaggacatccacgtttcggttcttaacagaggagaaagaacatgaacgtggataacctggcggcagcgcaaaagatg

SEQ ID NO: 8726 - DNA, 103 bp, Artificial Sequence
  Synthetic Polynucleotide
taatacgactcactatagggcctctcctacctcctcctagagatttcattaacagaggagaaatgaaatgtctaggaggaacctggcggcagcgcaaaagatg

SEQ ID NO: 8727 - DNA, 103 bp, Artificial Sequence
  Synthetic Polynucleotide
taatacgactcactatagggccgtgcctctcctacctcctcctagagattaacagaggagaaatctcatggaggaggtaaacctggcggcagcgcaaaagatg

SEQ ID NO: 8728 - DNA, 103 bp, Artificial Sequence
  Synthetic Polynucleotide
taatacgactcactatagggggctcccgtgcctctcctacctcctcctagaacagaggagactaggaatgggtaggagaaacctggcggcagcgcaaaagatg

SEQ ID NO: 8729 - DNA, 103 bp, Artificial Sequence
  Synthetic Polynucleotide
taatacgactcactatagggccttgggctcccgtgcctctcctacctcctaacagaggagaaggaggatggagaggcacaacctggcggcagcgcaaaagatg

SEQ ID NO: 8730 - DNA, 103 bp, Artificial Sequence
  Synthetic Polynucleotide
taatacgactcactatagggtttccccttgggctcccgtgcctctcctacaacagaggagagtaggaatggcacgggagaacctggcggcagcgcaaaagatg

SEQ ID NO: 8731 - DNA, 103 bp, Artificial Sequence
  Synthetic Polynucleotide
taatacgactcactatagggcagtgtttccccttgggctcccgtgcctctaacagaggagaagaggcatgggagcccaaaacctggcggcagcgcaaaagatg

SEQ ID NO: 8732 - DNA, 103 bp, Artificial Sequence
  Synthetic Polynucleotide
taatacgactcactatagggtctcccagtgtttccccttgggctcccgtgaacagaggagacacgggatgccaaggggaaacctggcggcagcgcaaaagatg

SEQ ID NO: 8733 - DNA, 103 bp, Artificial Sequence
  Synthetic Polynucleotide
taatacgactcactatagggatttttctcccagtgtttccccttgggctcaacagaggagagagcccatggggaaacacaacctggcggcagcgcaaaagatg

SEQ ID NO: 8734 - DNA, 103 bp, Artificial Sequence
  Synthetic Polynucleotide
taatacgactcactatagggtttccatttttctcccagtgtttccccttgaacagaggagacaagggatgacactgggaaacctggcggcagcgcaaaagatg

SEQ ID NO: 8735 - DNA, 103 bp, Artificial Sequence
  Synthetic Polynucleotide
taatacgactcactatagggtgtcttttccatttttctcccagtgtttccaacagaggagaggaaacatggggagaaaaaacctggcggcagcgcaaaagatg

SEQ ID NO: 8736 - DNA, 103 bp, Artificial Sequence
  Synthetic Polynucleotide
taatacgactcactatagggaagcgccttcagaggacatccacgtttcggaacagaggagaccgaaaatgggatgtcctaacctggcggcagcgcaaaagatg

SEQ ID NO: 8737 - DNA, 103 bp, Artificial Sequence
  Synthetic Polynucleotide
taatacgactcactatagggttagctgtcttttccatttttctcccagtgaacagaggagacactggatgaaaaatggaaacctggcggcagcgcaaaagatg

SEQ ID NO: 8738 - DNA, 103 bp, Artificial Sequence
  Synthetic Polynucleotide
taatacgactcactatagggttggtttagctgtcttttccatttttctccaacagaggagaggagaaatgtggaaaagaaacctggcggcagcgcaaaagatg

SEQ ID NO: 8739 - DNA, 103 bp, Artificial Sequence
  Synthetic Polynucleotide
taatacgactcactatagggctcaattggtttagctgtcttttccattttaacagaggagaaaaatgatgaagacagctaacctggcggcagcgcaaaagatg

SEQ ID NO: 8740 - DNA, 103 bp, Artificial Sequence
  Synthetic Polynucleotide
taatacgactcactatagggacttgctcaattggtttagctgtcttttccaacagaggagaggaaaaatgagctaaaccaacctggcggcagcgcaaaagatg

SEQ ID NO: 8741 - DNA, 103 bp, Artificial Sequence
  Synthetic Polynucleotide
taatacgactcactatagggttctgacttgctcaattggtttagctgtctaacagaggagaagacagatgaaccaattgaacctggcggcagcgcaaaagatg

SEQ ID NO: 8742 - DNA, 103 bp, Artificial Sequence
  Synthetic Polynucleotide
taatacgactcactatagggttgaattctgacttgctcaattggtttagcaacagaggagagctaaaatgattgagcaaaacctggcggcagcgcaaaagatg

SEQ ID NO: 8743 - DNA, 103 bp, Artificial Sequence
  Synthetic Polynucleotide
taatacgactcactatagggaagtgttgaattctgacttgctcaattggtaacagaggagaaccaatatggcaagtcagaacctggcggcagcgcaaaagatg

SEQ ID NO: 8744 - DNA, 103 bp, Artificial Sequence
  Synthetic Polynucleotide
taatacgactcactatagggtttgtaagtgttgaattctgacttgctcaaaacagaggagattgagcatgtcagaattcaacctggcggcagcgcaaaagatg

SEQ ID NO: 8745 - DNA, 103 bp, Artificial Sequence
  Synthetic Polynucleotide
taatacgactcactatagggctccttttgtaagtgttgaattctgacttgaacagaggagacaagtcatgattcaacacaacctggcggcagcgcaaaagatg

SEQ ID NO: 8746 - DNA, 103 bp, Artificial Sequence
  Synthetic Polynucleotide
taatacgactcactatagggtcccactccttttgtaagtgttgaattctgaacagaggagacagaatatgacacttacaaacctggcggcagcgcaaaagatg

SEQ ID NO: 8747 - DNA, 103 bp, Artificial Sequence
  Synthetic Polynucleotide
taatacgactcactatagggtttccaagcgccttcagaggacatccacgtaacagaggagaacgtggatgtcctctgaaaacctggcggcagcgcaaaagatg

SEQ ID NO: 8748 - DNA, 103 bp, Artificial Sequence
  Synthetic Polynucleotide
taatacgactcactatagggtataatcccactccttttgtaagtgttgaaaacagaggagattcaacatgtacaaaaggaacctggcggcagcgcaaaagatg

SEQ ID NO: 8749 - DNA, 103 bp, Artificial Sequence
  Synthetic Polynucleotide
taatacgactcactatagggacctctataatcccactccttttgtaagtgaacagaggagacacttaatgaaggagtggaacctggcggcagcgcaaaagatg

SEQ ID NO: 8750 - DNA, 103 bp, Artificial Sequence
  Synthetic Polynucleotide
taatacgactcactatagggtatccacctctataatcccactccttttgtaacagaggagaacaaaaatggtgggattaaacctggcggcagcgcaaaagatg

SEQ ID NO: 8751 - DNA, 103 bp, Artificial Sequence
  Synthetic Polynucleotide
taatacgactcactatagggagatctatccacctctataatcccactcctaacagaggagaaggagtatgattatagagaacctggcggcagcgcaaaagatg

SEQ ID NO: 8752 - DNA, 103 bp, Artificial Sequence
  Synthetic Polynucleotide
taatacgactcactataggggcttcagatctatccacctctataatcccaaacagaggagatgggatatgagaggtggaaacctggcggcagcgcaaaagatg

SEQ ID NO: 8753 - DNA, 103 bp, Artificial Sequence
  Synthetic Polynucleotide
taatacgactcactatagggctttggcttcagatctatccacctctataaaacagaggagattatagatgtggatagataacctggcggcagcgcaaaagatg

SEQ ID NO: 8754 - DNA, 103 bp, Artificial Sequence
  Synthetic Polynucleotide
taatacgactcactatagggcccctctttggcttcagatctatccacctcaacagaggagagaggtgatgagatctgaaaacctggcggcagcgcaaaagatg

SEQ ID NO: 8755 - DNA, 103 bp, Artificial Sequence
  Synthetic Polynucleotide
taatacgactcactatagggtttaacccctctttggcttcagatctatccaacagaggagaggatagatgtgaagccaaaacctggcggcagcgcaaaagatg

SEQ ID NO: 8756 - DNA, 103 bp, Artificial Sequence
  Synthetic Polynucleotide
taatacgactcactatagggctctttttaacccctctttggcttcagatcaacagaggagagatctgatgccaaagaggaacctggcggcagcgcaaaagatg

SEQ ID NO: 8757 - DNA, 103 bp, Artificial Sequence
  Synthetic Polynucleotide
taatacgactcactatagggttctcctctttttaacccctctttggcttcaacagaggagagaagccatggaggggttaaacctggcggcagcgcaaaagatg

SEQ ID NO: 8758 - DNA, 103 bp, Artificial Sequence
  Synthetic Polynucleotide
taatacgactcactatagggatttgtttccaagcgccttcagaggacatcaacagaggagagatgtcatgtgaaggcgcaacctggcggcagcgcaaaagatg

SEQ ID NO: 8759 - DNA, 103 bp, Artificial Sequence
  Synthetic Polynucleotide
taatacgactcactataggggtcgtttctcctctttttaacccctctttgaacagaggagacaaagaatggttaaaaagaacctggcggcagcgcaaaagatg

SEQ ID NO: 8760 - DNA, 103 bp, Artificial Sequence
  Synthetic Polynucleotide
taatacgactcactataggggtttagtcgtttctcctctttttaacccctaacagaggagaaggggtatgaaagaggagaacctggcggcagcgcaaaagatg

SEQ ID NO: 8761 - DNA, 103 bp, Artificial Sequence
  Synthetic Polynucleotide
taatacgactcactatagggtgcgtgtttagtcgtttctcctctttttaaaacagaggagattaaaaatgggagaaacgaacctggcggcagcgcaaaagatg

SEQ ID NO: 8762 - DNA, 103 bp, Artificial Sequence
  Synthetic Polynucleotide
taatacgactcactataggggacactgcgtgtttagtcgtttctcctcttaacagaggagaaagaggatgaacgactaaaacctggcggcagcgcaaaagatg

SEQ ID NO: 8763 - DNA, 103 bp, Artificial Sequence
  Synthetic Polynucleotide
taatacgactcactatagggctctcgacactgcgtgtttagtcgtttctcaacagaggagagagaaaatgctaaacacgaacctggcggcagcgcaaaagatg

SEQ ID NO: 8764 - DNA, 103 bp, Artificial Sequence
  Synthetic Polynucleotide
taatacgactcactatagggcgttcctctcgacactgcgtgtttagtcgtaacagaggagaacgactatgcacgcagtgaacctggcggcagcgcaaaagatg

SEQ ID NO: 8765 - DNA, 103 bp, Artificial Sequence
  Synthetic Polynucleotide
taatacgactcactatagggttggccgttcctctcgacactgcgtgtttaaacagaggagataaacaatgagtgtcgagaacctggcggcagcgcaaaagatg

SEQ ID NO: 8766 - DNA, 103 bp, Artificial Sequence
  Synthetic Polynucleotide
taatacgactcactatagggtcagtttggccgttcctctcgacactgcgtaacagaggagaacgcagatgcgagaggaaaacctggcggcagcgcaaaagatg

SEQ ID NO: 8767 - DNA, 103 bp, Artificial Sequence
  Synthetic Polynucleotide
taatacgactcactatagggccacctcagtttggccgttcctctcgacacaacagaggagagtgtcgatgggaacggccaacctggcggcagcgcaaaagatg

SEQ ID NO: 8768 - DNA, 103 bp, Artificial Sequence
  Synthetic Polynucleotide
taatacgactcactatagggacaaaccacctcagtttggccgttcctctcaacagaggagagagaggatgggccaaactaacctggcggcagcgcaaaagatg

SEQ ID NO: 8769 - DNA, 103 bp, Artificial Sequence
  Synthetic Polynucleotide
taatacgactcactatagggtttgtatttgtttccaagcgccttcagaggaacagaggagacctctgatggcgcttggaaacctggcggcagcgcaaaagatg

SEQ ID NO: 8770 - DNA, 103 bp, Artificial Sequence
  Synthetic Polynucleotide
taatacgactcactatagggtctccacaaaccacctcagtttggccgttcaacagaggagagaacggatgaactgaggtaacctggcggcagcgcaaaagatg

SEQ ID NO: 8771 - DNA, 103 bp, Artificial Sequence
  Synthetic Polynucleotide
taatacgactcactataggggttcctctccacaaaccacctcagtttggcaacagaggagagccaaaatgaggtggtttaacctggcggcagcgcaaaagatg

SEQ ID NO: 8772 - DNA, 103 bp, Artificial Sequence
  Synthetic Polynucleotide
taatacgactcactatagggacaaggttcctctccacaaaccacctcagtaacagaggagaactgagatggtttgtggaaacctggcggcagcgcaaaagatg

SEQ ID NO: 8773 - DNA, 103 bp, Artificial Sequence
  Synthetic Polynucleotide
taatacgactcactataggggtttcacaaggttcctctccacaaaccaccaacagaggagaggtggtatgtggagaggaaacctggcggcagcgcaaaagatg

SEQ ID NO: 8774 - DNA, 103 bp, Artificial Sequence
  Synthetic Polynucleotide
taatacgactcactatagggttctggtttcacaaggttcctctccacaaaaacagaggagatttgtgatgaggaaccttaacctggcggcagcgcaaaagatg

SEQ ID NO: 8775 - DNA, 103 bp, Artificial Sequence
  Synthetic Polynucleotide
taatacgactcactatagggttcccttctggtttcacaaggttcctctccaacagaggagaggagagatgccttgtgaaaacctggcggcagcgcaaaagatg

SEQ ID NO: 8776 - DNA, 103 bp, Artificial Sequence
  Synthetic Polynucleotide
taatacgactcactatagggtgactttcccttctggtttcacaaggttccaacagaggagaggaaccatgtgaaaccagaacctggcggcagcgcaaaagatg

SEQ ID NO: 8777 - DNA, 103 bp, Artificial Sequence
  Synthetic Polynucleotide
taatacgactcactataggggtctatgactttcccttctggtttcacaagaacagaggagacttgtgatgccagaagggaacctggcggcagcgcaaaagatg

SEQ ID NO: 8778 - DNA, 103 bp, Artificial Sequence
  Synthetic Polynucleotide
taatacgactcactatagggccgaggtctatgactttcccttctggtttcaacagaggagagaaaccatgagggaaagtaacctggcggcagcgcaaaagatg

SEQ ID NO: 8779 - DNA, 103 bp, Artificial Sequence
  Synthetic Polynucleotide
taatacgactcactatagggcacaaccgaggtctatgactttcccttctgaacagaggagacagaagatgaagtcatagaacctggcggcagcgcaaaagatg

SEQ ID NO: 8780 - DNA, 103 bp, Artificial Sequence
  Synthetic Polynucleotide
taatacgactcactatagggcactttttgtatttgtttccaagcgccttcaacagaggagagaaggcatgtggaaacaaaacctggcggcagcgcaaaagatg

SEQ ID NO: 8781 - DNA, 103 bp, Artificial Sequence
  Synthetic Polynucleotide
taatacgactcactatagggtcttccacaaccgaggtctatgactttcccaacagaggagagggaaaatgatagacctcaacctggcggcagcgcaaaagatg

SEQ ID NO: 8782 - DNA, 103 bp, Artificial Sequence
  Synthetic Polynucleotide
taatacgactcactatagggccacctcttccacaaccgaggtctatgactaacagaggagaagtcatatgcctcggttgaacctggcggcagcgcaaaagatg

SEQ ID NO: 8783 - DNA, 103 bp, Artificial Sequence
  Synthetic Polynucleotide
taatacgactcactatagggaccagccacctcttccacaaccgaggtctaaacagaggagatagaccatggttgtggaaaacctggcggcagcgcaaaagatg

SEQ ID NO: 8784 - DNA, 103 bp, Artificial Sequence
  Synthetic Polynucleotide
taatacgactcactatagggatatgaccagccacctcttccacaaccgagaacagaggagactcggtatgggaagaggtaacctggcggcagcgcaaaagatg

SEQ ID NO: 8785 - DNA, 103 bp, Artificial Sequence
  Synthetic Polynucleotide
taatacgactcactatagggcaataatatgaccagccacctcttccacaaaacagaggagattgtggatgaggtggctgaacctggcggcagcgcaaaagatg

SEQ ID NO: 8786 - DNA, 103 bp, Artificial Sequence
  Synthetic Polynucleotide
taatacgactcactatagggcagcgcaataatatgaccagccacctcttcaacagaggagagaagagatggctggtcataacctggcggcagcgcaaaagatg

SEQ ID NO: 8787 - DNA, 103 bp, Artificial Sequence
  Synthetic Polynucleotide
taatacgactcactatagggcagcccagcgcaataatatgaccagccaccaacagaggagaggtggcatgtcatattataacctggcggcagcgcaaaagatg

SEQ ID NO: 8788 - DNA, 103 bp, Artificial Sequence
  Synthetic Polynucleotide
taatacgactcactatagggttcttcagcccagcgcaataatatgaccagaacagaggagactggtcatgttattgcgcaacctggcggcagcgcaaaagatg

SEQ ID NO: 8789 - DNA, 103 bp, Artificial Sequence
  Synthetic Polynucleotide
taatacgactcactatagggtgactttcttcagcccagcgcaataatatgaacagaggagacatattatggcgctgggcaacctggcggcagcgcaaaagatg

SEQ ID NO: 8790 - DNA, 103 bp, Artificial Sequence
  Synthetic Polynucleotide
taatacgactcactatagggttctgtgactttcttcagcccagcgcaataaacagaggagatattgcatggggctgaagaacctggcggcagcgcaaaagatg

SEQ ID NO: 8791 - DNA, 103 bp, Artificial Sequence
  Synthetic Polynucleotide
taatacgactcactataggggtctccactttttgtatttgtttccaagcgaacagaggagacgcttgatgacaaatacaaacctggcggcagcgcaaaagatg

SEQ ID NO: 8792 - DNA, 103 bp, Artificial Sequence
  Synthetic Polynucleotide
taatacgactcactatagggttcacttctgtgactttcttcagcccagcgaacagaggagacgctggatggaagaaagtaacctggcggcagcgcaaaagatg

SEQ ID NO: 8793 - DNA, 103 bp, Artificial Sequence
  Synthetic Polynucleotide
taatacgactcactatagggatcctttcacttctgtgactttcttcagccaacagaggagaggctgaatgaagtcacagaacctggcggcagcgcaaaagatg

SEQ ID NO: 8794 - DNA, 103 bp, Artificial Sequence
  Synthetic Polynucleotide
taatacgactcactatagggcgtgtatcctttcacttctgtgactttcttaacagaggagaaagaaaatgacagaagtgaacctggcggcagcgcaaaagatg

SEQ ID NO: 8795 - DNA, 103 bp, Artificial Sequence
  Synthetic Polynucleotide
taatacgactcactatagggcctttcgtgtatcctttcacttctgtgactaacagaggagaagtcacatgagtgaaaggaacctggcggcagcgcaaaagatg

SEQ ID NO: 8796 - DNA, 103 bp, Artificial Sequence
  Synthetic Polynucleotide
taatacgactcactataggggtcctcctttcgtgtatcctttcacttctgaacagaggagacagaagatgaaggatacaaacctggcggcagcgcaaaagatg

SEQ ID NO: 8797 - DNA, 103 bp, Artificial Sequence
  Synthetic Polynucleotide
taatacgactcactatagggtccaggtcctcctttcgtgtatcctttcacaacagaggagagtgaaaatgtacacgaaaaacctggcggcagcgcaaaagatg

SEQ ID NO: 8798 - DNA, 103 bp, Artificial Sequence
  Synthetic Polynucleotide
taatacgactcactatagggtcatgtccaggtcctcctttcgtgtatcctaacagaggagaaggataatggaaaggaggaacctggcggcagcgcaaaagatg

SEQ ID NO: 8799 - DNA, 103 bp, Artificial Sequence
  Synthetic Polynucleotide
taatacgactcactataggggttcctcatgtccaggtcctcctttcgtgtaacagaggagaacacgaatggaggacctgaacctggcggcagcgcaaaagatg

SEQ ID NO: 8800 - DNA, 103 bp, Artificial Sequence
  Synthetic Polynucleotide
taatacgactcactataggggattggttcctcatgtccaggtcctcctttaacagaggagaaaaggaatgcctggacataacctggcggcagcgcaaaagatg

SEQ ID NO: 8801 - DNA, 103 bp, Artificial Sequence
  Synthetic Polynucleotide
taatacgactcactatagggattgggattggttcctcatgtccaggtcctaacagaggagaaggaccatgacatgaggaaacctggcggcagcgcaaaagatg

SEQ ID NO: 8802 - DNA, 103 bp, Artificial Sequence
  Synthetic Polynucleotide
taatacgactcactatagggcccaggtctccactttttgtatttgtttccaacagaggagaggaaacatgtacaaaaagaacctggcggcagcgcaaaagatg

SEQ ID NO: 8803 - DNA, 103 bp, Artificial Sequence
  Synthetic Polynucleotide
taatacgactcactatagggttgccattgggattggttcctcatgtccagaacagaggagactggacatgaggaaccaaaacctggcggcagcgcaaaagatg

SEQ ID NO: 8804 - DNA, 103 bp, Artificial Sequence
  Synthetic Polynucleotide
taatacgactcactatagggataggttgccattgggattggttcctcatgaacagaggagacatgagatgccaatcccaaacctggcggcagcgcaaaagatg

SEQ ID NO: 8805 - DNA, 103 bp, Artificial Sequence
  Synthetic Polynucleotide
taatacgactcactatagggcatccataggttgccattgggattggttccaacagaggagaggaaccatgcccaatggcaacctggcggcagcgcaaaagatg

SEQ ID NO: 8806 - DNA, 103 bp, Artificial Sequence
  Synthetic Polynucleotide
taatacgactcactatagggggttccatccataggttgccattgggattgaacagaggagacaatccatgtggcaacctaacctggcggcagcgcaaaagatg

SEQ ID NO: 8807 - DNA, 103 bp, Artificial Sequence
  Synthetic Polynucleotide
taatacgactcactatagggtactaggttccatccataggttgccattggaacagaggagaccaatgatgacctatggaaacctggcggcagcgcaaaagatg

SEQ ID NO: 8808 - DNA, 103 bp, Artificial Sequence
  Synthetic Polynucleotide
taatacgactcactatagggagctttactaggttccatccataggttgccaacagaggagaggcaacatgtggatggaaaacctggcggcagcgcaaaagatg

SEQ ID NO: 8809 - DNA, 103 bp, Artificial Sequence
  Synthetic Polynucleotide
taatacgactcactatagggagtatagctttactaggttccatccataggaacagaggagacctatgatgggaacctagaacctggcggcagcgcaaaagatg

SEQ ID NO: 8810 - DNA, 103 bp, Artificial Sequence
  Synthetic Polynucleotide
taatacgactcactatagggcccggagtatagctttactaggttccatccaacagaggagaggatggatgctagtaaagaacctggcggcagcgcaaaagatg

SEQ ID NO: 8811 - DNA, 103 bp, Artificial Sequence
  Synthetic Polynucleotide
taatacgactcactatagggtctttcccggagtatagctttactaggttcaacagaggagagaacctatgaaagctataaacctggcggcagcgcaaaagatg

SEQ ID NO: 8812 - DNA, 103 bp, Artificial Sequence
  Synthetic Polynucleotide
taatacgactcactatagggatacatctttcccggagtatagctttactaaacagaggagatagtaaatgtatactccgaacctggcggcagcgcaaaagatg

SEQ ID NO: 8813 - DNA, 103 bp, Artificial Sequence
  Synthetic Polynucleotide
taatacgactcactatagggcagagcccaggtctccactttttgtatttgaacagaggagacaaataatgaaagtggagaacctggcggcagcgcaaaagatg

SEQ ID NO: 8814 - DNA, 103 bp, Artificial Sequence
  Synthetic Polynucleotide
taatacgactcactatagggaaagaatacatctttcccggagtatagcttaacagaggagaaagctaatgtccgggaaaaacctggcggcagcgcaaaagatg

SEQ ID NO: 8815 - DNA, 103 bp, Artificial Sequence
  Synthetic Polynucleotide
taatacgactcactatagggggtgtaaagaatacatctttcccggagtataacagaggagaatactcatggaaagatgtaacctggcggcagcgcaaaagatg

SEQ ID NO: 8816 - DNA, 103 bp, Artificial Sequence
  Synthetic Polynucleotide
taatacgactcactatagggcaggtggtgtaaagaatacatctttcccggaacagaggagaccgggaatgatgtattctaacctggcggcagcgcaaaagatg

SEQ ID NO: 8817 - DNA, 103 bp, Artificial Sequence
  Synthetic Polynucleotide
taatacgactcactatagggtttctcaggtggtgtaaagaatacatctttaacagaggagaaaagatatgttctttacaaacctggcggcagcgcaaaagatg

SEQ ID NO: 8818 - DNA, 103 bp, Artificial Sequence
  Synthetic Polynucleotide
taatacgactcactatagggtcacatttctcaggtggtgtaaagaatacaaacagaggagatgtattatgtacaccaccaacctggcggcagcgcaaaagatg

SEQ ID NO: 8819 - DNA, 103 bp, Artificial Sequence
  Synthetic Polynucleotide
taatacgactcactataggggggtgtcacatttctcaggtggtgtaaagaaacagaggagatctttaatgcacctgagaaacctggcggcagcgcaaaagatg

SEQ ID NO: 8820 - DNA, 103 bp, Artificial Sequence
  Synthetic Polynucleotide
taatacgactcactatagggcaagagggtgtcacatttctcaggtggtgtaacagaggagaacaccaatggagaaatgtaacctggcggcagcgcaaaagatg

SEQ ID NO: 8821 - DNA, 103 bp, Artificial Sequence
  Synthetic Polynucleotide
taatacgactcactatagggtcacacaagagggtgtcacatttctcaggtaacagaggagaacctgaatgatgtgacacaacctggcggcagcgcaaaagatg

SEQ ID NO: 8822 - DNA, 103 bp, Artificial Sequence
  Synthetic Polynucleotide
taatacgactcactatagggcaatatcacacaagagggtgtcacatttctaacagaggagaagaaatatgacaccctctaacctggcggcagcgcaaaagatg

SEQ ID NO: 8823 - DNA, 103 bp, Artificial Sequence
  Synthetic Polynucleotide
taatacgactcactatagggctcaccaatatcacacaagagggtgtcacaaacagaggagatgtgacatgctcttgtgtaacctggcggcagcgcaaaagatg

SEQ ID NO: 8824 - DNA, 103 bp, Artificial Sequence
  Synthetic Polynucleotide
taatacgactcactatagggtggttgttcatcagagatctgctctctaataacagaggagaattagaatgcagatctctaacctggcggcagcgcaaaagatg

SEQ ID NO: 8825 - DNA, 103 bp, Artificial Sequence
  Synthetic Polynucleotide
taatacgactcactatagggtgtctcagagcccaggtctccactttttgtaacagaggagaacaaaaatgggagacctgaacctggcggcagcgcaaaagatg

SEQ ID NO: 8826 - DNA, 103 bp, Artificial Sequence
  Synthetic Polynucleotide
taatacgactcactataggggaggactcaccaatatcacacaagagggtgaacagaggagacaccctatggtgtgatataacctggcggcagcgcaaaagatg

SEQ ID NO: 8827 - DNA, 103 bp, Artificial Sequence
  Synthetic Polynucleotide
taatacgactcactatagggtcggagaggactcaccaatatcacacaagaaacagaggagatcttgtatgatattggtgaacctggcggcagcgcaaaagatg

SEQ ID NO: 8828 - DNA, 103 bp, Artificial Sequence
  Synthetic Polynucleotide
taatacgactcactatagggtgggttcggagaggactcaccaatatcacaaacagaggagatgtgatatgggtgagtccaacctggcggcagcgcaaaagatg

SEQ ID NO: 8829 - DNA, 103 bp, Artificial Sequence
  Synthetic Polynucleotide
taatacgactcactatagggatagttgggttcggagaggactcaccaataaacagaggagatattggatggtcctctccaacctggcggcagcgcaaaagatg

SEQ ID NO: 8830 - DNA, 103 bp, Artificial Sequence
  Synthetic Polynucleotide
taatacgactcactatagggcttctatagttgggttcggagaggactcacaacagaggagagtgagtatgctccgaaccaacctggcggcagcgcaaaagatg

SEQ ID NO: 8831 - DNA, 103 bp, Artificial Sequence
  Synthetic Polynucleotide
taatacgactcactatagggtccttcttctatagttgggttcggagaggaaacagaggagatcctctatgaacccaactaacctggcggcagcgcaaaagatg

SEQ ID NO: 8832 - DNA, 103 bp, Artificial Sequence
  Synthetic Polynucleotide
taatacgactcactataggggttcttccttcttctatagttgggttcggaaacagaggagatccgaaatgaactatagaaacctggcggcagcgcaaaagatg

SEQ ID NO: 8833 - DNA, 103 bp, Artificial Sequence
  Synthetic Polynucleotide
taatacgactcactataggggtaacgttcttccttcttctatagttgggtaacagaggagaacccaaatgtagaagaagaacctggcggcagcgcaaaagatg

SEQ ID NO: 8834 - DNA, 103 bp, Artificial Sequence
  Synthetic Polynucleotide
taatacgactcactatagggaacacgtaacgttcttccttcttctatagtaacagaggagaactataatggaaggaagaaacctggcggcagcgcaaaagatg

SEQ ID NO: 8835 - DNA, 103 bp, Artificial Sequence
  Synthetic Polynucleotide
taatacgactcactatagggtttagaacacgtaacgttcttccttcttctaacagaggagaagaagaatgaagaacgttaacctggcggcagcgcaaaagatg

SEQ ID NO: 8836 - DNA, 103 bp, Artificial Sequence
  Synthetic Polynucleotide
taatacgactcactatagggctgggtgtctcagagcccaggtctccacttaacagaggagaaagtggatgcctgggctcaacctggcggcagcgcaaaagatg

SEQ ID NO: 8837 - DNA, 103 bp, Artificial Sequence
  Synthetic Polynucleotide
taatacgactcactatagggccatctttagaacacgtaacgttcttccttaacagaggagaaaggaaatgcgttacgtgaacctggcggcagcgcaaaagatg

SEQ ID NO: 8838 - DNA, 103 bp, Artificial Sequence
  Synthetic Polynucleotide
taatacgactcactatagggttccaccatctttagaacacgtaacgttctaacagaggagaagaacgatgcgtgttctaaacctggcggcagcgcaaaagatg

SEQ ID NO: 8839 - DNA, 103 bp, Artificial Sequence
  Synthetic Polynucleotide
taatacgactcactatagggcatggttccaccatctttagaacacgtaacaacagaggagagttacgatgtctaaagataacctggcggcagcgcaaaagatg

SEQ ID NO: 8840 - DNA, 103 bp, Artificial Sequence
  Synthetic Polynucleotide
taatacgactcactatagggtgagccatggttccaccatctttagaacacaacagaggagagtgttcatgagatggtggaacctggcggcagcgcaaaagatg

SEQ ID NO: 8841 - DNA, 103 bp, Artificial Sequence
  Synthetic Polynucleotide
taatacgactcactatagggtcctctgagccatggttccaccatctttagaacagaggagactaaagatggtggaaccaaacctggcggcagcgcaaaagatg

SEQ ID NO: 8842 - DNA, 103 bp, Artificial Sequence
  Synthetic Polynucleotide
taatacgactcactatagggtggtttcctctgagccatggttccaccatcaacagaggagagatggtatgaccatggctaacctggcggcagcgcaaaagatg

SEQ ID NO: 8843 - DNA, 103 bp, Artificial Sequence
  Synthetic Polynucleotide
taatacgactcactatagggaaaattggtttcctctgagccatggttccaaacagaggagatggaacatgggctcagagaacctggcggcagcgcaaaagatg

SEQ ID NO: 8844 - DNA, 103 bp, Artificial Sequence
  Synthetic Polynucleotide
taatacgactcactatagggtatgcaaaattggtttcctctgagccatggaacagaggagaccatggatgagaggaaacaacctggcggcagcgcaaaagatg

SEQ ID NO: 8845 - DNA, 103 bp, Artificial Sequence
  Synthetic Polynucleotide
taatacgactcactatagggatttttatgcaaaattggtttcctctgagcaacagaggagagctcagatgaaaccaattaacctggcggcagcgcaaaagatg

SEQ ID NO: 8846 - DNA, 103 bp, Artificial Sequence
  Synthetic Polynucleotide
taatacgactcactatagggttagaatttttatgcaaaattggtttcctcaacagaggagagaggaaatgaattttgcaaacctggcggcagcgcaaaagatg

SEQ ID NO: 8847 - DNA, 103 bp, Artificial Sequence
  Synthetic Polynucleotide
taatacgactcactataggggaatcctgggtgtctcagagcccaggtctcaacagaggagagagaccatggctctgagaaacctggcggcagcgcaaaagatg

SEQ ID NO: 8848 - DNA, 103 bp, Artificial Sequence
  Synthetic Polynucleotide
taatacgactcactataggggggatttagaatttttatgcaaaattggttaacagaggagaaaccaaatgtgcataaaaaacctggcggcagcgcaaaagatg

SEQ ID NO: 8849 - DNA, 103 bp, Artificial Sequence
  Synthetic Polynucleotide
taatacgactcactatagggatatagggatttagaatttttatgcaaaataacagaggagaattttgatgaaaaattctaacctggcggcagcgcaaaagatg

SEQ ID NO: 8850 - DNA, 103 bp, Artificial Sequence
  Synthetic Polynucleotide
taatacgactcactatagggtcggcatatagggatttagaatttttatgcaacagaggagagcataaatgttctaaatcaacctggcggcagcgcaaaagatg

SEQ ID NO: 8851 - DNA, 103 bp, Artificial Sequence
  Synthetic Polynucleotide
taatacgactcactatagggcacactcggcatatagggatttagaattttaacagaggagaaaaattatgaatccctataacctggcggcagcgcaaaagatg

SEQ ID NO: 8852 - DNA, 103 bp, Artificial Sequence
  Synthetic Polynucleotide
taatacgactcactatagggtctaccacactcggcatatagggatttagaaacagaggagatctaaaatgctatatgccaacctggcggcagcgcaaaagatg

SEQ ID NO: 8853 - DNA, 103 bp, Artificial Sequence
  Synthetic Polynucleotide
taatacgactcactatagggaagtttctaccacactcggcatatagggataacagaggagaatccctatgtgccgagtgaacctggcggcagcgcaaaagatg

SEQ ID NO: 8854 - DNA, 103 bp, Artificial Sequence
  Synthetic Polynucleotide
taatacgactcactatagggctccaaagtttctaccacactcggcatataaacagaggagatatatgatgagtgtggtaaacctggcggcagcgcaaaagatg

SEQ ID NO: 8855 - DNA, 103 bp, Artificial Sequence
  Synthetic Polynucleotide
taatacgactcactatagggatttgctccaaagtttctaccacactcggcaacagaggagagccgagatgggtagaaacaacctggcggcagcgcaaaagatg

SEQ ID NO: 8856 - DNA, 103 bp, Artificial Sequence
  Synthetic Polynucleotide
taatacgactcactatagggtttgcatttgctccaaagtttctaccacacaacagaggagagtgtggatgaaactttggaacctggcggcagcgcaaaagatg

SEQ ID NO: 8857 - DNA, 103 bp, Artificial Sequence
  Synthetic Polynucleotide
taatacgactcactatagggttttctttgcatttgctccaaagtttctacaacagaggagagtagaaatgttggagcaaaacctggcggcagcgcaaaagatg

SEQ ID NO: 8858 - DNA, 103 bp, Artificial Sequence
  Synthetic Polynucleotide
taatacgactcactatagggaccgtgaatcctgggtgtctcagagcccagaacagaggagactgggcatggagacacccaacctggcggcagcgcaaaagatg

SEQ ID NO: 8859 - DNA, 103 bp, Artificial Sequence
  Synthetic Polynucleotide
taatacgactcactatagggccatgttttctttgcatttgctccaaagttaacagaggagaaactttatggcaaatgcaaacctggcggcagcgcaaaagatg

SEQ ID NO: 8860 - DNA, 103 bp, Artificial Sequence
  Synthetic Polynucleotide
taatacgactcactatagggttcctccatgttttctttgcatttgctccaaacagaggagatggagcatgtgcaaagaaaacctggcggcagcgcaaaagatg

SEQ ID NO: 8861 - DNA, 103 bp, Artificial Sequence
  Synthetic Polynucleotide
taatacgactcactatagggtagcattcctccatgttttctttgcatttgaacagaggagacaaatgatgagaaaacataacctggcggcagcgcaaaagatg

SEQ ID NO: 8862 - DNA, 103 bp, Artificial Sequence
  Synthetic Polynucleotide
taatacgactcactatagggcgcactagcattcctccatgttttctttgcaacagaggagagcaaagatgacatggaggaacctggcggcagcgcaaaagatg

SEQ ID NO: 8863 - DNA, 103 bp, Artificial Sequence
  Synthetic Polynucleotide
taatacgactcactataggggatttcgcactagcattcctccatgttttcaacagaggagagaaaacatggaggaatgcaacctggcggcagcgcaaaagatg

SEQ ID NO: 8864 - DNA, 103 bp, Artificial Sequence
  Synthetic Polynucleotide
taatacgactcactataggggagtggatttcgcactagcattcctccatgaacagaggagacatggaatgatgctagtgaacctggcggcagcgcaaaagatg

SEQ ID NO: 8865 - DNA, 103 bp, Artificial Sequence
  Synthetic Polynucleotide
taatacgactcactatagggcttgagagtggatttcgcactagcattcctaacagaggagaaggaatatgagtgcgaaaaacctggcggcagcgcaaaagatg

SEQ ID NO: 8866 - DNA, 103 bp, Artificial Sequence
  Synthetic Polynucleotide
taatacgactcactatagggagtttcttgagagtggatttcgcactagcaaacagaggagatgctagatggaaatccacaacctggcggcagcgcaaaagatg

SEQ ID NO: 8867 - DNA, 103 bp, Artificial Sequence
  Synthetic Polynucleotide
taatacgactcactatagggagtggagtttcttgagagtggatttcgcacaacagaggagagtgcgaatgccactctcaaacctggcggcagcgcaaaagatg

SEQ ID NO: 8868 - DNA, 103 bp, Artificial Sequence
  Synthetic Polynucleotide
taatacgactcactatagggtcatgagtggagtttcttgagagtggatttaacagaggagaaaatccatgctcaagaaaaacctggcggcagcgcaaaagatg

SEQ ID NO: 8869 - DNA, 103 bp, Artificial Sequence
  Synthetic Polynucleotide
taatacgactcactatagggctatcaccgtgaatcctgggtgtctcagagaacagaggagactctgaatgacccaggataacctggcggcagcgcaaaagatg

SEQ ID NO: 8870 - DNA, 103 bp, Artificial Sequence
  Synthetic Polynucleotide
taatacgactcactatagggacatttcatgagtggagtttcttgagagtgaacagaggagacactctatggaaactccaaacctggcggcagcgcaaaagatg

SEQ ID NO: 8871 - DNA, 103 bp, Artificial Sequence
  Synthetic Polynucleotide
taatacgactcactatagggccagtacatttcatgagtggagtttcttgaaacagaggagatcaagaatgtccactcataacctggcggcagcgcaaaagatg

SEQ ID NO: 8872 - DNA, 103 bp, Artificial Sequence
  Synthetic Polynucleotide
taatacgactcactataggggaaacccagtacatttcatgagtggagtttaacagaggagaaaactcatgtcatgaaataacctggcggcagcgcaaaagatg

SEQ ID NO: 8873 - DNA, 103 bp, Artificial Sequence
  Synthetic Polynucleotide
taatacgactcactatagggcacatgaaacccagtacatttcatgagtggaacagaggagaccactcatgaaatgtactaacctggcggcagcgcaaaagatg

SEQ ID NO: 8874 - DNA, 103 bp, Artificial Sequence
  Synthetic Polynucleotide
taatacgactcactatagggtgttccacatgaaacccagtacatttcatgaacagaggagacatgaaatgtactgggttaacctggcggcagcgcaaaagatg

SEQ ID NO: 8875 - DNA, 103 bp, Artificial Sequence
  Synthetic Polynucleotide
taatacgactcactatagggtttcctgttccacatgaaacccagtacattaacagaggagaaatgtaatgggtttcatgaacctggcggcagcgcaaaagatg

SEQ ID NO: 8876 - DNA, 103 bp, Artificial Sequence
  Synthetic Polynucleotide
taatacgactcactatagggcaatgtttcctgttccacatgaaacccagtaacagaggagaactgggatgcatgtggaaaacctggcggcagcgcaaaagatg

SEQ ID NO: 8877 - DNA, 103 bp, Artificial Sequence
  Synthetic Polynucleotide
taatacgactcactatagggtgacacaatgtttcctgttccacatgaaacaacagaggagagtttcaatgggaacaggaaacctggcggcagcgcaaaagatg

SEQ ID NO: 8878 - DNA, 103 bp, Artificial Sequence
  Synthetic Polynucleotide
taatacgactcactatagggactgctgacacaatgtttcctgttccacataacagaggagaatgtggatgaggaaacataacctggcggcagcgcaaaagatg

SEQ ID NO: 8879 - DNA, 103 bp, Artificial Sequence
  Synthetic Polynucleotide
taatacgactcactatagggtgtttactgctgacacaatgtttcctgttcaacagaggagagaacagatgacattgtgtaacctggcggcagcgcaaaagatg

SEQ ID NO: 8880 - DNA, 103 bp, Artificial Sequence
  Synthetic Polynucleotide
taatacgactcactatagggaagggctatcaccgtgaatcctgggtgtctaacagaggagaagacacatgggattcacgaacctggcggcagcgcaaaagatg

SEQ ID NO: 8881 - DNA, 103 bp, Artificial Sequence
  Synthetic Polynucleotide
taatacgactcactatagggtgtcatgtttactgctgacacaatgtttccaacagaggagaggaaacatggtgtcagcaaacctggcggcagcgcaaaagatg

SEQ ID NO: 8882 - DNA, 103 bp, Artificial Sequence
  Synthetic Polynucleotide
taatacgactcactatagggctagatgtcatgtttactgctgacacaatgaacagaggagacattgtatgagcagtaaaaacctggcggcagcgcaaaagatg

SEQ ID NO: 8883 - DNA, 103 bp, Artificial Sequence
  Synthetic Polynucleotide
taatacgactcactataggggcattctagatgtcatgtttactgctgacaaacagaggagatgtcagatgtaaacatgaaacctggcggcagcgcaaaagatg

SEQ ID NO: 8884 - DNA, 103 bp, Artificial Sequence
  Synthetic Polynucleotide
taatacgactcactatagggtagcagcattctagatgtcatgtttactgcaacagaggagagcagtaatgatgacatctaacctggcggcagcgcaaaagatg

SEQ ID NO: 8885 - DNA, 103 bp, Artificial Sequence
  Synthetic Polynucleotide
taatacgactcactatagggcgatttagcagcattctagatgtcatgtttaacagaggagaaaacatatgatctagaataacctggcggcagcgcaaaagatg

SEQ ID NO: 8886 - DNA, 103 bp, Artificial Sequence
  Synthetic Polynucleotide
taatacgactcactatagggtgaatcgatttagcagcattctagatgtcaaacagaggagatgacatatggaatgctgcaacctggcggcagcgcaaaagatg

SEQ ID NO: 8887 - DNA, 103 bp, Artificial Sequence
  Synthetic Polynucleotide
taatacgactcactatagggcattgtgaatcgatttagcagcattctagaaacagaggagatctagaatgctgctaaataacctggcggcagcgcaaaagatg

SEQ ID NO: 8888 - DNA, 103 bp, Artificial Sequence
  Synthetic Polynucleotide
taatacgactcactatagggtgagccattgtgaatcgatttagcagcattaacagaggagaaatgctatgaaatcgattaacctggcggcagcgcaaaagatg

SEQ ID NO: 8889 - DNA, 103 bp, Artificial Sequence
  Synthetic Polynucleotide
taatacgactcactatagggtcctgtgagccattgtgaatcgatttagcaaacagaggagatgctaaatggattcacaaaacctggcggcagcgcaaaagatg

SEQ ID NO: 8890 - DNA, 103 bp, Artificial Sequence
  Synthetic Polynucleotide
taatacgactcactatagggtggcttcctgtgagccattgtgaatcgattaacagaggagaaatcgaatgacaatggctaacctggcggcagcgcaaaagatg

SEQ ID NO: 8891 - DNA, 103 bp, Artificial Sequence
  Synthetic Polynucleotide
taatacgactcactatagggagaaaaagggctatcaccgtgaatcctgggaacagaggagacccaggatgcacggtgataacctggcggcagcgcaaaagatg

SEQ ID NO: 8892 - DNA, 103 bp, Artificial Sequence
  Synthetic Polynucleotide
taatacgactcactatagggtatgttggcttcctgtgagccattgtgaataacagaggagaattcacatgggctcacagaacctggcggcagcgcaaaagatg

SEQ ID NO: 8893 - DNA, 103 bp, Artificial Sequence
  Synthetic Polynucleotide
taatacgactcactatagggtttcatatgttggcttcctgtgagccattgaacagaggagacaatggatgacaggaagcaacctggcggcagcgcaaaagatg

SEQ ID NO: 8894 - DNA, 103 bp, Artificial Sequence
  Synthetic Polynucleotide
taatacgactcactataggggtctctttcatatgttggcttcctgtgagcaacagaggagagctcacatgaagccaacaaacctggcggcagcgcaaaagatg

SEQ ID NO: 8895 - DNA, 103 bp, Artificial Sequence
  Synthetic Polynucleotide
taatacgactcactatagggtccacgtctctttcatatgttggcttcctgaacagaggagacaggaaatgaacatatgaaacctggcggcagcgcaaaagatg

SEQ ID NO: 8896 - DNA, 103 bp, Artificial Sequence
  Synthetic Polynucleotide
taatacgactcactatagggctaagtccacgtctctttcatatgttggctaacagaggagaagccaaatgatgaaagagaacctggcggcagcgcaaaagatg

SEQ ID NO: 8897 - DNA, 103 bp, Artificial Sequence
  Synthetic Polynucleotide
taatacgactcactatagggagcgcctaagtccacgtctctttcatatgtaacagaggagaacatatatgagagacgtgaacctggcggcagcgcaaaagatg

SEQ ID NO: 8898 - DNA, 103 bp, Artificial Sequence
  Synthetic Polynucleotide
taatacgactcactataggggttccagcgcctaagtccacgtctctttcaaacagaggagatgaaagatgcgtggacttaacctggcggcagcgcaaaagatg

SEQ ID NO: 8899 - DNA, 103 bp, Artificial Sequence
  Synthetic Polynucleotide
taatacgactcactataggggtcttgttccagcgcctaagtccacgtctcaacagaggagagagacgatgacttaggcgaacctggcggcagcgcaaaagatg

SEQ ID NO: 8900 - DNA, 103 bp, Artificial Sequence
  Synthetic Polynucleotide
taatacgactcactatagggcacatgtcttgttccagcgcctaagtccacaacagaggagagtggacatgggcgctggaaacctggcggcagcgcaaaagatg

SEQ ID NO: 8901 - DNA, 103 bp, Artificial Sequence
  Synthetic Polynucleotide
taatacgactcactatagggactgccacatgtcttgttccagcgcctaagaacagaggagacttaggatgtggaacaagaacctggcggcagcgcaaaagatg

SEQ ID NO: 8902 - DNA, 103 bp, Artificial Sequence
  Synthetic Polynucleotide
taatacgactcactataggggtgctagaaaaagggctatcaccgtgaatcaacagaggagagattcaatgtgatagcccaacctggcggcagcgcaaaagatg

SEQ ID NO: 8903 - DNA, 103 bp, Artificial Sequence
  Synthetic Polynucleotide
taatacgactcactataggggttctactgccacatgtcttgttccagcgcaacagaggagagcgctgatgcaagacatgaacctggcggcagcgcaaaagatg

SEQ ID NO: 8904 - DNA, 103 bp, Artificial Sequence
  Synthetic Polynucleotide
taatacgactcactatagggctctggttctactgccacatgtcttgttccaacagaggagaggaacaatgcatgtggcaaacctggcggcagcgcaaaagatg

SEQ ID NO: 8905 - DNA, 103 bp, Artificial Sequence
  Synthetic Polynucleotide
taatacgactcactataggggccacctctggttctactgccacatgtcttaacagaggagaaagacaatgggcagtagaaacctggcggcagcgcaaaagatg

SEQ ID NO: 8906 - DNA, 103 bp, Artificial Sequence
  Synthetic Polynucleotide
taatacgactcactatagggggttggccacctctggttctactgccacataacagaggagaatgtggatgtagaaccagaacctggcggcagcgcaaaagatg

SEQ ID NO: 8907 - DNA, 103 bp, Artificial Sequence
  Synthetic Polynucleotide
taatacgactcactatagggatctaggttggccacctctggttctactgcaacagaggagagcagtaatgccagaggtgaacctggcggcagcgcaaaagatg

SEQ ID NO: 8908 - DNA, 103 bp, Artificial Sequence
  Synthetic Polynucleotide
taatacgactcactatagggatgatatctaggttggccacctctggttctaacagaggagaagaaccatgggtggccaaaacctggcggcagcgcaaaagatg

SEQ ID NO: 8909 - DNA, 103 bp, Artificial Sequence
  Synthetic Polynucleotide
taatacgactcactatagggggccaatgatatctaggttggccacctctgaacagaggagacagaggatgccaacctagaacctggcggcagcgcaaaagatg

SEQ ID NO: 8910 - DNA, 103 bp, Artificial Sequence
  Synthetic Polynucleotide
taatacgactcactatagggcctctggccaatgatatctaggttggccacaacagaggagagtggccatgctagatatcaacctggcggcagcgcaaaagatg

SEQ ID NO: 8911 - DNA, 103 bp, Artificial Sequence
  Synthetic Polynucleotide
taatacgactcactatagggtctatcctctggccaatgatatctaggttgaacagaggagacaacctatgtatcattggaacctggcggcagcgcaaaagatg

SEQ ID NO: 8912 - DNA, 103 bp, Artificial Sequence
  Synthetic Polynucleotide
taatacgactcactatagggtattctctatcctctggccaatgatatctaaacagaggagatagataatgttggccagaaacctggcggcagcgcaaaagatg

SEQ ID NO: 8913 - DNA, 103 bp, Artificial Sequence
  Synthetic Polynucleotide
taatacgactcactatagggggcatgtgctagaaaaagggctatcaccgtaacagaggagaacggtgatggccctttttaacctggcggcagcgcaaaagatg

SEQ ID NO: 8914 - DNA, 103 bp, Artificial Sequence
  Synthetic Polynucleotide
taatacgactcactatagggttttatattctctatcctctggccaatgataacagaggagaatcattatgcagaggataaacctggcggcagcgcaaaagatg

SEQ ID NO: 8915 - DNA, 103 bp, Artificial Sequence
  Synthetic Polynucleotide
taatacgactcactatagggtcattttttatattctctatcctctggccaaacagaggagatggccaatggatagagaaaacctggcggcagcgcaaaagatg

SEQ ID NO: 8916 - DNA, 103 bp, Artificial Sequence
  Synthetic Polynucleotide
taatacgactcactatagggtgtgttcattttttatattctctatcctctaacagaggagaagaggaatgagaatataaaacctggcggcagcgcaaaagatg

SEQ ID NO: 8917 - DNA, 103 bp, Artificial Sequence
  Synthetic Polynucleotide
taatacgactcactatagggtgatttgtgttcattttttatattctctataacagaggagaatagagatgataaaaaataacctggcggcagcgcaaaagatg

SEQ ID NO: 8918 - DNA, 103 bp, Artificial Sequence
  Synthetic Polynucleotide
taatacgactcactatagggcatgttgatttgtgttcattttttatattcaacagaggagagaatatatgaaatgaacaaacctggcggcagcgcaaaagatg

SEQ ID NO: 8919 - DNA, 103 bp, Artificial Sequence
  Synthetic Polynucleotide
taatacgactcactatagggaatgccatgttgatttgtgttcattttttaaacagaggagataaaaaatgaacacaaataacctggcggcagcgcaaaagatg

SEQ ID NO: 8920 - DNA, 103 bp, Artificial Sequence
  Synthetic Polynucleotide
taatacgactcactatagggatcataatgccatgttgatttgtgttcattaacagaggagaaatgaaatgaaatcaacaaacctggcggcagcgcaaaagatg

SEQ ID NO: 8921 - DNA, 103 bp, Artificial Sequence
  Synthetic Polynucleotide
taatacgactcactatagggtcctcatcataatgccatgttgatttgtgtaacagaggagaacacaaatgaacatggcaaacctggcggcagcgcaaaagatg

SEQ ID NO: 8922 - DNA, 103 bp, Artificial Sequence
  Synthetic Polynucleotide
taatacgactcactataggggattgtcctcatcataatgccatgttgattaacagaggagaaatcaaatgggcattatgaacctggcggcagcgcaaaagatg

SEQ ID NO: 8923 - DNA, 103 bp, Artificial Sequence
  Synthetic Polynucleotide
taatacgactcactataggggtatggattgtcctcatcataatgccatgtaacagaggagaacatggatgtatgatgagaacctggcggcagcgcaaaagatg

SEQ ID NO: 8924 - DNA, 103 bp, Artificial Sequence
  Synthetic Polynucleotide
taatacgactcactatagggcctatggcatgtgctagaaaaagggctatcaacagaggagagatagcatgttttctagcaacctggcggcagcgcaaaagatg

SEQ ID NO: 8925 - DNA, 103 bp, Artificial Sequence
  Synthetic Polynucleotide
taatacgactcactataggggttttgtatggattgtcctcatcataatgcaacagaggagagcattaatgtgaggacaaaacctggcggcagcgcaaaagatg

SEQ ID NO: 8926 - DNA, 103 bp, Artificial Sequence
  Synthetic Polynucleotide
taatacgactcactatagggcccatgttttgtatggattgtcctcatcataacagaggagaatgatgatgacaatccataacctggcggcagcgcaaaagatg

SEQ ID NO: 8927 - DNA, 103 bp, Artificial Sequence
  Synthetic Polynucleotide
taatacgactcactatagggataggcccatgttttgtatggattgtcctcaacagaggagagaggacatgccatacaaaaacctggcggcagcgcaaaagatg

SEQ ID NO: 8928 - DNA, 103 bp, Artificial Sequence
  Synthetic Polynucleotide
taatacgactcactatagggccatgataggcccatgttttgtatggattgaacagaggagacaatccatgcaaaacatgaacctggcggcagcgcaaaagatg

SEQ ID NO: 8929 - DNA, 103 bp, Artificial Sequence
  Synthetic Polynucleotide
taatacgactcactatagggatgatccatgataggcccatgttttgtatgaacagaggagacatacaatgcatgggcctaacctggcggcagcgcaaaagatg

SEQ ID NO: 8930 - DNA, 103 bp, Artificial Sequence
  Synthetic Polynucleotide
taatacgactcactatagggctcatatgatccatgataggcccatgttttaacagaggagaaaaacaatggcctatcataacctggcggcagcgcaaaagatg

SEQ ID NO: 8931 - DNA, 103 bp, Artificial Sequence
  Synthetic Polynucleotide
taatacgactcactatagggttgacctcatatgatccatgataggcccataacagaggagaatgggcatgtcatggatcaacctggcggcagcgcaaaagatg

SEQ ID NO: 8932 - DNA, 103 bp, Artificial Sequence
  Synthetic Polynucleotide
taatacgactcactatagggatggcttgacctcatatgatccatgataggaacagaggagacctatcatggatcatatgaacctggcggcagcgcaaaagatg

SEQ ID NO: 8933 - DNA, 103 bp, Artificial Sequence
  Synthetic Polynucleotide
taatacgactcactatagggtcctgatggcttgacctcatatgatccatgaacagaggagacatggaatgtatgaggtcaacctggcggcagcgcaaaagatg

SEQ ID NO: 8934 - DNA, 103 bp, Artificial Sequence
  Synthetic Polynucleotide
taatacgactcactataggggctgatcctgatggcttgacctcatatgataacagaggagaatcataatgggtcaagccaacctggcggcagcgcaaaagatg

SEQ ID NO: 8935 - DNA, 103 bp, Artificial Sequence
  Synthetic Polynucleotide
taatacgactcactatagggtccgttggttgttcatcagagatctgctctaacagaggagaagagcaatgctctgatgaaacctggcggcagcgcaaaagatg

SEQ ID NO: 8936 - DNA, 103 bp, Artificial Sequence
  Synthetic Polynucleotide
taatacgactcactatagggatgttcctatggcatgtgctagaaaaagggaacagaggagaccctttatgtagcacatgaacctggcggcagcgcaaaagatg

SEQ ID NO: 8937 - DNA, 103 bp, Artificial Sequence
  Synthetic Polynucleotide
taatacgactcactatagggatgaggctgatcctgatggcttgacctcataacagaggagaatgaggatgagccatcagaacctggcggcagcgcaaaagatg

SEQ ID NO: 8938 - DNA, 103 bp, Artificial Sequence
  Synthetic Polynucleotide
taatacgactcactatagggcatggatgaggctgatcctgatggcttgacaacagaggagagtcaagatgtcaggatcaaacctggcggcagcgcaaaagatg

SEQ ID NO: 8939 - DNA, 103 bp, Artificial Sequence
  Synthetic Polynucleotide
taatacgactcactatagggttgaccatggatgaggctgatcctgatggcaacagaggagagccatcatgatcagcctcaacctggcggcagcgcaaaagatg

SEQ ID NO: 8940 - DNA, 103 bp, Artificial Sequence
  Synthetic Polynucleotide
taatacgactcactatagggcaccattgaccatggatgaggctgatcctgaacagaggagacaggatatgcctcatccaaacctggcggcagcgcaaaagatg

SEQ ID NO: 8941 - DNA, 103 bp, Artificial Sequence
  Synthetic Polynucleotide
taatacgactcactatagggcaccacaccattgaccatggatgaggctgaaacagaggagatcagccatgtccatggtcaacctggcggcagcgcaaaagatg

SEQ ID NO: 8942 - DNA, 103 bp, Artificial Sequence
  Synthetic Polynucleotide
taatacgactcactatagggagtctcaccacaccattgaccatggatgagaacagaggagactcatcatgggtcaatggaacctggcggcagcgcaaaagatg

SEQ ID NO: 8943 - DNA, 103 bp, Artificial Sequence
  Synthetic Polynucleotide
taatacgactcactatagggttagcagtctcaccacaccattgaccatggaacagaggagaccatggatgatggtgtggaacctggcggcagcgcaaaagatg

SEQ ID NO: 8944 - DNA, 103 bp, Artificial Sequence
  Synthetic Polynucleotide
taatacgactcactatagggtttggttagcagtctcaccacaccattgacaacagaggagagtcaatatggtggtgagaaacctggcggcagcgcaaaagatg

SEQ ID NO: 8945 - DNA, 103 bp, Artificial Sequence
  Synthetic Polynucleotide
taatacgactcactatagggcatggtttggttagcagtctcaccacaccaaacagaggagatggtgtatggagactgctaacctggcggcagcgcaaaagatg

SEQ ID NO: 8946 - DNA, 103 bp, Artificial Sequence
  Synthetic Polynucleotide
taatacgactcactatagggcatcccatggtttggttagcagtctcaccaaacagaggagatggtgaatgtgctaaccaaacctggcggcagcgcaaaagatg

SEQ ID NO: 8947 - DNA, 103 bp, Artificial Sequence
  Synthetic Polynucleotide
taatacgactcactataggggatggatgttcctatggcatgtgctagaaaaacagaggagatttctaatgcatgccataaacctggcggcagcgcaaaagatg

SEQ ID NO: 8948 - DNA, 103 bp, Artificial Sequence
  Synthetic Polynucleotide
taatacgactcactatagggaatgacatcccatggtttggttagcagtctaacagaggagaagactgatgaccaaaccaaacctggcggcagcgcaaaagatg

SEQ ID NO: 8949 - DNA, 103 bp, Artificial Sequence
  Synthetic Polynucleotide
taatacgactcactatagggatgggaatgacatcccatggtttggttagcaacagaggagagctaacatgaccatgggaaacctggcggcagcgcaaaagatg

SEQ ID NO: 8950 - DNA, 103 bp, Artificial Sequence
  Synthetic Polynucleotide
taatacgactcactatagggtgaccatgggaatgacatcccatggtttggaacagaggagaccaaacatggggatgtcaaacctggcggcagcgcaaaagatg

SEQ ID NO: 8951 - DNA, 103 bp, Artificial Sequence
  Synthetic Polynucleotide
taatacgactcactatagggttgtgtgaccatgggaatgacatcccatggaacagaggagaccatggatggtcattcccaacctggcggcagcgcaaaagatg

SEQ ID NO: 8952 - DNA, 103 bp, Artificial Sequence
  Synthetic Polynucleotide
taatacgactcactataggggctatttgtgtgaccatgggaatgacatccaacagaggagaggatgtatgtcccatggtaacctggcggcagcgcaaaagatg

SEQ ID NO: 8953 - DNA, 103 bp, Artificial Sequence
  Synthetic Polynucleotide
taatacgactcactatagggtcatggctatttgtgtgaccatgggaatgaaacagaggagatcattcatgtggtcacacaacctggcggcagcgcaaaagatg

SEQ ID NO: 8954 - DNA, 103 bp, Artificial Sequence
  Synthetic Polynucleotide
taatacgactcactataggggtcagtcatggctatttgtgtgaccatgggaacagaggagacccatgatgacacaaataaacctggcggcagcgcaaaagatg

SEQ ID NO: 8955 - DNA, 103 bp, Artificial Sequence
  Synthetic Polynucleotide
taatacgactcactataggggtggtgtcagtcatggctatttgtgtgaccaacagaggagaggtcacatgaatagccataacctggcggcagcgcaaaagatg

SEQ ID NO: 8956 - DNA, 103 bp, Artificial Sequence
  Synthetic Polynucleotide
taatacgactcactatagggagggtgtggtgtcagtcatggctatttgtgaacagaggagacacaaaatgccatgactgaacctggcggcagcgcaaaagatg

SEQ ID NO: 8957 - DNA, 103 bp, Artificial Sequence
  Synthetic Polynucleotide
taatacgactcactatagggtccaaagggtgtggtgtcagtcatggctataacagaggagaatagccatgactgacaccaacctggcggcagcgcaaaagatg

SEQ ID NO: 8958 - DNA, 103 bp, Artificial Sequence
  Synthetic Polynucleotide
taatacgactcactatagggtgggtgatggatgttcctatggcatgtgctaacagaggagaagcacaatgcataggaacaacctggcggcagcgcaaaagatg

SEQ ID NO: 8959 - DNA, 103 bp, Artificial Sequence
  Synthetic Polynucleotide
taatacgactcactatagggtgttgtccaaagggtgtggtgtcagtcatgaacagaggagacatgacatgcaccacaccaacctggcggcagcgcaaaagatg

SEQ ID NO: 8960 - DNA, 103 bp, Artificial Sequence
  Synthetic Polynucleotide
taatacgactcactatagggccctctgttgtccaaagggtgtggtgtcagaacagaggagactgacaatgcaccctttgaacctggcggcagcgcaaaagatg

SEQ ID NO: 8961 - DNA, 103 bp, Artificial Sequence
  Synthetic Polynucleotide
taatacgactcactatagggaaacaccctctgttgtccaaagggtgtggtaacagaggagaaccacaatgtttggacaaaacctggcggcagcgcaaaagatg

SEQ ID NO: 8962 - DNA, 103 bp, Artificial Sequence
  Synthetic Polynucleotide
taatacgactcactatagggtctttaaacaccctctgttgtccaaagggtaacagaggagaacccttatgacaacagagaacctggcggcagcgcaaaagatg

SEQ ID NO: 8963 - DNA, 103 bp, Artificial Sequence
  Synthetic Polynucleotide
taatacgactcactatagggctttctctttaaacaccctctgttgtccaaaacagaggagattggacatgagagggtgtaacctggcggcagcgcaaaagatg

SEQ ID NO: 8964 - DNA, 103 bp, Artificial Sequence
  Synthetic Polynucleotide
taatacgactcactataggggtcaactttctctttaaacaccctctgttgaacagaggagacaacagatggtgtttaaaaacctggcggcagcgcaaaagatg

SEQ ID NO: 8965 - DNA, 103 bp, Artificial Sequence
  Synthetic Polynucleotide
taatacgactcactatagggcgcgtgtcaactttctctttaaacaccctcaacagaggagagagggtatgtaaagagaaaacctggcggcagcgcaaaagatg

SEQ ID NO: 8966 - DNA, 103 bp, Artificial Sequence
  Synthetic Polynucleotide
taatacgactcactataggggtgtacgcgtgtcaactttctctttaaacaaacagaggagatgtttaatgagaaagttgaacctggcggcagcgcaaaagatg

SEQ ID NO: 8967 - DNA, 103 bp, Artificial Sequence
  Synthetic Polynucleotide
taatacgactcactatagggttttggtgtacgcgtgtcaactttctctttaacagaggagaaaagagatggttgacacgaacctggcggcagcgcaaaagatg

SEQ ID NO: 8968 - DNA, 103 bp, Artificial Sequence
  Synthetic Polynucleotide
taatacgactcactatagggttcgcttttggtgtacgcgtgtcaactttcaacagaggagagaaagtatgcacgcgtacaacctggcggcagcgcaaaagatg

SEQ ID NO: 8969 - DNA, 103 bp, Artificial Sequence
  Synthetic Polynucleotide
taatacgactcactatagggctttctgggtgatggatgttcctatggcataacagaggagaatgccaatggaacatccaaacctggcggcagcgcaaaagatg

SEQ ID NO: 8970 - DNA, 103 bp, Artificial Sequence
  Synthetic Polynucleotide
taatacgactcactatagggctcgtttcgcttttggtgtacgcgtgtcaaaacagaggagattgacaatggtacaccaaaacctggcggcagcgcaaaagatg

SEQ ID NO: 8971 - DNA, 103 bp, Artificial Sequence
  Synthetic Polynucleotide
taatacgactcactatagggtgtgcctcgtttcgcttttggtgtacgcgtaacagaggagaacgcgtatgccaaaagcgaacctggcggcagcgcaaaagatg

SEQ ID NO: 8972 - DNA, 103 bp, Artificial Sequence
  Synthetic Polynucleotide
taatacgactcactatagggtgtgctgtgcctcgtttcgcttttggtgtaaacagaggagatacaccatgagcgaaacgaacctggcggcagcgcaaaagatg

SEQ ID NO: 8973 - DNA, 103 bp, Artificial Sequence
  Synthetic Polynucleotide
taatacgactcactatagggtaatttgtgctgtgcctcgtttcgcttttgaacagaggagacaaaagatgaacgaggcaaacctggcggcagcgcaaaagatg

SEQ ID NO: 8974 - DNA, 103 bp, Artificial Sequence
  Synthetic Polynucleotide
taatacgactcactatagggctccataatttgtgctgtgcctcgtttcgcaacagaggagagcgaaaatgggcacagcaaacctggcggcagcgcaaaagatg

SEQ ID NO: 8975 - DNA, 103 bp, Artificial Sequence
  Synthetic Polynucleotide
taatacgactcactataggggtcacctccataatttgtgctgtgcctcgtaacagaggagaacgaggatgagcacaaataacctggcggcagcgcaaaagatg

SEQ ID NO: 8976 - DNA, 103 bp, Artificial Sequence
  Synthetic Polynucleotide
taatacgactcactatagggtggctgtcacctccataatttgtgctgtgcaacagaggagagcacagatgaaattatggaacctggcggcagcgcaaaagatg

SEQ ID NO: 8977 - DNA, 103 bp, Artificial Sequence
  Synthetic Polynucleotide
taatacgactcactatagggccacctggctgtcacctccataatttgtgcaacagaggagagcacaaatgatggaggtgaacctggcggcagcgcaaaagatg

SEQ ID NO: 8978 - DNA, 103 bp, Artificial Sequence
  Synthetic Polynucleotide
taatacgactcactatagggcataaccacctggctgtcacctccataattaacagaggagaaattatatgggtgacagcaacctggcggcagcgcaaaagatg

SEQ ID NO: 8979 - DNA, 103 bp, Artificial Sequence
  Synthetic Polynucleotide
taatacgactcactatagggaaccccataaccacctggctgtcacctccaaacagaggagatggaggatgcagccaggtaacctggcggcagcgcaaaagatg

SEQ ID NO: 8980 - DNA, 103 bp, Artificial Sequence
  Synthetic Polynucleotide
taatacgactcactataggggatccctttctgggtgatggatgttcctataacagaggagaataggaatgtccatcaccaacctggcggcagcgcaaaagatg

SEQ ID NO: 8981 - DNA, 103 bp, Artificial Sequence
  Synthetic Polynucleotide
taatacgactcactataggggagaaaaccccataaccacctggctgtcacaacagaggagagtgacaatgaggtggttaaacctggcggcagcgcaaaagatg

SEQ ID NO: 8982 - DNA, 103 bp, Artificial Sequence
  Synthetic Polynucleotide
taatacgactcactatagggctagagagaaaaccccataaccacctggctaacagaggagaagccagatggttatggggaacctggcggcagcgcaaaagatg

SEQ ID NO: 8983 - DNA, 103 bp, Artificial Sequence
  Synthetic Polynucleotide
taatacgactcactatagggtgtttctagagagaaaaccccataaccaccaacagaggagaggtggtatgggggttttcaacctggcggcagcgcaaaagatg

SEQ ID NO: 8984 - DNA, 103 bp, Artificial Sequence
  Synthetic Polynucleotide
taatacgactcactatagggttttttgtttctagagagaaaaccccataaaacagaggagattatggatgtttctctctaacctggcggcagcgcaaaagatg

SEQ ID NO: 8985 - DNA, 103 bp, Artificial Sequence
  Synthetic Polynucleotide
taatacgactcactatagggctgggttttttgtttctagagagaaaacccaacagaggagagggtttatgctctagaaaaacctggcggcagcgcaaaagatg

SEQ ID NO: 8986 - DNA, 103 bp, Artificial Sequence
  Synthetic Polynucleotide
taatacgactcactatagggagattctgggttttttgtttctagagagaaaacagaggagattctctatggaaacaaaaaacctggcggcagcgcaaaagatg

SEQ ID NO: 8987 - DNA, 103 bp, Artificial Sequence
  Synthetic Polynucleotide
taatacgactcactatagggtgtgcagattctgggttttttgtttctagaaacagaggagatctagaatgaaaaaacccaacctggcggcagcgcaaaagatg

SEQ ID NO: 8988 - DNA, 103 bp, Artificial Sequence
  Synthetic Polynucleotide
taatacgactcactatagggtctcttgtgcagattctgggttttttgtttaacagaggagaaaacaaatgacccagaataacctggcggcagcgcaaaagatg

SEQ ID NO: 8989 - DNA, 103 bp, Artificial Sequence
  Synthetic Polynucleotide
taatacgactcactatagggactcctctcttgtgcagattctgggtttttaacagaggagaaaaaacatggaatctgcaaacctggcggcagcgcaaaagatg

SEQ ID NO: 8990 - DNA, 103 bp, Artificial Sequence
  Synthetic Polynucleotide
taatacgactcactatagggtgtgaactcctctcttgtgcagattctgggaacagaggagacccagaatgtgcacaagaaacctggcggcagcgcaaaagatg

SEQ ID NO: 8991 - DNA, 103 bp, Artificial Sequence
  Synthetic Polynucleotide
taatacgactcactatagggaaaatgatccctttctgggtgatggatgttaacagaggagaaacatcatgcacccagaaaacctggcggcagcgcaaaagatg

SEQ ID NO: 8992 - DNA, 103 bp, Artificial Sequence
  Synthetic Polynucleotide
taatacgactcactatagggtttcttgtgaactcctctcttgtgcagattaacagaggagaaatctgatgaagagaggaaacctggcggcagcgcaaaagatg

SEQ ID NO: 8993 - DNA, 103 bp, Artificial Sequence
  Synthetic Polynucleotide
taatacgactcactatagggtgacttttcttgtgaactcctctcttgtgcaacagaggagagcacaaatgaggagttcaaacctggcggcagcgcaaaagatg

SEQ ID NO: 8994 - DNA, 103 bp, Artificial Sequence
  Synthetic Polynucleotide
taatacgactcactatagggtgacctgacttttcttgtgaactcctctctaacagaggagaagagagatgttcacaagaaacctggcggcagcgcaaaagatg

SEQ ID NO: 8995 - DNA, 103 bp, Artificial Sequence
  Synthetic Polynucleotide
taatacgactcactataggggcgtttgacctgacttttcttgtgaactccaacagaggagaggagttatgaagaaaagtaacctggcggcagcgcaaaagatg

SEQ ID NO: 8996 - DNA, 103 bp, Artificial Sequence
  Synthetic Polynucleotide
taatacgactcactatagggtagctgcgtttgacctgacttttcttgtgaaacagaggagatcacaaatgaagtcaggtaacctggcggcagcgcaaaagatg

SEQ ID NO: 8997 - DNA, 103 bp, Artificial Sequence
  Synthetic Polynucleotide
taatacgactcactatagggtccaatagctgcgtttgacctgacttttctaacagaggagaagaaaaatgaggtcaaacaacctggcggcagcgcaaaagatg

SEQ ID NO: 8998 - DNA, 103 bp, Artificial Sequence
  Synthetic Polynucleotide
taatacgactcactatagggactgctccaatagctgcgtttgacctgactaacagaggagaagtcagatgaaacgcagcaacctggcggcagcgcaaaagatg

SEQ ID NO: 8999 - DNA, 103 bp, Artificial Sequence
  Synthetic Polynucleotide
taatacgactcactatagggcgaacactgctccaatagctgcgtttgaccaacagaggagaggtcaaatgcagctattgaacctggcggcagcgcaaaagatg

SEQ ID NO: 9000 - DNA, 103 bp, Artificial Sequence
  Synthetic Polynucleotide
taatacgactcactatagggatcaacgaacactgctccaatagctgcgttaacagaggagaaacgcaatgattggagcaaacctggcggcagcgcaaaagatg

SEQ ID NO: 9001 - DNA, 103 bp, Artificial Sequence
  Synthetic Polynucleotide
taatacgactcactatagggttttcatcaacgaacactgctccaatagctaacagaggagaagctatatgagcagtgttaacctggcggcagcgcaaaagatg

SEQ ID NO: 9002 - DNA, 103 bp, Artificial Sequence
  Synthetic Polynucleotide
taatacgactcactatagggaaataaaaatgatccctttctgggtgatggaacagaggagaccatcaatgagaaagggaaacctggcggcagcgcaaaagatg

SEQ ID NO: 9003 - DNA, 103 bp, Artificial Sequence
  Synthetic Polynucleotide
taatacgactcactatagggattgattttcatcaacgaacactgctccaaaacagaggagattggagatgtgttcgttgaacctggcggcagcgcaaaagatg

SEQ ID NO: 9004 - DNA, 103 bp, Artificial Sequence
  Synthetic Polynucleotide
taatacgactcactataggggttccattgattttcatcaacgaacactgcaacagaggagagcagtgatggttgatgaaaacctggcggcagcgcaaaagatg

SEQ ID NO: 9005 - DNA, 103 bp, Artificial Sequence
  Synthetic Polynucleotide
taatacgactcactataggggctgagttccattgattttcatcaacgaacaacagaggagagttcgtatgtgaaaatcaaacctggcggcagcgcaaaagatg

SEQ ID NO: 9006 - DNA, 103 bp, Artificial Sequence
  Synthetic Polynucleotide
taatacgactcactatagggcttttgctgagttccattgattttcatcaaaacagaggagattgatgatgatcaatggaaacctggcggcagcgcaaaagatg

SEQ ID NO: 9007 - DNA, 103 bp, Artificial Sequence
  Synthetic Polynucleotide
taatacgactcactatagggtgcctcttttgctgagttccattgattttcaacagaggagagaaaatatgtggaactcaaacctggcggcagcgcaaaagatg

SEQ ID NO: 9008 - DNA, 103 bp, Artificial Sequence
  Synthetic Polynucleotide
taatacgactcactatagggtccactgcctcttttgctgagttccattgaaacagaggagatcaatgatgctcagcaaaaacctggcggcagcgcaaaagatg

SEQ ID NO: 9009 - DNA, 103 bp, Artificial Sequence
  Synthetic Polynucleotide
taatacgactcactatagggcatcttccactgcctcttttgctgagttccaacagaggagaggaactatgcaaaagaggaacctggcggcagcgcaaaagatg

SEQ ID NO: 9010 - DNA, 103 bp, Artificial Sequence
  Synthetic Polynucleotide
taatacgactcactatagggccgttcatcttccactgcctcttttgctgaaacagaggagatcagcaatggaggcagtgaacctggcggcagcgcaaaagatg

SEQ ID NO: 9011 - DNA, 103 bp, Artificial Sequence
  Synthetic Polynucleotide
taatacgactcactatagggcagaaccgttcatcttccactgcctcttttaacagaggagaaaaagaatgagtggaagaaacctggcggcagcgcaaaagatg

SEQ ID NO: 9012 - DNA, 103 bp, Artificial Sequence
  Synthetic Polynucleotide
taatacgactcactatagggggtcccagaaccgttcatcttccactgcctaacagaggagaaggcagatgaagatgaacaacctggcggcagcgcaaaagatg

SEQ ID NO: 9013 - DNA, 103 bp, Artificial Sequence
  Synthetic Polynucleotide
taatacgactcactatagggcagcaaaataaaaatgatccctttctgggtaacagaggagaacccagatggggatcattaacctggcggcagcgcaaaagatg

SEQ ID NO: 9014 - DNA, 103 bp, Artificial Sequence
  Synthetic Polynucleotide
taatacgactcactatagggcacaaggtcccagaaccgttcatcttccacaacagaggagagtggaaatggaacggttcaacctggcggcagcgcaaaagatg

SEQ ID NO: 9015 - DNA, 103 bp, Artificial Sequence
  Synthetic Polynucleotide
taatacgactcactatagggctgtgcacaaggtcccagaaccgttcatctaacagaggagaagatgaatggttctgggaaacctggcggcagcgcaaaagatg

SEQ ID NO: 9016 - DNA, 103 bp, Artificial Sequence
  Synthetic Polynucleotide
taatacgactcactatagggtctctctgtgcacaaggtcccagaaccgttaacagaggagaaacggtatggggaccttgaacctggcggcagcgcaaaagatg

SEQ ID NO: 9017 - DNA, 103 bp, Artificial Sequence
  Synthetic Polynucleotide
taatacgactcactatagggctccctctctctgtgcacaaggtcccagaaaacagaggagattctggatgcttgtgcacaacctggcggcagcgcaaaagatg

SEQ ID NO: 9018 - DNA, 103 bp, Artificial Sequence
  Synthetic Polynucleotide
taatacgactcactatagggtgaagctccctctctctgtgcacaaggtccaacagaggagaggacctatggcacagagaaacctggcggcagcgcaaaagatg

SEQ ID NO: 9019 - DNA, 103 bp, Artificial Sequence
  Synthetic Polynucleotide
taatacgactcactataggggtttatgaagctccctctctctgtgcacaaaacagaggagattgtgcatggagagagggaacctggcggcagcgcaaaagatg

SEQ ID NO: 9020 - DNA, 103 bp, Artificial Sequence
  Synthetic Polynucleotide
taatacgactcactatagggtccttgtttatgaagctccctctctctgtgaacagaggagacacagaatgagggagcttaacctggcggcagcgcaaaagatg

SEQ ID NO: 9021 - DNA, 103 bp, Artificial Sequence
  Synthetic Polynucleotide
taatacgactcactatagggcattttccttgtttatgaagctccctctctaacagaggagaagagagatggcttcataaaacctggcggcagcgcaaaagatg

SEQ ID NO: 9022 - DNA, 103 bp, Artificial Sequence
  Synthetic Polynucleotide
taatacgactcactatagggtggcacattttccttgtttatgaagctcccaacagaggagagggagcatgataaacaagaacctggcggcagcgcaaaagatg

SEQ ID NO: 9023 - DNA, 103 bp, Artificial Sequence
  Synthetic Polynucleotide
taatacgactcactatagggacacgtggcacattttccttgtttatgaagaacagaggagacttcatatgcaaggaaaaaacctggcggcagcgcaaaagatg

SEQ ID NO: 9024 - DNA, 103 bp, Artificial Sequence
  Synthetic Polynucleotide
taatacgactcactatagggagcatcagcaaaataaaaatgatccctttcaacagaggagagaaaggatgcatttttataacctggcggcagcgcaaaagatg

SEQ ID NO: 9025 - DNA, 103 bp, Artificial Sequence
  Synthetic Polynucleotide
taatacgactcactatagggtagacacacgtggcacattttccttgtttaaacagaggagataaacaatgaaaatgtgcaacctggcggcagcgcaaaagatg

SEQ ID NO: 9026 - DNA, 103 bp, Artificial Sequence
  Synthetic Polynucleotide
taatacgactcactatagggtgttgtagacacacgtggcacattttccttaacagaggagaaaggaaatggtgccacgtaacctggcggcagcgcaaaagatg

SEQ ID NO: 9027 - DNA, 103 bp, Artificial Sequence
  Synthetic Polynucleotide
taatacgactcactatagggcatcatgttgtagacacacgtggcacatttaacagaggagaaaatgtatgacgtgtgtcaacctggcggcagcgcaaaagatg

SEQ ID NO: 9028 - DNA, 103 bp, Artificial Sequence
  Synthetic Polynucleotide
taatacgactcactatagggtttcccatcatgttgtagacacacgtggcaaacagaggagatgccacatgtgtctacaaaacctggcggcagcgcaaaagatg

SEQ ID NO: 9029 - DNA, 103 bp, Artificial Sequence
  Synthetic Polynucleotide
taatacgactcactatagggctctctttcccatcatgttgtagacacacgaacagaggagacgtgtgatgacaacatgaaacctggcggcagcgcaaaagatg

SEQ ID NO: 9030 - DNA, 103 bp, Artificial Sequence
  Synthetic Polynucleotide
taatacgactcactatagggtttctctctctttcccatcatgttgtagacaacagaggagagtctacatgatgatgggaaacctggcggcagcgcaaaagatg

SEQ ID NO: 9031 - DNA, 103 bp, Artificial Sequence
  Synthetic Polynucleotide
taatacgactcactatagggaattttttctctctctttcccatcatgttgaacagaggagacaacatatggggaaagagaacctggcggcagcgcaaaagatg

SEQ ID NO: 9032 - DNA, 103 bp, Artificial Sequence
  Synthetic Polynucleotide
taatacgactcactatagggctcctaattttttctctctctttcccatcaaacagaggagatgatggatgagagagagaaacctggcggcagcgcaaaagatg

SEQ ID NO: 9033 - DNA, 103 bp, Artificial Sequence
  Synthetic Polynucleotide
taatacgactcactataggggaactctcctaattttttctctctctttccaacagaggagaggaaagatggagaaaaaaaacctggcggcagcgcaaaagatg

SEQ ID NO: 9034 - DNA, 103 bp, Artificial Sequence
  Synthetic Polynucleotide
taatacgactcactatagggtttccgaactctcctaattttttctctctcaacagaggagagagagaatgaaaattaggaacctggcggcagcgcaaaagatg

SEQ ID NO: 9035 - DNA, 103 bp, Artificial Sequence
  Synthetic Polynucleotide
taatacgactcactatagggttaccagcatcagcaaaataaaaatgatccaacagaggagaggatcaatgttattttgcaacctggcggcagcgcaaaagatg

SEQ ID NO: 9036 - DNA, 103 bp, Artificial Sequence
  Synthetic Polynucleotide
taatacgactcactatagggttgcctttccgaactctcctaattttttctaacagaggagaagaaaaatgtaggagagtaacctggcggcagcgcaaaagatg

SEQ ID NO: 9037 - DNA, 103 bp, Artificial Sequence
  Synthetic Polynucleotide
taatacgactcactatagggtccttttgcctttccgaactctcctaatttaacagaggagaaaattaatggagttcggaaacctggcggcagcgcaaaagatg

SEQ ID NO: 9038 - DNA, 103 bp, Artificial Sequence
  Synthetic Polynucleotide
taatacgactcactatagggcgacttccttttgcctttccgaactctcctaacagaggagaaggagaatgcggaaaggcaacctggcggcagcgcaaaagatg

SEQ ID NO: 9039 - DNA, 103 bp, Artificial Sequence
  Synthetic Polynucleotide
taatacgactcactatagggttgcgcgacttccttttgcctttccgaactaacagaggagaagttcgatgaggcaaaagaacctggcggcagcgcaaaagatg

SEQ ID NO: 9040 - DNA, 103 bp, Artificial Sequence
  Synthetic Polynucleotide
taatacgactcactatagggccatattgcgcgacttccttttgcctttccaacagaggagaggaaagatgaaaggaagtaacctggcggcagcgcaaaagatg

SEQ ID NO: 9041 - DNA, 103 bp, Artificial Sequence
  Synthetic Polynucleotide
taatacgactcactatagggatgtaccatattgcgcgacttccttttgccaacagaggagaggcaaaatgaagtcgcgcaacctggcggcagcgcaaaagatg

SEQ ID NO: 9042 - DNA, 103 bp, Artificial Sequence
  Synthetic Polynucleotide
taatacgactcactatagggaccacatgtaccatattgcgcgacttccttaacagaggagaaaggaaatggcgcaatataacctggcggcagcgcaaaagatg

SEQ ID NO: 9043 - DNA, 103 bp, Artificial Sequence
  Synthetic Polynucleotide
taatacgactcactatagggtcccaaccacatgtaccatattgcgcgactaacagaggagaagtcgcatgatatggtacaacctggcggcagcgcaaaagatg

SEQ ID NO: 9044 - DNA, 103 bp, Artificial Sequence
  Synthetic Polynucleotide
taatacgactcactatagggcgcgctcccaaccacatgtaccatattgcgaacagaggagacgcaatatggtacatgtgaacctggcggcagcgcaaaagatg

SEQ ID NO: 9045 - DNA, 103 bp, Artificial Sequence
  Synthetic Polynucleotide
taatacgactcactatagggaaaagcgcgctcccaaccacatgtaccataaacagaggagatatggtatgtgtggttggaacctggcggcagcgcaaaagatg

SEQ ID NO: 9046 - DNA, 103 bp, Artificial Sequence
  Synthetic Polynucleotide
taatacgactcactatagggctttttccgttggttgttcatcagagatctaacagaggagaagatctatgatgaacaacaacctggcggcagcgcaaaagatg

SEQ ID NO: 9047 - DNA, 103 bp, Artificial Sequence
  Synthetic Polynucleotide
taatacgactcactatagggtggagttaccagcatcagcaaaataaaaataacagaggagaatttttatgttgctgatgaacctggcggcagcgcaaaagatg

SEQ ID NO: 9048 - DNA, 103 bp, Artificial Sequence
  Synthetic Polynucleotide
taatacgactcactatagggctctaaaaagcgcgctcccaaccacatgtaaacagaggagatacatgatgttgggagcgaacctggcggcagcgcaaaagatg

SEQ ID NO: 9049 - DNA, 103 bp, Artificial Sequence
  Synthetic Polynucleotide
taatacgactcactatagggtcaaactctaaaaagcgcgctcccaaccacaacagaggagagtggttatgagcgcgcttaacctggcggcagcgcaaaagatg

SEQ ID NO: 9050 - DNA, 103 bp, Artificial Sequence
  Synthetic Polynucleotide
taatacgactcactataggggggcttcaaactctaaaaagcgcgctcccaaacagaggagatgggagatggctttttagaacctggcggcagcgcaaaagatg

SEQ ID NO: 9051 - DNA, 103 bp, Artificial Sequence
  Synthetic Polynucleotide
taatacgactcactatagggaccaagggcttcaaactctaaaaagcgcgcaacagaggagagcgcgcatgttagagtttaacctggcggcagcgcaaaagatg

SEQ ID NO: 9052 - DNA, 103 bp, Artificial Sequence
  Synthetic Polynucleotide
taatacgactcactatagggatgaaaccaagggcttcaaactctaaaaagaacagaggagactttttatggtttgaagcaacctggcggcagcgcaaaagatg

SEQ ID NO: 9053 - DNA, 103 bp, Artificial Sequence
  Synthetic Polynucleotide
taatacgactcactatagggcattcatgaaaccaagggcttcaaactctaaacagaggagatagagtatgaagcccttgaacctggcggcagcgcaaaagatg

SEQ ID NO: 9054 - DNA, 103 bp, Artificial Sequence
  Synthetic Polynucleotide
taatacgactcactatagggatcttcattcatgaaaccaagggcttcaaaaacagaggagatttgaaatgcttggtttcaacctggcggcagcgcaaaagatg

SEQ ID NO: 9055 - DNA, 103 bp, Artificial Sequence
  Synthetic Polynucleotide
taatacgactcactatagggcagtgatcttcattcatgaaaccaagggctaacagaggagaagccctatgtttcatgaaaacctggcggcagcgcaaaagatg

SEQ ID NO: 9056 - DNA, 103 bp, Artificial Sequence
  Synthetic Polynucleotide
taatacgactcactatagggtgaaccagtgatcttcattcatgaaaccaaaacagaggagattggttatgtgaatgaagaacctggcggcagcgcaaaagatg

SEQ ID NO: 9057 - DNA, 103 bp, Artificial Sequence
  Synthetic Polynucleotide
taatacgactcactatagggtctgctgaaccagtgatcttcattcatgaaaacagaggagattcatgatggaagatcacaacctggcggcagcgcaaaagatg

SEQ ID NO: 9058 - DNA, 103 bp, Artificial Sequence
  Synthetic Polynucleotide
taatacgactcactatagggatggatggagttaccagcatcagcaaaataaacagaggagatattttatggatgctggtaacctggcggcagcgcaaaagatg

SEQ ID NO: 9059 - DNA, 103 bp, Artificial Sequence
  Synthetic Polynucleotide
taatacgactcactatagggttctctctgctgaaccagtgatcttcattcaacagaggagagaatgaatgtcactggttaacctggcggcagcgcaaaagatg

SEQ ID NO: 9060 - DNA, 103 bp, Artificial Sequence
  Synthetic Polynucleotide
taatacgactcactataggggtgaattctctctgctgaaccagtgatcttaacagaggagaaagatcatgggttcagcaaacctggcggcagcgcaaaagatg

SEQ ID NO: 9061 - DNA, 103 bp, Artificial Sequence
  Synthetic Polynucleotide
taatacgactcactatagggactgagtgaattctctctgctgaaccagtgaacagaggagacactggatgagcagagagaacctggcggcagcgcaaaagatg

SEQ ID NO: 9062 - DNA, 103 bp, Artificial Sequence
  Synthetic Polynucleotide
taatacgactcactatagggactccactgagtgaattctctctgctgaacaacagaggagagttcagatgagagaattcaacctggcggcagcgcaaaagatg

SEQ ID NO: 9063 - DNA, 103 bp, Artificial Sequence
  Synthetic Polynucleotide
taatacgactcactatagggcttccactccactgagtgaattctctctgcaacagaggagagcagagatgattcactcaaacctggcggcagcgcaaaagatg

SEQ ID NO: 9064 - DNA, 103 bp, Artificial Sequence
  Synthetic Polynucleotide
taatacgactcactatagggttctccttccactccactgagtgaattctcaacagaggagagagaatatgctcagtggaaacctggcggcagcgcaaaagatg

SEQ ID NO: 9065 - DNA, 103 bp, Artificial Sequence
  Synthetic Polynucleotide
taatacgactcactatagggagtccttctccttccactccactgagtgaaaacagaggagattcactatgtggagtggaaacctggcggcagcgcaaaagatg

SEQ ID NO: 9066 - DNA, 103 bp, Artificial Sequence
  Synthetic Polynucleotide
taatacgactcactatagggtgtggagtccttctccttccactccactgaaacagaggagatcagtgatgtggaaggagaacctggcggcagcgcaaaagatg

SEQ ID NO: 9067 - DNA, 103 bp, Artificial Sequence
  Synthetic Polynucleotide
taatacgactcactatagggaagtttgtggagtccttctccttccactccaacagaggagaggagtgatgggagaaggaaacctggcggcagcgcaaaagatg

SEQ ID NO: 9068 - DNA, 103 bp, Artificial Sequence
  Synthetic Polynucleotide
taatacgactcactatagggtatccaagtttgtggagtccttctccttccaacagaggagaggaaggatgaggactccaaacctggcggcagcgcaaaagatg

SEQ ID NO: 9069 - DNA, 103 bp, Artificial Sequence
  Synthetic Polynucleotide
taatacgactcactatagggtggccatggatggagttaccagcatcagcaaacagaggagatgctgaatgtggtaactcaacctggcggcagcgcaaaagatg

SEQ ID NO: 9070 - DNA, 103 bp, Artificial Sequence
  Synthetic Polynucleotide
taatacgactcactataggggtatgtatccaagtttgtggagtccttctcaacagaggagagagaagatgtccacaaacaacctggcggcagcgcaaaagatg

SEQ ID NO: 9071 - DNA, 103 bp, Artificial Sequence
  Synthetic Polynucleotide
taatacgactcactatagggtctgagtatgtatccaagtttgtggagtccaacagaggagaggactcatgaaacttggaaacctggcggcagcgcaaaagatg

SEQ ID NO: 9072 - DNA, 103 bp, Artificial Sequence
  Synthetic Polynucleotide
taatacgactcactatagggatgtctctgagtatgtatccaagtttgtggaacagaggagaccacaaatgtggatacataacctggcggcagcgcaaaagatg

SEQ ID NO: 9073 - DNA, 103 bp, Artificial Sequence
  Synthetic Polynucleotide
taatacgactcactatagggttgatatgtctctgagtatgtatccaagttaacagaggagaaacttgatgacatactcaaacctggcggcagcgcaaaagatg

SEQ ID NO: 9074 - DNA, 103 bp, Artificial Sequence
  Synthetic Polynucleotide
taatacgactcactatagggaatctttgatatgtctctgagtatgtatccaacagaggagaggatacatgctcagagacaacctggcggcagcgcaaaagatg

SEQ ID NO: 9075 - DNA, 103 bp, Artificial Sequence
  Synthetic Polynucleotide
taatacgactcactatagggcctggaatctttgatatgtctctgagtatgaacagaggagacatactatgagacatatcaacctggcggcagcgcaaaagatg

SEQ ID NO: 9076 - DNA, 103 bp, Artificial Sequence
  Synthetic Polynucleotide
taatacgactcactatagggttccccctggaatctttgatatgtctctgaaacagaggagatcagagatgtatcaaagaaacctggcggcagcgcaaaagatg

SEQ ID NO: 9077 - DNA, 103 bp, Artificial Sequence
  Synthetic Polynucleotide
taatacgactcactatagggcatatttccccctggaatctttgatatgtcaacagaggagagacataatgaagattccaaacctggcggcagcgcaaaagatg

SEQ ID NO: 9078 - DNA, 103 bp, Artificial Sequence
  Synthetic Polynucleotide
taatacgactcactataggggcatacatatttccccctggaatctttgataacagaggagaatcaaaatgtccagggggaacctggcggcagcgcaaaagatg

SEQ ID NO: 9079 - DNA, 103 bp, Artificial Sequence
  Synthetic Polynucleotide
taatacgactcactatagggcatctgcatacatatttccccctggaatctaacagaggagaagattcatgggggaaataaacctggcggcagcgcaaaagatg

SEQ ID NO: 9080 - DNA, 103 bp, Artificial Sequence
  Synthetic Polynucleotide
taatacgactcactatagggccgcatggccatggatggagttaccagcataacagaggagaatgctgatgactccatccaacctggcggcagcgcaaaagatg

SEQ ID NO: 9081 - DNA, 103 bp, Artificial Sequence
  Synthetic Polynucleotide
taatacgactcactatagggtgtgtcatctgcatacatatttccccctggaacagaggagaccagggatgaatatgtataacctggcggcagcgcaaaagatg

SEQ ID NO: 9082 - DNA, 103 bp, Artificial Sequence
  Synthetic Polynucleotide
taatacgactcactatagggccggctgtgtcatctgcatacatatttcccaacagaggagagggaaaatggtatgcagaaacctggcggcagcgcaaaagatg

SEQ ID NO: 9083 - DNA, 103 bp, Artificial Sequence
  Synthetic Polynucleotide
taatacgactcactatagggcccatccggctgtgtcatctgcatacatataacagaggagaatatgtatgcagatgacaaacctggcggcagcgcaaaagatg

SEQ ID NO: 9084 - DNA, 103 bp, Artificial Sequence
  Synthetic Polynucleotide
taatacgactcactatagggtgtgtcccatccggctgtgtcatctgcataaacagaggagatatgcaatggacacagccaacctggcggcagcgcaaaagatg

SEQ ID NO: 9085 - DNA, 103 bp, Artificial Sequence
  Synthetic Polynucleotide
taatacgactcactatagggattcttgtgtcccatccggctgtgtcatctaacagaggagaagatgaatgagccggatgaacctggcggcagcgcaaaagatg

SEQ ID NO: 9086 - DNA, 103 bp, Artificial Sequence
  Synthetic Polynucleotide
taatacgactcactatagggctgttattcttgtgtcccatccggctgtgtaacagaggagaacacagatggatgggacaaacctggcggcagcgcaaaagatg

SEQ ID NO: 9087 - DNA, 103 bp, Artificial Sequence
  Synthetic Polynucleotide
taatacgactcactatagggatcctctgttattcttgtgtcccatccggcaacagaggagagccggaatggacacaagaaacctggcggcagcgcaaaagatg

SEQ ID NO: 9088 - DNA, 103 bp, Artificial Sequence
  Synthetic Polynucleotide
taatacgactcactatagggagatcatcctctgttattcttgtgtcccataacagaggagaatgggaatgaagaataacaacctggcggcagcgcaaaagatg

SEQ ID NO: 9089 - DNA, 103 bp, Artificial Sequence
  Synthetic Polynucleotide
taatacgactcactatagggtctgaagatcatcctctgttattcttgtgtaacagaggagaacacaaatgtaacagaggaacctggcggcagcgcaaaagatg

SEQ ID NO: 9090 - DNA, 103 bp, Artificial Sequence
  Synthetic Polynucleotide
taatacgactcactatagggctcattctgaagatcatcctctgttattctaacagaggagaagaataatggaggatgataacctggcggcagcgcaaaagatg

SEQ ID NO: 9091 - DNA, 103 bp, Artificial Sequence
  Synthetic Polynucleotide
taatacgactcactatagggacgcaccgcatggccatggatggagttaccaacagaggagaggtaacatgatccatggcaacctggcggcagcgcaaaagatg

SEQ ID NO: 9092 - DNA, 103 bp, Artificial Sequence
  Synthetic Polynucleotide
taatacgactcactatagggttggcctcattctgaagatcatcctctgttaacagaggagaaacagaatgtgatcttcaaacctggcggcagcgcaaaagatg

SEQ ID NO: 9093 - DNA, 103 bp, Artificial Sequence
  Synthetic Polynucleotide
taatacgactcactatagggtgattttggcctcattctgaagatcatcctaacagaggagaaggatgatgttcagaatgaacctggcggcagcgcaaaagatg

SEQ ID NO: 9094 - DNA, 103 bp, Artificial Sequence
  Synthetic Polynucleotide
taatacgactcactataggggtcagtgattttggcctcattctgaagatcaacagaggagagatcttatgaatgaggccaacctggcggcagcgcaaaagatg

SEQ ID NO: 9095 - DNA, 103 bp, Artificial Sequence
  Synthetic Polynucleotide
taatacgactcactatagggatgatgtcagtgattttggcctcattctgaaacagaggagatcagaaatgggccaaaataacctggcggcagcgcaaaagatg

SEQ ID NO: 9096 - DNA, 103 bp, Artificial Sequence
  Synthetic Polynucleotide
taatacgactcactataggggttccatgatgtcagtgattttggcctcataacagaggagaatgaggatgaaatcactgaacctggcggcagcgcaaaagatg

SEQ ID NO: 9097 - DNA, 103 bp, Artificial Sequence
  Synthetic Polynucleotide
taatacgactcactatagggttcaggttccatgatgtcagtgattttggcaacagaggagagccaaaatgactgacatcaacctggcggcagcgcaaaagatg

SEQ ID NO: 9098 - DNA, 103 bp, Artificial Sequence
  Synthetic Polynucleotide
taatacgactcactataggggcatgttcaggttccatgatgtcagtgattaacagaggagaaatcacatgcatcatggaaacctggcggcagcgcaaaagatg

SEQ ID NO: 9099 - DNA, 103 bp, Artificial Sequence
  Synthetic Polynucleotide
taatacgactcactatagggatagggcatgttcaggttccatgatgtcagaacagaggagactgacaatgtggaacctgaacctggcggcagcgcaaaagatg

SEQ ID NO: 9100 - DNA, 103 bp, Artificial Sequence
  Synthetic Polynucleotide
taatacgactcactatagggggccaatagggcatgttcaggttccatgataacagaggagaatcatgatgcctgaacataacctggcggcagcgcaaaagatg

SEQ ID NO: 9101 - DNA, 103 bp, Artificial Sequence
  Synthetic Polynucleotide
taatacgactcactataggggacgtggccaatagggcatgttcaggttccaacagaggagaggaaccatgacatgccctaacctggcggcagcgcaaaagatg

SEQ ID NO: 9102 - DNA, 103 bp, Artificial Sequence
  Synthetic Polynucleotide
taatacgactcactatagggttcccacgcaccgcatggccatggatggagaacagaggagactccatatgtggccatgcaacctggcggcagcgcaaaagatg

SEQ ID NO: 9103 - DNA, 103 bp, Artificial Sequence
  Synthetic Polynucleotide
taatacgactcactatagggagattgacgtggccaatagggcatgttcagaacagaggagactgaacatgccctattggaacctggcggcagcgcaaaagatg

SEQ ID NO: 9104 - DNA, 103 bp, Artificial Sequence
  Synthetic Polynucleotide
taatacgactcactatagggcttaaagattgacgtggccaatagggcatgaacagaggagacatgccatgttggccacgaacctggcggcagcgcaaaagatg

SEQ ID NO: 9105 - DNA, 103 bp, Artificial Sequence
  Synthetic Polynucleotide
taatacgactcactataggggttagcttaaagattgacgtggccaataggaacagaggagacctattatgcacgtcaataacctggcggcagcgcaaaagatg

SEQ ID NO: 9106 - DNA, 103 bp, Artificial Sequence
  Synthetic Polynucleotide
taatacgactcactatagggggtaggttagcttaaagattgacgtggccaaacagaggagatggccaatgcaatctttaaacctggcggcagcgcaaaagatg

SEQ ID NO: 9107 - DNA, 103 bp, Artificial Sequence
  Synthetic Polynucleotide
taatacgactcactataggggttttggtaggttagcttaaagattgacgtaacagaggagaacgtcaatgtttaagctaaacctggcggcagcgcaaaagatg

SEQ ID NO: 9108 - DNA, 103 bp, Artificial Sequence
  Synthetic Polynucleotide
taatacgactcactatagggaccttgttttggtaggttagcttaaagattaacagaggagaaatcttatggctaacctaaacctggcggcagcgcaaaagatg

SEQ ID NO: 9109 - DNA, 103 bp, Artificial Sequence
  Synthetic Polynucleotide
taatacgactcactatagggttactaccttgttttggtaggttagcttaaaacagaggagattaagcatgcctaccaaaaacctggcggcagcgcaaaagatg

SEQ ID NO: 9110 - DNA, 103 bp, Artificial Sequence
  Synthetic Polynucleotide
taatacgactcactatagggcacccttactaccttgttttggtaggttagaacagaggagactaaccatgcaaaacaagaacctggcggcagcgcaaaagatg

SEQ ID NO: 9111 - DNA, 103 bp, Artificial Sequence
  Synthetic Polynucleotide
taatacgactcactatagggctctgcacccttactaccttgttttggtagaacagaggagactaccaatgcaaggtagtaacctggcggcagcgcaaaagatg

SEQ ID NO: 9112 - DNA, 103 bp, Artificial Sequence
  Synthetic Polynucleotide
taatacgactcactatagggctggtctctgcacccttactaccttgttttaacagaggagaaaaacaatgtagtaagggaacctggcggcagcgcaaaagatg

SEQ ID NO: 9113 - DNA, 103 bp, Artificial Sequence
  Synthetic Polynucleotide
taatacgactcactataggggcctattcccacgcaccgcatggccatggaaacagaggagatccatgatgatgcggtgcaacctggcggcagcgcaaaagatg

SEQ ID NO: 9114 - DNA, 103 bp, Artificial Sequence
  Synthetic Polynucleotide
taatacgactcactatagggtttcgctggtctctgcacccttactaccttaacagaggagaaaggtaatgagggtgcagaacctggcggcagcgcaaaagatg

SEQ ID NO: 9115 - DNA, 103 bp, Artificial Sequence
  Synthetic Polynucleotide
taatacgactcactatagggccatttttcgctggtctctgcacccttactaacagaggagaagtaagatggcagagaccaacctggcggcagcgcaaaagatg

SEQ ID NO: 9116 - DNA, 103 bp, Artificial Sequence
  Synthetic Polynucleotide
taatacgactcactatagggcggttccatttttcgctggtctctgcacccaacagaggagagggtgcatggaccagcgaaacctggcggcagcgcaaaagatg

SEQ ID NO: 9117 - DNA, 103 bp, Artificial Sequence
  Synthetic Polynucleotide
taatacgactcactatagggcatcacggttccatttttcgctggtctctgaacagaggagacagagaatggcgaaaaataacctggcggcagcgcaaaagatg

SEQ ID NO: 9118 - DNA, 103 bp, Artificial Sequence
  Synthetic Polynucleotide
taatacgactcactatagggacatccatcacggttccatttttcgctggtaacagaggagaaccagcatgaaatggaacaacctggcggcagcgcaaaagatg

SEQ ID NO: 9119 - DNA, 103 bp, Artificial Sequence
  Synthetic Polynucleotide
taatacgactcactatagggatatgacatccatcacggttccatttttcgaacagaggagacgaaaaatggaaccgtgaaacctggcggcagcgcaaaagatg

SEQ ID NO: 9120 - DNA, 103 bp, Artificial Sequence
  Synthetic Polynucleotide
taatacgactcactatagggtctggatatgacatccatcacggttccattaacagaggagaaatggaatggtgatggataacctggcggcagcgcaaaagatg

SEQ ID NO: 9121 - DNA, 103 bp, Artificial Sequence
  Synthetic Polynucleotide
taatacgactcactatagggtcacgtctggatatgacatccatcacggttaacagaggagaaaccgtatgggatgtcataacctggcggcagcgcaaaagatg

SEQ ID NO: 9122 - DNA, 103 bp, Artificial Sequence
  Synthetic Polynucleotide
taatacgactcactatagggtctggtcacgtctggatatgacatccatcaaacagaggagatgatggatgtcatatccaaacctggcggcagcgcaaaagatg

SEQ ID NO: 9123 - DNA, 103 bp, Artificial Sequence
  Synthetic Polynucleotide
taatacgactcactatagggtcctctctggtcacgtctggatatgacatcaacagaggagagatgtcatgtccagacgtaacctggcggcagcgcaaaagatg

SEQ ID NO: 9124 - DNA, 103 bp, Artificial Sequence
  Synthetic Polynucleotide
taatacgactcactatagggctgttgcctattcccacgcaccgcatggccaacagaggagaggccatatggtgcgtgggaacctggcggcagcgcaaaagatg

SEQ ID NO: 9125 - DNA, 103 bp, Artificial Sequence
  Synthetic Polynucleotide
taatacgactcactatagggccacttcctctctggtcacgtctggatatgaacagaggagacatatcatgacgtgaccaaacctggcggcagcgcaaaagatg

SEQ ID NO: 9126 - DNA, 103 bp, Artificial Sequence
  Synthetic Polynucleotide
taatacgactcactatagggcctgtccacttcctctctggtcacgtctggaacagaggagaccagacatgaccagagagaacctggcggcagcgcaaaagatg

SEQ ID NO: 9127 - DNA, 103 bp, Artificial Sequence
  Synthetic Polynucleotide
taatacgactcactatagggtccaacctgtccacttcctctctggtcacgaacagaggagacgtgacatgagaggaagtaacctggcggcagcgcaaaagatg

SEQ ID NO: 9128 - DNA, 103 bp, Artificial Sequence
  Synthetic Polynucleotide
taatacgactcactatagggtaggttccaacctgtccacttcctctctggaacagaggagaccagagatgaagtggacaaacctggcggcagcgcaaaagatg

SEQ ID NO: 9129 - DNA, 103 bp, Artificial Sequence
  Synthetic Polynucleotide
taatacgactcactatagggagccataggttccaacctgtccacttcctcaacagaggagagaggaaatggacaggttgaacctggcggcagcgcaaaagatg

SEQ ID NO: 9130 - DNA, 103 bp, Artificial Sequence
  Synthetic Polynucleotide
taatacgactcactataggggtttaagccataggttccaacctgtccactaacagaggagaagtggaatggttggaaccaacctggcggcagcgcaaaagatg

SEQ ID NO: 9131 - DNA, 103 bp, Artificial Sequence
  Synthetic Polynucleotide
taatacgactcactatagggaaggtgtttaagccataggttccaacctgtaacagaggagaacaggtatgaacctatggaacctggcggcagcgcaaaagatg

SEQ ID NO: 9132 - DNA, 103 bp, Artificial Sequence
  Synthetic Polynucleotide
taatacgactcactatagggtggtgaaggtgtttaagccataggttccaaaacagaggagattggaaatgatggcttaaaacctggcggcagcgcaaaagatg

SEQ ID NO: 9133 - DNA, 103 bp, Artificial Sequence
  Synthetic Polynucleotide
taatacgactcactatagggcatgttggtgaaggtgtttaagccataggtaacagaggagaacctatatgttaaacaccaacctggcggcagcgcaaaagatg

SEQ ID NO: 9134 - DNA, 103 bp, Artificial Sequence
  Synthetic Polynucleotide
taatacgactcactataggggcctccatgttggtgaaggtgtttaagccaaacagaggagatggcttatgcaccttcacaacctggcggcagcgcaaaagatg

SEQ ID NO: 9135 - DNA, 103 bp, Artificial Sequence
  Synthetic Polynucleotide
taatacgactcactatagggagtctctgttgcctattcccacgcaccgcaaacagaggagatgcggtatgtgggaatagaacctggcggcagcgcaaaagatg

SEQ ID NO: 9136 - DNA, 103 bp, Artificial Sequence
  Synthetic Polynucleotide
taatacgactcactataggggttgggcctccatgttggtgaaggtgtttaaacagaggagataaacaatgtcaccaacaaacctggcggcagcgcaaaagatg

SEQ ID NO: 9137 - DNA, 103 bp, Artificial Sequence
  Synthetic Polynucleotide
taatacgactcactatagggtattagttgggcctccatgttggtgaaggtaacagaggagaaccttcatgaacatggagaacctggcggcagcgcaaaagatg

SEQ ID NO: 9138 - DNA, 103 bp, Artificial Sequence
  Synthetic Polynucleotide
taatacgactcactatagggtgtcttattagttgggcctccatgttggtgaacagaggagacaccaaatgggaggcccaaacctggcggcagcgcaaaagatg

SEQ ID NO: 9139 - DNA, 103 bp, Artificial Sequence
  Synthetic Polynucleotide
taatacgactcactatagggccatttgtcttattagttgggcctccatgtaacagaggagaacatggatgcccaactaaaacctggcggcagcgcaaaagatg

SEQ ID NO: 9140 - DNA, 103 bp, Artificial Sequence
  Synthetic Polynucleotide
taatacgactcactatagggagactccatttgtcttattagttgggcctcaacagaggagagaggccatgctaataagaaacctggcggcagcgcaaaagatg

SEQ ID NO: 9141 - DNA, 103 bp, Artificial Sequence
  Synthetic Polynucleotide
taatacgactcactatagggccctcagactccatttgtcttattagttggaacagaggagaccaactatgaagacaaataacctggcggcagcgcaaaagatg

SEQ ID NO: 9142 - DNA, 103 bp, Artificial Sequence
  Synthetic Polynucleotide
taatacgactcactatagggagattccctcagactccatttgtcttattaaacagaggagataataaatgaaatggagtaacctggcggcagcgcaaaagatg

SEQ ID NO: 9143 - DNA, 103 bp, Artificial Sequence
  Synthetic Polynucleotide
taatacgactcactatagggtgaaaagattccctcagactccatttgtctaacagaggagaagacaaatggagtctgagaacctggcggcagcgcaaaagatg

SEQ ID NO: 9144 - DNA, 103 bp, Artificial Sequence
  Synthetic Polynucleotide
taatacgactcactatagggctgggtgaaaagattccctcagactccattaacagaggagaaatggaatgtgagggaataacctggcggcagcgcaaaagatg

SEQ ID NO: 9145 - DNA, 103 bp, Artificial Sequence
  Synthetic Polynucleotide
taatacgactcactatagggattcgctgggtgaaaagattccctcagactaacagaggagaagtctgatggaatcttttaacctggcggcagcgcaaaagatg

SEQ ID NO: 9146 - DNA, 103 bp, Artificial Sequence
  Synthetic Polynucleotide
taatacgactcactatagggcacgaagtctctgttgcctattcccacgcaaacagaggagatgcgtgatgataggcaacaacctggcggcagcgcaaaagatg

SEQ ID NO: 9147 - DNA, 103 bp, Artificial Sequence
  Synthetic Polynucleotide
taatacgactcactatagggttccaattcgctgggtgaaaagattccctcaacagaggagagagggaatgttttcacccaacctggcggcagcgcaaaagatg

SEQ ID NO: 9148 - DNA, 103 bp, Artificial Sequence
  Synthetic Polynucleotide
taatacgactcactatagggggggtttccaattcgctgggtgaaaagattaacagaggagaaatcttatgacccagcgaaacctggcggcagcgcaaaagatg

SEQ ID NO: 9149 - DNA, 103 bp, Artificial Sequence
  Synthetic Polynucleotide
taatacgactcactataggggatttggggtttccaattcgctgggtgaaaaacagaggagatttcacatggcgaattggaacctggcggcagcgcaaaagatg

SEQ ID NO: 9150 - DNA, 103 bp, Artificial Sequence
  Synthetic Polynucleotide
taatacgactcactatagggggctagatttggggtttccaattcgctgggaacagaggagacccagcatgttggaaaccaacctggcggcagcgcaaaagatg

SEQ ID NO: 9151 - DNA, 103 bp, Artificial Sequence
  Synthetic Polynucleotide
taatacgactcactatagggctttcggctagatttggggtttccaattcgaacagaggagacgaattatgaaccccaaaaacctggcggcagcgcaaaagatg

SEQ ID NO: 9152 - DNA, 103 bp, Artificial Sequence
  Synthetic Polynucleotide
taatacgactcactatagggggactctttcggctagatttggggtttccaaacagaggagatggaaaatgcaaatctagaacctggcggcagcgcaaaagatg

SEQ ID NO: 9153 - DNA, 103 bp, Artificial Sequence
  Synthetic Polynucleotide
taatacgactcactataggggtcgaggactctttcggctagatttggggtaacagaggagaaccccaatgctagccgaaaacctggcggcagcgcaaaagatg

SEQ ID NO: 9154 - DNA, 103 bp, Artificial Sequence
  Synthetic Polynucleotide
taatacgactcactatagggaaccagtcgaggactctttcggctagatttaacagaggagaaaatctatgcgaaagagtaacctggcggcagcgcaaaagatg

SEQ ID NO: 9155 - DNA, 103 bp, Artificial Sequence
  Synthetic Polynucleotide
taatacgactcactatagggttttcaaccagtcgaggactctttcggctaaacagaggagatagccgatggagtcctcgaacctggcggcagcgcaaaagatg

SEQ ID NO: 9156 - DNA, 103 bp, Artificial Sequence
  Synthetic Polynucleotide
taatacgactcactatagggatgttttttcaaccagtcgaggactctttcaacagaggagagaaagaatgctcgactggaacctggcggcagcgcaaaagatg

SEQ ID NO: 9157 - DNA, 103 bp, Artificial Sequence
  Synthetic Polynucleotide
taatacgactcactatagggcccgtctttttccgttggttgttcatcagaaacagaggagatctgatatgcaaccaacgaacctggcggcagcgcaaaagatg

SEQ ID NO: 9158 - DNA, 103 bp, Artificial Sequence
  Synthetic Polynucleotide
taatacgactcactatagggccttccacgaagtctctgttgcctattcccaacagaggagagggaatatgcaacagagaaacctggcggcagcgcaaaagatg

SEQ ID NO: 9159 - DNA, 103 bp, Artificial Sequence
  Synthetic Polynucleotide
taatacgactcactataggggtgccatgttttttcaaccagtcgaggactaacagaggagaagtcctatgctggttgaaaacctggcggcagcgcaaaagatg

SEQ ID NO: 9160 - DNA, 103 bp, Artificial Sequence
  Synthetic Polynucleotide
taatacgactcactatagggtctcggtgccatgttttttcaaccagtcgaaacagaggagatcgactatgtgaaaaaacaacctggcggcagcgcaaaagatg

SEQ ID NO: 9161 - DNA, 103 bp, Artificial Sequence
  Synthetic Polynucleotide
taatacgactcactatagggcagcctctcggtgccatgttttttcaaccaaacagaggagatggttgatgaaacatggcaacctggcggcagcgcaaaagatg

SEQ ID NO: 9162 - DNA, 103 bp, Artificial Sequence
  Synthetic Polynucleotide
taatacgactcactatagggcttttcagcctctcggtgccatgttttttcaacagaggagagaaaaaatgtggcaccgaaacctggcggcagcgcaaaagatg

SEQ ID NO: 9163 - DNA, 103 bp, Artificial Sequence
  Synthetic Polynucleotide
taatacgactcactatagggccattcttttcagcctctcggtgccatgttaacagaggagaaacatgatgccgagaggcaacctggcggcagcgcaaaagatg

SEQ ID NO: 9164 - DNA, 103 bp, Artificial Sequence
  Synthetic Polynucleotide
taatacgactcactataggggattgccattcttttcagcctctcggtgccaacagaggagaggcaccatgaggctgaaaaacctggcggcagcgcaaaagatg

SEQ ID NO: 9165 - DNA, 103 bp, Artificial Sequence
  Synthetic Polynucleotide
taatacgactcactatagggccactgattgccattcttttcagcctctcgaacagaggagacgagagatggaaaagaataacctggcggcagcgcaaaagatg

SEQ ID NO: 9166 - DNA, 103 bp, Artificial Sequence
  Synthetic Polynucleotide
taatacgactcactatagggcatctccactgattgccattcttttcagccaacagaggagaggctgaatggaatggcaaaacctggcggcagcgcaaaagatg

SEQ ID NO: 9167 - DNA, 103 bp, Artificial Sequence
  Synthetic Polynucleotide
taatacgactcactatagggacagtcatctccactgattgccattcttttaacagaggagaaaaagaatggcaatcagtaacctggcggcagcgcaaaagatg

SEQ ID NO: 9168 - DNA, 103 bp, Artificial Sequence
  Synthetic Polynucleotide
taatacgactcactatagggaccacacagtcatctccactgattgccattaacagaggagaaatggcatgcagtggagaaacctggcggcagcgcaaaagatg

SEQ ID NO: 9169 - DNA, 103 bp, Artificial Sequence
  Synthetic Polynucleotide
taatacgactcactatagggacagtccttccacgaagtctctgttgcctaaacagaggagataggcaatggagacttcgaacctggcggcagcgcaaaagatg

SEQ ID NO: 9170 - DNA, 103 bp, Artificial Sequence
  Synthetic Polynucleotide
taatacgactcactataggggtttcaccacacagtcatctccactgattgaacagaggagacaatcaatggagatgactaacctggcggcagcgcaaaagatg

SEQ ID NO: 9171 - DNA, 103 bp, Artificial Sequence
  Synthetic Polynucleotide
taatacgactcactataggggattggtttcaccacacagtcatctccactaacagaggagaagtggaatggactgtgtgaacctggcggcagcgcaaaagatg

SEQ ID NO: 9172 - DNA, 103 bp, Artificial Sequence
  Synthetic Polynucleotide
taatacgactcactatagggtcatcgattggtttcaccacacagtcatctaacagaggagaagatgaatgtgtggtgaaaacctggcggcagcgcaaaagatg

SEQ ID NO: 9173 - DNA, 103 bp, Artificial Sequence
  Synthetic Polynucleotide
taatacgactcactatagggatctgtcatcgattggtttcaccacacagtaacagaggagaactgtgatgtgaaaccaaaacctggcggcagcgcaaaagatg

SEQ ID NO: 9174 - DNA, 103 bp, Artificial Sequence
  Synthetic Polynucleotide
taatacgactcactatagggtgcaaatctgtcatcgattggtttcaccacaacagaggagagtggtgatgccaatcgataacctggcggcagcgcaaaagatg

SEQ ID NO: 9175 - DNA, 103 bp, Artificial Sequence
  Synthetic Polynucleotide
taatacgactcactataggggctgttgcaaatctgtcatcgattggtttcaacagaggagagaaaccatgcgatgacagaacctggcggcagcgcaaaagatg

SEQ ID NO: 9176 - DNA, 103 bp, Artificial Sequence
  Synthetic Polynucleotide
taatacgactcactatagggttaaggctgttgcaaatctgtcatcgattgaacagaggagacaatcgatgacagatttgaacctggcggcagcgcaaaagatg

SEQ ID NO: 9177 - DNA, 103 bp, Artificial Sequence
  Synthetic Polynucleotide
taatacgactcactatagggagctgttaaggctgttgcaaatctgtcatcaacagaggagagatgacatgtttgcaacaaacctggcggcagcgcaaaagatg

SEQ ID NO: 9178 - DNA, 103 bp, Artificial Sequence
  Synthetic Polynucleotide
taatacgactcactatagggttcaaagctgttaaggctgttgcaaatctgaacagaggagacagattatgaacagccttaacctggcggcagcgcaaaagatg

SEQ ID NO: 9179 - DNA, 103 bp, Artificial Sequence
  Synthetic Polynucleotide
taatacgactcactatagggtgtcattcaaagctgttaaggctgttgcaaaacagaggagattgcaaatgccttaacagaacctggcggcagcgcaaaagatg

SEQ ID NO: 9180 - DNA, 103 bp, Artificial Sequence
  Synthetic Polynucleotide
taatacgactcactatagggtcctgacagtccttccacgaagtctctgttaacagaggagaaacagaatgttcgtggaaaacctggcggcagcgcaaaagatg

SEQ ID NO: 9181 - DNA, 103 bp, Artificial Sequence
  Synthetic Polynucleotide
taatacgactcactatagggtcccatgtcattcaaagctgttaaggctgtaacagaggagaacagccatgacagctttgaacctggcggcagcgcaaaagatg

SEQ ID NO: 9182 - DNA, 103 bp, Artificial Sequence
  Synthetic Polynucleotide
taatacgactcactatagggacctttcccatgtcattcaaagctgttaagaacagaggagacttaacatgtttgaatgaaacctggcggcagcgcaaaagatg

SEQ ID NO: 9183 - DNA, 103 bp, Artificial Sequence
  Synthetic Polynucleotide
taatacgactcactatagggttcttacctttcccatgtcattcaaagctgaacagaggagacagcttatgatgacatggaacctggcggcagcgcaaaagatg

SEQ ID NO: 9184 - DNA, 103 bp, Artificial Sequence
  Synthetic Polynucleotide
taatacgactcactataggggtcttttcttacctttcccatgtcattcaaaacagaggagattgaatatgatgggaaagaacctggcggcagcgcaaaagatg

SEQ ID NO: 9185 - DNA, 103 bp, Artificial Sequence
  Synthetic Polynucleotide
taatacgactcactatagggggtatgtcttttcttacctttcccatgtcaaacagaggagatgacatatgaaaggtaagaacctggcggcagcgcaaaagatg

SEQ ID NO: 9186 - DNA, 103 bp, Artificial Sequence
  Synthetic Polynucleotide
taatacgactcactatagggattgcggtatgtcttttcttacctttcccaaacagaggagatgggaaatgtaagaaaagaacctggcggcagcgcaaaagatg

SEQ ID NO: 9187 - DNA, 103 bp, Artificial Sequence
  Synthetic Polynucleotide
taatacgactcactatagggttcccattgcggtatgtcttttcttaccttaacagaggagaaaggtaatgaaagacataaacctggcggcagcgcaaaagatg

SEQ ID NO: 9188 - DNA, 103 bp, Artificial Sequence
  Synthetic Polynucleotide
taatacgactcactataggggaaggttcccattgcggtatgtcttttcttaacagaggagaaagaaaatgcataccgcaaacctggcggcagcgcaaaagatg

SEQ ID NO: 9189 - DNA, 103 bp, Artificial Sequence
  Synthetic Polynucleotide
taatacgactcactatagggcttttgaaggttcccattgcggtatgtcttaacagaggagaaagacaatgcgcaatgggaacctggcggcagcgcaaaagatg

SEQ ID NO: 9190 - DNA, 103 bp, Artificial Sequence
  Synthetic Polynucleotide
taatacgactcactatagggccatccttttgaaggttcccattgcggtataacagaggagaataccgatgtgggaacctaacctggcggcagcgcaaaagatg

SEQ ID NO: 9191 - DNA, 103 bp, Artificial Sequence
  Synthetic Polynucleotide
taatacgactcactataggggtagctcctgacagtccttccacgaagtctaacagaggagaagacttatgggaaggactaacctggcggcagcgcaaaagatg

SEQ ID NO: 9192 - DNA, 103 bp, Artificial Sequence
  Synthetic Polynucleotide
taatacgactcactatagggtcattccatccttttgaaggttcccattgcaacagaggagagcaatgatgaccttcaaaaacctggcggcagcgcaaaagatg

SEQ ID NO: 9193 - DNA, 103 bp, Artificial Sequence
  Synthetic Polynucleotide
taatacgactcactataggggccaatcattccatccttttgaaggttcccaacagaggagagggaacatgcaaaaggataacctggcggcagcgcaaaagatg

SEQ ID NO: 9194 - DNA, 103 bp, Artificial Sequence
  Synthetic Polynucleotide
taatacgactcactatagggttgttgccaatcattccatccttttgaaggaacagaggagaccttcaatgggatggaataacctggcggcagcgcaaaagatg

SEQ ID NO: 9195 - DNA, 103 bp, Artificial Sequence
  Synthetic Polynucleotide
taatacgactcactatagggggcacttgttgccaatcattccatccttttaacagaggagaaaaaggatggaatgattgaacctggcggcagcgcaaaagatg

SEQ ID NO: 9196 - DNA, 103 bp, Artificial Sequence
  Synthetic Polynucleotide
taatacgactcactatagggagaaaggcacttgttgccaatcattccatcaacagaggagagatggaatgattggcaacaacctggcggcagcgcaaaagatg

SEQ ID NO: 9197 - DNA, 103 bp, Artificial Sequence
  Synthetic Polynucleotide
taatacgactcactatagggtgaacagaaaggcacttgttgccaatcattaacagaggagaaatgatatgcaacaagtgaacctggcggcagcgcaaaagatg

SEQ ID NO: 9198 - DNA, 103 bp, Artificial Sequence
  Synthetic Polynucleotide
taatacgactcactatagggtggtgtgaacagaaaggcacttgttgccaaaacagaggagattggcaatgagtgcctttaacctggcggcagcgcaaaagatg

SEQ ID NO: 9199 - DNA, 103 bp, Artificial Sequence
  Synthetic Polynucleotide
taatacgactcactatagggggaaatggtgtgaacagaaaggcacttgttaacagaggagaaacaagatgctttctgttaacctggcggcagcgcaaaagatg

SEQ ID NO: 9200 - DNA, 103 bp, Artificial Sequence
  Synthetic Polynucleotide
taatacgactcactatagggctggtggaaatggtgtgaacagaaaggcacaacagaggagagtgcctatgtgttcacacaacctggcggcagcgcaaaagatg

SEQ ID NO: 9201 - DNA, 103 bp, Artificial Sequence
  Synthetic Polynucleotide
taatacgactcactatagggatcagctggtggaaatggtgtgaacagaaaaacagaggagatttctgatgacaccatttaacctggcggcagcgcaaaagatg

SEQ ID NO: 9202 - DNA, 103 bp, Artificial Sequence
  Synthetic Polynucleotide
taatacgactcactatagggcccacgtagctcctgacagtccttccacgaaacagaggagatcgtggatggactgtcagaacctggcggcagcgcaaaagatg

SEQ ID NO: 9203 - DNA, 103 bp, Artificial Sequence
  Synthetic Polynucleotide
taatacgactcactatagggtcataatcagctggtggaaatggtgtgaacaacagaggagagttcacatgatttccaccaacctggcggcagcgcaaaagatg

SEQ ID NO: 9204 - DNA, 103 bp, Artificial Sequence
  Synthetic Polynucleotide
taatacgactcactatagggatccttcataatcagctggtggaaatggtgaacagaggagacaccatatgcaccagctgaacctggcggcagcgcaaaagatg

SEQ ID NO: 9205 - DNA, 103 bp, Artificial Sequence
  Synthetic Polynucleotide
taatacgactcactatagggctcccatccttcataatcagctggtggaaaaacagaggagatttccaatggctgattataacctggcggcagcgcaaaagatg

SEQ ID NO: 9206 - DNA, 103 bp, Artificial Sequence
  Synthetic Polynucleotide
taatacgactcactatagggtctccctcccatccttcataatcagctggtaacagaggagaaccagcatgttatgaaggaacctggcggcagcgcaaaagatg

SEQ ID NO: 9207 - DNA, 103 bp, Artificial Sequence
  Synthetic Polynucleotide
taatacgactcactatagggcactatctccctcccatccttcataatcagaacagaggagactgattatgaaggatgggaacctggcggcagcgcaaaagatg

SEQ ID NO: 9208 - DNA, 103 bp, Artificial Sequence
  Synthetic Polynucleotide
taatacgactcactatagggggcaccactatctccctcccatccttcataaacagaggagatatgaaatgtgggagggaaacctggcggcagcgcaaaagatg

SEQ ID NO: 9209 - DNA, 103 bp, Artificial Sequence
  Synthetic Polynucleotide
taatacgactcactatagggggcatggcaccactatctccctcccatcctaacagaggagaaggatgatggggagatagaacctggcggcagcgcaaaagatg

SEQ ID NO: 9210 - DNA, 103 bp, Artificial Sequence
  Synthetic Polynucleotide
taatacgactcactataggggttgcggcatggcaccactatctccctcccaacagaggagagggaggatgatagtggtgaacctggcggcagcgcaaaagatg

SEQ ID NO: 9211 - DNA, 103 bp, Artificial Sequence
  Synthetic Polynucleotide
taatacgactcactatagggtcttggttgcggcatggcaccactatctccaacagaggagaggagatatgggtgccatgaacctggcggcagcgcaaaagatg

SEQ ID NO: 9212 - DNA, 103 bp, Artificial Sequence
  Synthetic Polynucleotide
taatacgactcactataggggttcatcttggttgcggcatggcaccactaaacagaggagatagtggatgcatgccgcaaacctggcggcagcgcaaaagatg

SEQ ID NO: 9213 - DNA, 103 bp, Artificial Sequence
  Synthetic Polynucleotide
taatacgactcactatagggatccacccacgtagctcctgacagtccttcaacagaggagagaaggaatgtcaggagctaacctggcggcagcgcaaaagatg

SEQ ID NO: 9214 - DNA, 103 bp, Artificial Sequence
  Synthetic Polynucleotide
taatacgactcactatagggtacaagttcatcttggttgcggcatggcacaacagaggagagtgccaatgcgcaaccaaaacctggcggcagcgcaaaagatg

SEQ ID NO: 9215 - DNA, 103 bp, Artificial Sequence
  Synthetic Polynucleotide
taatacgactcactatagggctacctacaagttcatcttggttgcggcataacagaggagaatgccgatgccaagatgaaacctggcggcagcgcaaaagatg

SEQ ID NO: 9216 - DNA, 103 bp, Artificial Sequence
  Synthetic Polynucleotide
taatacgactcactatagggtggccctacctacaagttcatcttggttgcaacagaggagagcaaccatgatgaacttgaacctggcggcagcgcaaaagatg

SEQ ID NO: 9217 - DNA, 103 bp, Artificial Sequence
  Synthetic Polynucleotide
taatacgactcactatagggtactctggccctacctacaagttcatcttgaacagaggagacaagatatgcttgtaggtaacctggcggcagcgcaaaagatg

SEQ ID NO: 9218 - DNA, 103 bp, Artificial Sequence
  Synthetic Polynucleotide
taatacgactcactatagggtgtgatactctggccctacctacaagttcaaacagaggagatgaactatgaggtagggcaacctggcggcagcgcaaaagatg

SEQ ID NO: 9219 - DNA, 103 bp, Artificial Sequence
  Synthetic Polynucleotide
taatacgactcactatagggcgccttgtgatactctggccctacctacaaaacagaggagattgtagatggggccagagaacctggcggcagcgcaaaagatg

SEQ ID NO: 9220 - DNA, 103 bp, Artificial Sequence
  Synthetic Polynucleotide
taatacgactcactatagggtccggcgccttgtgatactctggccctaccaacagaggagaggtaggatgagagtatcaaacctggcggcagcgcaaaagatg

SEQ ID NO: 9221 - DNA, 103 bp, Artificial Sequence
  Synthetic Polynucleotide
taatacgactcactatagggctccatccggcgccttgtgatactctggccaacagaggagaggccagatgatcacaaggaacctggcggcagcgcaaaagatg

SEQ ID NO: 9222 - DNA, 103 bp, Artificial Sequence
  Synthetic Polynucleotide
taatacgactcactatagggtcaagctccatccggcgccttgtgatactcaacagaggagagagtatatgaaggcgccgaacctggcggcagcgcaaaagatg

SEQ ID NO: 9223 - DNA, 103 bp, Artificial Sequence
  Synthetic Polynucleotide
taatacgactcactatagggttctctcaagctccatccggcgccttgtgaaacagaggagatcacaaatggccggatggaacctggcggcagcgcaaaagatg

SEQ ID NO: 9224 - DNA, 103 bp, Artificial Sequence
  Synthetic Polynucleotide
taatacgactcactatagggaccacatccacccacgtagctcctgacagtaacagaggagaactgtcatgagctacgtgaacctggcggcagcgcaaaagatg

SEQ ID NO: 9225 - DNA, 103 bp, Artificial Sequence
  Synthetic Polynucleotide
taatacgactcactataggggcagtttctctcaagctccatccggcgcctaacagaggagaaggcgcatgatggagcttaacctggcggcagcgcaaaagatg

SEQ ID NO: 9226 - DNA, 103 bp, Artificial Sequence
  Synthetic Polynucleotide
taatacgactcactatagggggcatgcagtttctctcaagctccatccggaacagaggagaccggatatggcttgagagaacctggcggcagcgcaaaagatg

SEQ ID NO: 9227 - DNA, 103 bp, Artificial Sequence
  Synthetic Polynucleotide
taatacgactcactataggggcctaggcatgcagtttctctcaagctccaaacagaggagatggagcatgagagaaactaacctggcggcagcgcaaaagatg

SEQ ID NO: 9228 - DNA, 103 bp, Artificial Sequence
  Synthetic Polynucleotide
taatacgactcactataggggacttgcctaggcatgcagtttctctcaagaacagaggagacttgagatgaactgcatgaacctggcggcagcgcaaaagatg

SEQ ID NO: 9229 - DNA, 103 bp, Artificial Sequence
  Synthetic Polynucleotide
taatacgactcactatagggcatatgacttgcctaggcatgcagtttctcaacagaggagagagaaaatgcatgcctagaacctggcggcagcgcaaaagatg

SEQ ID NO: 9230 - DNA, 103 bp, Artificial Sequence
  Synthetic Polynucleotide
taatacgactcactatagggttgtgcatatgacttgcctaggcatgcagtaacagaggagaactgcaatgctaggcaagaacctggcggcagcgcaaaagatg

SEQ ID NO: 9231 - DNA, 103 bp, Artificial Sequence
  Synthetic Polynucleotide
taatacgactcactatagggcacatttgtgcatatgacttgcctaggcataacagaggagaatgcctatgcaagtcataaacctggcggcagcgcaaaagatg

SEQ ID NO: 9232 - DNA, 103 bp, Artificial Sequence
  Synthetic Polynucleotide
taatacgactcactataggggctgccacatttgtgcatatgacttgcctaaacagaggagataggcaatgcatatgcacaacctggcggcagcgcaaaagatg

SEQ ID NO: 9233 - DNA, 103 bp, Artificial Sequence
  Synthetic Polynucleotide
taatacgactcactatagggcatcagctgccacatttgtgcatatgacttaacagaggagaaagtcaatggcacaaatgaacctggcggcagcgcaaaagatg

SEQ ID NO: 9234 - DNA, 103 bp, Artificial Sequence
  Synthetic Polynucleotide
taatacgactcactatagggaagtacatcagctgccacatttgtgcatataacagaggagaatatgcatgaatgtggcaaacctggcggcagcgcaaaagatg

SEQ ID NO: 9235 - DNA, 103 bp, Artificial Sequence
  Synthetic Polynucleotide
taatacgactcactatagggccagtaccacatccacccacgtagctcctgaacagaggagacaggagatgcgtgggtggaacctggcggcagcgcaaaagatg

SEQ ID NO: 9236 - DNA, 103 bp, Artificial Sequence
  Synthetic Polynucleotide
taatacgactcactatagggtgtggaagtacatcagctgccacatttgtgaacagaggagacacaaaatgggcagctgaaacctggcggcagcgcaaaagatg

SEQ ID NO: 9237 - DNA, 103 bp, Artificial Sequence
  Synthetic Polynucleotide
taatacgactcactatagggtctcctgtggaagtacatcagctgccacataacagaggagaatgtggatgctgatgtacaacctggcggcagcgcaaaagatg

SEQ ID NO: 9238 - DNA, 103 bp, Artificial Sequence
  Synthetic Polynucleotide
taatacgactcactatagggaagtctctcctgtggaagtacatcagctgcaacagaggagagcagctatggtacttccaaacctggcggcagcgcaaaagatg

SEQ ID NO: 9239 - DNA, 103 bp, Artificial Sequence
  Synthetic Polynucleotide
taatacgactcactatagggatctcaagtctctcctgtggaagtacatcaaacagaggagatgatgtatgtccacaggaaacctggcggcagcgcaaaagatg

SEQ ID NO: 9240 - DNA, 103 bp, Artificial Sequence
  Synthetic Polynucleotide
taatacgactcactatagggcgctaatctcaagtctctcctgtggaagtaaacagaggagatacttcatgaggagagacaacctggcggcagcgcaaaagatg

SEQ ID NO: 9241 - DNA, 103 bp, Artificial Sequence
  Synthetic Polynucleotide
taatacgactcactatagggttagccgctaatctcaagtctctcctgtggaacagaggagaccacagatgagacttgagaacctggcggcagcgcaaaagatg

SEQ ID NO: 9242 - DNA, 103 bp, Artificial Sequence
  Synthetic Polynucleotide
taatacgactcactatagggtagcattagccgctaatctcaagtctctccaacagaggagaggagagatgtgagattagaacctggcggcagcgcaaaagatg

SEQ ID NO: 9243 - DNA, 103 bp, Artificial Sequence
  Synthetic Polynucleotide
taatacgactcactatagggacagatagcattagccgctaatctcaagtcaacagaggagagacttgatgttagcggctaacctggcggcagcgcaaaagatg

SEQ ID NO: 9244 - DNA, 103 bp, Artificial Sequence
  Synthetic Polynucleotide
taatacgactcactataggggctgaacagatagcattagccgctaatctcaacagaggagagagattatgggctaatgcaacctggcggcagcgcaaaagatg

SEQ ID NO: 9245 - DNA, 103 bp, Artificial Sequence
  Synthetic Polynucleotide
taatacgactcactataggggaacggctgaacagatagcattagccgctaaacagaggagatagcggatgatgctatctaacctggcggcagcgcaaaagatg

SEQ ID NO: 9246 - DNA, 103 bp, Artificial Sequence
  Synthetic Polynucleotide
taatacgactcactatagggatgctccagtaccacatccacccacgtagcaacagaggagagctacgatggtggatgtgaacctggcggcagcgcaaaagatg

SEQ ID NO: 9247 - DNA, 103 bp, Artificial Sequence
  Synthetic Polynucleotide
taatacgactcactatagggaactggaacggctgaacagatagcattagcaacagaggagagctaatatgatctgttcaaacctggcggcagcgcaaaagatg

SEQ ID NO: 9248 - DNA, 103 bp, Artificial Sequence
  Synthetic Polynucleotide
taatacgactcactatagggcaatcaactggaacggctgaacagatagcaaacagaggagatgctatatgttcagccgtaacctggcggcagcgcaaaagatg

SEQ ID NO: 9249 - DNA, 103 bp, Artificial Sequence
  Synthetic Polynucleotide
taatacgactcactatagggggacccaatcaactggaacggctgaacagaaacagaggagatctgttatgccgttccagaacctggcggcagcgcaaaagatg

SEQ ID NO: 9250 - DNA, 103 bp, Artificial Sequence
  Synthetic Polynucleotide
taatacgactcactatagggggttgggacccaatcaactggaacggctgaaacagaggagatcagccatgccagttgataacctggcggcagcgcaaaagatg

SEQ ID NO: 9251 - DNA, 103 bp, Artificial Sequence
  Synthetic Polynucleotide
taatacgactcactatagggcggctggttgggacccaatcaactggaacgaacagaggagacgttccatgtgattgggtaacctggcggcagcgcaaaagatg

SEQ ID NO: 9252 - DNA, 103 bp, Artificial Sequence
  Synthetic Polynucleotide
taatacgactcactatagggtggtgcggctggttgggacccaatcaactgaacagaggagacagttgatggggtcccaaaacctggcggcagcgcaaaagatg

SEQ ID NO: 9253 - DNA, 103 bp, Artificial Sequence
  Synthetic Polynucleotide
taatacgactcactatagggccaggtggtgcggctggttgggacccaatcaacagaggagagattggatgccaaccagcaacctggcggcagcgcaaaagatg

SEQ ID NO: 9254 - DNA, 103 bp, Artificial Sequence
  Synthetic Polynucleotide
taatacgactcactatagggatcgaccaggtggtgcggctggttgggaccaacagaggagaggtcccatgcagccgcacaacctggcggcagcgcaaaagatg

SEQ ID NO: 9255 - DNA, 103 bp, Artificial Sequence
  Synthetic Polynucleotide
taatacgactcactatagggcatggatcgaccaggtggtgcggctggttgaacagaggagacaaccaatggcaccacctaacctggcggcagcgcaaaagatg

SEQ ID NO: 9256 - DNA, 103 bp, Artificial Sequence
  Synthetic Polynucleotide
taatacgactcactataggggtgggcatggatcgaccaggtggtgcggctaacagaggagaagccgcatgacctggtcgaacctggcggcagcgcaaaagatg

SEQ ID NO: 9257 - DNA, 103 bp, Artificial Sequence
  Synthetic Polynucleotide
taatacgactcactatagggcttccatgctccagtaccacatccacccacaacagaggagagtgggtatgtgtggtactaacctggcggcagcgcaaaagatg

SEQ ID NO: 9258 - DNA, 103 bp, Artificial Sequence
  Synthetic Polynucleotide
taatacgactcactatagggtgatggtgggcatggatcgaccaggtggtgaacagaggagacaccacatggtcgatccaaacctggcggcagcgcaaaagatg

SEQ ID NO: 9259 - DNA, 103 bp, Artificial Sequence
  Synthetic Polynucleotide
taatacgactcactatagggtccattgatggtgggcatggatcgaccaggaacagaggagacctggtatgtccatgcccaacctggcggcagcgcaaaagatg

SEQ ID NO: 9260 - DNA, 103 bp, Artificial Sequence
  Synthetic Polynucleotide
taatacgactcactatagggtgtcatccattgatggtgggcatggatcgaaacagaggagatcgatcatggcccaccataacctggcggcagcgcaaaagatg

SEQ ID NO: 9261 - DNA, 103 bp, Artificial Sequence
  Synthetic Polynucleotide
taatacgactcactatagggtctgttgtcatccattgatggtgggcatggaacagaggagaccatgcatgccatcaatgaacctggcggcagcgcaaaagatg

SEQ ID NO: 9262 - DNA, 103 bp, Artificial Sequence
  Synthetic Polynucleotide
taatacgactcactatagggtgtcttctgttgtcatccattgatggtgggaacagaggagacccaccatgaatggatgaaacctggcggcagcgcaaaagatg

SEQ ID NO: 9263 - DNA, 103 bp, Artificial Sequence
  Synthetic Polynucleotide
taatacgactcactatagggcaacatgtcttctgttgtcatccattgatgaacagaggagacatcaaatgatgacaacaaacctggcggcagcgcaaaagatg

SEQ ID NO: 9264 - DNA, 103 bp, Artificial Sequence
  Synthetic Polynucleotide
taatacgactcactatagggactgacaacatgtcttctgttgtcatccataacagaggagaatggatatgaacagaagaaacctggcggcagcgcaaaagatg

SEQ ID NO: 9265 - DNA, 103 bp, Artificial Sequence
  Synthetic Polynucleotide
taatacgactcactatagggtccacactgacaacatgtcttctgttgtcaaacagaggagatgacaaatgaagacatgtaacctggcggcagcgcaaaagatg

SEQ ID NO: 9266 - DNA, 103 bp, Artificial Sequence
  Synthetic Polynucleotide
taatacgactcactatagggcctattccacactgacaacatgtcttctgtaacagaggagaacagaaatgatgttgtcaaacctggcggcagcgcaaaagatg

SEQ ID NO: 9267 - DNA, 103 bp, Artificial Sequence
  Synthetic Polynucleotide
taatacgactcactatagggcaaaccctattccacactgacaacatgtctaacagaggagaagacatatggtcagtgtgaacctggcggcagcgcaaaagatg

SEQ ID NO: 9268 - DNA, 103 bp, Artificial Sequence
  Synthetic Polynucleotide
taatacgactcactatagggaaactgttcttgtcggtccacgtagactaaaacagaggagattagtcatggtggaccgaaacctggcggcagcgcaaaagatg

SEQ ID NO: 9269 - DNA, 103 bp, Artificial Sequence
  Synthetic Polynucleotide
taatacgactcactataggggtcgacccgtctttttccgttggttgttcaaacagaggagatgaacaatgaacggaaaaaacctggcggcagcgcaaaagatg

SEQ ID NO: 9270 - DNA, 103 bp, Artificial Sequence
  Synthetic Polynucleotide
taatacgactcactatagggcgcaacttccatgctccagtaccacatccaaacagaggagatggatgatgtactggagcaacctggcggcagcgcaaaagatg

SEQ ID NO: 9271 - DNA, 103 bp, Artificial Sequence
  Synthetic Polynucleotide
taatacgactcactatagggctatccaaaccctattccacactgacaacaaacagaggagatgttgtatgtgtggaataaacctggcggcagcgcaaaagatg

SEQ ID NO: 9272 - DNA, 103 bp, Artificial Sequence
  Synthetic Polynucleotide
taatacgactcactatagggttcctctatccaaaccctattccacactgaaacagaggagatcagtgatgaatagggttaacctggcggcagcgcaaaagatg

SEQ ID NO: 9273 - DNA, 103 bp, Artificial Sequence
  Synthetic Polynucleotide
taatacgactcactataggggggttttcctctatccaaaccctattccacaacagaggagagtggaaatgggtttggataacctggcggcagcgcaaaagatg

SEQ ID NO: 9274 - DNA, 103 bp, Artificial Sequence
  Synthetic Polynucleotide
taatacgactcactatagggtccatgggttttcctctatccaaaccctataacagaggagaatagggatgggatagaggaacctggcggcagcgcaaaagatg

SEQ ID NO: 9275 - DNA, 103 bp, Artificial Sequence
  Synthetic Polynucleotide
taatacgactcactatagggctccatccatgggttttcctctatccaaacaacagaggagagtttggatggaggaaaacaacctggcggcagcgcaaaagatg

SEQ ID NO: 9276 - DNA, 103 bp, Artificial Sequence
  Synthetic Polynucleotide
taatacgactcactatagggttgtcctccatccatgggttttcctctatcaacagaggagagatagaatgaaacccatgaacctggcggcagcgcaaaagatg

SEQ ID NO: 9277 - DNA, 103 bp, Artificial Sequence
  Synthetic Polynucleotide
taatacgactcactataggggagtcttgtcctccatccatgggttttcctaacagaggagaaggaaaatgcatggatggaacctggcggcagcgcaaaagatg

SEQ ID NO: 9278 - DNA, 103 bp, Artificial Sequence
  Synthetic Polynucleotide
taatacgactcactatagggcacatgagtcttgtcctccatccatgggttaacagaggagaaacccaatgatggaggacaacctggcggcagcgcaaaagatg

SEQ ID NO: 9279 - DNA, 103 bp, Artificial Sequence
  Synthetic Polynucleotide
taatacgactcactatagggctggacacatgagtcttgtcctccatccataacagaggagaatggatatgggacaagacaacctggcggcagcgcaaaagatg

SEQ ID NO: 9280 - DNA, 103 bp, Artificial Sequence
  Synthetic Polynucleotide
taatacgactcactatagggcccaactggacacatgagtcttgtcctccaaacagaggagatggaggatgagactcatgaacctggcggcagcgcaaaagatg

SEQ ID NO: 9281 - DNA, 103 bp, Artificial Sequence
  Synthetic Polynucleotide
taatacgactcactatagggagtgacgcaacttccatgctccagtaccacaacagaggagagtggtaatggagcatggaaacctggcggcagcgcaaaagatg

SEQ ID NO: 9282 - DNA, 103 bp, Artificial Sequence
  Synthetic Polynucleotide
taatacgactcactataggggtcttcccaactggacacatgagtcttgtcaacagaggagagacaagatgcatgtgtccaacctggcggcagcgcaaaagatg

SEQ ID NO: 9283 - DNA, 103 bp, Artificial Sequence
  Synthetic Polynucleotide
taatacgactcactatagggggaacgtcttcccaactggacacatgagtcaacagaggagagactcaatggtccagttgaacctggcggcagcgcaaaagatg

SEQ ID NO: 9284 - DNA, 103 bp, Artificial Sequence
  Synthetic Polynucleotide
taatacgactcactatagggggtatggaacgtcttcccaactggacacataacagaggagaatgtgtatggttgggaagaacctggcggcagcgcaaaagatg

SEQ ID NO: 9285 - DNA, 103 bp, Artificial Sequence
  Synthetic Polynucleotide
taatacgactcactatagggtcctaggtatggaacgtcttcccaactggaaacagaggagatccagtatggaagacgttaacctggcggcagcgcaaaagatg

SEQ ID NO: 9286 - DNA, 103 bp, Artificial Sequence
  Synthetic Polynucleotide
taatacgactcactatagggctttttcctaggtatggaacgtcttcccaaaacagaggagattgggaatgcgttccataaacctggcggcagcgcaaaagatg

SEQ ID NO: 9287 - DNA, 103 bp, Artificial Sequence
  Synthetic Polynucleotide
taatacgactcactatagggcttccctttttcctaggtatggaacgtcttaacagaggagaaagacgatgcatacctagaacctggcggcagcgcaaaagatg

SEQ ID NO: 9288 - DNA, 103 bp, Artificial Sequence
  Synthetic Polynucleotide
taatacgactcactatagggttgatcttccctttttcctaggtatggaacaacagaggagagttccaatgctaggaaaaaacctggcggcagcgcaaaagatg

SEQ ID NO: 9289 - DNA, 103 bp, Artificial Sequence
  Synthetic Polynucleotide
taatacgactcactatagggcaccattgatcttccctttttcctaggtataacagaggagaatacctatgaaaaagggaaacctggcggcagcgcaaaagatg

SEQ ID NO: 9290 - DNA, 103 bp, Artificial Sequence
  Synthetic Polynucleotide
taatacgactcactatagggaaccacaccattgatcttccctttttcctaaacagaggagataggaaatggggaagatcaacctggcggcagcgcaaaagatg

SEQ ID NO: 9291 - DNA, 103 bp, Artificial Sequence
  Synthetic Polynucleotide
taatacgactcactatagggtagggaaccacaccattgatcttcccttttaacagaggagaaaaaggatggatcaatggaacctggcggcagcgcaaaagatg

SEQ ID NO: 9292 - DNA, 103 bp, Artificial Sequence
  Synthetic Polynucleotide
taatacgactcactatagggatggtagtgacgcaacttccatgctccagtaacagaggagaactggaatgtggaagttgaacctggcggcagcgcaaaagatg

SEQ ID NO: 9293 - DNA, 103 bp, Artificial Sequence
  Synthetic Polynucleotide
taatacgactcactatagggcctattagggaaccacaccattgatcttccaacagaggagaggaagaatgatggtgtggaacctggcggcagcgcaaaagatg

SEQ ID NO: 9294 - DNA, 103 bp, Artificial Sequence
  Synthetic Polynucleotide
taatacgactcactatagggttaagcctattagggaaccacaccattgataacagaggagaatcaatatggtggttcccaacctggcggcagcgcaaaagatg

SEQ ID NO: 9295 - DNA, 103 bp, Artificial Sequence
  Synthetic Polynucleotide
taatacgactcactatagggtgctgttaagcctattagggaaccacaccaaacagaggagatggtgtatgtccctaataaacctggcggcagcgcaaaagatg

SEQ ID NO: 9296 - DNA, 103 bp, Artificial Sequence
  Synthetic Polynucleotide
taatacgactcactataggggctcgtgctgttaagcctattagggaaccaaacagaggagatggttcatgaataggcttaacctggcggcagcgcaaaagatg

SEQ ID NO: 9297 - DNA, 103 bp, Artificial Sequence
  Synthetic Polynucleotide
taatacgactcactatagggaggtggctcgtgctgttaagcctattagggaacagaggagaccctaaatggcttaacagaacctggcggcagcgcaaaagatg

SEQ ID NO: 9298 - DNA, 103 bp, Artificial Sequence
  Synthetic Polynucleotide
taatacgactcactatagggggcccaggtggctcgtgctgttaagcctataacagaggagaataggcatgacagcacgaaacctggcggcagcgcaaaagatg

SEQ ID NO: 9299 - DNA, 103 bp, Artificial Sequence
  Synthetic Polynucleotide
taatacgactcactatagggttggtggcccaggtggctcgtgctgttaagaacagaggagacttaacatgacgagccacaacctggcggcagcgcaaaagatg

SEQ ID NO: 9300 - DNA, 103 bp, Artificial Sequence
  Synthetic Polynucleotide
taatacgactcactataggggtatgttggtggcccaggtggctcgtgctgaacagaggagacagcacatgccacctgggaacctggcggcagcgcaaaagatg

SEQ ID NO: 9301 - DNA, 103 bp, Artificial Sequence
  Synthetic Polynucleotide
taatacgactcactatagggcacttgtatgttggtggcccaggtggctcgaacagaggagacgagccatgtgggccaccaacctggcggcagcgcaaaagatg

SEQ ID NO: 9302 - DNA, 103 bp, Artificial Sequence
  Synthetic Polynucleotide
taatacgactcactatagggatggccacttgtatgttggtggcccaggtgaacagaggagacacctgatgcaccaacataacctggcggcagcgcaaaagatg

SEQ ID NO: 9303 - DNA, 103 bp, Artificial Sequence
  Synthetic Polynucleotide
taatacgactcactatagggttgccatggtagtgacgcaacttccatgctaacagaggagaagcatgatggttgcgtcaaacctggcggcagcgcaaaagatg

SEQ ID NO: 9304 - DNA, 103 bp, Artificial Sequence
  Synthetic Polynucleotide
taatacgactcactatagggggtttatggccacttgtatgttggtggcccaacagaggagagggccaatgacatacaagaacctggcggcagcgcaaaagatg

SEQ ID NO: 9305 - DNA, 103 bp, Artificial Sequence
  Synthetic Polynucleotide
taatacgactcactatagggcacttggtttatggccacttgtatgttggtaacagaggagaaccaacatgcaagtggccaacctggcggcagcgcaaaagatg

SEQ ID NO: 9306 - DNA, 103 bp, Artificial Sequence
  Synthetic Polynucleotide
taatacgactcactatagggcttctcacttggtttatggccacttgtatgaacagaggagacatacaatgggccataaaaacctggcggcagcgcaaaagatg

SEQ ID NO: 9307 - DNA, 103 bp, Artificial Sequence
  Synthetic Polynucleotide
taatacgactcactatagggtgagccttctcacttggtttatggccacttaacagaggagaaagtggatgtaaaccaagaacctggcggcagcgcaaaagatg

SEQ ID NO: 9308 - DNA, 103 bp, Artificial Sequence
  Synthetic Polynucleotide
taatacgactcactatagggcccaatgagccttctcacttggtttatggcaacagaggagagccataatgcaagtgagaaacctggcggcagcgcaaaagatg

SEQ ID NO: 9309 - DNA, 103 bp, Artificial Sequence
  Synthetic Polynucleotide
taatacgactcactatagggtcattcccaatgagccttctcacttggtttaacagaggagaaaaccaatggagaaggctaacctggcggcagcgcaaaagatg

SEQ ID NO: 9310 - DNA, 103 bp, Artificial Sequence
  Synthetic Polynucleotide
taatacgactcactatagggaattctcattcccaatgagccttctcacttaacagaggagaaagtgaatgggctcattgaacctggcggcagcgcaaaagatg

SEQ ID NO: 9311 - DNA, 103 bp, Artificial Sequence
  Synthetic Polynucleotide
taatacgactcactatagggtagataattctcattcccaatgagccttctaacagaggagaagaaggatgattgggaataacctggcggcagcgcaaaagatg

SEQ ID NO: 9312 - DNA, 103 bp, Artificial Sequence
  Synthetic Polynucleotide
taatacgactcactatagggaagtctagataattctcattcccaatgagcaacagaggagagctcatatggaatgagaaaacctggcggcagcgcaaaagatg

SEQ ID NO: 9313 - DNA, 103 bp, Artificial Sequence
  Synthetic Polynucleotide
taatacgactcactatagggtcatgaagtctagataattctcattcccaaaacagaggagattgggaatgagaattatcaacctggcggcagcgcaaaagatg

SEQ ID NO: 9314 - DNA, 103 bp, Artificial Sequence
  Synthetic Polynucleotide
taatacgactcactataggggtcttttgccatggtagtgacgcaacttccaacagaggagaggaagtatggtcactaccaacctggcggcagcgcaaaagatg

SEQ ID NO: 9315 - DNA, 103 bp, Artificial Sequence
  Synthetic Polynucleotide
taatacgactcactatagggtgatgtcatgaagtctagataattctcattaacagaggagaaatgagatgtatctagacaacctggcggcagcgcaaaagatg

SEQ ID NO: 9316 - DNA, 103 bp, Artificial Sequence
  Synthetic Polynucleotide
taatacgactcactatagggttcattgatgtcatgaagtctagataattcaacagaggagagaattaatgagacttcataacctggcggcagcgcaaaagatg

SEQ ID NO: 9317 - DNA, 103 bp, Artificial Sequence
  Synthetic Polynucleotide
taatacgactcactatagggatctcttcattgatgtcatgaagtctagataacagaggagaatctagatgtcatgacataacctggcggcagcgcaaaagatg

SEQ ID NO: 9318 - DNA, 103 bp, Artificial Sequence
  Synthetic Polynucleotide
taatacgactcactatagggtttgaatctcttcattgatgtcatgaagtcaacagaggagagacttcatgacatcaatgaacctggcggcagcgcaaaagatg

SEQ ID NO: 9319 - DNA, 103 bp, Artificial Sequence
  Synthetic Polynucleotide
taatacgactcactatagggtcgtttttgaatctcttcattgatgtcatgaacagaggagacatgacatgaatgaagagaacctggcggcagcgcaaaagatg

SEQ ID NO: 9320 - DNA, 103 bp, Artificial Sequence
  Synthetic Polynucleotide
taatacgactcactatagggcactctcgtttttgaatctcttcattgatgaacagaggagacatcaaatgagagattcaaacctggcggcagcgcaaaagatg

SEQ ID NO: 9321 - DNA, 103 bp, Artificial Sequence
  Synthetic Polynucleotide
taatacgactcactataggggggatcactctcgtttttgaatctcttcataacagaggagaatgaagatgttcaaaaacaacctggcggcagcgcaaaagatg

SEQ ID NO: 9322 - DNA, 103 bp, Artificial Sequence
  Synthetic Polynucleotide
taatacgactcactatagggccttcgggatcactctcgtttttgaatctcaacagaggagagagattatgaaacgagagaacctggcggcagcgcaaaagatg

SEQ ID NO: 9323 - DNA, 103 bp, Artificial Sequence
  Synthetic Polynucleotide
taatacgactcactataggggtgccccttcgggatcactctcgtttttgaaacagaggagatcaaaaatgagagtgatcaacctggcggcagcgcaaaagatg

SEQ ID NO: 9324 - DNA, 103 bp, Artificial Sequence
  Synthetic Polynucleotide
taatacgactcactatagggccagagtgccccttcgggatcactctcgttaacagaggagaaacgagatggatcccgaaaacctggcggcagcgcaaaagatg

SEQ ID NO: 9325 - DNA, 103 bp, Artificial Sequence
  Synthetic Polynucleotide
taatacgactcactatagggggtttgtcttttgccatggtagtgacgcaaaacagaggagattgcgtatgtaccatggcaacctggcggcagcgcaaaagatg

SEQ ID NO: 9326 - DNA, 103 bp, Artificial Sequence
  Synthetic Polynucleotide
taatacgactcactataggggcttaccagagtgccccttcgggatcactcaacagaggagagagtgaatgcgaaggggcaacctggcggcagcgcaaaagatg

SEQ ID NO: 9327 - DNA, 103 bp, Artificial Sequence
  Synthetic Polynucleotide
taatacgactcactatagggagttggcttaccagagtgccccttcgggataacagaggagaatcccgatggggcactctaacctggcggcagcgcaaaagatg

SEQ ID NO: 9328 - DNA, 103 bp, Artificial Sequence
  Synthetic Polynucleotide
taatacgactcactataggggaatgagttggcttaccagagtgccccttcaacagaggagagaagggatgctctggtaaaacctggcggcagcgcaaaagatg

SEQ ID NO: 9329 - DNA, 103 bp, Artificial Sequence
  Synthetic Polynucleotide
taatacgactcactatagggtttgtgaatgagttggcttaccagagtgccaacagaggagaggcactatggtaagccaaaacctggcggcagcgcaaaagatg

SEQ ID NO: 9330 - DNA, 103 bp, Artificial Sequence
  Synthetic Polynucleotide
taatacgactcactatagggtttattttgtgaatgagttggcttaccagaaacagaggagatctggtatgccaactcataacctggcggcagcgcaaaagatg

SEQ ID NO: 9331 - DNA, 103 bp, Artificial Sequence
  Synthetic Polynucleotide
taatacgactcactatagggtttcctttattttgtgaatgagttggcttaaacagaggagataagccatgtcattcacaaacctggcggcagcgcaaaagatg

SEQ ID NO: 9332 - DNA, 103 bp, Artificial Sequence
  Synthetic Polynucleotide
taatacgactcactatagggtttattttcctttattttgtgaatgagttgaacagaggagacaactcatgcacaaaataaacctggcggcagcgcaaaagatg

SEQ ID NO: 9333 - DNA, 103 bp, Artificial Sequence
  Synthetic Polynucleotide
taatacgactcactataggggattttttattttcctttattttgtgaatgaacagaggagacattcaatgaataaaggaaacctggcggcagcgcaaaagatg

SEQ ID NO: 9334 - DNA, 103 bp, Artificial Sequence
  Synthetic Polynucleotide
taatacgactcactatagggtgtttgattttttattttcctttattttgtaacagaggagaacaaaaatgaggaaaataaacctggcggcagcgcaaaagatg

SEQ ID NO: 9335 - DNA, 103 bp, Artificial Sequence
  Synthetic Polynucleotide
taatacgactcactatagggtgccttgtttgattttttattttcctttataacagaggagaataaagatgaataaaaaaaacctggcggcagcgcaaaagatg

SEQ ID NO: 9336 - DNA, 103 bp, Artificial Sequence
  Synthetic Polynucleotide
taatacgactcactataggggtgttggtttgtcttttgccatggtagtgaaacagaggagatcactaatgtggcaaaagaacctggcggcagcgcaaaagatg

SEQ ID NO: 9337 - DNA, 103 bp, Artificial Sequence
  Synthetic Polynucleotide
taatacgactcactatagggcttcttgccttgtttgattttttattttccaacagaggagaggaaaaatgaaaatcaaaaacctggcggcagcgcaaaagatg

SEQ ID NO: 9338 - DNA, 103 bp, Artificial Sequence
  Synthetic Polynucleotide
taatacgactcactatagggcctgacttcttgccttgtttgattttttataacagaggagaataaaaatgcaaacaaggaacctggcggcagcgcaaaagatg

SEQ ID NO: 9339 - DNA, 103 bp, Artificial Sequence
  Synthetic Polynucleotide
taatacgactcactatagggtccggcctgacttcttgccttgtttgatttaacagaggagaaaatcaatgaaggcaagaaacctggcggcagcgcaaaagatg

SEQ ID NO: 9340 - DNA, 103 bp, Artificial Sequence
  Synthetic Polynucleotide
taatacgactcactatagggcttaatccggcctgacttcttgccttgtttaacagaggagaaaacaaatgaagaagtcaaacctggcggcagcgcaaaagatg

SEQ ID NO: 9341 - DNA, 103 bp, Artificial Sequence
  Synthetic Polynucleotide
taatacgactcactatagggtatggcttaatccggcctgacttcttgcctaacagaggagaaggcaaatggtcaggccgaacctggcggcagcgcaaaagatg

SEQ ID NO: 9342 - DNA, 103 bp, Artificial Sequence
  Synthetic Polynucleotide
taatacgactcactatagggcgtgctatggcttaatccggcctgacttctaacagaggagaagaagtatggccggattaaacctggcggcagcgcaaaagatg

SEQ ID NO: 9343 - DNA, 103 bp, Artificial Sequence
  Synthetic Polynucleotide
taatacgactcactatagggcttaccgtgctatggcttaatccggcctgaaacagaggagatcaggcatgattaagccaaacctggcggcagcgcaaaagatg

SEQ ID NO: 9344 - DNA, 103 bp, Artificial Sequence
  Synthetic Polynucleotide
taatacgactcactatagggtagctcttaccgtgctatggcttaatccggaacagaggagaccggatatggccatagcaaacctggcggcagcgcaaaagatg

SEQ ID NO: 9345 - DNA, 103 bp, Artificial Sequence
  Synthetic Polynucleotide
taatacgactcactatagggcagcatagctcttaccgtgctatggcttaaaacagaggagattaagcatgagcacggtaaacctggcggcagcgcaaaagatg

SEQ ID NO: 9346 - DNA, 103 bp, Artificial Sequence
  Synthetic Polynucleotide
taatacgactcactatagggacaggcagcatagctcttaccgtgctatggaacagaggagaccatagatgggtaagagcaacctggcggcagcgcaaaagatg

SEQ ID NO: 9347 - DNA, 103 bp, Artificial Sequence
  Synthetic Polynucleotide
taatacgactcactataggggtccagtgttggtttgtcttttgccatggtaacagaggagaaccatgatgaaagacaaaaacctggcggcagcgcaaaagatg

SEQ ID NO: 9348 - DNA, 103 bp, Artificial Sequence
  Synthetic Polynucleotide
taatacgactcactatagggggctcacaggcagcatagctcttaccgtgcaacagaggagagcacggatggagctatgcaacctggcggcagcgcaaaagatg

SEQ ID NO: 9349 - DNA, 103 bp, Artificial Sequence
  Synthetic Polynucleotide
taatacgactcactataggggacggggctcacaggcagcatagctcttacaacagaggagagtaagaatgatgctgcctaacctggcggcagcgcaaaagatg

SEQ ID NO: 9350 - DNA, 103 bp, Artificial Sequence
  Synthetic Polynucleotide
taatacgactcactatagggccttggacggggctcacaggcagcatagctaacagaggagaagctatatggcctgtgagaacctggcggcagcgcaaaagatg

SEQ ID NO: 9351 - DNA, 103 bp, Artificial Sequence
  Synthetic Polynucleotide
taatacgactcactatagggtacgtccttggacggggctcacaggcagcaaacagaggagatgctgcatgtgagccccgaacctggcggcagcgcaaaagatg

SEQ ID NO: 9352 - DNA, 103 bp, Artificial Sequence
  Synthetic Polynucleotide
taatacgactcactatagggcattttacgtccttggacggggctcacaggaacagaggagacctgtgatgcccgtccaaaacctggcggcagcgcaaaagatg

SEQ ID NO: 9353 - DNA, 103 bp, Artificial Sequence
  Synthetic Polynucleotide
taatacgactcactataggggacttcattttacgtccttggacggggctcaacagaggagagagcccatgccaaggacgaacctggcggcagcgcaaaagatg

SEQ ID NO: 9354 - DNA, 103 bp, Artificial Sequence
  Synthetic Polynucleotide
taatacgactcactatagggggcctgacttcattttacgtccttggacggaacagaggagaccgtccatggacgtaaaaaacctggcggcagcgcaaaagatg

SEQ ID NO: 9355 - DNA, 103 bp, Artificial Sequence
  Synthetic Polynucleotide
taatacgactcactatagggctttcggcctgacttcattttacgtccttgaacagaggagacaaggaatgaaaatgaagaacctggcggcagcgcaaaagatg

SEQ ID NO: 9356 - DNA, 103 bp, Artificial Sequence
  Synthetic Polynucleotide
taatacgactcactatagggcgtggctttcggcctgacttcattttacgtaacagaggagaacgtaaatggaagtcaggaacctggcggcagcgcaaaagatg

SEQ ID NO: 9357 - DNA, 103 bp, Artificial Sequence
  Synthetic Polynucleotide
taatacgactcactatagggcgaaccgtggctttcggcctgacttcatttaacagaggagaaaatgaatgcaggccgaaaacctggcggcagcgcaaaagatg

SEQ ID NO: 9358 - DNA, 103 bp, Artificial Sequence
  Synthetic Polynucleotide
taatacgactcactatagggtcaatgtccagtgttggtttgtcttttgccaacagaggagaggcaaaatgcaaaccaacaacctggcggcagcgcaaaagatg

SEQ ID NO: 9359 - DNA, 103 bp, Artificial Sequence
  Synthetic Polynucleotide
taatacgactcactatagggttgctcgaaccgtggctttcggcctgacttaacagaggagaaagtcaatgcgaaagccaaacctggcggcagcgcaaaagatg

SEQ ID NO: 9360 - DNA, 103 bp, Artificial Sequence
  Synthetic Polynucleotide
taatacgactcactatagggacggcttgctcgaaccgtggctttcggcctaacagaggagaaggccgatggccacggttaacctggcggcagcgcaaaagatg

SEQ ID NO: 9361 - DNA, 103 bp, Artificial Sequence
  Synthetic Polynucleotide
taatacgactcactataggggcagcacggcttgctcgaaccgtggctttcaacagaggagagaaagcatgggttcgagcaacctggcggcagcgcaaaagatg

SEQ ID NO: 9362 - DNA, 103 bp, Artificial Sequence
  Synthetic Polynucleotide
taatacgactcactatagggtacaggcagcacggcttgctcgaaccgtggaacagaggagaccacggatggagcaagccaacctggcggcagcgcaaaagatg

SEQ ID NO: 9363 - DNA, 103 bp, Artificial Sequence
  Synthetic Polynucleotide
taatacgactcactatagggggagctacaggcagcacggcttgctcgaacaacagaggagagttcgaatgagccgtgctaacctggcggcagcgcaaaagatg

SEQ ID NO: 9364 - DNA, 103 bp, Artificial Sequence
  Synthetic Polynucleotide
taatacgactcactatagggacgatggagctacaggcagcacggcttgctaacagaggagaagcaagatgtgctgcctgaacctggcggcagcgcaaaagatg

SEQ ID NO: 9365 - DNA, 103 bp, Artificial Sequence
  Synthetic Polynucleotide
taatacgactcactatagggtccccacgatggagctacaggcagcacggcaacagaggagagccgtgatgcctgtagctaacctggcggcagcgcaaaagatg

SEQ ID NO: 9366 - DNA, 103 bp, Artificial Sequence
  Synthetic Polynucleotide
taatacgactcactatagggttacatccccacgatggagctacaggcagcaacagaggagagctgccatgagctccatcaacctggcggcagcgcaaaagatg

SEQ ID NO: 9367 - DNA, 103 bp, Artificial Sequence
  Synthetic Polynucleotide
taatacgactcactatagggggtttttacatccccacgatggagctacagaacagaggagactgtagatgcatcgtgggaacctggcggcagcgcaaaagatg

SEQ ID NO: 9368 - DNA, 103 bp, Artificial Sequence
  Synthetic Polynucleotide
taatacgactcactatagggtcccgggtttttacatccccacgatggagcaacagaggagagctccaatgtggggatgtaacctggcggcagcgcaaaagatg

SEQ ID NO: 9369 - DNA, 103 bp, Artificial Sequence
  Synthetic Polynucleotide
taatacgactcactatagggagagttcaatgtccagtgttggtttgtcttaacagaggagaaagacaatgcaacactggaacctggcggcagcgcaaaagatg

SEQ ID NO: 9370 - DNA, 103 bp, Artificial Sequence
  Synthetic Polynucleotide
taatacgactcactatagggcagcctcccgggtttttacatccccacgataacagaggagaatcgtgatgatgtaaaaaaacctggcggcagcgcaaaagatg

SEQ ID NO: 9371 - DNA, 103 bp, Artificial Sequence
  Synthetic Polynucleotide
taatacgactcactataggggtttgcagcctcccgggtttttacatccccaacagaggagaggggatatgaaaacccggaacctggcggcagcgcaaaagatg

SEQ ID NO: 9372 - DNA, 103 bp, Artificial Sequence
  Synthetic Polynucleotide
taatacgactcactatagggccatggtttgcagcctcccgggtttttacaaacagaggagatgtaaaatgccgggaggcaacctggcggcagcgcaaaagatg

SEQ ID NO: 9373 - DNA, 103 bp, Artificial Sequence
  Synthetic Polynucleotide
taatacgactcactatagggagcttccatggtttgcagcctcccgggtttaacagaggagaaaacccatgaggctgcaaaacctggcggcagcgcaaaagatg

SEQ ID NO: 9374 - DNA, 103 bp, Artificial Sequence
  Synthetic Polynucleotide
taatacgactcactatagggcgtacagcttccatggtttgcagcctcccgaacagaggagacgggagatggcaaaccataacctggcggcagcgcaaaagatg

SEQ ID NO: 9375 - DNA, 103 bp, Artificial Sequence
  Synthetic Polynucleotide
taatacgactcactatagggccatgcgtacagcttccatggtttgcagccaacagaggagaggctgcatgccatggaagaacctggcggcagcgcaaaagatg

SEQ ID NO: 9376 - DNA, 103 bp, Artificial Sequence
  Synthetic Polynucleotide
taatacgactcactatagggctaccccatgcgtacagcttccatggtttgaacagaggagacaaaccatggaagctgtaaacctggcggcagcgcaaaagatg

SEQ ID NO: 9377 - DNA, 103 bp, Artificial Sequence
  Synthetic Polynucleotide
taatacgactcactataggggtctgctaccccatgcgtacagcttccatgaacagaggagacatggaatgtgtacgcataacctggcggcagcgcaaaagatg

SEQ ID NO: 9378 - DNA, 103 bp, Artificial Sequence
  Synthetic Polynucleotide
taatacgactcactatagggcactagtctgctaccccatgcgtacagcttaacagaggagaaagctgatggcatggggtaacctggcggcagcgcaaaagatg

SEQ ID NO: 9379 - DNA, 103 bp, Artificial Sequence
  Synthetic Polynucleotide
taatacgactcactatagggctaaccactagtctgctaccccatgcgtacaacagaggagagtacgcatggggtagcagaacctggcggcagcgcaaaagatg

SEQ ID NO: 9380 - DNA, 103 bp, Artificial Sequence
  Synthetic Polynucleotide
taatacgactcactatagggagacggtcgacccgtctttttccgttggttaacagaggagaaaccaaatgaaaaagacgaacctggcggcagcgcaaaagatg

SEQ ID NO: 9381 - DNA, 103 bp, Artificial Sequence
  Synthetic Polynucleotide
taatacgactcactatagggcttcaagagttcaatgtccagtgttggtttaacagaggagaaaaccaatgctggacattaacctggcggcagcgcaaaagatg

SEQ ID NO: 9382 - DNA, 103 bp, Artificial Sequence
  Synthetic Polynucleotide
taatacgactcactatagggctcctctaaccactagtctgctaccccatgaacagaggagacatgggatggcagactagaacctggcggcagcgcaaaagatg

SEQ ID NO: 9383 - DNA, 103 bp, Artificial Sequence
  Synthetic Polynucleotide
taatacgactcactatagggggggtctcctctaaccactagtctgctaccaacagaggagaggtagcatgctagtggttaacctggcggcagcgcaaaagatg

SEQ ID NO: 9384 - DNA, 103 bp, Artificial Sequence
  Synthetic Polynucleotide
taatacgactcactatagggtgggaggggtctcctctaaccactagtctgaacagaggagacagactatgggttagaggaacctggcggcagcgcaaaagatg

SEQ ID NO: 9385 - DNA, 103 bp, Artificial Sequence
  Synthetic Polynucleotide
taatacgactcactatagggtgtcttgggaggggtctcctctaaccactaaacagaggagatagtggatggaggagaccaacctggcggcagcgcaaaagatg

SEQ ID NO: 9386 - DNA, 103 bp, Artificial Sequence
  Synthetic Polynucleotide
taatacgactcactatagggcgttgtgtcttgggaggggtctcctctaacaacagaggagagttagaatggacccctccaacctggcggcagcgcaaaagatg

SEQ ID NO: 9387 - DNA, 103 bp, Artificial Sequence
  Synthetic Polynucleotide
taatacgactcactatagggtgctgcgttgtgtcttgggaggggtctcctaacagaggagaaggagaatgctcccaagaaacctggcggcagcgcaaaagatg

SEQ ID NO: 9388 - DNA, 103 bp, Artificial Sequence
  Synthetic Polynucleotide
taatacgactcactatagggcccgctgctgcgttgtgtcttgggaggggtaacagaggagaacccctatgaagacacaaaacctggcggcagcgcaaaagatg

SEQ ID NO: 9389 - DNA, 103 bp, Artificial Sequence
  Synthetic Polynucleotide
taatacgactcactatagggtgggccccgctgctgcgttgtgtcttgggaaacagaggagatcccaaatgacaacgcagaacctggcggcagcgcaaaagatg

SEQ ID NO: 9390 - DNA, 103 bp, Artificial Sequence
  Synthetic Polynucleotide
taatacgactcactatagggggtgttgggccccgctgctgcgttgtgtctaacagaggagaagacacatggcagcagcgaacctggcggcagcgcaaaagatg

SEQ ID NO: 9391 - DNA, 103 bp, Artificial Sequence
  Synthetic Polynucleotide
taatacgactcactatagggcccctggtgttgggccccgctgctgcgttgaacagaggagacaacgcatgagcggggccaacctggcggcagcgcaaaagatg

SEQ ID NO: 9392 - DNA, 103 bp, Artificial Sequence
  Synthetic Polynucleotide
taatacgactcactatagggtccgtcttcaagagttcaatgtccagtgttaacagaggagaaacactatgcattgaactaacctggcggcagcgcaaaagatg

SEQ ID NO: 9393 - DNA, 103 bp, Artificial Sequence
  Synthetic Polynucleotide
taatacgactcactatagggagcttcccctggtgttgggccccgctgctgaacagaggagacagcagatgggcccaacaaacctggcggcagcgcaaaagatg

SEQ ID NO: 9394 - DNA, 103 bp, Artificial Sequence
  Synthetic Polynucleotide
taatacgactcactatagggggtacagcttcccctggtgttgggccccgcaacagaggagagcggggatgaacaccaggaacctggcggcagcgcaaaagatg

SEQ ID NO: 9395 - DNA, 103 bp, Artificial Sequence
  Synthetic Polynucleotide
taatacgactcactatagggaccagggtacagcttcccctggtgttgggcaacagaggagagcccaaatgcaggggaagaacctggcggcagcgcaaaagatg

SEQ ID NO: 9396 - DNA, 103 bp, Artificial Sequence
  Synthetic Polynucleotide
taatacgactcactatagggttaccaccagggtacagcttcccctggtgtaacagaggagaacaccaatggaagctgtaaacctggcggcagcgcaaaagatg

SEQ ID NO: 9397 - DNA, 103 bp, Artificial Sequence
  Synthetic Polynucleotide
taatacgactcactatagggagtccttaccaccagggtacagcttcccctaacagaggagaaggggaatgtgtaccctgaacctggcggcagcgcaaaagatg

SEQ ID NO: 9398 - DNA, 103 bp, Artificial Sequence
  Synthetic Polynucleotide
taatacgactcactatagggcctctagtccttaccaccagggtacagcttaacagaggagaaagctgatgcctggtggtaacctggcggcagcgcaaaagatg

SEQ ID NO: 9399 - DNA, 103 bp, Artificial Sequence
  Synthetic Polynucleotide
taatacgactcactatagggtctaacctctagtccttaccaccagggtacaacagaggagagtacccatgtggtaaggaaacctggcggcagcgcaaaagatg

SEQ ID NO: 9400 - DNA, 103 bp, Artificial Sequence
  Synthetic Polynucleotide
taatacgactcactatagggtctcctctaacctctagtccttaccaccagaacagaggagactggtgatgaggactagaaacctggcggcagcgcaaaagatg

SEQ ID NO: 9401 - DNA, 103 bp, Artificial Sequence
  Synthetic Polynucleotide
taatacgactcactataggggggggtctcctctaacctctagtccttaccaacagaggagaggtaagatgtagaggttaaacctggcggcagcgcaaaagatg

SEQ ID NO: 9402 - DNA, 103 bp, Artificial Sequence
  Synthetic Polynucleotide
taatacgactcactataggggtgcggggggtctcctctaacctctagtccaacagaggagaggactaatggttagaggaaacctggcggcagcgcaaaagatg

SEQ ID NO: 9403 - DNA, 103 bp, Artificial Sequence
  Synthetic Polynucleotide
taatacgactcactatagggtgacctccgtcttcaagagttcaatgtccaaacagaggagatggacaatgaactcttgaaacctggcggcagcgcaaaagatg

SEQ ID NO: 9404 - DNA, 103 bp, Artificial Sequence
  Synthetic Polynucleotide
taatacgactcactatagggttgttgtgcggggggtctcctctaacctctaacagaggagaagaggtatgaggagacccaacctggcggcagcgcaaaagatg

SEQ ID NO: 9405 - DNA, 103 bp, Artificial Sequence
  Synthetic Polynucleotide
taatacgactcactataggggtttgttgttgtgcggggggtctcctctaaaacagaggagattagagatgaccccccgcaacctggcggcagcgcaaaagatg

SEQ ID NO: 9406 - DNA, 103 bp, Artificial Sequence
  Synthetic Polynucleotide
taatacgactcactatagggatgctgtttgttgttgtgcggggggtctccaacagaggagaggagacatgccgcacaacaacctggcggcagcgcaaaagatg

SEQ ID NO: 9407 - DNA, 103 bp, Artificial Sequence
  Synthetic Polynucleotide
taatacgactcactatagggtcaatatgctgtttgttgttgtgcggggggaacagaggagaccccccatgcaacaacaaaacctggcggcagcgcaaaagatg

SEQ ID NO: 9408 - DNA, 103 bp, Artificial Sequence
  Synthetic Polynucleotide
taatacgactcactatagggcagcgtcaatatgctgtttgttgttgtgcgaacagaggagacgcacaatgacaaacagcaacctggcggcagcgcaaaagatg

SEQ ID NO: 9409 - DNA, 103 bp, Artificial Sequence
  Synthetic Polynucleotide
taatacgactcactatagggtctcccagcgtcaatatgctgtttgttgttaacagaggagaaacaacatgcagcatattaacctggcggcagcgcaaaagatg

SEQ ID NO: 9410 - DNA, 103 bp, Artificial Sequence
  Synthetic Polynucleotide
taatacgactcactatagggtggtctctcccagcgtcaatatgctgtttgaacagaggagacaaacaatgtattgacgcaacctggcggcagcgcaaaagatg

SEQ ID NO: 9411 - DNA, 103 bp, Artificial Sequence
  Synthetic Polynucleotide
taatacgactcactatagggatctctggtctctcccagcgtcaatatgctaacagaggagaagcataatgacgctgggaaacctggcggcagcgcaaaagatg

SEQ ID NO: 9412 - DNA, 103 bp, Artificial Sequence
  Synthetic Polynucleotide
taatacgactcactataggggcaggatctctggtctctcccagcgtcaataacagaggagaattgacatggggagagacaacctggcggcagcgcaaaagatg

SEQ ID NO: 9413 - DNA, 103 bp, Artificial Sequence
  Synthetic Polynucleotide
taatacgactcactatagggagacagcaggatctctggtctctcccagcgaacagaggagacgctggatgagaccagagaacctggcggcagcgcaaaagatg

SEQ ID NO: 9414 - DNA, 103 bp, Artificial Sequence
  Synthetic Polynucleotide
taatacgactcactataggggtttgtgacctccgtcttcaagagttcaataacagaggagaattgaaatgttgaagacgaacctggcggcagcgcaaaagatg

SEQ ID NO: 9415 - DNA, 103 bp, Artificial Sequence
  Synthetic Polynucleotide
taatacgactcactatagggtgtagagacagcaggatctctggtctctccaacagaggagaggagagatgagagatcctaacctggcggcagcgcaaaagatg

SEQ ID NO: 9416 - DNA, 103 bp, Artificial Sequence
  Synthetic Polynucleotide
taatacgactcactataggggatgctgtagagacagcaggatctctggtcaacagaggagagaccagatgtcctgctgtaacctggcggcagcgcaaaagatg

SEQ ID NO: 9417 - DNA, 103 bp, Artificial Sequence
  Synthetic Polynucleotide
taatacgactcactatagggggaatgatgctgtagagacagcaggatctcaacagaggagagagatcatgctgtctctaaacctggcggcagcgcaaaagatg

SEQ ID NO: 9418 - DNA, 103 bp, Artificial Sequence
  Synthetic Polynucleotide
taatacgactcactatagggtgcctggaatgatgctgtagagacagcaggaacagaggagacctgctatgtctacagcaaacctggcggcagcgcaaaagatg

SEQ ID NO: 9419 - DNA, 103 bp, Artificial Sequence
  Synthetic Polynucleotide
taatacgactcactatagggttctgtgcctggaatgatgctgtagagacaaacagaggagatgtctcatgagcatcattaacctggcggcagcgcaaaagatg

SEQ ID NO: 9420 - DNA, 103 bp, Artificial Sequence
  Synthetic Polynucleotide
taatacgactcactatagggtggcgttctgtgcctggaatgatgctgtagaacagaggagactacagatgcattccaggaacctggcggcagcgcaaaagatg

SEQ ID NO: 9421 - DNA, 103 bp, Artificial Sequence
  Synthetic Polynucleotide
taatacgactcactatagggttttttggcgttctgtgcctggaatgatgcaacagaggagagcatcaatgcaggcacagaacctggcggcagcgcaaaagatg

SEQ ID NO: 9422 - DNA, 103 bp, Artificial Sequence
  Synthetic Polynucleotide
taatacgactcactatagggttccattttttggcgttctgtgcctggaataacagaggagaattccaatgacagaacgcaacctggcggcagcgcaaaagatg

SEQ ID NO: 9423 - DNA, 103 bp, Artificial Sequence
  Synthetic Polynucleotide
taatacgactcactatagggcaccattccattttttggcgttctgtgcctaacagaggagaaggcacatgacgccaaaaaacctggcggcagcgcaaaagatg

SEQ ID NO: 9424 - DNA, 103 bp, Artificial Sequence
  Synthetic Polynucleotide
taatacgactcactatagggaacagcaccattccattttttggcgttctgaacagaggagacagaacatgaaaaaatggaacctggcggcagcgcaaaagatg

SEQ ID NO: 9425 - DNA, 103 bp, Artificial Sequence
  Synthetic Polynucleotide
taatacgactcactataggggcagggtttgtgacctccgtcttcaagagtaacagaggagaactcttatggacggaggtaacctggcggcagcgcaaaagatg

SEQ ID NO: 9426 - DNA, 103 bp, Artificial Sequence
  Synthetic Polynucleotide
taatacgactcactataggggattcaacagcaccattccattttttggcgaacagaggagacgccaaatgatggaatggaacctggcggcagcgcaaaagatg

SEQ ID NO: 9427 - DNA, 103 bp, Artificial Sequence
  Synthetic Polynucleotide
taatacgactcactatagggctgttgattcaacagcaccattccatttttaacagaggagaaaaaatatgatggtgctgaacctggcggcagcgcaaaagatg

SEQ ID NO: 9428 - DNA, 103 bp, Artificial Sequence
  Synthetic Polynucleotide
taatacgactcactatagggagaacctgttgattcaacagcaccattccaaacagaggagatggaatatggctgttgaaaacctggcggcagcgcaaaagatg

SEQ ID NO: 9429 - DNA, 103 bp, Artificial Sequence
  Synthetic Polynucleotide
taatacgactcactatagggggacggcagggtttgtgacctccgtcttcaaacagaggagatgaagaatgaggtcacaaaacctggcggcagcgcaaaagatg

SEQ ID NO: 9430 - DNA, 103 bp, Artificial Sequence
  Synthetic Polynucleotide
taatacgactcactataggggcgcaggacggcagggtttgtgacctccgtaacagaggagaacggagatgacaaaccctaacctggcggcagcgcaaaagatg

SEQ ID NO: 9431 - DNA, 103 bp, Artificial Sequence
  Synthetic Polynucleotide
taatacgactcactatagggagtttgcgcaggacggcagggtttgtgaccaacagaggagaggtcacatgccctgccgtaacctggcggcagcgcaaaagatg

SEQ ID NO: 9432 - DNA, 103 bp, Artificial Sequence
  Synthetic Polynucleotide
taatacgactcactatagggtgcacagtttgcgcaggacggcagggtttgaacagaggagacaaaccatgccgtcctgcaacctggcggcagcgcaaaagatg

SEQ ID NO: 9433 - DNA, 103 bp, Artificial Sequence
  Synthetic Polynucleotide
taatacgactcactatagggttcaatgcacagtttgcgcaggacggcaggaacagaggagacctgccatgctgcgcaaaaacctggcggcagcgcaaaagatg

SEQ ID NO: 9434 - DNA, 103 bp, Artificial Sequence
  Synthetic Polynucleotide
taatacgactcactatagggttgaaagacggtcgacccgtctttttccgtaacagaggagaacggaaatggacgggtcgaacctggcggcagcgcaaaagatg

SEQ ID NO: 9435 - DNA, 103 bp, Artificial Sequence
  Synthetic Polynucleotide
taatacgactcactatagggttagcttcaatgcacagtttgcgcaggacgaacagaggagacgtcctatgcaaactgtgaacctggcggcagcgcaaaagatg

SEQ ID NO: 9436 - DNA, 103 bp, Artificial Sequence
  Synthetic Polynucleotide
taatacgactcactatagggatattttagcttcaatgcacagtttgcgcaaacagaggagatgcgcaatgtgtgcattgaacctggcggcagcgcaaaagatg

SEQ ID NO: 9437 - DNA, 103 bp, Artificial Sequence
  Synthetic Polynucleotide
taatacgactcactataggggtttgatattttagcttcaatgcacagtttaacagaggagaaaactgatgattgaagctaacctggcggcagcgcaaaagatg

SEQ ID NO: 9438 - DNA, 103 bp, Artificial Sequence
  Synthetic Polynucleotide
taatacgactcactataggggtggtgtttgatattttagcttcaatgcacaacagaggagagtgcatatgagctaaaataacctggcggcagcgcaaaagatg

SEQ ID NO: 9439 - DNA, 103 bp, Artificial Sequence
  Synthetic Polynucleotide
taatacgactcactatagggcggtggtggtgtttgatattttagcttcaaaacagaggagattgaagatgaaatatcaaaacctggcggcagcgcaaaagatg

SEQ ID NO: 9440 - DNA, 103 bp, Artificial Sequence
  Synthetic Polynucleotide
taatacgactcactatagggcgaatcggtggtggtgtttgatattttagcaacagaggagagctaaaatgtcaaacaccaacctggcggcagcgcaaaagatg

SEQ ID NO: 9441 - DNA, 103 bp, Artificial Sequence
  Synthetic Polynucleotide
taatacgactcactatagggcatctcgaatcggtggtggtgtttgatattaacagaggagaaatatcatgcaccaccacaacctggcggcagcgcaaaagatg

SEQ ID NO: 9442 - DNA, 103 bp, Artificial Sequence
  Synthetic Polynucleotide
taatacgactcactatagggttggacatctcgaatcggtggtggtgtttgaacagaggagacaaacaatgccaccgattaacctggcggcagcgcaaaagatg

SEQ ID NO: 9443 - DNA, 103 bp, Artificial Sequence
  Synthetic Polynucleotide
taatacgactcactatagggttgtgttggacatctcgaatcggtggtggtaacagaggagaaccaccatggattcgagaaacctggcggcagcgcaaaagatg

SEQ ID NO: 9444 - DNA, 103 bp, Artificial Sequence
  Synthetic Polynucleotide
taatacgactcactatagggtctccttgtgttggacatctcgaatcggtgaacagaggagacaccgaatggagatgtccaacctggcggcagcgcaaaagatg

SEQ ID NO: 9445 - DNA, 103 bp, Artificial Sequence
  Synthetic Polynucleotide
taatacgactcactataggggcatattgaaagacggtcgacccgtcttttaacagaggagaaaaagaatggtcgaccgtaacctggcggcagcgcaaaagatg

SEQ ID NO: 9446 - DNA, 103 bp, Artificial Sequence
  Synthetic Polynucleotide
taatacgactcactatagggtggcttctccttgtgttggacatctcgaataacagaggagaattcgaatggtccaacacaacctggcggcagcgcaaaagatg

SEQ ID NO: 9447 - DNA, 103 bp, Artificial Sequence
  Synthetic Polynucleotide
taatacgactcactatagggcagcgtggcttctccttgtgttggacatctaacagaggagaagatgtatgacacaaggaaacctggcggcagcgcaaaagatg

SEQ ID NO: 9448 - DNA, 103 bp, Artificial Sequence
  Synthetic Polynucleotide
taatacgactcactatagggtccaccagcgtggcttctccttgtgttggaaacagaggagatccaacatgaggagaagcaacctggcggcagcgcaaaagatg

SEQ ID NO: 9449 - DNA, 103 bp, Artificial Sequence
  Synthetic Polynucleotide
taatacgactcactataggggttcttccaccagcgtggcttctccttgtgaacagaggagacacaagatgaagccacgcaacctggcggcagcgcaaaagatg

SEQ ID NO: 9450 - DNA, 103 bp, Artificial Sequence
  Synthetic Polynucleotide
taatacgactcactataggggtcctgttcttccaccagcgtggcttctccaacagaggagaggagaaatgacgctggtgaacctggcggcagcgcaaaagatg

SEQ ID NO: 9451 - DNA, 103 bp, Artificial Sequence
  Synthetic Polynucleotide
taatacgactcactatagggttcgtgtcctgttcttccaccagcgtggctaacagaggagaagccacatgggtggaagaaacctggcggcagcgcaaaagatg

SEQ ID NO: 9452 - DNA, 103 bp, Artificial Sequence
  Synthetic Polynucleotide
taatacgactcactatagggcaaagttcgtgtcctgttcttccaccagcgaacagaggagacgctggatgaagaacaggaacctggcggcagcgcaaaagatg

SEQ ID NO: 9453 - DNA, 103 bp, Artificial Sequence
  Synthetic Polynucleotide
taatacgactcactatagggacacacaaagttcgtgtcctgttcttccacaacagaggagagtggaaatgcaggacacgaacctggcggcagcgcaaaagatg

SEQ ID NO: 9454 - DNA, 103 bp, Artificial Sequence
  Synthetic Polynucleotide
taatacgactcactatagggcgtcgacacacaaagttcgtgtcctgttctaacagaggagaagaacaatgcacgaacttaacctggcggcagcgcaaaagatg

SEQ ID NO: 9455 - DNA, 103 bp, Artificial Sequence
  Synthetic Polynucleotide
taatacgactcactatagggacgttcgtcgacacacaaagttcgtgtcctaacagaggagaaggacaatgactttgtgtaacctggcggcagcgcaaaagatg

SEQ ID NO: 9456 - DNA, 103 bp, Artificial Sequence
  Synthetic Polynucleotide
taatacgactcactatagggtttcagcatattgaaagacggtcgacccgtaacagaggagaacgggtatgccgtctttcaacctggcggcagcgcaaaagatg

SEQ ID NO: 9457 - DNA, 103 bp, Artificial Sequence
  Synthetic Polynucleotide
taatacgactcactatagggcacgaacgttcgtcgacacacaaagttcgtaacagaggagaacgaacatggtgtgtcgaaacctggcggcagcgcaaaagatg

SEQ ID NO: 9458 - DNA, 103 bp, Artificial Sequence
  Synthetic Polynucleotide
taatacgactcactatagggctgtccacgaacgttcgtcgacacacaaagaacagaggagactttgtatgtcgacgaacaacctggcggcagcgcaaaagatg

SEQ ID NO: 9459 - DNA, 103 bp, Artificial Sequence
  Synthetic Polynucleotide
taatacgactcactatagggagcctctgtccacgaacgttcgtcgacacaaacagaggagatgtgtcatggaacgttcgaacctggcggcagcgcaaaagatg

SEQ ID NO: 9460 - DNA, 103 bp, Artificial Sequence
  Synthetic Polynucleotide
taatacgactcactataggggccccagcctctgtccacgaacgttcgtcgaacagaggagacgacgaatgttcgtggacaacctggcggcagcgcaaaagatg

SEQ ID NO: 9461 - DNA, 103 bp, Artificial Sequence
  Synthetic Polynucleotide
taatacgactcactatagggccattgccccagcctctgtccacgaacgttaacagaggagaaacgttatgggacagaggaacctggcggcagcgcaaaagatg

SEQ ID NO: 9462 - DNA, 103 bp, Artificial Sequence
  Synthetic Polynucleotide
taatacgactcactatagggcacaaccattgccccagcctctgtccacgaaacagaggagatcgtggatggaggctgggaacctggcggcagcgcaaaagatg

SEQ ID NO: 9463 - DNA, 103 bp, Artificial Sequence
  Synthetic Polynucleotide
taatacgactcactatagggtagcccacaaccattgccccagcctctgtcaacagaggagagacagaatgtggggcaataacctggcggcagcgcaaaagatg

SEQ ID NO: 9464 - DNA, 103 bp, Artificial Sequence
  Synthetic Polynucleotide
taatacgactcactatagggccgaatagcccacaaccattgccccagcctaacagaggagaaggctgatgcaatggttgaacctggcggcagcgcaaaagatg

SEQ ID NO: 9465 - DNA, 103 bp, Artificial Sequence
  Synthetic Polynucleotide
taatacgactcactatagggcttttccgaatagcccacaaccattgccccaacagaggagaggggcaatggttgtgggcaacctggcggcagcgcaaaagatg

SEQ ID NO: 9466 - DNA, 103 bp, Artificial Sequence
  Synthetic Polynucleotide
taatacgactcactataggggctaccttttccgaatagcccacaaccattaacagaggagaaatggtatggggctattcaacctggcggcagcgcaaaagatg

SEQ ID NO: 9467 - DNA, 103 bp, Artificial Sequence
  Synthetic Polynucleotide
taatacgactcactataggggcgcgtttcagcatattgaaagacggtcgaaacagaggagatcgaccatgtttcaatataacctggcggcagcgcaaaagatg

SEQ ID NO: 9468 - DNA, 103 bp, Artificial Sequence
  Synthetic Polynucleotide
taatacgactcactatagggattaagctaccttttccgaatagcccacaaaacagaggagattgtggatgattcggaaaaacctggcggcagcgcaaaagatg

SEQ ID NO: 9469 - DNA, 103 bp, Artificial Sequence
  Synthetic Polynucleotide
taatacgactcactatagggacgttattaagctaccttttccgaatagccaacagaggagaggctatatggaaaaggtaaacctggcggcagcgcaaaagatg

SEQ ID NO: 9470 - DNA, 103 bp, Artificial Sequence
  Synthetic Polynucleotide
taatacgactcactatagggagcacacgttattaagctaccttttccgaaaacagaggagattcggaatgggtagcttaaacctggcggcagcgcaaaagatg

SEQ ID NO: 9471 - DNA, 103 bp, Artificial Sequence
  Synthetic Polynucleotide
taatacgactcactatagggaacttagcacacgttattaagctaccttttaacagaggagaaaaaggatgcttaataacaacctggcggcagcgcaaaagatg

SEQ ID NO: 9472 - DNA, 103 bp, Artificial Sequence
  Synthetic Polynucleotide
taatacgactcactatagggacttaaacttagcacacgttattaagctacaacagaggagagtagctatgtaacgtgtgaacctggcggcagcgcaaaagatg

SEQ ID NO: 9473 - DNA, 103 bp, Artificial Sequence
  Synthetic Polynucleotide
taatacgactcactatagggcacacacttaaacttagcacacgttattaaaacagaggagattaataatgtgtgctaagaacctggcggcagcgcaaaagatg

SEQ ID NO: 9474 - DNA, 103 bp, Artificial Sequence
  Synthetic Polynucleotide
taatacgactcactatagggtttgtcacacacttaaacttagcacacgttaacagaggagaaacgtgatgtaagtttaaaacctggcggcagcgcaaaagatg

SEQ ID NO: 9475 - DNA, 103 bp, Artificial Sequence
  Synthetic Polynucleotide
taatacgactcactatagggccagttttgtcacacacttaaacttagcacaacagaggagagtgctaatgttaagtgtgaacctggcggcagcgcaaaagatg

SEQ ID NO: 9476 - DNA, 103 bp, Artificial Sequence
  Synthetic Polynucleotide
taatacgactcactatagggtccttccagttttgtcacacacttaaacttaacagaggagaaagtttatgtgtgtgacaaacctggcggcagcgcaaaagatg

SEQ ID NO: 9477 - DNA, 103 bp, Artificial Sequence
  Synthetic Polynucleotide
taatacgactcactatagggatctttccttccagttttgtcacacacttaaacagaggagataagtgatggacaaaactaacctggcggcagcgcaaaagatg

SEQ ID NO: 9478 - DNA, 103 bp, Artificial Sequence
  Synthetic Polynucleotide
taatacgactcactatagggttctcgcgcgtttcagcatattgaaagacgaacagaggagacgtcttatgatatgctgaaacctggcggcagcgcaaaagatg

SEQ ID NO: 9479 - DNA, 103 bp, Artificial Sequence
  Synthetic Polynucleotide
taatacgactcactatagggggactatctttccttccagttttgtcacacaacagaggagagtgtgaatgaactggaagaacctggcggcagcgcaaaagatg

SEQ ID NO: 9480 - DNA, 103 bp, Artificial Sequence
  Synthetic Polynucleotide
taatacgactcactatagggatattggactatctttccttccagttttgtaacagaggagaacaaaaatggaaggaaagaacctggcggcagcgcaaaagatg

SEQ ID NO: 9481 - DNA, 103 bp, Artificial Sequence
  Synthetic Polynucleotide
taatacgactcactatagggttttcatattggactatctttccttccagtaacagaggagaactggaatgaaagatagtaacctggcggcagcgcaaaagatg

SEQ ID NO: 9482 - DNA, 103 bp, Artificial Sequence
  Synthetic Polynucleotide
taatacgactcactatagggttaagttttcatattggactatctttccttaacagaggagaaaggaaatgtagtccaataacctggcggcagcgcaaaagatg

SEQ ID NO: 9483 - DNA, 103 bp, Artificial Sequence
  Synthetic Polynucleotide
taatacgactcactatagggatattttaagttttcatattggactatcttaacagaggagaaagataatgcaatatgaaaacctggcggcagcgcaaaagatg

SEQ ID NO: 9484 - DNA, 103 bp, Artificial Sequence
  Synthetic Polynucleotide
taatacgactcactatagggactgaatattttaagttttcatattggactaacagaggagaagtccaatgtgaaaacttaacctggcggcagcgcaaaagatg

SEQ ID NO: 9485 - DNA, 103 bp, Artificial Sequence
  Synthetic Polynucleotide
taatacgactcactatagggctatcactgaatattttaagttttcatattaacagaggagaaatatgatgacttaaaataacctggcggcagcgcaaaagatg

SEQ ID NO: 9486 - DNA, 103 bp, Artificial Sequence
  Synthetic Polynucleotide
taatacgactcactatagggggtgactatcactgaatattttaagttttcaacagaggagagaaaacatgaaatattcaaacctggcggcagcgcaaaagatg

SEQ ID NO: 9487 - DNA, 103 bp, Artificial Sequence
  Synthetic Polynucleotide
taatacgactcactatagggtgtacggtgactatcactgaatattttaagaacagaggagacttaaaatgttcagtgataacctggcggcagcgcaaaagatg

SEQ ID NO: 9488 - DNA, 103 bp, Artificial Sequence
  Synthetic Polynucleotide
taatacgactcactatagggcagtgtgtacggtgactatcactgaatattaacagaggagaaatattatgtgatagtcaaacctggcggcagcgcaaaagatg

SEQ ID NO: 9489 - DNA, 103 bp, Artificial Sequence
  Synthetic Polynucleotide
taatacgactcactataggggcggtttctcgcgcgtttcagcatattgaaaacagaggagattcaatatgctgaaacgcaacctggcggcagcgcaaaagatg

SEQ ID NO: 9490 - DNA, 103 bp, Artificial Sequence
  Synthetic Polynucleotide
taatacgactcactataggggtctccagtgtgtacggtgactatcactgaaacagaggagatcagtgatggtcaccgtaaacctggcggcagcgcaaaagatg

SEQ ID NO: 9491 - DNA, 103 bp, Artificial Sequence
  Synthetic Polynucleotide
taatacgactcactatagggtgctggtctccagtgtgtacggtgactatcaacagaggagagatagtatgcgtacacacaacctggcggcagcgcaaaagatg

SEQ ID NO: 9492 - DNA, 103 bp, Artificial Sequence
  Synthetic Polynucleotide
taatacgactcactatagggcttggtgctggtctccagtgtgtacggtgaaacagaggagatcaccgatgacactggagaacctggcggcagcgcaaaagatg

SEQ ID NO: 9493 - DNA, 103 bp, Artificial Sequence
  Synthetic Polynucleotide
taatacgactcactatagggtccaacttggtgctggtctccagtgtgtacaacagaggagagtacacatgggagaccagaacctggcggcagcgcaaaagatg

SEQ ID NO: 9494 - DNA, 103 bp, Artificial Sequence
  Synthetic Polynucleotide
taatacgactcactatagggtcatttccaacttggtgctggtctccagtgaacagaggagacactggatgccagcaccaaacctggcggcagcgcaaaagatg

SEQ ID NO: 9495 - DNA, 103 bp, Artificial Sequence
  Synthetic Polynucleotide
taatacgactcactatagggtggtctcatttccaacttggtgctggtctcaacagaggagagagaccatgaccaagttgaacctggcggcagcgcaaaagatg

SEQ ID NO: 9496 - DNA, 103 bp, Artificial Sequence
  Synthetic Polynucleotide
taatacgactcactatagggttctgtggtctcatttccaacttggtgctgaacagaggagacagcacatggttggaaataacctggcggcagcgcaaaagatg

SEQ ID NO: 9497 - DNA, 103 bp, Artificial Sequence
  Synthetic Polynucleotide
taatacgactcactatagggccatgttctgtggtctcatttccaacttggaacagaggagaccaagtatgaaatgagacaacctggcggcagcgcaaaagatg

SEQ ID NO: 9498 - DNA, 103 bp, Artificial Sequence
  Synthetic Polynucleotide
taatacgactcactatagggttgttccatgttctgtggtctcatttccaaaacagaggagattggaaatgagaccacagaacctggcggcagcgcaaaagatg

SEQ ID NO: 9499 - DNA, 103 bp, Artificial Sequence
  Synthetic Polynucleotide
taatacgactcactatagggtgcagttgttccatgttctgtggtctcattaacagaggagaaatgagatgacagaacataacctggcggcagcgcaaaagatg

SEQ ID NO: 9500 - DNA, 103 bp, Artificial Sequence
  Synthetic Polynucleotide
taatacgactcactataggggacacgcggtttctcgcgcgtttcagcataaacagaggagatatgctatgacgcgcgagaacctggcggcagcgcaaaagatg

SEQ ID NO: 9501 - DNA, 103 bp, Artificial Sequence
  Synthetic Polynucleotide
taatacgactcactatagggatggttgcagttgttccatgttctgtggtcaacagaggagagaccacatgacatggaacaacctggcggcagcgcaaaagatg

SEQ ID NO: 9502 - DNA, 103 bp, Artificial Sequence
  Synthetic Polynucleotide
taatacgactcactataggggtgttatggttgcagttgttccatgttctgaacagaggagacagaacatggaacaactgaacctggcggcagcgcaaaagatg

SEQ ID NO: 9503 - DNA, 103 bp, Artificial Sequence
  Synthetic Polynucleotide
taatacgactcactatagggttgaggtgttatggttgcagttgttccatgaacagaggagacatggaatgactgcaaccaacctggcggcagcgcaaaagatg

SEQ ID NO: 9504 - DNA, 103 bp, Artificial Sequence
  Synthetic Polynucleotide
taatacgactcactatagggggagcttgaggtgttatggttgcagttgttaacagaggagaaacaacatgaaccataacaacctggcggcagcgcaaaagatg

SEQ ID NO: 9505 - DNA, 103 bp, Artificial Sequence
  Synthetic Polynucleotide
taatacgactcactatagggacgtgggagcttgaggtgttatggttgcagaacagaggagactgcaaatgtaacacctcaacctggcggcagcgcaaaagatg

SEQ ID NO: 9506 - DNA, 103 bp, Artificial Sequence
  Synthetic Polynucleotide
taatacgactcactatagggttccgacgtgggagcttgaggtgttatggtaacagaggagaaccataatgcctcaagctaacctggcggcagcgcaaaagatg

SEQ ID NO: 9507 - DNA, 103 bp, Artificial Sequence
  Synthetic Polynucleotide
taatacgactcactatagggtgtatttccgacgtgggagcttgaggtgttaacagaggagaaacaccatgagctcccacaacctggcggcagcgcaaaagatg

SEQ ID NO: 9508 - DNA, 103 bp, Artificial Sequence
  Synthetic Polynucleotide
taatacgactcactatagggtcagctgtatttccgacgtgggagcttgagaacagaggagactcaagatgccacgtcggaacctggcggcagcgcaaaagatg

SEQ ID NO: 9509 - DNA, 103 bp, Artificial Sequence
  Synthetic Polynucleotide
taatacgactcactataggggtctgtcagctgtatttccgacgtgggagcaacagaggagagctcccatgtcggaaataaacctggcggcagcgcaaaagatg

SEQ ID NO: 9510 - DNA, 103 bp, Artificial Sequence
  Synthetic Polynucleotide
taatacgactcactatagggccgtagtctgtcagctgtatttccgacgtgaacagaggagacacgtcatgaatacagctaacctggcggcagcgcaaaagatg

SEQ ID NO: 9511 - DNA, 103 bp, Artificial Sequence
  Synthetic Polynucleotide
taatacgactcactatagggcagttgacacgcggtttctcgcgcgtttcaaacagaggagatgaaacatgcgagaaaccaacctggcggcagcgcaaaagatg

SEQ ID NO: 9512 - DNA, 103 bp, Artificial Sequence
  Synthetic Polynucleotide
taatacgactcactataggggagctccgtagtctgtcagctgtatttccgaacagaggagacggaaaatgagctgacagaacctggcggcagcgcaaaagatg

SEQ ID NO: 9513 - DNA, 103 bp, Artificial Sequence
  Synthetic Polynucleotide
taatacgactcactatagggtgttagagctccgtagtctgtcagctgtataacagaggagaatacagatgacagactacaacctggcggcagcgcaaaagatg

SEQ ID NO: 9514 - DNA, 103 bp, Artificial Sequence
  Synthetic Polynucleotide
taatacgactcactatagggtccaatgttagagctccgtagtctgtcagcaacagaggagagctgacatgctacggagcaacctggcggcagcgcaaaagatg

SEQ ID NO: 9515 - DNA, 103 bp, Artificial Sequence
  Synthetic Polynucleotide
taatacgactcactatagggaacaatccaatgttagagctccgtagtctgaacagaggagacagactatggagctctaaaacctggcggcagcgcaaaagatg

SEQ ID NO: 9516 - DNA, 103 bp, Artificial Sequence
  Synthetic Polynucleotide
taatacgactcactatagggaggtgaacaatccaatgttagagctccgtaaacagaggagatacggaatgctaacattgaacctggcggcagcgcaaaagatg

SEQ ID NO: 9517 - DNA, 103 bp, Artificial Sequence
  Synthetic Polynucleotide
taatacgactcactataggggttctaggtgaacaatccaatgttagagctaacagaggagaagctctatgattggattgaacctggcggcagcgcaaaagatg

SEQ ID NO: 9518 - DNA, 103 bp, Artificial Sequence
  Synthetic Polynucleotide
taatacgactcactataggggccctgttctaggtgaacaatccaatgttaaacagaggagataacatatgattgttcacaacctggcggcagcgcaaaagatg

SEQ ID NO: 9519 - DNA, 103 bp, Artificial Sequence
  Synthetic Polynucleotide
taatacgactcactataggggtctagccctgttctaggtgaacaatccaaaacagaggagattggatatgtcacctagaaacctggcggcagcgcaaaagatg

SEQ ID NO: 9520 - DNA, 103 bp, Artificial Sequence
  Synthetic Polynucleotide
taatacgactcactatagggttaaagtctagccctgttctaggtgaacaaaacagaggagattgttcatgtagaacaggaacctggcggcagcgcaaaagatg

SEQ ID NO: 9521 - DNA, 103 bp, Artificial Sequence
  Synthetic Polynucleotide
taatacgactcactatagggtctcattaaagtctagccctgttctaggtgaacagaggagacacctaatgcagggctagaacctggcggcagcgcaaaagatg

SEQ ID NO: 9522 - DNA, 103 bp, Artificial Sequence
  Synthetic Polynucleotide
taatacgactcactatagggattcgaaactgttcttgtcggtccacgtagaacagaggagactacgtatgccgacaagaaacctggcggcagcgcaaaagatg

SEQ ID NO: 9523 - DNA, 103 bp, Artificial Sequence
  Synthetic Polynucleotide
taatacgactcactatagggtgaaacagttgacacgcggtttctcgcgcgaacagaggagacgcgcgatgaaccgcgtgaacctggcggcagcgcaaaagatg

SEQ ID NO: 9524 - DNA, 103 bp, Artificial Sequence
  Synthetic Polynucleotide
taatacgactcactatagggcaccatctcattaaagtctagccctgttctaacagaggagaagaacaatgctagactttaacctggcggcagcgcaaaagatg

SEQ ID NO: 9525 - DNA, 103 bp, Artificial Sequence
  Synthetic Polynucleotide
taatacgactcactatagggaacaacaccatctcattaaagtctagccctaacagaggagaagggctatgctttaatgaaacctggcggcagcgcaaaagatg

SEQ ID NO: 9526 - DNA, 103 bp, Artificial Sequence
  Synthetic Polynucleotide
taatacgactcactatagggttgtcaacaacaccatctcattaaagtctaaacagaggagatagactatgatgagatggaacctggcggcagcgcaaaagatg

SEQ ID NO: 9527 - DNA, 103 bp, Artificial Sequence
  Synthetic Polynucleotide
taatacgactcactatagggtttcattgtcaacaacaccatctcattaaaaacagaggagatttaatatgatggtgttgaacctggcggcagcgcaaaagatg

SEQ ID NO: 9528 - DNA, 103 bp, Artificial Sequence
  Synthetic Polynucleotide
taatacgactcactatagggttttttttcattgtcaacaacaccatctcaaacagaggagatgagatatggttgttgacaacctggcggcagcgcaaaagatg

SEQ ID NO: 9529 - DNA, 103 bp, Artificial Sequence
  Synthetic Polynucleotide
taatacgactcactatagggatgatttttttttcattgtcaacaacaccaaacagaggagatggtgtatgtgacaatgaaacctggcggcagcgcaaaagatg

SEQ ID NO: 9530 - DNA, 103 bp, Artificial Sequence
  Synthetic Polynucleotide
taatacgactcactataggggagccatgatttttttttcattgtcaacaaaacagaggagattgttgatgatgaaaaaaaacctggcggcagcgcaaaagatg

SEQ ID NO: 9531 - DNA, 103 bp, Artificial Sequence
  Synthetic Polynucleotide
taatacgactcactatagggtggacgagccatgatttttttttcattgtcaacagaggagagacaatatgaaaaaaatcaacctggcggcagcgcaaaagatg

SEQ ID NO: 9532 - DNA, 103 bp, Artificial Sequence
  Synthetic Polynucleotide
taatacgactcactataggggtttgtggacgagccatgatttttttttcaaacagaggagatgaaaaatgaatcatggcaacctggcggcagcgcaaaagatg

SEQ ID NO: 9533 - DNA, 103 bp, Artificial Sequence
  Synthetic Polynucleotide
taatacgactcactatagggccattgtttgtggacgagccatgattttttaacagaggagaaaaaaaatgtggctcgtcaacctggcggcagcgcaaaagatg

SEQ ID NO: 9534 - DNA, 103 bp, Artificial Sequence
  Synthetic Polynucleotide
taatacgactcactatagggaactgtgaaacagttgacacgcggtttctcaacagaggagagagaaaatgcgtgtcaacaacctggcggcagcgcaaaagatg

SEQ ID NO: 9535 - DNA, 103 bp, Artificial Sequence
  Synthetic Polynucleotide
taatacgactcactatagggagaaaccattgtttgtggacgagccatgataacagaggagaatcatgatgcgtccacaaaacctggcggcagcgcaaaagatg

SEQ ID NO: 9536 - DNA, 103 bp, Artificial Sequence
  Synthetic Polynucleotide
taatacgactcactatagggagtctagaaaccattgtttgtggacgagccaacagaggagaggctcgatgacaaacaataacctggcggcagcgcaaaagatg

SEQ ID NO: 9537 - DNA, 103 bp, Artificial Sequence
  Synthetic Polynucleotide
taatacgactcactatagggtggtaagtctagaaaccattgtttgtggacaacagaggagagtccacatgcaatggtttaacctggcggcagcgcaaaagatg

SEQ ID NO: 9538 - DNA, 103 bp, Artificial Sequence
  Synthetic Polynucleotide
taatacgactcactatagggggcagtggtaagtctagaaaccattgtttgaacagaggagacaaacaatggtttctagaaacctggcggcagcgcaaaagatg

SEQ ID NO: 9539 - DNA, 103 bp, Artificial Sequence
  Synthetic Polynucleotide
taatacgactcactatagggtccaaggcagtggtaagtctagaaaccattaacagaggagaaatggtatgtagacttacaacctggcggcagcgcaaaagatg

SEQ ID NO: 9540 - DNA, 103 bp, Artificial Sequence
  Synthetic Polynucleotide
taatacgactcactatagggcgaggtccaaggcagtggtaagtctagaaaaacagaggagatttctaatgttaccactgaacctggcggcagcgcaaaagatg

SEQ ID NO: 9541 - DNA, 103 bp, Artificial Sequence
  Synthetic Polynucleotide
taatacgactcactataggggcccccgaggtccaaggcagtggtaagtctaacagaggagaagacttatgactgccttgaacctggcggcagcgcaaaagatg

SEQ ID NO: 9542 - DNA, 103 bp, Artificial Sequence
  Synthetic Polynucleotide
taatacgactcactatagggttgaagcccccgaggtccaaggcagtggtaaacagaggagataccacatgcttggacctaacctggcggcagcgcaaaagatg

SEQ ID NO: 9543 - DNA, 103 bp, Artificial Sequence
  Synthetic Polynucleotide
taatacgactcactatagggggatgttgaagcccccgaggtccaaggcagaacagaggagactgcctatgacctcggggaacctggcggcagcgcaaaagatg

SEQ ID NO: 9544 - DNA, 103 bp, Artificial Sequence
  Synthetic Polynucleotide
taatacgactcactatagggtcttgggatgttgaagcccccgaggtccaaaacagaggagattggacatggggggcttcaacctggcggcagcgcaaaagatg

SEQ ID NO: 9545 - DNA, 103 bp, Artificial Sequence
  Synthetic Polynucleotide
taatacgactcactatagggtcgccaactgtgaaacagttgacacgcggtaacagaggagaaccgcgatgcaactgtttaacctggcggcagcgcaaaagatg

SEQ ID NO: 9546 - DNA, 103 bp, Artificial Sequence
  Synthetic Polynucleotide
taatacgactcactatagggaagtctcttgggatgttgaagcccccgaggaacagaggagacctcggatgcttcaacataacctggcggcagcgcaaaagatg

SEQ ID NO: 9547 - DNA, 103 bp, Artificial Sequence
  Synthetic Polynucleotide
taatacgactcactatagggattccaagtctcttgggatgttgaagccccaacagaggagaggggctatgacatcccaaaacctggcggcagcgcaaaagatg

SEQ ID NO: 9548 - DNA, 103 bp, Artificial Sequence
  Synthetic Polynucleotide
taatacgactcactatagggtgtctattccaagtctcttgggatgttgaaaacagaggagattcaacatgccaagagacaacctggcggcagcgcaaaagatg

SEQ ID NO: 9549 - DNA, 103 bp, Artificial Sequence
  Synthetic Polynucleotide
taatacgactcactatagggagtcttgtctattccaagtctcttgggatgaacagaggagacatcccatgagacttggaaacctggcggcagcgcaaaagatg

SEQ ID NO: 9550 - DNA, 103 bp, Artificial Sequence
  Synthetic Polynucleotide
taatacgactcactatagggcagcaagtcttgtctattccaagtctcttgaacagaggagacaagagatgtggaatagaaacctggcggcagcgcaaaagatg

SEQ ID NO: 9551 - DNA, 103 bp, Artificial Sequence
  Synthetic Polynucleotide
taatacgactcactataggggtgaccagcaagtcttgtctattccaagtcaacagaggagagacttgatgtagacaagaaacctggcggcagcgcaaaagatg

SEQ ID NO: 9552 - DNA, 103 bp, Artificial Sequence
  Synthetic Polynucleotide
taatacgactcactatagggtaaatgtgaccagcaagtcttgtctattccaacagaggagaggaataatgaagacttgcaacctggcggcagcgcaaaagatg

SEQ ID NO: 9553 - DNA, 103 bp, Artificial Sequence
  Synthetic Polynucleotide
taatacgactcactatagggtgtcttaaatgtgaccagcaagtcttgtctaacagaggagaagacaaatgttgctggtcaacctggcggcagcgcaaaagatg

SEQ ID NO: 9554 - DNA, 103 bp, Artificial Sequence
  Synthetic Polynucleotide
taatacgactcactatagggtgagctgtcttaaatgtgaccagcaagtctaacagaggagaagacttatgggtcacattaacctggcggcagcgcaaaagatg

SEQ ID NO: 9555 - DNA, 103 bp, Artificial Sequence
  Synthetic Polynucleotide
taatacgactcactatagggttgcatgagctgtcttaaatgtgaccagcaaacagaggagatgctggatgcatttaagaaacctggcggcagcgcaaaagatg

SEQ ID NO: 9556 - DNA, 103 bp, Artificial Sequence
  Synthetic Polynucleotide
taatacgactcactatagggtctcttcgccaactgtgaaacagttgacacaacagaggagagtgtcaatggtttcacagaacctggcggcagcgcaaaagatg

SEQ ID NO: 9557 - DNA, 103 bp, Artificial Sequence
  Synthetic Polynucleotide
taatacgactcactatagggcttttttgcatgagctgtcttaaatgtgacaacagaggagagtcacaatgaagacagctaacctggcggcagcgcaaaagatg

SEQ ID NO: 9558 - DNA, 103 bp, Artificial Sequence
  Synthetic Polynucleotide
taatacgactcactatagggtcctgcttttttgcatgagctgtcttaaataacagaggagaatttaaatgagctcatgcaacctggcggcagcgcaaaagatg

SEQ ID NO: 9559 - DNA, 103 bp, Artificial Sequence
  Synthetic Polynucleotide
taatacgactcactatagggctacttcctgcttttttgcatgagctgtctaacagaggagaagacagatgatgcaaaaaaacctggcggcagcgcaaaagatg

SEQ ID NO: 9560 - DNA, 103 bp, Artificial Sequence
  Synthetic Polynucleotide
taatacgactcactatagggtacgactacttcctgcttttttgcatgagcaacagaggagagctcatatgaaaaagcagaacctggcggcagcgcaaaagatg

SEQ ID NO: 9561 - DNA, 103 bp, Artificial Sequence
  Synthetic Polynucleotide
taatacgactcactatagggcctagtacgactacttcctgcttttttgcaaacagaggagatgcaaaatggcaggaagtaacctggcggcagcgcaaaagatg

SEQ ID NO: 9562 - DNA, 103 bp, Artificial Sequence
  Synthetic Polynucleotide
taatacgactcactataggggtgatcctagtacgactacttcctgcttttaacagaggagaaaaagcatgaagtagtcgaacctggcggcagcgcaaaagatg

SEQ ID NO: 9563 - DNA, 103 bp, Artificial Sequence
  Synthetic Polynucleotide
taatacgactcactatagggttcttgtgatcctagtacgactacttcctgaacagaggagacaggaaatggtcgtactaaacctggcggcagcgcaaaagatg

SEQ ID NO: 9564 - DNA, 103 bp, Artificial Sequence
  Synthetic Polynucleotide
taatacgactcactataggggctccttcttgtgatcctagtacgactactaacagaggagaagtagtatgactaggatcaacctggcggcagcgcaaaagatg

SEQ ID NO: 9565 - DNA, 103 bp, Artificial Sequence
  Synthetic Polynucleotide
taatacgactcactataggggcattgctccttcttgtgatcctagtacgaaacagaggagatcgtacatggatcacaagaacctggcggcagcgcaaaagatg

SEQ ID NO: 9566 - DNA, 103 bp, Artificial Sequence
  Synthetic Polynucleotide
taatacgactcactatagggagtgtgcattgctccttcttgtgatcctagaacagaggagactaggaatgcaagaaggaaacctggcggcagcgcaaaagatg

SEQ ID NO: 9567 - DNA, 103 bp, Artificial Sequence
  Synthetic Polynucleotide
taatacgactcactataggggagaatctcttcgccaactgtgaaacagttaacagaggagaaactgtatgacagttggcaacctggcggcagcgcaaaagatg

SEQ ID NO: 9568 - DNA, 103 bp, Artificial Sequence
  Synthetic Polynucleotide
taatacgactcactatagggaacgcagtgtgcattgctccttcttgtgataacagaggagaatcacaatgaggagcaataacctggcggcagcgcaaaagatg

SEQ ID NO: 9569 - DNA, 103 bp, Artificial Sequence
  Synthetic Polynucleotide
taatacgactcactatagggcagtcaacgcagtgtgcattgctccttcttaacagaggagaaagaagatgcaatgcacaaacctggcggcagcgcaaaagatg

SEQ ID NO: 9570 - DNA, 103 bp, Artificial Sequence
  Synthetic Polynucleotide
taatacgactcactatagggcgctccagtcaacgcagtgtgcattgctccaacagaggagaggagcaatgcacactgcgaacctggcggcagcgcaaaagatg

SEQ ID NO: 9571 - DNA, 103 bp, Artificial Sequence
  Synthetic Polynucleotide
taatacgactcactatagggtctgtcgctccagtcaacgcagtgtgcattaacagaggagaaatgcaatgtgcgttgacaacctggcggcagcgcaaaagatg

SEQ ID NO: 9572 - DNA, 103 bp, Artificial Sequence
  Synthetic Polynucleotide
taatacgactcactatagggggatttctgtcgctccagtcaacgcagtgtaacagaggagaacactgatgtgactggagaacctggcggcagcgcaaaagatg

SEQ ID NO: 9573 - DNA, 103 bp, Artificial Sequence
  Synthetic Polynucleotide
taatacgactcactatagggcgtttggatttctgtcgctccagtcaacgcaacagaggagagcgttgatgggagcgacaaacctggcggcagcgcaaaagatg

SEQ ID NO: 9574 - DNA, 103 bp, Artificial Sequence
  Synthetic Polynucleotide
taatacgactcactatagggccagacgtttggatttctgtcgctccagtcaacagaggagagactggatggacagaaataacctggcggcagcgcaaaagatg

SEQ ID NO: 9575 - DNA, 103 bp, Artificial Sequence
  Synthetic Polynucleotide
taatacgactcactatagggtcgttccagacgtttggatttctgtcgctcaacagaggagagagcgaatgaaatccaaaaacctggcggcagcgcaaaagatg

SEQ ID NO: 9576 - DNA, 103 bp, Artificial Sequence
  Synthetic Polynucleotide
taatacgactcactatagggtgttgtcgttccagacgtttggatttctgtaacagaggagaacagaaatgcaaacgtctaacctggcggcagcgcaaaagatg

SEQ ID NO: 9577 - DNA, 103 bp, Artificial Sequence
  Synthetic Polynucleotide
taatacgactcactatagggaaaattgttgtcgttccagacgtttggattaacagaggagaaatccaatggtctggaacaacctggcggcagcgcaaaagatg

SEQ ID NO: 9578 - DNA, 103 bp, Artificial Sequence
  Synthetic Polynucleotide
taatacgactcactatagggcttttgagaatctcttcgccaactgtgaaaaacagaggagatttcacatgtggcgaagaaacctggcggcagcgcaaaagatg

SEQ ID NO: 9579 - DNA, 103 bp, Artificial Sequence
  Synthetic Polynucleotide
taatacgactcactatagggctgcaaaaattgttgtcgttccagacgtttaacagaggagaaaacgtatggaacgacaaaacctggcggcagcgcaaaagatg

SEQ ID NO: 9580 - DNA, 103 bp, Artificial Sequence
  Synthetic Polynucleotide
taatacgactcactataggggtgtcctgcaaaaattgttgtcgttccagaaacagaggagatctggaatgacaacaattaacctggcggcagcgcaaaagatg

SEQ ID NO: 9581 - DNA, 103 bp, Artificial Sequence
  Synthetic Polynucleotide
taatacgactcactatagggttcaggtgtcctgcaaaaattgttgtcgttaacagaggagaaacgacatgaatttttgcaacctggcggcagcgcaaaagatg

SEQ ID NO: 9582 - DNA, 103 bp, Artificial Sequence
  Synthetic Polynucleotide
taatacgactcactatagggtgcatttcaggtgtcctgcaaaaattgttgaacagaggagacaacaaatgttgcaggacaacctggcggcagcgcaaaagatg

SEQ ID NO: 9583 - DNA, 103 bp, Artificial Sequence
  Synthetic Polynucleotide
taatacgactcactatagggtaatctgcatttcaggtgtcctgcaaaaataacagaggagaatttttatgggacacctgaacctggcggcagcgcaaaagatg

SEQ ID NO: 9584 - DNA, 103 bp, Artificial Sequence
  Synthetic Polynucleotide
taatacgactcactatagggatttttaatctgcatttcaggtgtcctgcaaacagaggagatgcaggatgcctgaaatgaacctggcggcagcgcaaaagatg

SEQ ID NO: 9585 - DNA, 103 bp, Artificial Sequence
  Synthetic Polynucleotide
taatacgactcactatagggtatccatttttaatctgcatttcaggtgtcaacagaggagagacaccatgaatgcagataacctggcggcagcgcaaaagatg

SEQ ID NO: 9586 - DNA, 103 bp, Artificial Sequence
  Synthetic Polynucleotide
taatacgactcactatagggcagtttatccatttttaatctgcatttcagaacagaggagactgaaaatgagattaaaaaacctggcggcagcgcaaaagatg

SEQ ID NO: 9587 - DNA, 103 bp, Artificial Sequence
  Synthetic Polynucleotide
taatacgactcactatagggaaaatcagtttatccatttttaatctgcataacagaggagaatgcagatgaaaaatggaaacctggcggcagcgcaaaagatg

SEQ ID NO: 9588 - DNA, 103 bp, Artificial Sequence
  Synthetic Polynucleotide
taatacgactcactatagggcttttaaaatcagtttatccatttttaatcaacagaggagagattaaatgtggataaacaacctggcggcagcgcaaaagatg

SEQ ID NO: 9589 - DNA, 103 bp, Artificial Sequence
  Synthetic Polynucleotide
taatacgactcactatagggcaatccttttgagaatctcttcgccaactgaacagaggagacagttgatgaagagattcaacctggcggcagcgcaaaagatg

SEQ ID NO: 9590 - DNA, 103 bp, Artificial Sequence
  Synthetic Polynucleotide
taatacgactcactatagggcatcccttttaaaatcagtttatccattttaacagaggagaaaaatgatgaaactgattaacctggcggcagcgcaaaagatg

SEQ ID NO: 9591 - DNA, 103 bp, Artificial Sequence
  Synthetic Polynucleotide
taatacgactcactatagggtatgacatcccttttaaaatcagtttatccaacagaggagaggataaatggattttaaaaacctggcggcagcgcaaaagatg

SEQ ID NO: 9592 - DNA, 103 bp, Artificial Sequence
  Synthetic Polynucleotide
taatacgactcactatagggttacatatgacatcccttttaaaatcagttaacagaggagaaactgaatgtaaaagggaaacctggcggcagcgcaaaagatg

SEQ ID NO: 9593 - DNA, 103 bp, Artificial Sequence
  Synthetic Polynucleotide
taatacgactcactataggggcacattacatatgacatcccttttaaaataacagaggagaattttaatggggatgtcaaacctggcggcagcgcaaaagatg

SEQ ID NO: 9594 - DNA, 103 bp, Artificial Sequence
  Synthetic Polynucleotide
taatacgactcactatagggcctgtgcacattacatatgacatcccttttaacagaggagaaaaaggatggtcatatgtaacctggcggcagcgcaaaagatg

SEQ ID NO: 9595 - DNA, 103 bp, Artificial Sequence
  Synthetic Polynucleotide
taatacgactcactatagggatgaccctgtgcacattacatatgacatccaacagaggagaggatgtatgatgtaatgtaacctggcggcagcgcaaaagatg

SEQ ID NO: 9596 - DNA, 103 bp, Artificial Sequence
  Synthetic Polynucleotide
taatacgactcactatagggcttgaatgaccctgtgcacattacatatgaaacagaggagatcatatatgatgtgcacaaacctggcggcagcgcaaaagatg

SEQ ID NO: 9597 - DNA, 103 bp, Artificial Sequence
  Synthetic Polynucleotide
taatacgactcactatagggtctaacttgaatgaccctgtgcacattacaaacagaggagatgtaatatgcacagggtcaacctggcggcagcgcaaaagatg

SEQ ID NO: 9598 - DNA, 103 bp, Artificial Sequence
  Synthetic Polynucleotide
taatacgactcactatagggccttctctaacttgaatgaccctgtgcacaaacagaggagatgtgcaatgggtcattcaaacctggcggcagcgcaaaagatg

SEQ ID NO: 9599 - DNA, 103 bp, Artificial Sequence
  Synthetic Polynucleotide
taatacgactcactatagggcacttccttctctaacttgaatgaccctgtaacagaggagaacagggatgttcaagttaaacctggcggcagcgcaaaagatg

SEQ ID NO: 9600 - DNA, 103 bp, Artificial Sequence
  Synthetic Polynucleotide
taatacgactcactataggggaaagcaatccttttgagaatctcttcgccaacagaggagaggcgaaatgattctcaaaaacctggcggcagcgcaaaagatg

SEQ ID NO: 9601 - DNA, 103 bp, Artificial Sequence
  Synthetic Polynucleotide
taatacgactcactatagggtcagccacttccttctctaacttgaatgacaacagaggagagtcattatggttagagaaaacctggcggcagcgcaaaagatg

SEQ ID NO: 9602 - DNA, 103 bp, Artificial Sequence
  Synthetic Polynucleotide
taatacgactcactataggggggtctcagccacttccttctctaacttgaaacagaggagatcaagtatgagaaggaagaacctggcggcagcgcaaaagatg

SEQ ID NO: 9603 - DNA, 103 bp, Artificial Sequence
  Synthetic Polynucleotide
taatacgactcactatagggatgctgggtctcagccacttccttctctaaaacagaggagattagagatggaagtggctaacctggcggcagcgcaaaagatg

SEQ ID NO: 9604 - DNA, 103 bp, Artificial Sequence
  Synthetic Polynucleotide
taatacgactcactataggggttccatgctgggtctcagccacttccttcaacagaggagagaaggaatgggctgagacaacctggcggcagcgcaaaagatg

SEQ ID NO: 9605 - DNA, 103 bp, Artificial Sequence
  Synthetic Polynucleotide
taatacgactcactataggggaacagttccatgctgggtctcagccacttaacagaggagaaagtggatgagacccagcaacctggcggcagcgcaaaagatg

SEQ ID NO: 9606 - DNA, 103 bp, Artificial Sequence
  Synthetic Polynucleotide
taatacgactcactatagggcactagaacagttccatgctgggtctcagcaacagaggagagctgagatgcagcatggaaacctggcggcagcgcaaaagatg

SEQ ID NO: 9607 - DNA, 103 bp, Artificial Sequence
  Synthetic Polynucleotide
taatacgactcactatagggacctgcactagaacagttccatgctgggtcaacagaggagagacccaatgtggaactgtaacctggcggcagcgcaaaagatg

SEQ ID NO: 9608 - DNA, 103 bp, Artificial Sequence
  Synthetic Polynucleotide
taatacgactcactatagggatttaacctgcactagaacagttccatgctaacagaggagaagcatgatgctgttctagaacctggcggcagcgcaaaagatg

SEQ ID NO: 9609 - DNA, 103 bp, Artificial Sequence
  Synthetic Polynucleotide
taatacgactcactatagggttcgtatttaacctgcactagaacagttccaacagaggagaggaactatgctagtgcagaacctggcggcagcgcaaaagatg

SEQ ID NO: 9610 - DNA, 103 bp, Artificial Sequence
  Synthetic Polynucleotide
taatacgactcactataggggttccttcgtatttaacctgcactagaacaaacagaggagatgttctatggcaggttaaaacctggcggcagcgcaaaagatg

SEQ ID NO: 9611 - DNA, 103 bp, Artificial Sequence
  Synthetic Polynucleotide
taatacgactcactatagggggcctgaaagcaatccttttgagaatctctaacagaggagaagagatatgcaaaaggataacctggcggcagcgcaaaagatg

SEQ ID NO: 9612 - DNA, 103 bp, Artificial Sequence
  Synthetic Polynucleotide
taatacgactcactatagggcatctgttccttcgtatttaacctgcactaaacagaggagatagtgcatgttaaatacgaacctggcggcagcgcaaaagatg

SEQ ID NO: 9613 - DNA, 103 bp, Artificial Sequence
  Synthetic Polynucleotide
taatacgactcactatagggtggtgcatctgttccttcgtatttaacctgaacagaggagacaggttatgtacgaaggaaacctggcggcagcgcaaaagatg

SEQ ID NO: 9614 - DNA, 103 bp, Artificial Sequence
  Synthetic Polynucleotide
taatacgactcactatagggttgcatggtgcatctgttccttcgtatttaaacagaggagataaataatgaggaacagaaacctggcggcagcgcaaaagatg

SEQ ID NO: 9615 - DNA, 103 bp, Artificial Sequence
  Synthetic Polynucleotide
taatacgactcactatagggggatcttgcatggtgcatctgttccttcgtaacagaggagaacgaagatgcagatgcacaacctggcggcagcgcaaaagatg

SEQ ID NO: 9616 - DNA, 103 bp, Artificial Sequence
  Synthetic Polynucleotide
taatacgactcactataggggaaggggatcttgcatggtgcatctgttccaacagaggagaggaacaatggcaccatgcaacctggcggcagcgcaaaagatg

SEQ ID NO: 9617 - DNA, 103 bp, Artificial Sequence
  Synthetic Polynucleotide
taatacgactcactataggggacgagaaggggatcttgcatggtgcatctaacagaggagaagatgcatgatgcaagataacctggcggcagcgcaaaagatg

SEQ ID NO: 9618 - DNA, 103 bp, Artificial Sequence
  Synthetic Polynucleotide
taatacgactcactatagggcttgggacgagaaggggatcttgcatggtgaacagaggagacaccatatgagatcccctaacctggcggcagcgcaaaagatg

SEQ ID NO: 9619 - DNA, 103 bp, Artificial Sequence
  Synthetic Polynucleotide
taatacgactcactatagggctcatcttgggacgagaaggggatcttgcaaacagaggagatgcaagatgcccttctcgaacctggcggcagcgcaaaagatg

SEQ ID NO: 9620 - DNA, 103 bp, Artificial Sequence
  Synthetic Polynucleotide
taatacgactcactatagggcccttctcatcttgggacgagaaggggatcaacagaggagagatcccatgctcgtcccaaacctggcggcagcgcaaaagatg

SEQ ID NO: 9621 - DNA, 103 bp, Artificial Sequence
  Synthetic Polynucleotide
taatacgactcactatagggttactcccttctcatcttgggacgagaaggaacagaggagaccttctatgcccaagatgaacctggcggcagcgcaaaagatg

SEQ ID NO: 9622 - DNA, 103 bp, Artificial Sequence
  Synthetic Polynucleotide
taatacgactcactatagggtccttggcctgaaagcaatccttttgagaaaacagaggagattctcaatgggattgcttaacctggcggcagcgcaaaagatg

SEQ ID NO: 9623 - DNA, 103 bp, Artificial Sequence
  Synthetic Polynucleotide
taatacgactcactatagggctgggttactcccttctcatcttgggacgaaacagaggagatcgtccatggatgagaagaacctggcggcagcgcaaaagatg

SEQ ID NO: 9624 - DNA, 103 bp, Artificial Sequence
  Synthetic Polynucleotide
taatacgactcactatagggccattctgggttactcccttctcatcttggaacagaggagaccaagaatggaagggagtaacctggcggcagcgcaaaagatg

SEQ ID NO: 9625 - DNA, 103 bp, Artificial Sequence
  Synthetic Polynucleotide
taatacgactcactatagggatctcccattctgggttactcccttctcataacagaggagaatgagaatggagtaacccaacctggcggcagcgcaaaagatg

SEQ ID NO: 9626 - DNA, 103 bp, Artificial Sequence
  Synthetic Polynucleotide
taatacgactcactatagggtatcaatctcccattctgggttactcccttaacagaggagaaagggaatgacccagaataacctggcggcagcgcaaaagatg

SEQ ID NO: 9627 - DNA, 103 bp, Artificial Sequence
  Synthetic Polynucleotide
taatacgactcactataggggctgttatcaatctcccattctgggttactaacagaggagaagtaacatggaatgggagaacctggcggcagcgcaaaagatg

SEQ ID NO: 9628 - DNA, 103 bp, Artificial Sequence
  Synthetic Polynucleotide
taatacgactcactatagggggttggctgttatcaatctcccattctgggaacagaggagacccagaatgggagattgaaacctggcggcagcgcaaaagatg

SEQ ID NO: 9629 - DNA, 103 bp, Artificial Sequence
  Synthetic Polynucleotide
taatacgactcactatagggtatggggttggctgttatcaatctcccattaacagaggagaaatgggatgttgataacaaacctggcggcagcgcaaaagatg

SEQ ID NO: 9630 - DNA, 103 bp, Artificial Sequence
  Synthetic Polynucleotide
taatacgactcactataggggtgactatggggttggctgttatcaatctcaacagaggagagagattatgaacagccaaaacctggcggcagcgcaaaagatg

SEQ ID NO: 9631 - DNA, 103 bp, Artificial Sequence
  Synthetic Polynucleotide
taatacgactcactatagggtgtcagtgactatggggttggctgttatcaaacagaggagatgataaatgccaaccccaaacctggcggcagcgcaaaagatg

SEQ ID NO: 9632 - DNA, 103 bp, Artificial Sequence
  Synthetic Polynucleotide
taatacgactcactatagggttctttgtcagtgactatggggttggctgtaacagaggagaacagccatgcccatagtcaacctggcggcagcgcaaaagatg

SEQ ID NO: 9633 - DNA, 103 bp, Artificial Sequence
  Synthetic Polynucleotide
taatacgactcactatagggttccgattcgaaactgttcttgtcggtccaaacagaggagatggaccatgaagaacagtaacctggcggcagcgcaaaagatg

SEQ ID NO: 9634 - DNA, 103 bp, Artificial Sequence
  Synthetic Polynucleotide
taatacgactcactatagggatgggtccttggcctgaaagcaatccttttaacagaggagaaaaaggatggctttcaggaacctggcggcagcgcaaaagatg

SEQ ID NO: 9635 - DNA, 103 bp, Artificial Sequence
  Synthetic Polynucleotide
taatacgactcactatagggggtttttctttgtcagtgactatggggttgaacagaggagacaacccatgagtcactgaaacctggcggcagcgcaaaagatg

SEQ ID NO: 9636 - DNA, 103 bp, Artificial Sequence
  Synthetic Polynucleotide
taatacgactcactatagggtgactggtttttctttgtcagtgactatggaacagaggagaccatagatgctgacaaagaacctggcggcagcgcaaaagatg

SEQ ID NO: 9637 - DNA, 103 bp, Artificial Sequence
  Synthetic Polynucleotide
taatacgactcactatagggaatgttgactggtttttctttgtcagtgacaacagaggagagtcactatgaaagaaaaaaacctggcggcagcgcaaaagatg

SEQ ID NO: 9638 - DNA, 103 bp, Artificial Sequence
  Synthetic Polynucleotide
taatacgactcactataggggcttcaatgttgactggtttttctttgtcaaacagaggagatgacaaatgaaaaccagtaacctggcggcagcgcaaaagatg

SEQ ID NO: 9639 - DNA, 103 bp, Artificial Sequence
  Synthetic Polynucleotide
taatacgactcactataggggctccgcttcaatgttgactggtttttcttaacagaggagaaagaaaatgcagtcaacaaacctggcggcagcgcaaaagatg

SEQ ID NO: 9640 - DNA, 103 bp, Artificial Sequence
  Synthetic Polynucleotide
taatacgactcactatagggaggtggctccgcttcaatgttgactggtttaacagaggagaaaaccaatgaacattgaaaacctggcggcagcgcaaaagatg

SEQ ID NO: 9641 - DNA, 103 bp, Artificial Sequence
  Synthetic Polynucleotide
taatacgactcactatagggccaaaaggtggctccgcttcaatgttgactaacagaggagaagtcaaatgtgaagcggaaacctggcggcagcgcaaaagatg

SEQ ID NO: 9642 - DNA, 103 bp, Artificial Sequence
  Synthetic Polynucleotide
taatacgactcactatagggtctcaccaaaaggtggctccgcttcaatgtaacagaggagaacattgatgcggagccacaacctggcggcagcgcaaaagatg

SEQ ID NO: 9643 - DNA, 103 bp, Artificial Sequence
  Synthetic Polynucleotide
taatacgactcactataggggtagctctcaccaaaaggtggctccgcttcaacagaggagagaagcgatgccaccttttaacctggcggcagcgcaaaagatg

SEQ ID NO: 9644 - DNA, 103 bp, Artificial Sequence
  Synthetic Polynucleotide
taatacgactcactatagggacaatgtagctctcaccaaaaggtggctccaacagaggagaggagccatgttttggtgaaacctggcggcagcgcaaaagatg

SEQ ID NO: 9645 - DNA, 103 bp, Artificial Sequence
  Synthetic Polynucleotide
taatacgactcactatagggatttcatgggtccttggcctgaaagcaatcaacagaggagagattgcatgcaggccaagaacctggcggcagcgcaaaagatg

SEQ ID NO: 9646 - DNA, 103 bp, Artificial Sequence
  Synthetic Polynucleotide
taatacgactcactatagggctaccacaatgtagctctcaccaaaaggtgaacagaggagacaccttatggtgagagctaacctggcggcagcgcaaaagatg

SEQ ID NO: 9647 - DNA, 103 bp, Artificial Sequence
  Synthetic Polynucleotide
taatacgactcactatagggtgctcctaccacaatgtagctctcaccaaaaacagaggagatttggtatgagctacattaacctggcggcagcgcaaaagatg

SEQ ID NO: 9648 - DNA, 103 bp, Artificial Sequence
  Synthetic Polynucleotide
taatacgactcactatagggtcacctgctcctaccacaatgtagctctcaaacagaggagatgagagatgcattgtggtaacctggcggcagcgcaaaagatg

SEQ ID NO: 9649 - DNA, 103 bp, Artificial Sequence
  Synthetic Polynucleotide
taatacgactcactatagggctttttcacctgctcctaccacaatgtagcaacagaggagagctacaatgtggtaggagaacctggcggcagcgcaaaagatg

SEQ ID NO: 9650 - DNA, 103 bp, Artificial Sequence
  Synthetic Polynucleotide
taatacgactcactatagggcaaagctttttcacctgctcctaccacaataacagaggagaattgtgatgggagcaggtaacctggcggcagcgcaaaagatg

SEQ ID NO: 9651 - DNA, 103 bp, Artificial Sequence
  Synthetic Polynucleotide
taatacgactcactatagggagtttcaaagctttttcacctgctcctaccaacagaggagaggtaggatgaggtgaaaaaacctggcggcagcgcaaaagatg

SEQ ID NO: 9652 - DNA, 103 bp, Artificial Sequence
  Synthetic Polynucleotide
taatacgactcactatagggagcttagtttcaaagctttttcacctgctcaacagaggagagagcagatgaaaaagcttaacctggcggcagcgcaaaagatg

SEQ ID NO: 9653 - DNA, 103 bp, Artificial Sequence
  Synthetic Polynucleotide
taatacgactcactataggggaaccagcttagtttcaaagctttttcaccaacagaggagaggtgaaatggctttgaaaaacctggcggcagcgcaaaagatg

SEQ ID NO: 9654 - DNA, 103 bp, Artificial Sequence
  Synthetic Polynucleotide
taatacgactcactatagggttcttgaaccagcttagtttcaaagcttttaacagaggagaaaaagcatggaaactaagaacctggcggcagcgcaaaagatg

SEQ ID NO: 9655 - DNA, 103 bp, Artificial Sequence
  Synthetic Polynucleotide
taatacgactcactatagggttcccttcttgaaccagcttagtttcaaagaacagaggagactttgaatgtaagctggtaacctggcggcagcgcaaaagatg

SEQ ID NO: 9656 - DNA, 103 bp, Artificial Sequence
  Synthetic Polynucleotide
taatacgactcactatagggcaccaatttcatgggtccttggcctgaaagaacagaggagactttcaatgcaaggacccaacctggcggcagcgcaaaagatg

SEQ ID NO: 9657 - DNA, 103 bp, Artificial Sequence
  Synthetic Polynucleotide
taatacgactcactatagggactgcttcccttcttgaaccagcttagtttaacagaggagaaaactaatgtggttcaagaacctggcggcagcgcaaaagatg

SEQ ID NO: 9658 - DNA, 103 bp, Artificial Sequence
  Synthetic Polynucleotide
taatacgactcactatagggcctatactgcttcccttcttgaaccagcttaacagaggagaaagctgatgcaagaagggaacctggcggcagcgcaaaagatg

SEQ ID NO: 9659 - DNA, 103 bp, Artificial Sequence
  Synthetic Polynucleotide
taatacgactcactatagggttttccctatactgcttcccttcttgaaccaacagaggagaggttcaatgagggaagcaaacctggcggcagcgcaaaagatg

SEQ ID NO: 9660 - DNA, 103 bp, Artificial Sequence
  Synthetic Polynucleotide
taatacgactcactatagggaaacattttccctatactgcttcccttcttaacagaggagaaagaagatgagcagtataaacctggcggcagcgcaaaagatg

SEQ ID NO: 9661 - DNA, 103 bp, Artificial Sequence
  Synthetic Polynucleotide
taatacgactcactataggggcttcaaacattttccctatactgcttcccaacagaggagagggaagatgtatagggaaaacctggcggcagcgcaaaagatg

SEQ ID NO: 9662 - DNA, 103 bp, Artificial Sequence
  Synthetic Polynucleotide
taatacgactcactatagggcagttgcttcaaacattttccctatactgcaacagaggagagcagtaatgggaaaatgtaacctggcggcagcgcaaaagatg

SEQ ID NO: 9663 - DNA, 103 bp, Artificial Sequence
  Synthetic Polynucleotide
taatacgactcactatagggacgggcagttgcttcaaacattttccctataacagaggagaatagggatgatgtttgaaaacctggcggcagcgcaaaagatg

SEQ ID NO: 9664 - DNA, 103 bp, Artificial Sequence
  Synthetic Polynucleotide
taatacgactcactataggggctccacgggcagttgcttcaaacattttcaacagaggagagaaaatatgtgaagcaacaacctggcggcagcgcaaaagatg

SEQ ID NO: 9665 - DNA, 103 bp, Artificial Sequence
  Synthetic Polynucleotide
taatacgactcactatagggttcgtgctccacgggcagttgcttcaaacaaacagaggagatgtttgatgcaactgcccaacctggcggcagcgcaaaagatg

SEQ ID NO: 9666 - DNA, 103 bp, Artificial Sequence
  Synthetic Polynucleotide
taatacgactcactatagggcatccttcgtgctccacgggcagttgcttcaacagaggagagaagcaatggcccgtggaaacctggcggcagcgcaaaagatg

SEQ ID NO: 9667 - DNA, 103 bp, Artificial Sequence
  Synthetic Polynucleotide
taatacgactcactataggggccatcaccaatttcatgggtccttggcctaacagaggagaaggccaatgacccatgaaaacctggcggcagcgcaaaagatg

SEQ ID NO: 9668 - DNA, 103 bp, Artificial Sequence
  Synthetic Polynucleotide
taatacgactcactatagggatggccatccttcgtgctccacgggcagttaacagaggagaaactgcatgtggagcacgaacctggcggcagcgcaaaagatg

SEQ ID NO: 9669 - DNA, 103 bp, Artificial Sequence
  Synthetic Polynucleotide
taatacgactcactatagggccaggatggccatccttcgtgctccacgggaacagaggagacccgtgatgcacgaaggaaacctggcggcagcgcaaaagatg

SEQ ID NO: 9670 - DNA, 103 bp, Artificial Sequence
  Synthetic Polynucleotide
taatacgactcactataggggtctcccaggatggccatccttcgtgctccaacagaggagaggagcaatgaggatggccaacctggcggcagcgcaaaagatg

SEQ ID NO: 9671 - DNA, 103 bp, Artificial Sequence
  Synthetic Polynucleotide
taatacgactcactataggggcagtgtctcccaggatggccatccttcgtaacagaggagaacgaagatgggccatcctaacctggcggcagcgcaaaagatg

SEQ ID NO: 9672 - DNA, 103 bp, Artificial Sequence
  Synthetic Polynucleotide
taatacgactcactatagggcccatgcagtgtctcccaggatggccatccaacagaggagaggatggatgtcctgggagaacctggcggcagcgcaaaagatg

SEQ ID NO: 9673 - DNA, 103 bp, Artificial Sequence
  Synthetic Polynucleotide
taatacgactcactataggggaagtcccatgcagtgtctcccaggatggcaacagaggagagccatcatgggagacactaacctggcggcagcgcaaaagatg

SEQ ID NO: 9674 - DNA, 103 bp, Artificial Sequence
  Synthetic Polynucleotide
taatacgactcactataggggaaccgaagtcccatgcagtgtctcccaggaacagaggagacctgggatgcactgcatgaacctggcggcagcgcaaaagatg

SEQ ID NO: 9675 - DNA, 103 bp, Artificial Sequence
  Synthetic Polynucleotide
taatacgactcactatagggctatagaaccgaagtcccatgcagtgtctcaacagaggagagagacaatgcatgggactaacctggcggcagcgcaaaagatg

SEQ ID NO: 9676 - DNA, 103 bp, Artificial Sequence
  Synthetic Polynucleotide
taatacgactcactatagggccctcctatagaaccgaagtcccatgcagtaacagaggagaactgcaatggacttcggtaacctggcggcagcgcaaaagatg

SEQ ID NO: 9677 - DNA, 103 bp, Artificial Sequence
  Synthetic Polynucleotide
taatacgactcactatagggaacacccctcctatagaaccgaagtcccataacagaggagaatgggaatgcggttctataacctggcggcagcgcaaaagatg

SEQ ID NO: 9678 - DNA, 103 bp, Artificial Sequence
  Synthetic Polynucleotide
taatacgactcactatagggtaaaagccatcaccaatttcatgggtccttaacagaggagaaaggacatgtgaaattggaacctggcggcagcgcaaaagatg

SEQ ID NO: 9679 - DNA, 103 bp, Artificial Sequence
  Synthetic Polynucleotide
taatacgactcactatagggacgtgaacacccctcctatagaaccgaagtaacagaggagaacttcgatgctataggagaacctggcggcagcgcaaaagatg

SEQ ID NO: 9680 - DNA, 103 bp, Artificial Sequence
  Synthetic Polynucleotide
taatacgactcactatagggcacagacgtgaacacccctcctatagaaccaacagaggagaggttctatgggaggggtgaacctggcggcagcgcaaaagatg

SEQ ID NO: 9681 - DNA, 103 bp, Artificial Sequence
  Synthetic Polynucleotide
taatacgactcactatagggtttcccacagacgtgaacacccctcctataaacagaggagatataggatgggtgttcacaacctggcggcagcgcaaaagatg

SEQ ID NO: 9682 - DNA, 103 bp, Artificial Sequence
  Synthetic Polynucleotide
taatacgactcactatagggtcagttttcccacagacgtgaacacccctcaacagaggagagaggggatgtcacgtctgaacctggcggcagcgcaaaagatg

SEQ ID NO: 9683 - DNA, 103 bp, Artificial Sequence
  Synthetic Polynucleotide
taatacgactcactataggggtgtatcagttttcccacagacgtgaacacaacagaggagagtgttcatgtctgtgggaaacctggcggcagcgcaaaagatg

SEQ ID NO: 9684 - DNA, 103 bp, Artificial Sequence
  Synthetic Polynucleotide
taatacgactcactatagggatctggtgtatcagttttcccacagacgtgaacagaggagacacgtcatggggaaaactaacctggcggcagcgcaaaagatg

SEQ ID NO: 9685 - DNA, 103 bp, Artificial Sequence
  Synthetic Polynucleotide
taatacgactcactatagggcaaaaatctggtgtatcagttttcccacagaacagaggagactgtggatgaactgatacaacctggcggcagcgcaaaagatg

SEQ ID NO: 9686 - DNA, 103 bp, Artificial Sequence
  Synthetic Polynucleotide
taatacgactcactatagggagtcccaaaaatctggtgtatcagttttccaacagaggagaggaaaaatgatacaccagaacctggcggcagcgcaaaagatg

SEQ ID NO: 9687 - DNA, 103 bp, Artificial Sequence
  Synthetic Polynucleotide
taatacgactcactatagggtacgcagtcccaaaaatctggtgtatcagtaacagaggagaactgatatgccagattttaacctggcggcagcgcaaaagatg

SEQ ID NO: 9688 - DNA, 103 bp, Artificial Sequence
  Synthetic Polynucleotide
taatacgactcactatagggctccatacgcagtcccaaaaatctggtgtaaacagaggagatacaccatgtttttgggaaacctggcggcagcgcaaaagatg

SEQ ID NO: 9689 - DNA, 103 bp, Artificial Sequence
  Synthetic Polynucleotide
taatacgactcactatagggtgctataaaagccatcaccaatttcatgggaacagaggagacccatgatgttggtgatgaacctggcggcagcgcaaaagatg

SEQ ID NO: 9690 - DNA, 103 bp, Artificial Sequence
  Synthetic Polynucleotide
taatacgactcactatagggcaaaactccatacgcagtcccaaaaatctgaacagaggagacagattatggggactgcgaacctggcggcagcgcaaaagatg

SEQ ID NO: 9691 - DNA, 103 bp, Artificial Sequence
  Synthetic Polynucleotide
taatacgactcactatagggctgaacaaaactccatacgcagtcccaaaaaacagaggagattttggatgtgcgtatggaacctggcggcagcgcaaaagatg

SEQ ID NO: 9692 - DNA, 103 bp, Artificial Sequence
  Synthetic Polynucleotide
taatacgactcactatagggcaccgctgaacaaaactccatacgcagtccaacagaggagaggactgatgatggagtttaacctggcggcagcgcaaaagatg

SEQ ID NO: 9693 - DNA, 103 bp, Artificial Sequence
  Synthetic Polynucleotide
taatacgactcactatagggagaaacaccgctgaacaaaactccatacgcaacagaggagagcgtatatggttttgttcaacctggcggcagcgcaaaagatg

SEQ ID NO: 9694 - DNA, 103 bp, Artificial Sequence
  Synthetic Polynucleotide
taatacgactcactataggggtccaagaaacaccgctgaacaaaactccaaacagaggagatggagtatggttcagcggaacctggcggcagcgcaaaagatg

SEQ ID NO: 9695 - DNA, 103 bp, Artificial Sequence
  Synthetic Polynucleotide
taatacgactcactatagggtcatggtccaagaaacaccgctgaacaaaaaacagaggagattttgtatggcggtgtttaacctggcggcagcgcaaaagatg

SEQ ID NO: 9696 - DNA, 103 bp, Artificial Sequence
  Synthetic Polynucleotide
taatacgactcactatagggtatcttcatggtccaagaaacaccgctgaaaacagaggagattcagcatggtttcttggaacctggcggcagcgcaaaagatg

SEQ ID NO: 9697 - DNA, 103 bp, Artificial Sequence
  Synthetic Polynucleotide
taatacgactcactatagggattcctatcttcatggtccaagaaacaccgaacagaggagacggtgtatgttggaccataacctggcggcagcgcaaaagatg

SEQ ID NO: 9698 - DNA, 103 bp, Artificial Sequence
  Synthetic Polynucleotide
taatacgactcactatagggtccctattcctatcttcatggtccaagaaaaacagaggagatttcttatgccatgaagaaacctggcggcagcgcaaaagatg

SEQ ID NO: 9699 - DNA, 103 bp, Artificial Sequence
  Synthetic Polynucleotide
taatacgactcactatagggcagaatccctattcctatcttcatggtccaaacagaggagatggaccatgaagataggaaacctggcggcagcgcaaaagatg

SEQ ID NO: 9700 - DNA, 103 bp, Artificial Sequence
  Synthetic Polynucleotide
taatacgactcactatagggaggaatgctataaaagccatcaccaatttcaacagaggagagaaattatggatggctttaacctggcggcagcgcaaaagatg

SEQ ID NO: 9701 - DNA, 103 bp, Artificial Sequence
  Synthetic Polynucleotide
taatacgactcactataggggtcagcagaatccctattcctatcttcatgaacagaggagacatgaaatgaggaataggaacctggcggcagcgcaaaagatg

SEQ ID NO: 9702 - DNA, 103 bp, Artificial Sequence
  Synthetic Polynucleotide
taatacgactcactataggggccatgtcagcagaatccctattcctatctaacagaggagaagatagatgtagggattcaacctggcggcagcgcaaaagatg

SEQ ID NO: 9703 - DNA, 103 bp, Artificial Sequence
  Synthetic Polynucleotide
taatacgactcactatagggtcctagccatgtcagcagaatccctattccaacagaggagaggaataatgattctgctgaacctggcggcagcgcaaaagatg

SEQ ID NO: 9704 - DNA, 103 bp, Artificial Sequence
  Synthetic Polynucleotide
taatacgactcactatagggtttaatcctagccatgtcagcagaatccctaacagaggagaagggatatggctgacatgaacctggcggcagcgcaaaagatg

SEQ ID NO: 9705 - DNA, 103 bp, Artificial Sequence
  Synthetic Polynucleotide
taatacgactcactatagggttgagtttaatcctagccatgtcagcagaaaacagaggagattctgcatgcatggctagaacctggcggcagcgcaaaagatg

SEQ ID NO: 9706 - DNA, 103 bp, Artificial Sequence
  Synthetic Polynucleotide
taatacgactcactataggggctccttgagtttaatcctagccatgtcagaacagaggagactgacaatgctaggattaaacctggcggcagcgcaaaagatg

SEQ ID NO: 9707 - DNA, 103 bp, Artificial Sequence
  Synthetic Polynucleotide
taatacgactcactataggggacgtgctccttgagtttaatcctagccataacagaggagaatggctatgattaaactcaacctggcggcagcgcaaaagatg

SEQ ID NO: 9708 - DNA, 103 bp, Artificial Sequence
  Synthetic Polynucleotide
taatacgactcactatagggaaagggacgtgctccttgagtttaatcctaaacagaggagataggatatgactcaaggaaacctggcggcagcgcaaaagatg

SEQ ID NO: 9709 - DNA, 103 bp, Artificial Sequence
  Synthetic Polynucleotide
taatacgactcactatagggcattgaaagggacgtgctccttgagtttaaaacagaggagattaaacatgaggagcacgaacctggcggcagcgcaaaagatg

SEQ ID NO: 9710 - DNA, 103 bp, Artificial Sequence
  Synthetic Polynucleotide
taatacgactcactatagggcacgtcattgaaagggacgtgctccttgagaacagaggagactcaagatgcacgtccctaacctggcggcagcgcaaaagatg

SEQ ID NO: 9711 - DNA, 103 bp, Artificial Sequence
  Synthetic Polynucleotide
taatacgactcactatagggatcttaggaatgctataaaagccatcaccaaacagaggagatggtgaatgcttttatagaacctggcggcagcgcaaaagatg

SEQ ID NO: 9712 - DNA, 103 bp, Artificial Sequence
  Synthetic Polynucleotide
taatacgactcactatagggcgatacacgtcattgaaagggacgtgctccaacagaggagaggagcaatgccctttcaaaacctggcggcagcgcaaaagatg

SEQ ID NO: 9713 - DNA, 103 bp, Artificial Sequence
  Synthetic Polynucleotide
taatacgactcactatagggaactgcgatacacgtcattgaaagggacgtaacagaggagaacgtccatgtcaatgacgaacctggcggcagcgcaaaagatg

SEQ ID NO: 9714 - DNA, 103 bp, Artificial Sequence
  Synthetic Polynucleotide
taatacgactcactatagggatgccaactgcgatacacgtcattgaaaggaacagaggagacctttcatggacgtgtataacctggcggcagcgcaaaagatg

SEQ ID NO: 9715 - DNA, 103 bp, Artificial Sequence
  Synthetic Polynucleotide
taatacgactcactatagggtgaccatgccaactgcgatacacgtcattgaacagaggagacaatgaatggtatcgcagaacctggcggcagcgcaaaagatg

SEQ ID NO: 9716 - DNA, 103 bp, Artificial Sequence
  Synthetic Polynucleotide
taatacgactcactatagggcagtgtgaccatgccaactgcgatacacgtaacagaggagaacgtgtatggcagttggcaacctggcggcagcgcaaaagatg

SEQ ID NO: 9717 - DNA, 103 bp, Artificial Sequence
  Synthetic Polynucleotide
taatacgactcactatagggaggtacagtgtgaccatgccaactgcgataaacagaggagatatcgcatgtggcatggtaacctggcggcagcgcaaaagatg

SEQ ID NO: 9718 - DNA, 103 bp, Artificial Sequence
  Synthetic Polynucleotide
taatacgactcactatagggctcctaggtacagtgtgaccatgccaactgaacagaggagacagttgatgtggtcacacaacctggcggcagcgcaaaagatg

SEQ ID NO: 9719 - DNA, 103 bp, Artificial Sequence
  Synthetic Polynucleotide
taatacgactcactatagggcatgactcctaggtacagtgtgaccatgccaacagaggagaggcatgatgacactgtacaacctggcggcagcgcaaaagatg

SEQ ID NO: 9720 - DNA, 103 bp, Artificial Sequence
  Synthetic Polynucleotide
taatacgactcactatagggtgaaccatgactcctaggtacagtgtgaccaacagaggagaggtcacatggtacctaggaacctggcggcagcgcaaaagatg

SEQ ID NO: 9721 - DNA, 103 bp, Artificial Sequence
  Synthetic Polynucleotide
taatacgactcactatagggccgcctgaaccatgactcctaggtacagtgaacagaggagacactgtatgtaggagtcaaacctggcggcagcgcaaaagatg

SEQ ID NO: 9722 - DNA, 103 bp, Artificial Sequence
  Synthetic Polynucleotide
taatacgactcactatagggtagaaatcttaggaatgctataaaagccataacagaggagaatggctatgatagcattcaacctggcggcagcgcaaaagatg

SEQ ID NO: 9723 - DNA, 103 bp, Artificial Sequence
  Synthetic Polynucleotide
taatacgactcactatagggcgagtccgcctgaaccatgactcctaggtaaacagaggagatacctaatggtcatggttaacctggcggcagcgcaaaagatg

SEQ ID NO: 9724 - DNA, 103 bp, Artificial Sequence
  Synthetic Polynucleotide
taatacgactcactatagggcatcccgagtccgcctgaaccatgactcctaacagaggagaaggagtatgggttcaggcaacctggcggcagcgcaaaagatg

SEQ ID NO: 9725 - DNA, 103 bp, Artificial Sequence
  Synthetic Polynucleotide
taatacgactcactatagggttacacatcccgagtccgcctgaaccatgaaacagaggagatcatggatgaggcggactaacctggcggcagcgcaaaagatg

SEQ ID NO: 9726 - DNA, 103 bp, Artificial Sequence
  Synthetic Polynucleotide
taatacgactcactataggggttgattacacatcccgagtccgcctgaacaacagaggagagttcagatggactcgggaaacctggcggcagcgcaaaagatg

SEQ ID NO: 9727 - DNA, 103 bp, Artificial Sequence
  Synthetic Polynucleotide
taatacgactcactatagggttccagttgattacacatcccgagtccgccaacagaggagaggcggaatggggatgtgtaacctggcggcagcgcaaaagatg

SEQ ID NO: 9728 - DNA, 103 bp, Artificial Sequence
  Synthetic Polynucleotide
taatacgactcactatagggtgcctttccagttgattacacatcccgagtaacagaggagaactcggatggtgtaatcaaacctggcggcagcgcaaaagatg

SEQ ID NO: 9729 - DNA, 103 bp, Artificial Sequence
  Synthetic Polynucleotide
taatacgactcactatagggttctctgcctttccagttgattacacatccaacagaggagaggatgtatgatcaactggaacctggcggcagcgcaaaagatg

SEQ ID NO: 9730 - DNA, 103 bp, Artificial Sequence
  Synthetic Polynucleotide
taatacgactcactatagggttgagttctctgcctttccagttgattacaaacagaggagatgtaatatgctggaaaggaacctggcggcagcgcaaaagatg

SEQ ID NO: 9731 - DNA, 103 bp, Artificial Sequence
  Synthetic Polynucleotide
taatacgactcactatagggcacatttgagttctctgcctttccagttgaaacagaggagatcaactatgaaggcagagaacctggcggcagcgcaaaagatg

SEQ ID NO: 9732 - DNA, 103 bp, Artificial Sequence
  Synthetic Polynucleotide
taatacgactcactataggggcttccacatttgagttctctgcctttccaaacagaggagatggaaaatgagagaactcaacctggcggcagcgcaaaagatg

SEQ ID NO: 9733 - DNA, 103 bp, Artificial Sequence
  Synthetic Polynucleotide
taatacgactcactatagggatggctagaaatcttaggaatgctataaaaaacagaggagattttatatgattcctaagaacctggcggcagcgcaaaagatg

SEQ ID NO: 9734 - DNA, 103 bp, Artificial Sequence
  Synthetic Polynucleotide
taatacgactcactatagggatgccgcttccacatttgagttctctgcctaacagaggagaaggcagatgactcaaatgaacctggcggcagcgcaaaagatg

SEQ ID NO: 9735 - DNA, 103 bp, Artificial Sequence
  Synthetic Polynucleotide
taatacgactcactatagggcaaaaatgccgcttccacatttgagttctcaacagaggagagagaacatgaatgtggaaaacctggcggcagcgcaaaagatg

SEQ ID NO: 9736 - DNA, 103 bp, Artificial Sequence
  Synthetic Polynucleotide
taatacgactcactatagggggtgacaaaaatgccgcttccacatttgagaacagaggagactcaaaatgggaagcggcaacctggcggcagcgcaaaagatg

SEQ ID NO: 9737 - DNA, 103 bp, Artificial Sequence
  Synthetic Polynucleotide
taatacgactcactatagggtcattggtgacaaaaatgccgcttccacataacagaggagaatgtggatgcggcattttaacctggcggcagcgcaaaagatg

SEQ ID NO: 9738 - DNA, 103 bp, Artificial Sequence
  Synthetic Polynucleotide
taatacgactcactatagggggacttcattggtgacaaaaatgccgcttcaacagaggagagaagcgatgtttttgtcaaacctggcggcagcgcaaaagatg

SEQ ID NO: 9739 - DNA, 103 bp, Artificial Sequence
  Synthetic Polynucleotide
taatacgactcactatagggggtgtggacttcattggtgacaaaaatgccaacagaggagaggcattatggtcaccaataacctggcggcagcgcaaaagatg

SEQ ID NO: 9740 - DNA, 103 bp, Artificial Sequence
  Synthetic Polynucleotide
taatacgactcactataggggtccaggtgtggacttcattggtgacaaaaaacagaggagattttgtatgcaatgaagtaacctggcggcagcgcaaaagatg

SEQ ID NO: 9741 - DNA, 103 bp, Artificial Sequence
  Synthetic Polynucleotide
taatacgactcactataggggctctgtccaggtgtggacttcattggtgaaacagaggagatcaccaatgaagtccacaaacctggcggcagcgcaaaagatg

SEQ ID NO: 9742 - DNA, 103 bp, Artificial Sequence
  Synthetic Polynucleotide
taatacgactcactatagggatattgctctgtccaggtgtggacttcattaacagaggagaaatgaaatgcacacctggaacctggcggcagcgcaaaagatg

SEQ ID NO: 9743 - DNA, 103 bp, Artificial Sequence
  Synthetic Polynucleotide
taatacgactcactatagggaatttatattgctctgtccaggtgtggactaacagaggagaagtccaatgctggacagaaacctggcggcagcgcaaaagatg

SEQ ID NO: 9744 - DNA, 103 bp, Artificial Sequence
  Synthetic Polynucleotide
taatacgactcactatagggcaagcttccgattcgaaactgttcttgtcgaacagaggagacgacaaatgcagtttcgaaacctggcggcagcgcaaaagatg

SEQ ID NO: 9745 - DNA, 103 bp, Artificial Sequence
  Synthetic Polynucleotide
taatacgactcactataggggaggtatggctagaaatcttaggaatgctaaacagaggagatagcatatgtaagatttcaacctggcggcagcgcaaaagatg

SEQ ID NO: 9746 - DNA, 103 bp, Artificial Sequence
  Synthetic Polynucleotide
taatacgactcactatagggcctggaatttatattgctctgtccaggtgtaacagaggagaacacctatgcagagcaataacctggcggcagcgcaaaagatg

SEQ ID NO: 9747 - DNA, 103 bp, Artificial Sequence
  Synthetic Polynucleotide
taatacgactcactataggggtcggcctggaatttatattgctctgtccaaacagaggagatggacaatgcaatataaaaacctggcggcagcgcaaaagatg

SEQ ID NO: 9748 - DNA, 103 bp, Artificial Sequence
  Synthetic Polynucleotide
taatacgactcactatagggggggagtcggcctggaatttatattgctctaacagaggagaagagcaatgtaaattccaaacctggcggcagcgcaaaagatg

SEQ ID NO: 9749 - DNA, 103 bp, Artificial Sequence
  Synthetic Polynucleotide
taatacgactcactatagggtcttaggggagtcggcctggaatttatattaacagaggagaaatataatgtccaggccgaacctggcggcagcgcaaaagatg

SEQ ID NO: 9750 - DNA, 103 bp, Artificial Sequence
  Synthetic Polynucleotide
taatacgactcactatagggtagtctcttaggggagtcggcctggaatttaacagaggagaaaattcatggccgactccaacctggcggcagcgcaaaagatg

SEQ ID NO: 9751 - DNA, 103 bp, Artificial Sequence
  Synthetic Polynucleotide
taatacgactcactataggggctgatagtctcttaggggagtcggcctggaacagaggagaccaggcatgctcccctaaaacctggcggcagcgcaaaagatg

SEQ ID NO: 9752 - DNA, 103 bp, Artificial Sequence
  Synthetic Polynucleotide
taatacgactcactatagggtggccgctgatagtctcttaggggagtcggaacagaggagaccgactatgctaagagacaacctggcggcagcgcaaaagatg

SEQ ID NO: 9753 - DNA, 103 bp, Artificial Sequence
  Synthetic Polynucleotide
taatacgactcactatagggcccaatggccgctgatagtctcttaggggaaacagaggagatcccctatgagactatcaaacctggcggcagcgcaaaagatg

SEQ ID NO: 9754 - DNA, 103 bp, Artificial Sequence
  Synthetic Polynucleotide
taatacgactcactataggggccttcccaatggccgctgatagtctcttaaacagaggagataagagatgatcagcggcaacctggcggcagcgcaaaagatg

SEQ ID NO: 9755 - DNA, 103 bp, Artificial Sequence
  Synthetic Polynucleotide
taatacgactcactatagggcccatgccttcccaatggccgctgatagtcaacagaggagagactatatgcggccattgaacctggcggcagcgcaaaagatg

SEQ ID NO: 9756 - DNA, 103 bp, Artificial Sequence
  Synthetic Polynucleotide
taatacgactcactatagggtgttggaggtatggctagaaatcttaggaaaacagaggagattcctaatgtttctagccaacctggcggcagcgcaaaagatg

SEQ ID NO: 9757 - DNA, 103 bp, Artificial Sequence
  Synthetic Polynucleotide
taatacgactcactatagggctcctcccatgccttcccaatggccgctgaaacagaggagatcagcgatgattgggaagaacctggcggcagcgcaaaagatg

SEQ ID NO: 9758 - DNA, 103 bp, Artificial Sequence
  Synthetic Polynucleotide
taatacgactcactatagggacaccctcctcccatgccttcccaatggccaacagaggagaggccatatggaaggcatgaacctggcggcagcgcaaaagatg

SEQ ID NO: 9759 - DNA, 103 bp, Artificial Sequence
  Synthetic Polynucleotide
taatacgactcactatagggcacacacaccctcctcccatgccttcccaaaacagaggagattgggaatgcatgggaggaacctggcggcagcgcaaaagatg

SEQ ID NO: 9760 - DNA, 103 bp, Artificial Sequence
  Synthetic Polynucleotide
taatacgactcactatagggaattccacacacaccctcctcccatgccttaacagaggagaaaggcaatggaggagggtaacctggcggcagcgcaaaagatg

SEQ ID NO: 9761 - DNA, 103 bp, Artificial Sequence
  Synthetic Polynucleotide
taatacgactcactataggggatcgaattccacacacaccctcctcccataacagaggagaatgggaatggggtgtgtgaacctggcggcagcgcaaaagatg

SEQ ID NO: 9762 - DNA, 103 bp, Artificial Sequence
  Synthetic Polynucleotide
taatacgactcactatagggtggctgatcgaattccacacacaccctcctaacagaggagaaggaggatgtgtgtggaaaacctggcggcagcgcaaaagatg

SEQ ID NO: 9763 - DNA, 103 bp, Artificial Sequence
  Synthetic Polynucleotide
taatacgactcactatagggacgagtggctgatcgaattccacacacaccaacagaggagaggtgtgatgggaattcgaaacctggcggcagcgcaaaagatg

SEQ ID NO: 9764 - DNA, 103 bp, Artificial Sequence
  Synthetic Polynucleotide
taatacgactcactatagggtcgagacgagtggctgatcgaattccacacaacagaggagagtgtggatgtcgatcagcaacctggcggcagcgcaaaagatg

SEQ ID NO: 9765 - DNA, 103 bp, Artificial Sequence
  Synthetic Polynucleotide
taatacgactcactatagggtgttctcgagacgagtggctgatcgaattcaacagaggagagaattcatgcagccactcaacctggcggcagcgcaaaagatg

SEQ ID NO: 9766 - DNA, 103 bp, Artificial Sequence
  Synthetic Polynucleotide
taatacgactcactatagggcatgatgttctcgagacgagtggctgatcgaacagaggagacgatcaatgactcgtctcaacctggcggcagcgcaaaagatg

SEQ ID NO: 9767 - DNA, 103 bp, Artificial Sequence
  Synthetic Polynucleotide
taatacgactcactatagggcctgctgttggaggtatggctagaaatcttaacagaggagaaagattatgagccataccaacctggcggcagcgcaaaagatg

SEQ ID NO: 9768 - DNA, 103 bp, Artificial Sequence
  Synthetic Polynucleotide
taatacgactcactatagggttccacatgatgttctcgagacgagtggctaacagaggagaagccacatgtctcgagaaaacctggcggcagcgcaaaagatg

SEQ ID NO: 9769 - DNA, 103 bp, Artificial Sequence
  Synthetic Polynucleotide
taatacgactcactatagggtttgcttccacatgatgttctcgagacgagaacagaggagactcgtcatgagaacatcaaacctggcggcagcgcaaaagatg

SEQ ID NO: 9770 - DNA, 103 bp, Artificial Sequence
  Synthetic Polynucleotide
taatacgactcactatagggtgatatttgcttccacatgatgttctcgagaacagaggagactcgagatgatcatgtggaacctggcggcagcgcaaaagatg

SEQ ID NO: 9771 - DNA, 103 bp, Artificial Sequence
  Synthetic Polynucleotide
taatacgactcactatagggtcatttgatatttgcttccacatgatgttcaacagaggagagaacatatggtggaagcaaacctggcggcagcgcaaaagatg

SEQ ID NO: 9772 - DNA, 103 bp, Artificial Sequence
  Synthetic Polynucleotide
taatacgactcactatagggttaattcatttgatatttgcttccacatgaaacagaggagatcatgtatgagcaaatataacctggcggcagcgcaaaagatg

SEQ ID NO: 9773 - DNA, 103 bp, Artificial Sequence
  Synthetic Polynucleotide
taatacgactcactataggggtggtttaattcatttgatatttgcttccaaacagaggagatggaagatgatatcaaataacctggcggcagcgcaaaagatg

SEQ ID NO: 9774 - DNA, 103 bp, Artificial Sequence
  Synthetic Polynucleotide
taatacgactcactatagggaagatgtggtttaattcatttgatatttgcaacagaggagagcaaatatgaaatgaattaacctggcggcagcgcaaaagatg

SEQ ID NO: 9775 - DNA, 103 bp, Artificial Sequence
  Synthetic Polynucleotide
taatacgactcactatagggcaagtaagatgtggtttaattcatttgataaacagaggagatatcaaatgaattaaaccaacctggcggcagcgcaaaagatg

SEQ ID NO: 9776 - DNA, 103 bp, Artificial Sequence
  Synthetic Polynucleotide
taatacgactcactatagggattttcaagtaagatgtggtttaattcattaacagaggagaaatgaaatgaaccacatcaacctggcggcagcgcaaaagatg

SEQ ID NO: 9777 - DNA, 103 bp, Artificial Sequence
  Synthetic Polynucleotide
taatacgactcactatagggatgtcattttcaagtaagatgtggtttaataacagaggagaattaaaatgcatcttactaacctggcggcagcgcaaaagatg

SEQ ID NO: 9778 - DNA, 103 bp, Artificial Sequence
  Synthetic Polynucleotide
taatacgactcactatagggaaattcctgctgttggaggtatggctagaaaacagaggagattctagatgtacctccaaaacctggcggcagcgcaaaagatg

SEQ ID NO: 9779 - DNA, 103 bp, Artificial Sequence
  Synthetic Polynucleotide
taatacgactcactatagggatttcatgtcattttcaagtaagatgtggtaacagaggagaaccacaatgtacttgaaaaacctggcggcagcgcaaaagatg

SEQ ID NO: 9780 - DNA, 103 bp, Artificial Sequence
  Synthetic Polynucleotide
taatacgactcactatagggtgtaaatttcatgtcattttcaagtaagataacagaggagaatcttaatggaaaatgacaacctggcggcagcgcaaaagatg

SEQ ID NO: 9781 - DNA, 103 bp, Artificial Sequence
  Synthetic Polynucleotide
taatacgactcactatagggaccactgtaaatttcatgtcattttcaagtaacagaggagaacttgaatgtgacatgaaaacctggcggcagcgcaaaagatg

SEQ ID NO: 9782 - DNA, 103 bp, Artificial Sequence
  Synthetic Polynucleotide
taatacgactcactatagggctacgaccactgtaaatttcatgtcattttaacagaggagaaaaatgatgtgaaatttaaacctggcggcagcgcaaaagatg

SEQ ID NO: 9783 - DNA, 103 bp, Artificial Sequence
  Synthetic Polynucleotide
taatacgactcactataggggtctcctacgaccactgtaaatttcatgtcaacagaggagagacatgatgtttacagtgaacctggcggcagcgcaaaagatg

SEQ ID NO: 9784 - DNA, 103 bp, Artificial Sequence
  Synthetic Polynucleotide
taatacgactcactatagggctaacgtctcctacgaccactgtaaatttcaacagaggagagaaattatgagtggtcgtaacctggcggcagcgcaaaagatg

SEQ ID NO: 9785 - DNA, 103 bp, Artificial Sequence
  Synthetic Polynucleotide
taatacgactcactatagggttccactaacgtctcctacgaccactgtaaaacagaggagattacagatgtcgtaggagaacctggcggcagcgcaaaagatg

SEQ ID NO: 9786 - DNA, 103 bp, Artificial Sequence
  Synthetic Polynucleotide
taatacgactcactatagggcaagattccactaacgtctcctacgaccacaacagaggagagtggtcatgggagacgttaacctggcggcagcgcaaaagatg

SEQ ID NO: 9787 - DNA, 103 bp, Artificial Sequence
  Synthetic Polynucleotide
taatacgactcactatagggtgggccaagattccactaacgtctcctacgaacagaggagacgtaggatgcgttagtggaacctggcggcagcgcaaaagatg

SEQ ID NO: 9788 - DNA, 103 bp, Artificial Sequence
  Synthetic Polynucleotide
taatacgactcactatagggttccttgggccaagattccactaacgtctcaacagaggagagagacgatggtggaatctaacctggcggcagcgcaaaagatg

SEQ ID NO: 9789 - DNA, 103 bp, Artificial Sequence
  Synthetic Polynucleotide
taatacgactcactatagggagccaaaattcctgctgttggaggtatggcaacagaggagagccataatgccaacagcaaacctggcggcagcgcaaaagatg

SEQ ID NO: 9790 - DNA, 103 bp, Artificial Sequence
  Synthetic Polynucleotide
taatacgactcactatagggtttctttccttgggccaagattccactaacaacagaggagagttagtatgatcttggccaacctggcggcagcgcaaaagatg

SEQ ID NO: 9791 - DNA, 103 bp, Artificial Sequence
  Synthetic Polynucleotide
taatacgactcactatagggatcattttctttccttgggccaagattccaaacagaggagatggaatatgggcccaaggaacctggcggcagcgcaaaagatg

SEQ ID NO: 9792 - DNA, 103 bp, Artificial Sequence
  Synthetic Polynucleotide
taatacgactcactataggggcctaatcattttctttccttgggccaagaaacagaggagatcttggatgaaggaaagaaacctggcggcagcgcaaaagatg

SEQ ID NO: 9793 - DNA, 103 bp, Artificial Sequence
  Synthetic Polynucleotide
taatacgactcactatagggttgtggcctaatcattttctttccttgggcaacagaggagagcccaaatgaagaaaatgaacctggcggcagcgcaaaagatg

SEQ ID NO: 9794 - DNA, 103 bp, Artificial Sequence
  Synthetic Polynucleotide
taatacgactcactatagggatgggttgtggcctaatcattttctttcctaacagaggagaaggaaaatgaatgattagaacctggcggcagcgcaaaagatg

SEQ ID NO: 9795 - DNA, 103 bp, Artificial Sequence
  Synthetic Polynucleotide
taatacgactcactataggggttccatgggttgtggcctaatcattttctaacagaggagaagaaaaatgttaggccacaacctggcggcagcgcaaaagatg

SEQ ID NO: 9796 - DNA, 103 bp, Artificial Sequence
  Synthetic Polynucleotide
taatacgactcactatagggtttgtgttccatgggttgtggcctaatcataacagaggagaatgattatgccacaacccaacctggcggcagcgcaaaagatg

SEQ ID NO: 9797 - DNA, 103 bp, Artificial Sequence
  Synthetic Polynucleotide
taatacgactcactataggggagtatttgtgttccatgggttgtggcctaaacagaggagataggccatgacccatggaaacctggcggcagcgcaaaagatg

SEQ ID NO: 9798 - DNA, 103 bp, Artificial Sequence
  Synthetic Polynucleotide
taatacgactcactatagggtccacgagtatttgtgttccatgggttgtgaacagaggagacacaacatgtggaacacaaacctggcggcagcgcaaaagatg

SEQ ID NO: 9799 - DNA, 103 bp, Artificial Sequence
  Synthetic Polynucleotide
taatacgactcactataggggcttttccacgagtatttgtgttccatgggaacagaggagacccatgatgcacaaatacaacctggcggcagcgcaaaagatg

SEQ ID NO: 9800 - DNA, 103 bp, Artificial Sequence
  Synthetic Polynucleotide
taatacgactcactatagggcatctagccaaaattcctgctgttggaggtaacagaggagaacctccatgagcaggaataacctggcggcagcgcaaaagatg

SEQ ID NO: 9801 - DNA, 103 bp, Artificial Sequence
  Synthetic Polynucleotide
taatacgactcactatagggccccagcttttccacgagtatttgtgttccaacagaggagaggaacaatgatactcgtgaacctggcggcagcgcaaaagatg

SEQ ID NO: 9802 - DNA, 103 bp, Artificial Sequence
  Synthetic Polynucleotide
taatacgactcactatagggcttttccccagcttttccacgagtatttgtaacagaggagaacaaatatgcgtggaaaaaacctggcggcagcgcaaaagatg

SEQ ID NO: 9803 - DNA, 103 bp, Artificial Sequence
  Synthetic Polynucleotide
taatacgactcactatagggtttggcttttccccagcttttccacgagtaaacagaggagatactcgatgaaaagctggaacctggcggcagcgcaaaagatg

SEQ ID NO: 9804 - DNA, 103 bp, Artificial Sequence
  Synthetic Polynucleotide
taatacgactcactatagggatgattttggcttttccccagcttttccacaacagaggagagtggaaatgctggggaaaaacctggcggcagcgcaaaagatg

SEQ ID NO: 9805 - DNA, 103 bp, Artificial Sequence
  Synthetic Polynucleotide
taatacgactcactatagggctcctatgattttggcttttccccagctttaacagaggagaaaagctatggaaaagccaaacctggcggcagcgcaaaagatg

SEQ ID NO: 9806 - DNA, 103 bp, Artificial Sequence
  Synthetic Polynucleotide
taatacgactcactatagggatctgctcctatgattttggcttttccccaaacagaggagatggggaatggccaaaatcaacctggcggcagcgcaaaagatg

SEQ ID NO: 9807 - DNA, 103 bp, Artificial Sequence
  Synthetic Polynucleotide
taatacgactcactatagggtgtacatctgctcctatgattttggcttttaacagaggagaaaaagcatgaatcataggaacctggcggcagcgcaaaagatg

SEQ ID NO: 9808 - DNA, 103 bp, Artificial Sequence
  Synthetic Polynucleotide
taatacgactcactatagggtattctgtacatctgctcctatgattttggaacagaggagaccaaaaatgtaggagcagaacctggcggcagcgcaaaagatg

SEQ ID NO: 9809 - DNA, 103 bp, Artificial Sequence
  Synthetic Polynucleotide
taatacgactcactatagggggtggtattctgtacatctgctcctatgataacagaggagaatcataatggcagatgtaaacctggcggcagcgcaaaagatg

SEQ ID NO: 9810 - DNA, 103 bp, Artificial Sequence
  Synthetic Polynucleotide
taatacgactcactatagggatgaaggtggtattctgtacatctgctcctaacagaggagaaggagcatgtgtacagaaaacctggcggcagcgcaaaagatg

SEQ ID NO: 9811 - DNA, 103 bp, Artificial Sequence
  Synthetic Polynucleotide
taatacgactcactatagggagccccatctagccaaaattcctgctgttgaacagaggagacaacagatggaattttggaacctggcggcagcgcaaaagatg

SEQ ID NO: 9812 - DNA, 103 bp, Artificial Sequence
  Synthetic Polynucleotide
taatacgactcactatagggcgatgatgaaggtggtattctgtacatctgaacagaggagacagatgatgagaataccaaacctggcggcagcgcaaaagatg

SEQ ID NO: 9813 - DNA, 103 bp, Artificial Sequence
  Synthetic Polynucleotide
taatacgactcactataggggccgtcgatgatgaaggtggtattctgtacaacagaggagagtacagatgaccaccttcaacctggcggcagcgcaaaagatg

SEQ ID NO: 9814 - DNA, 103 bp, Artificial Sequence
  Synthetic Polynucleotide
taatacgactcactatagggtttgggccgtcgatgatgaaggtggtattcaacagaggagagaatacatgcttcatcataacctggcggcagcgcaaaagatg

SEQ ID NO: 9815 - DNA, 103 bp, Artificial Sequence
  Synthetic Polynucleotide
taatacgactcactataggggggtgtttgggccgtcgatgatgaaggtggaacagaggagaccacctatgtcatcgacgaacctggcggcagcgcaaaagatg

SEQ ID NO: 9816 - DNA, 103 bp, Artificial Sequence
  Synthetic Polynucleotide
taatacgactcactatagggttctggggtgtttgggccgtcgatgatgaaaacagaggagattcatcatggacggcccaaacctggcggcagcgcaaaagatg

SEQ ID NO: 9817 - DNA, 103 bp, Artificial Sequence
  Synthetic Polynucleotide
taatacgactcactataggggggcattctggggtgtttgggccgtcgatgaacagaggagacatcgaatgcccaaacacaacctggcggcagcgcaaaagatg

SEQ ID NO: 9818 - DNA, 103 bp, Artificial Sequence
  Synthetic Polynucleotide
taatacgactcactatagggtatcagggcattctggggtgtttgggccgtaacagaggagaacggccatgacaccccagaacctggcggcagcgcaaaagatg

SEQ ID NO: 9819 - DNA, 103 bp, Artificial Sequence
  Synthetic Polynucleotide
taatacgactcactatagggttggttatcagggcattctggggtgtttggaacagaggagaccaaacatgccagaatgcaacctggcggcagcgcaaaagatg

SEQ ID NO: 9820 - DNA, 103 bp, Artificial Sequence
  Synthetic Polynucleotide
taatacgactcactataggggctctttggttatcagggcattctggggtgaacagaggagacaccccatgatgccctgaaacctggcggcagcgcaaaagatg

SEQ ID NO: 9821 - DNA, 103 bp, Artificial Sequence
  Synthetic Polynucleotide
taatacgactcactatagggtccatgctctttggttatcagggcattctgaacagaggagacagaatatgctgataaccaacctggcggcagcgcaaaagatg

SEQ ID NO: 9822 - DNA, 103 bp, Artificial Sequence
  Synthetic Polynucleotide
taatacgactcactataggggaatgagccccatctagccaaaattcctgcaacagaggagagcaggaatgttggctagaaacctggcggcagcgcaaaagatg

SEQ ID NO: 9823 - DNA, 103 bp, Artificial Sequence
  Synthetic Polynucleotide
taatacgactcactatagggaatgttccatgctctttggttatcagggcaaacagaggagatgccctatgaaccaaagaaacctggcggcagcgcaaaagatg

SEQ ID NO: 9824 - DNA, 103 bp, Artificial Sequence
  Synthetic Polynucleotide
taatacgactcactatagggtcccaaatgttccatgctctttggttatcaaacagaggagatgataaatgaagagcatgaacctggcggcagcgcaaaagatg

SEQ ID NO: 9825 - DNA, 103 bp, Artificial Sequence
  Synthetic Polynucleotide
taatacgactcactatagggcaacttcccaaatgttccatgctctttggtaacagaggagaaccaaaatgcatggaacaaacctggcggcagcgcaaaagatg

SEQ ID NO: 9826 - DNA, 103 bp, Artificial Sequence
  Synthetic Polynucleotide
taatacgactcactataggggtcttcaacttcccaaatgttccatgctctaacagaggagaagagcaatgaacatttggaacctggcggcagcgcaaaagatg

SEQ ID NO: 9827 - DNA, 103 bp, Artificial Sequence
  Synthetic Polynucleotide
taatacgactcactatagggccatagtcttcaacttcccaaatgttccataacagaggagaatggaaatgttgggaagtaacctggcggcagcgcaaaagatg

SEQ ID NO: 9828 - DNA, 103 bp, Artificial Sequence
  Synthetic Polynucleotide
taatacgactcactatagggcaaatccatagtcttcaacttcccaaatgtaacagaggagaacatttatgaagttgaagaacctggcggcagcgcaaaagatg

SEQ ID NO: 9829 - DNA, 103 bp, Artificial Sequence
  Synthetic Polynucleotide
taatacgactcactatagggaattccaaatccatagtcttcaacttcccaaacagaggagatgggaaatggaagactataacctggcggcagcgcaaaagatg

SEQ ID NO: 9830 - DNA, 103 bp, Artificial Sequence
  Synthetic Polynucleotide
taatacgactcactataggggtgaaaattccaaatccatagtcttcaactaacagaggagaagttgaatgctatggattaacctggcggcagcgcaaaagatg

SEQ ID NO: 9831 - DNA, 103 bp, Artificial Sequence
  Synthetic Polynucleotide
taatacgactcactatagggttgtcgtgaaaattccaaatccatagtcttaacagaggagaaagactatggatttggaaaacctggcggcagcgcaaaagatg

SEQ ID NO: 9832 - DNA, 103 bp, Artificial Sequence
  Synthetic Polynucleotide
taatacgactcactatagggtatgtttgtcgtgaaaattccaaatccataaacagaggagatatggaatgggaattttcaacctggcggcagcgcaaaagatg

SEQ ID NO: 9833 - DNA, 103 bp, Artificial Sequence
  Synthetic Polynucleotide
taatacgactcactatagggttcttgaatgagccccatctagccaaaattaacagaggagaaattttatgtagatggggaacctggcggcagcgcaaaagatg

SEQ ID NO: 9834 - DNA, 103 bp, Artificial Sequence
  Synthetic Polynucleotide
taatacgactcactatagggaaccatatgtttgtcgtgaaaattccaaataacagaggagaatttggatgtttcacgacaacctggcggcagcgcaaaagatg

SEQ ID NO: 9835 - DNA, 103 bp, Artificial Sequence
  Synthetic Polynucleotide
taatacgactcactatagggatttcaaccatatgtttgtcgtgaaaattcaacagaggagagaatttatgcgacaaacaaacctggcggcagcgcaaaagatg

SEQ ID NO: 9836 - DNA, 103 bp, Artificial Sequence
  Synthetic Polynucleotide
taatacgactcactatagggacgcaatttcaaccatatgtttgtcgtgaaaacagaggagattcacgatgaacatatggaacctggcggcagcgcaaaagatg

SEQ ID NO: 9837 - DNA, 103 bp, Artificial Sequence
  Synthetic Polynucleotide
taatacgactcactataggggagtcacgcaatttcaaccatatgtttgtcaacagaggagagacaaaatgatggttgaaaacctggcggcagcgcaaaagatg

SEQ ID NO: 9838 - DNA, 103 bp, Artificial Sequence
  Synthetic Polynucleotide
taatacgactcactatagggtgtaggagtcacgcaatttcaaccatatgtaacagaggagaacatatatgtgaaattgcaacctggcggcagcgcaaaagatg

SEQ ID NO: 9839 - DNA, 103 bp, Artificial Sequence
  Synthetic Polynucleotide
taatacgactcactatagggttgagtgtaggagtcacgcaatttcaaccaaacagaggagatggttgatgttgcgtgacaacctggcggcagcgcaaaagatg

SEQ ID NO: 9840 - DNA, 103 bp, Artificial Sequence
  Synthetic Polynucleotide
taatacgactcactatagggcacacttgagtgtaggagtcacgcaatttcaacagaggagagaaattatgtgactcctaaacctggcggcagcgcaaaagatg

SEQ ID NO: 9841 - DNA, 103 bp, Artificial Sequence
  Synthetic Polynucleotide
taatacgactcactatagggggtcacacacttgagtgtaggagtcacgcaaacagaggagatgcgtgatgcctacactcaacctggcggcagcgcaaaagatg

SEQ ID NO: 9842 - DNA, 103 bp, Artificial Sequence
  Synthetic Polynucleotide
taatacgactcactatagggccggtggtcacacacttgagtgtaggagtcaacagaggagagactccatgactcaagtgaacctggcggcagcgcaaaagatg

SEQ ID NO: 9843 - DNA, 103 bp, Artificial Sequence
  Synthetic Polynucleotide
taatacgactcactatagggattagccggtggtcacacacttgagtgtagaacagaggagactacacatgagtgtgtgaaacctggcggcagcgcaaaagatg

SEQ ID NO: 9844 - DNA, 103 bp, Artificial Sequence
  Synthetic Polynucleotide
taatacgactcactatagggcattcttcttgaatgagccccatctagccaaacagaggagatggctaatgggggctcataacctggcggcagcgcaaaagatg

SEQ ID NO: 9845 - DNA, 103 bp, Artificial Sequence
  Synthetic Polynucleotide
taatacgactcactatagggctgacattagccggtggtcacacacttgagaacagaggagactcaagatggtgaccaccaacctggcggcagcgcaaaagatg

SEQ ID NO: 9846 - DNA, 103 bp, Artificial Sequence
  Synthetic Polynucleotide
taatacgactcactatagggggcagctgacattagccggtggtcacacacaacagaggagagtgtgtatgcaccggctaaacctggcggcagcgcaaaagatg

SEQ ID NO: 9847 - DNA, 103 bp, Artificial Sequence
  Synthetic Polynucleotide
taatacgactcactatagggttgatggcagctgacattagccggtggtcaaacagaggagatgaccaatggctaatgtcaacctggcggcagcgcaaaagatg

SEQ ID NO: 9848 - DNA, 103 bp, Artificial Sequence
  Synthetic Polynucleotide
taatacgactcactatagggtatccttgatggcagctgacattagccggtaacagaggagaaccggcatgtgtcagctgaacctggcggcagcgcaaaagatg

SEQ ID NO: 9849 - DNA, 103 bp, Artificial Sequence
  Synthetic Polynucleotide
taatacgactcactatagggtttgctatccttgatggcagctgacattagaacagaggagactaatgatggctgccatcaacctggcggcagcgcaaaagatg

SEQ ID NO: 9850 - DNA, 103 bp, Artificial Sequence
  Synthetic Polynucleotide
taatacgactcactatagggactgctttgctatccttgatggcagctgacaacagaggagagtcagcatgcatcaaggaaacctggcggcagcgcaaaagatg

SEQ ID NO: 9851 - DNA, 103 bp, Artificial Sequence
  Synthetic Polynucleotide
taatacgactcactatagggcatggactgctttgctatccttgatggcagaacagaggagactgccaatgaggatagcaaacctggcggcagcgcaaaagatg

SEQ ID NO: 9852 - DNA, 103 bp, Artificial Sequence
  Synthetic Polynucleotide
taatacgactcactataggggtcagcatggactgctttgctatccttgataacagaggagaatcaagatgagcaaagcaaacctggcggcagcgcaaaagatg

SEQ ID NO: 9853 - DNA, 103 bp, Artificial Sequence
  Synthetic Polynucleotide
taatacgactcactatagggcccatgtcagcatggactgctttgctatccaacagaggagaggatagatgagcagtccaaacctggcggcagcgcaaaagatg

SEQ ID NO: 9854 - DNA, 103 bp, Artificial Sequence
  Synthetic Polynucleotide
taatacgactcactatagggagtaccccatgtcagcatggactgctttgcaacagaggagagcaaagatgtccatgctgaacctggcggcagcgcaaaagatg

SEQ ID NO: 9855 - DNA, 103 bp, Artificial Sequence
  Synthetic Polynucleotide
taatacgactcactatagggttaagcaagcttccgattcgaaactgttctaacagaggagaagaacaatgtcgaatcggaacctggcggcagcgcaaaagatg

SEQ ID NO: 9856 - DNA, 103 bp, Artificial Sequence
  Synthetic Polynucleotide
taatacgactcactatagggcgctccattcttcttgaatgagccccatctaacagaggagaagatggatgtcattcaagaacctggcggcagcgcaaaagatg

SEQ ID NO: 9857 - DNA, 103 bp, Artificial Sequence
  Synthetic Polynucleotide
taatacgactcactatagggtatccagtaccccatgtcagcatggactgcaacagaggagagcagtcatggctgacatgaacctggcggcagcgcaaaagatg

SEQ ID NO: 9858 - DNA, 103 bp, Artificial Sequence
  Synthetic Polynucleotide
taatacgactcactatagggctttctatccagtaccccatgtcagcatggaacagaggagaccatgcatgcatggggtaaacctggcggcagcgcaaaagatg

SEQ ID NO: 9859 - DNA, 103 bp, Artificial Sequence
  Synthetic Polynucleotide
taatacgactcactatagggtttcactttctatccagtaccccatgtcagaacagaggagactgacaatgggtactggaaacctggcggcagcgcaaaagatg

SEQ ID NO: 9860 - DNA, 103 bp, Artificial Sequence
  Synthetic Polynucleotide
taatacgactcactataggggttcttttcactttctatccagtaccccataacagaggagaatggggatgtggatagaaaacctggcggcagcgcaaaagatg

SEQ ID NO: 9861 - DNA, 103 bp, Artificial Sequence
  Synthetic Polynucleotide
taatacgactcactataggggtctcgttcttttcactttctatccagtacaacagaggagagtactgatgagaaagtgaaacctggcggcagcgcaaaagatg

SEQ ID NO: 9862 - DNA, 103 bp, Artificial Sequence
  Synthetic Polynucleotide
taatacgactcactatagggtccaagtctcgttcttttcactttctatccaacagaggagaggatagatggtgaaaagaaacctggcggcagcgcaaaagatg

SEQ ID NO: 9863 - DNA, 103 bp, Artificial Sequence
  Synthetic Polynucleotide
taatacgactcactatagggcaacttccaagtctcgttcttttcactttcaacagaggagagaaagtatgaagaacgagaacctggcggcagcgcaaaagatg

SEQ ID NO: 9864 - DNA, 103 bp, Artificial Sequence
  Synthetic Polynucleotide
taatacgactcactatagggcttgccaacttccaagtctcgttcttttcaaacagaggagatgaaaaatgcgagacttgaacctggcggcagcgcaaaagatg

SEQ ID NO: 9865 - DNA, 103 bp, Artificial Sequence
  Synthetic Polynucleotide
taatacgactcactatagggaggctcttgccaacttccaagtctcgttctaacagaggagaagaacgatgcttggaagtaacctggcggcagcgcaaaagatg

SEQ ID NO: 9866 - DNA, 103 bp, Artificial Sequence
  Synthetic Polynucleotide
taatacgactcactataggggaaggaggctcttgccaacttccaagtctcaacagaggagagagactatgaagttggcaaacctggcggcagcgcaaaagatg

SEQ ID NO: 9867 - DNA, 103 bp, Artificial Sequence
  Synthetic Polynucleotide
taatacgactcactatagggttgatcgctccattcttcttgaatgagcccaacagaggagagggctcatgcaagaagaaaacctggcggcagcgcaaaagatg

SEQ ID NO: 9868 - DNA, 103 bp, Artificial Sequence
  Synthetic Polynucleotide
taatacgactcactatagggtctatgaaggaggctcttgccaacttccaaaacagaggagattggaaatgggcaagagcaacctggcggcagcgcaaaagatg

SEQ ID NO: 9869 - DNA, 103 bp, Artificial Sequence
  Synthetic Polynucleotide
taatacgactcactatagggtaacttctatgaaggaggctcttgccaactaacagaggagaagttggatggagcctcctaacctggcggcagcgcaaaagatg

SEQ ID NO: 9870 - DNA, 103 bp, Artificial Sequence
  Synthetic Polynucleotide
taatacgactcactatagggtgtcttaacttctatgaaggaggctcttgcaacagaggagagcaagaatgtccttcataaacctggcggcagcgcaaaagatg

SEQ ID NO: 9871 - DNA, 103 bp, Artificial Sequence
  Synthetic Polynucleotide
taatacgactcactatagggatgcatgtcttaacttctatgaaggaggctaacagaggagaagcctcatgcatagaagtaacctggcggcagcgcaaaagatg

SEQ ID NO: 9872 - DNA, 103 bp, Artificial Sequence
  Synthetic Polynucleotide
taatacgactcactataggggccagatgcatgtcttaacttctatgaaggaacagaggagaccttcaatgaagttaagaaacctggcggcagcgcaaaagatg

SEQ ID NO: 9873 - DNA, 103 bp, Artificial Sequence
  Synthetic Polynucleotide
taatacgactcactatagggttttggccagatgcatgtcttaacttctataacagaggagaatagaaatgaagacatgcaacctggcggcagcgcaaaagatg

SEQ ID NO: 9874 - DNA, 103 bp, Artificial Sequence
  Synthetic Polynucleotide
taatacgactcactatagggtgggattttggccagatgcatgtcttaactaacagaggagaagttaaatgatgcatctgaacctggcggcagcgcaaaagatg

SEQ ID NO: 9875 - DNA, 103 bp, Artificial Sequence
  Synthetic Polynucleotide
taatacgactcactataggggagtgtgggattttggccagatgcatgtctaacagaggagaagacatatgtctggccaaaacctggcggcagcgcaaaagatg

SEQ ID NO: 9876 - DNA, 103 bp, Artificial Sequence
  Synthetic Polynucleotide
taatacgactcactatagggccatagagtgtgggattttggccagatgcaaacagaggagatgcatcatgccaaaatccaacctggcggcagcgcaaaagatg

SEQ ID NO: 9877 - DNA, 103 bp, Artificial Sequence
  Synthetic Polynucleotide
taatacgactcactatagggttgctccatagagtgtgggattttggccagaacagaggagactggccatgatcccacacaacctggcggcagcgcaaaagatg

SEQ ID NO: 9878 - DNA, 103 bp, Artificial Sequence
  Synthetic Polynucleotide
taatacgactcactatagggacactttgatcgctccattcttcttgaatgaacagaggagacattcaatgagaatggagaacctggcggcagcgcaaaagatg

SEQ ID NO: 9879 - DNA, 103 bp, Artificial Sequence
  Synthetic Polynucleotide
taatacgactcactatagggctccattgctccatagagtgtgggattttgaacagaggagacaaaatatgacactctataacctggcggcagcgcaaaagatg

SEQ ID NO: 9880 - DNA, 103 bp, Artificial Sequence
  Synthetic Polynucleotide
taatacgactcactatagggcaggactccattgctccatagagtgtgggaaacagaggagatcccacatgctatggagcaacctggcggcagcgcaaaagatg

SEQ ID NO: 9881 - DNA, 103 bp, Artificial Sequence
  Synthetic Polynucleotide
taatacgactcactatagggctttccaggactccattgctccatagagtgaacagaggagacactctatggagcaatggaacctggcggcagcgcaaaagatg

SEQ ID NO: 9882 - DNA, 103 bp, Artificial Sequence
  Synthetic Polynucleotide
taatacgactcactatagggtctcactttccaggactccattgctccataaacagaggagatatggaatgatggagtccaacctggcggcagcgcaaaagatg

SEQ ID NO: 9883 - DNA, 103 bp, Artificial Sequence
  Synthetic Polynucleotide
taatacgactcactatagggtatcatctcactttccaggactccattgctaacagaggagaagcaatatggtcctggaaaacctggcggcagcgcaaaagatg

SEQ ID NO: 9884 - DNA, 103 bp, Artificial Sequence
  Synthetic Polynucleotide
taatacgactcactataggggggattatcatctcactttccaggactccaaacagaggagatggagtatgggaaagtgaaacctggcggcagcgcaaaagatg

SEQ ID NO: 9885 - DNA, 103 bp, Artificial Sequence
  Synthetic Polynucleotide
taatacgactcactatagggtctttgggattatcatctcactttccaggaaacagaggagatcctggatggtgagatgaaacctggcggcagcgcaaaagatg

SEQ ID NO: 9886 - DNA, 103 bp, Artificial Sequence
  Synthetic Polynucleotide
taatacgactcactatagggatatatctttgggattatcatctcactttcaacagaggagagaaagtatgatgataatcaacctggcggcagcgcaaaagatg

SEQ ID NO: 9887 - DNA, 103 bp, Artificial Sequence
  Synthetic Polynucleotide
taatacgactcactatagggcctccatatatctttgggattatcatctcaaacagaggagatgagatatgaatcccaaaaacctggcggcagcgcaaaagatg

SEQ ID NO: 9888 - DNA, 103 bp, Artificial Sequence
  Synthetic Polynucleotide
taatacgactcactatagggttggtcctccatatatctttgggattatcaaacagaggagatgataaatgcaaagatataacctggcggcagcgcaaaagatg

SEQ ID NO: 9889 - DNA, 103 bp, Artificial Sequence
  Synthetic Polynucleotide
taatacgactcactatagggccgtaacactttgatcgctccattcttcttaacagaggagaaagaagatgggagcgatcaacctggcggcagcgcaaaagatg

SEQ ID NO: 9890 - DNA, 103 bp, Artificial Sequence
  Synthetic Polynucleotide
taatacgactcactatagggagatattggtcctccatatatctttgggataacagaggagaatcccaatgatatatggaaacctggcggcagcgcaaaagatg

SEQ ID NO: 9891 - DNA, 103 bp, Artificial Sequence
  Synthetic Polynucleotide
taatacgactcactatagggtgctgagatattggtcctccatatatctttaacagaggagaaaagatatgtggaggaccaacctggcggcagcgcaaaagatg

SEQ ID NO: 9892 - DNA, 103 bp, Artificial Sequence
  Synthetic Polynucleotide
taatacgactcactatagggagttgtgctgagatattggtcctccatataaacagaggagatatatgatggaccaatataacctggcggcagcgcaaaagatg

SEQ ID NO: 9893 - DNA, 103 bp, Artificial Sequence
  Synthetic Polynucleotide
taatacgactcactatagggtctgtagttgtgctgagatattggtcctccaacagaggagaggaggaatgatatctcagaacctggcggcagcgcaaaagatg

SEQ ID NO: 9894 - DNA, 103 bp, Artificial Sequence
  Synthetic Polynucleotide
taatacgactcactatagggcctggtctgtagttgtgctgagatattggtaacagaggagaaccaatatgtcagcacaaaacctggcggcagcgcaaaagatg

SEQ ID NO: 9895 - DNA, 103 bp, Artificial Sequence
  Synthetic Polynucleotide
taatacgactcactatagggaatatcctggtctgtagttgtgctgagataaacagaggagatatctcatgacaactacaaacctggcggcagcgcaaaagatg

SEQ ID NO: 9896 - DNA, 103 bp, Artificial Sequence
  Synthetic Polynucleotide
taatacgactcactatagggtgtgaaatatcctggtctgtagttgtgctgaacagaggagacagcacatgtacagaccaaacctggcggcagcgcaaaagatg

SEQ ID NO: 9897 - DNA, 103 bp, Artificial Sequence
  Synthetic Polynucleotide
taatacgactcactataggggtttgtgtgaaatatcctggtctgtagttgaacagaggagacaactaatgaccaggataaacctggcggcagcgcaaaagatg

SEQ ID NO: 9898 - DNA, 103 bp, Artificial Sequence
  Synthetic Polynucleotide
taatacgactcactatagggctgctgtttgtgtgaaatatcctggtctgtaacagaggagaacagacatggatatttcaaacctggcggcagcgcaaaagatg

SEQ ID NO: 9899 - DNA, 103 bp, Artificial Sequence
  Synthetic Polynucleotide
taatacgactcactatagggcggccctgctgtttgtgtgaaatatcctggaacagaggagaccaggaatgttcacacaaaacctggcggcagcgcaaaagatg

SEQ ID NO: 9900 - DNA, 103 bp, Artificial Sequence
  Synthetic Polynucleotide
taatacgactcactatagggaaaccccgtaacactttgatcgctccattcaacagaggagagaatggatggatcaaagtaacctggcggcagcgcaaaagatg

SEQ ID NO: 9901 - DNA, 103 bp, Artificial Sequence
  Synthetic Polynucleotide
taatacgactcactatagggtgccacggccctgctgtttgtgtgaaatataacagaggagaatatttatgacaaacagcaacctggcggcagcgcaaaagatg

SEQ ID NO: 9902 - DNA, 103 bp, Artificial Sequence
  Synthetic Polynucleotide
taatacgactcactatagggccaagtgccacggccctgctgtttgtgtgaaacagaggagatcacacatgcagcagggcaacctggcggcagcgcaaaagatg

SEQ ID NO: 9903 - DNA, 103 bp, Artificial Sequence
  Synthetic Polynucleotide
taatacgactcactatagggcttgcccaagtgccacggccctgctgtttgaacagaggagacaaacaatggggccgtggaacctggcggcagcgcaaaagatg

SEQ ID NO: 9904 - DNA, 103 bp, Artificial Sequence
  Synthetic Polynucleotide
taatacgactcactatagggtctaacttgcccaagtgccacggccctgctaacagaggagaagcaggatggtggcacttaacctggcggcagcgcaaaagatg

SEQ ID NO: 9905 - DNA, 103 bp, Artificial Sequence
  Synthetic Polynucleotide
taatacgactcactatagggctagttctaacttgcccaagtgccacggccaacagaggagaggccgtatgacttgggcaaacctggcggcagcgcaaaagatg

SEQ ID NO: 9906 - DNA, 103 bp, Artificial Sequence
  Synthetic Polynucleotide
taatacgactcactatagggaaaatctagttctaacttgcccaagtgccaaacagaggagatggcacatgggcaagttaaacctggcggcagcgcaaaagatg

SEQ ID NO: 9907 - DNA, 103 bp, Artificial Sequence
  Synthetic Polynucleotide
taatacgactcactatagggaaatcaaaatctagttctaacttgcccaagaacagaggagacttgggatggttagaactaacctggcggcagcgcaaaagatg

SEQ ID NO: 9908 - DNA, 103 bp, Artificial Sequence
  Synthetic Polynucleotide
taatacgactcactatagggcacataaatcaaaatctagttctaacttgcaacagaggagagcaagtatgaactagattaacctggcggcagcgcaaaagatg

SEQ ID NO: 9909 - DNA, 103 bp, Artificial Sequence
  Synthetic Polynucleotide
taatacgactcactatagggaccttcacataaatcaaaatctagttctaaaacagaggagattagaaatggattttgataacctggcggcagcgcaaaagatg

SEQ ID NO: 9910 - DNA, 103 bp, Artificial Sequence
  Synthetic Polynucleotide
taatacgactcactataggggtggtaccttcacataaatcaaaatctagtaacagaggagaactagaatgtgatttatgaacctggcggcagcgcaaaagatg

SEQ ID NO: 9911 - DNA, 103 bp, Artificial Sequence
  Synthetic Polynucleotide
taatacgactcactatagggtcttgaaaccccgtaacactttgatcgctcaacagaggagagagcgaatgaagtgttacaacctggcggcagcgcaaaagatg

SEQ ID NO: 9912 - DNA, 103 bp, Artificial Sequence
  Synthetic Polynucleotide
taatacgactcactatagggcaacagtggtaccttcacataaatcaaaataacagaggagaattttgatgtatgtgaagaacctggcggcagcgcaaaagatg

SEQ ID NO: 9913 - DNA, 103 bp, Artificial Sequence
  Synthetic Polynucleotide
taatacgactcactatagggcacaacaacagtggtaccttcacataaatcaacagaggagagatttaatggaaggtaccaacctggcggcagcgcaaaagatg

SEQ ID NO: 9914 - DNA, 103 bp, Artificial Sequence
  Synthetic Polynucleotide
taatacgactcactatagggtcatccacaacaacagtggtaccttcacataacagaggagaatgtgaatgtaccactgtaacctggcggcagcgcaaaagatg

SEQ ID NO: 9915 - DNA, 103 bp, Artificial Sequence
  Synthetic Polynucleotide
taatacgactcactatagggaatgttcatccacaacaacagtggtaccttaacagaggagaaaggtaatgctgttgttgaacctggcggcagcgcaaaagatg

SEQ ID NO: 9916 - DNA, 103 bp, Artificial Sequence
  Synthetic Polynucleotide
taatacgactcactatagggtccacaatgttcatccacaacaacagtggtaacagaggagaaccactatggttgtggataacctggcggcagcgcaaaagatg

SEQ ID NO: 9917 - DNA, 103 bp, Artificial Sequence
  Synthetic Polynucleotide
taatacgactcactatagggcgatttccacaatgttcatccacaacaacaaacagaggagatgttgtatgggatgaacaaacctggcggcagcgcaaaagatg

SEQ ID NO: 9918 - DNA, 103 bp, Artificial Sequence
  Synthetic Polynucleotide
taatacgactcactataggggtcctcgatttccacaatgttcatccacaaaacagaggagattgtggatgaacattgtgaacctggcggcagcgcaaaagatg

SEQ ID NO: 9919 - DNA, 103 bp, Artificial Sequence
  Synthetic Polynucleotide
taatacgactcactatagggagatggtcctcgatttccacaatgttcatcaacagaggagagatgaaatgtgtggaaataacctggcggcagcgcaaaagatg

SEQ ID NO: 9920 - DNA, 103 bp, Artificial Sequence
  Synthetic Polynucleotide
taatacgactcactatagggctaagagatggtcctcgatttccacaatgtaacagaggagaacattgatgaaatcgaggaacctggcggcagcgcaaaagatg

SEQ ID NO: 9921 - DNA, 103 bp, Artificial Sequence
  Synthetic Polynucleotide
taatacgactcactatagggtggttctaagagatggtcctcgatttccacaacagaggagagtggaaatggaggaccataacctggcggcagcgcaaaagatg

SEQ ID NO: 9922 - DNA, 103 bp, Artificial Sequence
  Synthetic Polynucleotide
taatacgactcactatagggttctttcttgaaaccccgtaacactttgataacagaggagaatcaaaatgttacggggtaacctggcggcagcgcaaaagatg

SEQ ID NO: 9923 - DNA, 103 bp, Artificial Sequence
  Synthetic Polynucleotide
taatacgactcactatagggtgttgtggttctaagagatggtcctcgattaacagaggagaaatcgaatgccatctcttaacctggcggcagcgcaaaagatg

SEQ ID NO: 9924 - DNA, 103 bp, Artificial Sequence
  Synthetic Polynucleotide
taatacgactcactataggggtgactgttgtggttctaagagatggtcctaacagaggagaaggaccatgtcttagaacaacctggcggcagcgcaaaagatg

SEQ ID NO: 9925 - DNA, 103 bp, Artificial Sequence
  Synthetic Polynucleotide
taatacgactcactatagggttcctgtgactgttgtggttctaagagatgaacagaggagacatctcatggaaccacaaaacctggcggcagcgcaaaagatg

SEQ ID NO: 9926 - DNA, 103 bp, Artificial Sequence
  Synthetic Polynucleotide
taatacgactcactatagggtgtctttcctgtgactgttgtggttctaagaacagaggagacttagaatgacaacagtcaacctggcggcagcgcaaaagatg

SEQ ID NO: 9927 - DNA, 103 bp, Artificial Sequence
  Synthetic Polynucleotide
taatacgactcactatagggtggattgtctttcctgtgactgttgtggttaacagaggagaaaccacatgagtcacaggaacctggcggcagcgcaaaagatg

SEQ ID NO: 9928 - DNA, 103 bp, Artificial Sequence
  Synthetic Polynucleotide
taatacgactcactatagggattcatggattgtctttcctgtgactgttgaacagaggagacaacagatgcaggaaagaaacctggcggcagcgcaaaagatg

SEQ ID NO: 9929 - DNA, 103 bp, Artificial Sequence
  Synthetic Polynucleotide
taatacgactcactataggggcaccattcatggattgtctttcctgtgacaacagaggagagtcacaatgaagacaatcaacctggcggcagcgcaaaagatg

SEQ ID NO: 9930 - DNA, 103 bp, Artificial Sequence
  Synthetic Polynucleotide
taatacgactcactatagggctacagcaccattcatggattgtctttcctaacagaggagaaggaaaatgaatccatgaaacctggcggcagcgcaaaagatg

SEQ ID NO: 9931 - DNA, 103 bp, Artificial Sequence
  Synthetic Polynucleotide
taatacgactcactatagggaagatctacagcaccattcatggattgtctaacagaggagaagacaaatgatgaatggtaacctggcggcagcgcaaaagatg

SEQ ID NO: 9932 - DNA, 103 bp, Artificial Sequence
  Synthetic Polynucleotide
taatacgactcactatagggcgtgcaagatctacagcaccattcatggataacagaggagaatccatatgtggtgctgtaacctggcggcagcgcaaaagatg

SEQ ID NO: 9933 - DNA, 103 bp, Artificial Sequence
  Synthetic Polynucleotide
taatacgactcactataggggagatttctttcttgaaaccccgtaacactaacagaggagaagtgttatggggtttcaaaacctggcggcagcgcaaaagatg

SEQ ID NO: 9934 - DNA, 103 bp, Artificial Sequence
  Synthetic Polynucleotide
taatacgactcactatagggggtaacgtgcaagatctacagcaccattcaaacagaggagatgaatgatgctgtagatcaacctggcggcagcgcaaaagatg

SEQ ID NO: 9935 - DNA, 103 bp, Artificial Sequence
  Synthetic Polynucleotide
taatacgactcactataggggggggggtaacgtgcaagatctacagcaccaacagaggagaggtgctatggatcttgcaaacctggcggcagcgcaaaagatg

SEQ ID NO: 9936 - DNA, 103 bp, Artificial Sequence
  Synthetic Polynucleotide
taatacgactcactatagggacgtagggggggtaacgtgcaagatctacaaacagaggagatgtagaatgtgcacgttaaacctggcggcagcgcaaaagatg

SEQ ID NO: 9937 - DNA, 103 bp, Artificial Sequence
  Synthetic Polynucleotide
taatacgactcactatagggttgaaacgtagggggggtaacgtgcaagataacagaggagaatcttgatggttacccccaacctggcggcagcgcaaaagatg

SEQ ID NO: 9938 - DNA, 103 bp, Artificial Sequence
  Synthetic Polynucleotide
taatacgactcactatagggctcctttgaaacgtagggggggtaacgtgcaacagaggagagcacgtatgcccccctacaacctggcggcagcgcaaaagatg

SEQ ID NO: 9939 - DNA, 103 bp, Artificial Sequence
  Synthetic Polynucleotide
taatacgactcactataggggtcttctcctttgaaacgtagggggggtaaaacagaggagattacccatgctacgtttcaacctggcggcagcgcaaaagatg

SEQ ID NO: 9940 - DNA, 103 bp, Artificial Sequence
  Synthetic Polynucleotide
taatacgactcactatagggcacccgtcttctcctttgaaacgtagggggaacagaggagaccccctatgtttcaaaggaacctggcggcagcgcaaaagatg

SEQ ID NO: 9941 - DNA, 103 bp, Artificial Sequence
  Synthetic Polynucleotide
taatacgactcactatagggaccagcacccgtcttctcctttgaaacgtaaacagaggagatacgttatgaaggagaagaacctggcggcagcgcaaaagatg

SEQ ID NO: 9942 - DNA, 103 bp, Artificial Sequence
  Synthetic Polynucleotide
taatacgactcactataggggccgtaccagcacccgtcttctcctttgaaaacagaggagattcaaaatggaagacgggaacctggcggcagcgcaaaagatg

SEQ ID NO: 9943 - DNA, 103 bp, Artificial Sequence
  Synthetic Polynucleotide
taatacgactcactatagggtccatgccgtaccagcacccgtcttctcctaacagaggagaaggagaatgcgggtgctgaacctggcggcagcgcaaaagatg

SEQ ID NO: 9944 - DNA, 103 bp, Artificial Sequence
  Synthetic Polynucleotide
taatacgactcactatagggtgtttgagatttctttcttgaaaccccgtaaacagaggagatacgggatgtcaagaaagaacctggcggcagcgcaaaagatg

SEQ ID NO: 9945 - DNA, 103 bp, Artificial Sequence
  Synthetic Polynucleotide
taatacgactcactatagggtgatttccatgccgtaccagcacccgtcttaacagaggagaaagacgatggctggtacgaacctggcggcagcgcaaaagatg

SEQ ID NO: 9946 - DNA, 103 bp, Artificial Sequence
  Synthetic Polynucleotide
taatacgactcactatagggtggtctgatttccatgccgtaccagcacccaacagaggagagggtgcatgtacggcatgaacctggcggcagcgcaaaagatg

SEQ ID NO: 9947 - DNA, 103 bp, Artificial Sequence
  Synthetic Polynucleotide
taatacgactcactatagggttgactggtctgatttccatgccgtaccagaacagaggagactggtaatgcatggaaataacctggcggcagcgcaaaagatg

SEQ ID NO: 9948 - DNA, 103 bp, Artificial Sequence
  Synthetic Polynucleotide
taatacgactcactatagggtctccttgactggtctgatttccatgccgtaacagaggagaacggcaatgaaatcagacaacctggcggcagcgcaaaagatg

SEQ ID NO: 9949 - DNA, 103 bp, Artificial Sequence
  Synthetic Polynucleotide
taatacgactcactatagggttccttctccttgactggtctgatttccataacagaggagaatggaaatgagaccagtcaacctggcggcagcgcaaaagatg

SEQ ID NO: 9950 - DNA, 103 bp, Artificial Sequence
  Synthetic Polynucleotide
taatacgactcactatagggttctcttccttctccttgactggtctgattaacagaggagaaatcagatgagtcaaggaaacctggcggcagcgcaaaagatg

SEQ ID NO: 9951 - DNA, 103 bp, Artificial Sequence
  Synthetic Polynucleotide
taatacgactcactatagggctaggttctcttccttctccttgactggtcaacagaggagagaccagatgaggagaaggaacctggcggcagcgcaaaagatg

SEQ ID NO: 9952 - DNA, 103 bp, Artificial Sequence
  Synthetic Polynucleotide
taatacgactcactatagggcttaactaggttctcttccttctccttgacaacagaggagagtcaagatgaaggaagagaacctggcggcagcgcaaaagatg

SEQ ID NO: 9953 - DNA, 103 bp, Artificial Sequence
  Synthetic Polynucleotide
taatacgactcactatagggattgacttaactaggttctcttccttctccaacagaggagaggagaaatgagagaacctaacctggcggcagcgcaaaagatg

SEQ ID NO: 9954 - DNA, 103 bp, Artificial Sequence
  Synthetic Polynucleotide
taatacgactcactatagggagaccattgacttaactaggttctcttcctaacagaggagaaggaagatgacctagttaaacctggcggcagcgcaaaagatg

SEQ ID NO: 9955 - DNA, 103 bp, Artificial Sequence
  Synthetic Polynucleotide
taatacgactcactatagggcaacatgtttgagatttctttcttgaaaccaacagaggagaggtttcatgaaagaaatcaacctggcggcagcgcaaaagatg

SEQ ID NO: 9956 - DNA, 103 bp, Artificial Sequence
  Synthetic Polynucleotide
taatacgactcactatagggtgcagagaccattgacttaactaggttctcaacagaggagagagaacatggttaagtcaaacctggcggcagcgcaaaagatg

SEQ ID NO: 9957 - DNA, 103 bp, Artificial Sequence
  Synthetic Polynucleotide
taatacgactcactataggggaccctgcagagaccattgacttaactaggaacagaggagacctagtatggtcaatggtaacctggcggcagcgcaaaagatg

SEQ ID NO: 9958 - DNA, 103 bp, Artificial Sequence
  Synthetic Polynucleotide
taatacgactcactatagggctcctgaccctgcagagaccattgacttaaaacagaggagattaagtatgtggtctctgaacctggcggcagcgcaaaagatg

SEQ ID NO: 9959 - DNA, 103 bp, Artificial Sequence
  Synthetic Polynucleotide
taatacgactcactatagggcacttctcctgaccctgcagagaccattgaaacagaggagatcaatgatgtctgcagggaacctggcggcagcgcaaaagatg

SEQ ID NO: 9960 - DNA, 103 bp, Artificial Sequence
  Synthetic Polynucleotide
taatacgactcactatagggctgtccacttctcctgaccctgcagagaccaacagaggagaggtctcatgagggtcaggaacctggcggcagcgcaaaagatg

SEQ ID NO: 9961 - DNA, 103 bp, Artificial Sequence
  Synthetic Polynucleotide
taatacgactcactatagggaaaaactgtccacttctcctgaccctgcagaacagaggagactgcagatgcaggagaagaacctggcggcagcgcaaaagatg

SEQ ID NO: 9962 - DNA, 103 bp, Artificial Sequence
  Synthetic Polynucleotide
taatacgactcactatagggtagtgaaaaactgtccacttctcctgacccaacagaggagagggtcaatggaagtggacaacctggcggcagcgcaaaagatg

SEQ ID NO: 9963 - DNA, 103 bp, Artificial Sequence
  Synthetic Polynucleotide
taatacgactcactatagggagtcctagtgaaaaactgtccacttctcctaacagaggagaaggagaatgggacagtttaacctggcggcagcgcaaaagatg

SEQ ID NO: 9964 - DNA, 103 bp, Artificial Sequence
  Synthetic Polynucleotide
taatacgactcactatagggatagcagtcctagtgaaaaactgtccacttaacagaggagaaagtggatggtttttcacaacctggcggcagcgcaaaagatg

SEQ ID NO: 9965 - DNA, 103 bp, Artificial Sequence
  Synthetic Polynucleotide
taatacgactcactatagggtatgcatagcagtcctagtgaaaaactgtcaacagaggagagacagtatgtcactaggaaacctggcggcagcgcaaaagatg

SEQ ID NO: 9966 - DNA, 103 bp, Artificial Sequence
  Synthetic Polynucleotide
taatacgactcactatagggctacgttaagcaagcttccgattcgaaactaacagaggagaagtttcatgtcggaagctaacctggcggcagcgcaaaagatg

SEQ ID NO: 9967 - DNA, 103 bp, Artificial Sequence
  Synthetic Polynucleotide
taatacgactcactatagggatgttcaacatgtttgagatttctttcttgaacagaggagacaagaaatgaatctcaaaaacctggcggcagcgcaaaagatg

SEQ ID NO: 9968 - DNA, 103 bp, Artificial Sequence
  Synthetic Polynucleotide
taatacgactcactatagggattgatatgcatagcagtcctagtgaaaaaaacagaggagatttttcatgaggactgctaacctggcggcagcgcaaaagatg

SEQ ID NO: 9969 - DNA, 103 bp, Artificial Sequence
  Synthetic Polynucleotide
taatacgactcactatagggtcattattgatatgcatagcagtcctagtgaacagaggagacactagatgtgctatgcaaacctggcggcagcgcaaaagatg

SEQ ID NO: 9970 - DNA, 103 bp, Artificial Sequence
  Synthetic Polynucleotide
taatacgactcactatagggttcgatcattattgatatgcatagcagtccaacagaggagaggactgatgtgcatatcaaacctggcggcagcgcaaaagatg

SEQ ID NO: 9971 - DNA, 103 bp, Artificial Sequence
  Synthetic Polynucleotide
taatacgactcactatagggacctcttcgatcattattgatatgcatagcaacagaggagagctatgatgatcaataataacctggcggcagcgcaaaagatg

SEQ ID NO: 9972 - DNA, 103 bp, Artificial Sequence
  Synthetic Polynucleotide
taatacgactcactatagggtcattacctcttcgatcattattgatatgcaacagaggagagcatatatgtaatgatcgaacctggcggcagcgcaaaagatg

SEQ ID NO: 9973 - DNA, 103 bp, Artificial Sequence
  Synthetic Polynucleotide
taatacgactcactatagggggatctcattacctcttcgatcattattgaaacagaggagatcaataatgatcgaagagaacctggcggcagcgcaaaagatg

SEQ ID NO: 9974 - DNA, 103 bp, Artificial Sequence
  Synthetic Polynucleotide
taatacgactcactatagggcatctggatctcattacctcttcgatcattaacagaggagaaatgatatgagaggtaataacctggcggcagcgcaaaagatg

SEQ ID NO: 9975 - DNA, 103 bp, Artificial Sequence
  Synthetic Polynucleotide
taatacgactcactatagggtgctccatctggatctcattacctcttcgaaacagaggagatcgaagatgtaatgagataacctggcggcagcgcaaaagatg

SEQ ID NO: 9976 - DNA, 103 bp, Artificial Sequence
  Synthetic Polynucleotide
taatacgactcactatagggttttctgctccatctggatctcattacctcaacagaggagagaggtaatgagatccagaaacctggcggcagcgcaaaagatg

SEQ ID NO: 9977 - DNA, 103 bp, Artificial Sequence
  Synthetic Polynucleotide
taatacgactcactatagggagcatttttctgctccatctggatctcattaacagaggagaaatgagatgcagatggagaacctggcggcagcgcaaaagatg

SEQ ID NO: 9978 - DNA, 103 bp, Artificial Sequence
  Synthetic Polynucleotide
taatacgactcactatagggtcattatgttcaacatgtttgagatttcttaacagaggagaaagaaaatgcaaacatgtaacctggcggcagcgcaaaagatg

SEQ ID NO: 9979 - DNA, 103 bp, Artificial Sequence
  Synthetic Polynucleotide
taatacgactcactatagggtcatcagcatttttctgctccatctggatcaacagaggagagatccaatgggagcagaaaacctggcggcagcgcaaaagatg

SEQ ID NO: 9980 - DNA, 103 bp, Artificial Sequence
  Synthetic Polynucleotide
taatacgactcactatagggtccagtcatcagcatttttctgctccatctaacagaggagaagatggatgagaaaaatgaacctggcggcagcgcaaaagatg

SEQ ID NO: 9981 - DNA, 103 bp, Artificial Sequence
  Synthetic Polynucleotide
taatacgactcactatagggaatgttccagtcatcagcatttttctgctcaacagaggagagagcagatgaatgctgataacctggcggcagcgcaaaagatg

SEQ ID NO: 9982 - DNA, 103 bp, Artificial Sequence
  Synthetic Polynucleotide
taatacgactcactatagggcagccaatgttccagtcatcagcatttttcaacagaggagagaaaaaatgtgatgactgaacctggcggcagcgcaaaagatg

SEQ ID NO: 9983 - DNA, 103 bp, Artificial Sequence
  Synthetic Polynucleotide
taatacgactcactataggggaacacagccaatgttccagtcatcagcataacagaggagaatgctgatgactggaacaaacctggcggcagcgcaaaagatg

SEQ ID NO: 9984 - DNA, 103 bp, Artificial Sequence
  Synthetic Polynucleotide
taatacgactcactatagggaggaggaacacagccaatgttccagtcatcaacagaggagagatgacatgaacattggcaacctggcggcagcgcaaaagatg

SEQ ID NO: 9985 - DNA, 103 bp, Artificial Sequence
  Synthetic Polynucleotide
taatacgactcactatagggtgagaaggaggaacacagccaatgttccagaacagaggagactggaaatgtggctgtgtaacctggcggcagcgcaaaagatg

SEQ ID NO: 9986 - DNA, 103 bp, Artificial Sequence
  Synthetic Polynucleotide
taatacgactcactatagggcattgtgagaaggaggaacacagccaatgtaacagaggagaacattgatggtgttcctcaacctggcggcagcgcaaaagatg

SEQ ID NO: 9987 - DNA, 103 bp, Artificial Sequence
  Synthetic Polynucleotide
taatacgactcactatagggtgtcccattgtgagaaggaggaacacagccaacagaggagaggctgtatgcctccttctaacctggcggcagcgcaaaagatg

SEQ ID NO: 9988 - DNA, 103 bp, Artificial Sequence
  Synthetic Polynucleotide
taatacgactcactatagggtcaattgtcccattgtgagaaggaggaacaaacagaggagatgttccatgttctcacaaaacctggcggcagcgcaaaagatg

SEQ ID NO: 9989 - DNA, 103 bp, Artificial Sequence
  Synthetic Polynucleotide
taatacgactcactatagggcctgttcattatgttcaacatgtttgagataacagaggagaatctcaatgatgttgaacaacctggcggcagcgcaaaagatg

SEQ ID NO: 9990 - DNA, 103 bp, Artificial Sequence
  Synthetic Polynucleotide
taatacgactcactatagggccatgtcaattgtcccattgtgagaaggagaacagaggagactccttatgacaatgggaaacctggcggcagcgcaaaagatg

SEQ ID NO: 9991 - DNA, 103 bp, Artificial Sequence
  Synthetic Polynucleotide
taatacgactcactatagggtcattccatgtcaattgtcccattgtgagaaacagaggagatctcacatggggacaattaacctggcggcagcgcaaaagatg

SEQ ID NO: 9992 - DNA, 103 bp, Artificial Sequence
  Synthetic Polynucleotide
taatacgactcactatagggtcagatcattccatgtcaattgtcccattgaacagaggagacaatggatgaattgacataacctggcggcagcgcaaaagatg

SEQ ID NO: 9993 - DNA, 103 bp, Artificial Sequence
  Synthetic Polynucleotide
taatacgactcactatagggcctgatcagatcattccatgtcaattgtccaacagaggagaggacaaatgacatggaataacctggcggcagcgcaaaagatg

SEQ ID NO: 9994 - DNA, 103 bp, Artificial Sequence
  Synthetic Polynucleotide
taatacgactcactatagggcatagcctgatcagatcattccatgtcaataacagaggagaattgacatggaatgatctaacctggcggcagcgcaaaagatg

SEQ ID NO: 9995 - DNA, 103 bp, Artificial Sequence
  Synthetic Polynucleotide
taatacgactcactatagggtgatacatagcctgatcagatcattccatgaacagaggagacatggaatgatctgatcaaacctggcggcagcgcaaaagatg

SEQ ID NO: 9996 - DNA, 103 bp, Artificial Sequence
  Synthetic Polynucleotide
taatacgactcactatagggaaccatgatacatagcctgatcagatcattaacagaggagaaatgatatgatcaggctaaacctggcggcagcgcaaaagatg

SEQ ID NO: 9997 - DNA, 103 bp, Artificial Sequence
  Synthetic Polynucleotide
taatacgactcactataggggctccaaccatgatacatagcctgatcagaaacagaggagatctgatatggctatgtataacctggcggcagcgcaaaagatg

SEQ ID NO: 9998 - DNA, 103 bp, Artificial Sequence
  Synthetic Polynucleotide
taatacgactcactatagggcgttggctccaaccatgatacatagcctgaaacagaggagatcaggcatggtatcatggaacctggcggcagcgcaaaagatg

SEQ ID NO: 9999 - DNA, 103 bp, Artificial Sequence
  Synthetic Polynucleotide
taatacgactcactatagggtgaagcgttggctccaaccatgatacatagaacagaggagactatgtatgatggttggaaacctggcggcagcgcaaaagatg

SEQ ID NO: 10000 - DNA, 103 bp, Artificial Sequence
  Synthetic Polynucleotide
taatacgactcactatagggttcctcctgttcattatgttcaacatgtttaacagaggagaaaacatatggaacataataacctggcggcagcgcaaaagatg

SEQ ID NO: 10001 - DNA, 103 bp, Artificial Sequence
  Synthetic Polynucleotide
taatacgactcactatagggttgtctgaagcgttggctccaaccatgataaacagaggagatatcatatgtggagccaaaacctggcggcagcgcaaaagatg

SEQ ID NO: 10002 - DNA, 103 bp, Artificial Sequence
  Synthetic Polynucleotide
taatacgactcactatagggccatcttgtctgaagcgttggctccaaccaaacagaggagatggttgatgccaacgcttaacctggcggcagcgcaaaagatg

SEQ ID NO: 10003 - DNA, 103 bp, Artificial Sequence
  Synthetic Polynucleotide
taatacgactcactatagggcatccccatcttgtctgaagcgttggctccaacagaggagaggagccatggcttcagacaacctggcggcagcgcaaaagatg

SEQ ID NO: 10004 - DNA, 103 bp, Artificial Sequence
  Synthetic Polynucleotide
taatacgactcactataggggttcccatccccatcttgtctgaagcgttgaacagaggagacaacgcatgagacaagataacctggcggcagcgcaaaagatg

SEQ ID NO: 10005 - DNA, 103 bp, Artificial Sequence
  Synthetic Polynucleotide
taatacgactcactatagggacgttgttcccatccccatcttgtctgaagaacagaggagacttcagatgagatggggaaacctggcggcagcgcaaaagatg

SEQ ID NO: 10006 - DNA, 103 bp, Artificial Sequence
  Synthetic Polynucleotide
taatacgactcactatagggtaggtacgttgttcccatccccatcttgtcaacagaggagagacaagatggggatgggaaacctggcggcagcgcaaaagatg

SEQ ID NO: 10007 - DNA, 103 bp, Artificial Sequence
  Synthetic Polynucleotide
taatacgactcactatagggaaagctaggtacgttgttcccatccccatcaacagaggagagatgggatggggaacaacaacctggcggcagcgcaaaagatg

SEQ ID NO: 10008 - DNA, 103 bp, Artificial Sequence
  Synthetic Polynucleotide
taatacgactcactatagggccatcaaagctaggtacgttgttcccatccaacagaggagaggatggatgcaacgtaccaacctggcggcagcgcaaaagatg

SEQ ID NO: 10009 - DNA, 103 bp, Artificial Sequence
  Synthetic Polynucleotide
taatacgactcactatagggagtggccatcaaagctaggtacgttgttccaacagaggagaggaacaatgtacctagctaacctggcggcagcgcaaaagatg

SEQ ID NO: 10010 - DNA, 103 bp, Artificial Sequence
  Synthetic Polynucleotide
taatacgactcactatagggctgaaagtggccatcaaagctaggtacgttaacagaggagaaacgtaatgagctttgataacctggcggcagcgcaaaagatg

SEQ ID NO: 10011 - DNA, 103 bp, Artificial Sequence
  Synthetic Polynucleotide
taatacgactcactatagggatcttttcctcctgttcattatgttcaacaaacagaggagatgttgaatgtaatgaacaaacctggcggcagcgcaaaagatg

SEQ ID NO: 10012 - DNA, 103 bp, Artificial Sequence
  Synthetic Polynucleotide
taatacgactcactatagggtcattctgaaagtggccatcaaagctaggtaacagaggagaacctagatgtgatggccaaacctggcggcagcgcaaaagatg

SEQ ID NO: 10013 - DNA, 103 bp, Artificial Sequence
  Synthetic Polynucleotide
taatacgactcactatagggtggtctcattctgaaagtggccatcaaagcaacagaggagagctttgatggccactttcaacctggcggcagcgcaaaagatg

SEQ ID NO: 10014 - DNA, 103 bp, Artificial Sequence
  Synthetic Polynucleotide
taatacgactcactatagggaacattggtctcattctgaaagtggccatcaacagaggagagatggcatgtttcagaataacctggcggcagcgcaaaagatg

SEQ ID NO: 10015 - DNA, 103 bp, Artificial Sequence
  Synthetic Polynucleotide
taatacgactcactatagggctgcgaacattggtctcattctgaaagtggaacagaggagaccacttatggaatgagacaacctggcggcagcgcaaaagatg

SEQ ID NO: 10016 - DNA, 103 bp, Artificial Sequence
  Synthetic Polynucleotide
taatacgactcactatagggcccgactgcgaacattggtctcattctgaaaacagaggagattcagaatgagaccaatgaacctggcggcagcgcaaaagatg

SEQ ID NO: 10017 - DNA, 103 bp, Artificial Sequence
  Synthetic Polynucleotide
taatacgactcactatagggagtagcccgactgcgaacattggtctcattaacagaggagaaatgagatgaatgttcgcaacctggcggcagcgcaaaagatg

SEQ ID NO: 10018 - DNA, 103 bp, Artificial Sequence
  Synthetic Polynucleotide
taatacgactcactataggggaaacagtagcccgactgcgaacattggtcaacagaggagagaccaaatgtcgcagtcgaacctggcggcagcgcaaaagatg

SEQ ID NO: 10019 - DNA, 103 bp, Artificial Sequence
  Synthetic Polynucleotide
taatacgactcactatagggtctgcgaaacagtagcccgactgcgaacataacagaggagaatgttcatggtcgggctaaacctggcggcagcgcaaaagatg

SEQ ID NO: 10020 - DNA, 103 bp, Artificial Sequence
  Synthetic Polynucleotide
taatacgactcactataggggttaatctgcgaaacagtagcccgactgcgaacagaggagacgcagtatggctactgttaacctggcggcagcgcaaaagatg

SEQ ID NO: 10021 - DNA, 103 bp, Artificial Sequence
  Synthetic Polynucleotide
taatacgactcactatagggtagatgttaatctgcgaaacagtagcccgaaacagaggagatcgggcatgtgtttcgcaaacctggcggcagcgcaaaagatg

SEQ ID NO: 10022 - DNA, 103 bp, Artificial Sequence
  Synthetic Polynucleotide
taatacgactcactatagggcacagatcttttcctcctgttcattatgttaacagaggagaaacataatgaacaggaggaacctggcggcagcgcaaaagatg

SEQ ID NO: 10023 - DNA, 103 bp, Artificial Sequence
  Synthetic Polynucleotide
taatacgactcactatagggttctctagatgttaatctgcgaaacagtagaacagaggagactactgatgcgcagattaaacctggcggcagcgcaaaagatg

SEQ ID NO: 10024 - DNA, 103 bp, Artificial Sequence
  Synthetic Polynucleotide
taatacgactcactatagggagaacttctctagatgttaatctgcgaaacaacagaggagagtttcgatgattaacatcaacctggcggcagcgcaaaagatg

SEQ ID NO: 10025 - DNA, 103 bp, Artificial Sequence
  Synthetic Polynucleotide
taatacgactcactataggggaagaagaacttctctagatgttaatctgcaacagaggagagcagatatgcatctagagaacctggcggcagcgcaaaagatg

SEQ ID NO: 10026 - DNA, 103 bp, Artificial Sequence
  Synthetic Polynucleotide
taatacgactcactatagggtgtaagaagaagaacttctctagatgttaaaacagaggagattaacaatgagagaagttaacctggcggcagcgcaaaagatg

SEQ ID NO: 10027 - DNA, 103 bp, Artificial Sequence
  Synthetic Polynucleotide
taatacgactcactatagggccaactgtaagaagaagaacttctctagataacagaggagaatctagatgagttcttctaacctggcggcagcgcaaaagatg

SEQ ID NO: 10028 - DNA, 103 bp, Artificial Sequence
  Synthetic Polynucleotide
taatacgactcactatagggtcaatccaactgtaagaagaagaacttctcaacagaggagagagaagatgttcttcttaaacctggcggcagcgcaaaagatg

SEQ ID NO: 10029 - DNA, 103 bp, Artificial Sequence
  Synthetic Polynucleotide
taatacgactcactatagggcagactcaatccaactgtaagaagaagaacaacagaggagagttcttatgcttacagttaacctggcggcagcgcaaaagatg

SEQ ID NO: 10030 - DNA, 103 bp, Artificial Sequence
  Synthetic Polynucleotide
taatacgactcactataggggccaccagactcaatccaactgtaagaagaaacagaggagatcttctatgagttggattaacctggcggcagcgcaaaagatg

SEQ ID NO: 10031 - DNA, 103 bp, Artificial Sequence
  Synthetic Polynucleotide
taatacgactcactatagggcagatgccaccagactcaatccaactgtaaaacagaggagattacagatggattgagtcaacctggcggcagcgcaaaagatg

SEQ ID NO: 10032 - DNA, 103 bp, Artificial Sequence
  Synthetic Polynucleotide
taatacgactcactatagggttctacagatgccaccagactcaatccaacaacagaggagagttggaatgagtctggtgaacctggcggcagcgcaaaagatg

SEQ ID NO: 10033 - DNA, 103 bp, Artificial Sequence
  Synthetic Polynucleotide
taatacgactcactatagggatggtcacagatcttttcctcctgttcattaacagaggagaaatgaaatggaggaaaagaacctggcggcagcgcaaaagatg

SEQ ID NO: 10034 - DNA, 103 bp, Artificial Sequence
  Synthetic Polynucleotide
taatacgactcactatagggggtagttctacagatgccaccagactcaataacagaggagaattgagatgggtggcatcaacctggcggcagcgcaaaagatg

SEQ ID NO: 10035 - DNA, 103 bp, Artificial Sequence
  Synthetic Polynucleotide
taatacgactcactatagggaatttggtagttctacagatgccaccagacaacagaggagagtctggatgcatctgtagaacctggcggcagcgcaaaagatg

SEQ ID NO: 10036 - DNA, 103 bp, Artificial Sequence
  Synthetic Polynucleotide
taatacgactcactatagggtaaggaatttggtagttctacagatgccacaacagaggagagtggcaatggtagaactaaacctggcggcagcgcaaaagatg

SEQ ID NO: 10037 - DNA, 103 bp, Artificial Sequence
  Synthetic Polynucleotide
taatacgactcactatagggtcctctaaggaatttggtagttctacagataacagaggagaatctgtatgactaccaaaaacctggcggcagcgcaaaagatg

SEQ ID NO: 10038 - DNA, 103 bp, Artificial Sequence
  Synthetic Polynucleotide
taatacgactcactatagggctagctcctctaaggaatttggtagttctaaacagaggagatagaacatgcaaattcctaacctggcggcagcgcaaaagatg

SEQ ID NO: 10039 - DNA, 103 bp, Artificial Sequence
  Synthetic Polynucleotide
taatacgactcactatagggatcccctagctcctctaaggaatttggtagaacagaggagactaccaatgtccttagagaacctggcggcagcgcaaaagatg

SEQ ID NO: 10040 - DNA, 103 bp, Artificial Sequence
  Synthetic Polynucleotide
taatacgactcactatagggagtccatcccctagctcctctaaggaatttaacagaggagaaaattcatgagaggagctaacctggcggcagcgcaaaagatg

SEQ ID NO: 10041 - DNA, 103 bp, Artificial Sequence
  Synthetic Polynucleotide
taatacgactcactatagggttgcaagtccatcccctagctcctctaaggaacagaggagaccttagatgagctaggggaacctggcggcagcgcaaaagatg

SEQ ID NO: 10042 - DNA, 103 bp, Artificial Sequence
  Synthetic Polynucleotide
taatacgactcactataggggcccattgcaagtccatcccctagctcctcaacagaggagagaggagatgggggatggaaacctggcggcagcgcaaaagatg

SEQ ID NO: 10043 - DNA, 103 bp, Artificial Sequence
  Synthetic Polynucleotide
taatacgactcactatagggatgatgcccattgcaagtccatcccctagcaacagaggagagctaggatgtggacttgcaacctggcggcagcgcaaaagatg

SEQ ID NO: 10044 - DNA, 103 bp, Artificial Sequence
  Synthetic Polynucleotide
taatacgactcactatagggggagcatggtcacagatcttttcctcctgtaacagaggagaacaggaatgaaagatctgaacctggcggcagcgcaaaagatg

SEQ ID NO: 10045 - DNA, 103 bp, Artificial Sequence
  Synthetic Polynucleotide
taatacgactcactatagggacatcatgatgcccattgcaagtccatcccaacagaggagagggatgatgttgcaatggaacctggcggcagcgcaaaagatg

SEQ ID NO: 10046 - DNA, 103 bp, Artificial Sequence
  Synthetic Polynucleotide
taatacgactcactatagggtttcaacatcatgatgcccattgcaagtccaacagaggagaggacttatgatgggcatcaacctggcggcagcgcaaaagatg

SEQ ID NO: 10047 - DNA, 103 bp, Artificial Sequence
  Synthetic Polynucleotide
taatacgactcactatagggagtaatttcaacatcatgatgcccattgcaaacagaggagatgcaatatgcatcatgataacctggcggcagcgcaaaagatg

SEQ ID NO: 10048 - DNA, 103 bp, Artificial Sequence
  Synthetic Polynucleotide
taatacgactcactatagggcagtcagtaatttcaacatcatgatgcccaaacagaggagatgggcaatgtgatgttgaaacctggcggcagcgcaaaagatg

SEQ ID NO: 10049 - DNA, 103 bp, Artificial Sequence
  Synthetic Polynucleotide
taatacgactcactatagggaaaatcagtcagtaatttcaacatcatgataacagaggagaatcatgatgttgaaattaaacctggcggcagcgcaaaagatg

SEQ ID NO: 10050 - DNA, 103 bp, Artificial Sequence
  Synthetic Polynucleotide
taatacgactcactataggggactgaaaatcagtcagtaatttcaacatcaacagaggagagatgttatgattactgacaacctggcggcagcgcaaaagatg

SEQ ID NO: 10051 - DNA, 103 bp, Artificial Sequence
  Synthetic Polynucleotide
taatacgactcactataggggatgtgactgaaaatcagtcagtaatttcaaacagaggagatgaaatatgtgactgattaacctggcggcagcgcaaaagatg

SEQ ID NO: 10052 - DNA, 103 bp, Artificial Sequence
  Synthetic Polynucleotide
taatacgactcactatagggtagctgatgtgactgaaaatcagtcagtaaaacagaggagattactgatggattttcagaacctggcggcagcgcaaaagatg

SEQ ID NO: 10053 - DNA, 103 bp, Artificial Sequence
  Synthetic Polynucleotide
taatacgactcactataggggcccatagctgatgtgactgaaaatcagtcaacagaggagagactgaatgtcagtcacaaacctggcggcagcgcaaaagatg

SEQ ID NO: 10054 - DNA, 103 bp, Artificial Sequence
  Synthetic Polynucleotide
taatacgactcactatagggaggtagcccatagctgatgtgactgaaaataacagaggagaattttcatgcacatcagcaacctggcggcagcgcaaaagatg

SEQ ID NO: 10055 - DNA, 103 bp, Artificial Sequence
  Synthetic Polynucleotide
taatacgactcactatagggcatgaggagcatggtcacagatcttttcctaacagaggagaaggaaaatgtctgtgaccaacctggcggcagcgcaaaagatg

SEQ ID NO: 10056 - DNA, 103 bp, Artificial Sequence
  Synthetic Polynucleotide
taatacgactcactatagggcagcaaggtagcccatagctgatgtgactgaacagaggagacagtcaatgcagctatggaacctggcggcagcgcaaaagatg

SEQ ID NO: 10057 - DNA, 103 bp, Artificial Sequence
  Synthetic Polynucleotide
taatacgactcactatagggaaagacagcaaggtagcccatagctgatgtaacagaggagaacatcaatgatgggctacaacctggcggcagcgcaaaagatg

SEQ ID NO: 10058 - DNA, 103 bp, Artificial Sequence
  Synthetic Polynucleotide
taatacgactcactatagggatgttaaagacagcaaggtagcccatagctaacagaggagaagctatatgctaccttgcaacctggcggcagcgcaaaagatg

SEQ ID NO: 10059 - DNA, 103 bp, Artificial Sequence
  Synthetic Polynucleotide
taatacgactcactataggggacaaatgttaaagacagcaaggtagcccaaacagaggagatgggctatgttgctgtctaacctggcggcagcgcaaaagatg

SEQ ID NO: 10060 - DNA, 103 bp, Artificial Sequence
  Synthetic Polynucleotide
taatacgactcactataggggttttgacaaatgttaaagacagcaaggtaaacagaggagataccttatggtctttaacaacctggcggcagcgcaaaagatg

SEQ ID NO: 10061 - DNA, 103 bp, Artificial Sequence
  Synthetic Polynucleotide
taatacgactcactatagggaagttgttttgacaaatgttaaagacagcaaacagaggagatgctgtatgtaacatttgaacctggcggcagcgcaaaagatg

SEQ ID NO: 10062 - DNA, 103 bp, Artificial Sequence
  Synthetic Polynucleotide
taatacgactcactatagggtgaaaaagttgttttgacaaatgttaaagaaacagaggagatctttaatgtttgtcaaaaacctggcggcagcgcaaaagatg

SEQ ID NO: 10063 - DNA, 103 bp, Artificial Sequence
  Synthetic Polynucleotide
taatacgactcactatagggtgcaatgaaaaagttgttttgacaaatgttaacagaggagaaacattatgcaaaacaacaacctggcggcagcgcaaaagatg

SEQ ID NO: 10064 - DNA, 103 bp, Artificial Sequence
  Synthetic Polynucleotide
taatacgactcactatagggcatagtgcaatgaaaaagttgttttgacaaaacagaggagattgtcaatgcaactttttaacctggcggcagcgcaaaagatg

SEQ ID NO: 10065 - DNA, 103 bp, Artificial Sequence
  Synthetic Polynucleotide
taatacgactcactatagggccatgcatagtgcaatgaaaaagttgttttaacagaggagaaaaacaatgttttcattgaacctggcggcagcgcaaaagatg

SEQ ID NO: 10066 - DNA, 103 bp, Artificial Sequence
  Synthetic Polynucleotide
taatacgactcactatagggagcagcatgaggagcatggtcacagatcttaacagaggagaaagatcatggaccatgctaacctggcggcagcgcaaaagatg

SEQ ID NO: 10067 - DNA, 103 bp, Artificial Sequence
  Synthetic Polynucleotide
taatacgactcactataggggtcttccatgcatagtgcaatgaaaaagttaacagaggagaaactttatgattgcactaaacctggcggcagcgcaaaagatg

SEQ ID NO: 10068 - DNA, 103 bp, Artificial Sequence
  Synthetic Polynucleotide
taatacgactcactatagggccattgtcttccatgcatagtgcaatgaaaaacagaggagatttcatatgactatgcataacctggcggcagcgcaaaagatg

SEQ ID NO: 10069 - DNA, 103 bp, Artificial Sequence
  Synthetic Polynucleotide
taatacgactcactatagggcatagccattgtcttccatgcatagtgcaaaacagaggagattgcacatggcatggaagaacctggcggcagcgcaaaagatg

SEQ ID NO: 10070 - DNA, 103 bp, Artificial Sequence
  Synthetic Polynucleotide
taatacgactcactatagggagtatcatagccattgtcttccatgcatagaacagaggagactatgcatggaagacaataacctggcggcagcgcaaaagatg

SEQ ID NO: 10071 - DNA, 103 bp, Artificial Sequence
  Synthetic Polynucleotide
taatacgactcactatagggttgacagtatcatagccattgtcttccatgaacagaggagacatggaatgcaatggctaaacctggcggcagcgcaaaagatg

SEQ ID NO: 10072 - DNA, 103 bp, Artificial Sequence
  Synthetic Polynucleotide
taatacgactcactatagggtacaattgacagtatcatagccattgtcttaacagaggagaaagacaatggctatgataaacctggcggcagcgcaaaagatg

SEQ ID NO: 10073 - DNA, 103 bp, Artificial Sequence
  Synthetic Polynucleotide
taatacgactcactatagggagagatacaattgacagtatcatagccattaacagaggagaaatggcatggatactgtcaacctggcggcagcgcaaaagatg

SEQ ID NO: 10074 - DNA, 103 bp, Artificial Sequence
  Synthetic Polynucleotide
taatacgactcactatagggggaagagagatacaattgacagtatcatagaacagaggagactatgaatgtgtcaattgaacctggcggcagcgcaaaagatg

SEQ ID NO: 10075 - DNA, 103 bp, Artificial Sequence
  Synthetic Polynucleotide
taatacgactcactatagggtaaagggaagagagatacaattgacagtataacagaggagaatactgatgattgtatctaacctggcggcagcgcaaaagatg

SEQ ID NO: 10076 - DNA, 103 bp, Artificial Sequence
  Synthetic Polynucleotide
taatacgactcactatagggaggcataaagggaagagagatacaattgacaacagaggagagtcaatatgatctctcttaacctggcggcagcgcaaaagatg

SEQ ID NO: 10077 - DNA, 103 bp, Artificial Sequence
  Synthetic Polynucleotide
taatacgactcactatagggtagaactacgttaagcaagcttccgattcgaacagaggagacgaatcatgagcttgcttaacctggcggcagcgcaaaagatg

SEQ ID NO: 10078 - DNA, 103 bp, Artificial Sequence
  Synthetic Polynucleotide
taatacgactcactatagggtgggcagcagcatgaggagcatggtcacagaacagaggagactgtgaatgtgctcctcaaacctggcggcagcgcaaaagatg

SEQ ID NO: 10079 - DNA, 103 bp, Artificial Sequence
  Synthetic Polynucleotide
taatacgactcactatagggtggacaggcataaagggaagagagatacaaaacagaggagattgtatatgtcttcccttaacctggcggcagcgcaaaagatg

SEQ ID NO: 10080 - DNA, 103 bp, Artificial Sequence
  Synthetic Polynucleotide
taatacgactcactatagggagtcgtggacaggcataaagggaagagagaaacagaggagatctctcatgcctttatgcaacctggcggcagcgcaaaagatg

SEQ ID NO: 10081 - DNA, 103 bp, Artificial Sequence
  Synthetic Polynucleotide
taatacgactcactatagggtgagaagtcgtggacaggcataaagggaagaacagaggagacttcccatgatgcctgtcaacctggcggcagcgcaaaagatg

SEQ ID NO: 10082 - DNA, 103 bp, Artificial Sequence
  Synthetic Polynucleotide
taatacgactcactatagggttttttgagaagtcgtggacaggcataaagaacagaggagactttatatgtgtccacgaaacctggcggcagcgcaaaagatg

SEQ ID NO: 10083 - DNA, 103 bp, Artificial Sequence
  Synthetic Polynucleotide
taatacgactcactatagggtgttgttttttgagaagtcgtggacaggcaaacagaggagatgcctgatgacgacttctaacctggcggcagcgcaaaagatg

SEQ ID NO: 10084 - DNA, 103 bp, Artificial Sequence
  Synthetic Polynucleotide
taatacgactcactatagggagccatgttgttttttgagaagtcgtggacaacagaggagagtccacatgttctcaaaaaacctggcggcagcgcaaaagatg

SEQ ID NO: 10085 - DNA, 103 bp, Artificial Sequence
  Synthetic Polynucleotide
taatacgactcactatagggccggaagccatgttgttttttgagaagtcgaacagaggagacgacttatgaaaaaacaaaacctggcggcagcgcaaaagatg

SEQ ID NO: 10086 - DNA, 103 bp, Artificial Sequence
  Synthetic Polynucleotide
taatacgactcactatagggcaacaccggaagccatgttgttttttgagaaacagaggagatctcaaatgacaacatggaacctggcggcagcgcaaaagatg

SEQ ID NO: 10087 - DNA, 103 bp, Artificial Sequence
  Synthetic Polynucleotide
taatacgactcactatagggcccagcaacaccggaagccatgttgtttttaacagaggagaaaaaacatgatggcttccaacctggcggcagcgcaaaagatg

SEQ ID NO: 10088 - DNA, 103 bp, Artificial Sequence
  Synthetic Polynucleotide
taatacgactcactataggggagatcccagcaacaccggaagccatgttgaacagaggagacaacatatgttccggtgtaacctggcggcagcgcaaaagatg

SEQ ID NO: 10089 - DNA, 103 bp, Artificial Sequence
  Synthetic Polynucleotide
taatacgactcactatagggggctgtgggcagcagcatgaggagcatggtaacagaggagaaccatgatgctcatgctgaacctggcggcagcgcaaaagatg

SEQ ID NO: 10090 - DNA, 103 bp, Artificial Sequence
  Synthetic Polynucleotide
taatacgactcactatagggtccaagagatcccagcaacaccggaagccaaacagaggagatggcttatggtgttgctgaacctggcggcagcgcaaaagatg

SEQ ID NO: 10091 - DNA, 103 bp, Artificial Sequence
  Synthetic Polynucleotide
taatacgactcactatagggttgcatccaagagatcccagcaacaccggaaacagaggagatccggtatggctgggatcaacctggcggcagcgcaaaagatg

SEQ ID NO: 10092 - DNA, 103 bp, Artificial Sequence
  Synthetic Polynucleotide
taatacgactcactataggggtggtttgcatccaagagatcccagcaacaaacagaggagatgttgcatggatctcttgaacctggcggcagcgcaaaagatg

SEQ ID NO: 10093 - DNA, 103 bp, Artificial Sequence
  Synthetic Polynucleotide
taatacgactcactatagggggttagtggtttgcatccaagagatcccagaacagaggagactgggaatgcttggatgcaacctggcggcagcgcaaaagatg

SEQ ID NO: 10094 - DNA, 103 bp, Artificial Sequence
  Synthetic Polynucleotide
taatacgactcactatagggaacatggttagtggtttgcatccaagagataacagaggagaatctctatgatgcaaaccaacctggcggcagcgcaaaagatg

SEQ ID NO: 10095 - DNA, 103 bp, Artificial Sequence
  Synthetic Polynucleotide
taatacgactcactatagggtaagaaacatggttagtggtttgcatccaaaacagaggagattggatatgaaccactaaaacctggcggcagcgcaaaagatg

SEQ ID NO: 10096 - DNA, 103 bp, Artificial Sequence
  Synthetic Polynucleotide
taatacgactcactatagggtgttataagaaacatggttagtggtttgcaaacagaggagatgcaaaatgctaaccatgaacctggcggcagcgcaaaagatg

SEQ ID NO: 10097 - DNA, 103 bp, Artificial Sequence
  Synthetic Polynucleotide
taatacgactcactatagggttttctgttataagaaacatggttagtggtaacagaggagaaccactatgcatgtttctaacctggcggcagcgcaaaagatg

SEQ ID NO: 10098 - DNA, 103 bp, Artificial Sequence
  Synthetic Polynucleotide
taatacgactcactatagggttttgttttctgttataagaaacatggttaaacagaggagataaccaatgttcttataaaacctggcggcagcgcaaaagatg

SEQ ID NO: 10099 - DNA, 103 bp, Artificial Sequence
  Synthetic Polynucleotide
taatacgactcactatagggccagattttgttttctgttataagaaacataacagaggagaatgtttatgataacagaaaacctggcggcagcgcaaaagatg

SEQ ID NO: 10100 - DNA, 103 bp, Artificial Sequence
  Synthetic Polynucleotide
taatacgactcactataggggccagggctgtgggcagcagcatgaggagcaacagaggagagctcctatggctgctgccaacctggcggcagcgcaaaagatg

SEQ ID NO: 10101 - DNA, 103 bp, Artificial Sequence
  Synthetic Polynucleotide
taatacgactcactatagggcttccccagattttgttttctgttataagaaacagaggagatcttatatgagaaaacaaaacctggcggcagcgcaaaagatg

SEQ ID NO: 10102 - DNA, 103 bp, Artificial Sequence
  Synthetic Polynucleotide
taatacgactcactatagggttttccttccccagattttgttttctgttaaacagaggagataacagatgacaaaatctaacctggcggcagcgcaaaagatg

SEQ ID NO: 10103 - DNA, 103 bp, Artificial Sequence
  Synthetic Polynucleotide
taatacgactcactatagggccagcttttccttccccagattttgttttcaacagaggagagaaaacatgatctggggaaacctggcggcagcgcaaaagatg

SEQ ID NO: 10104 - DNA, 103 bp, Artificial Sequence
  Synthetic Polynucleotide
taatacgactcactatagggagaggccagcttttccttccccagattttgaacagaggagacaaaatatggggaaggaaaacctggcggcagcgcaaaagatg

SEQ ID NO: 10105 - DNA, 103 bp, Artificial Sequence
  Synthetic Polynucleotide
taatacgactcactatagggcattgagaggccagcttttccttccccagaaacagaggagatctgggatgggaaaagctaacctggcggcagcgcaaaagatg

SEQ ID NO: 10106 - DNA, 103 bp, Artificial Sequence
  Synthetic Polynucleotide
taatacgactcactatagggtccttcattgagaggccagcttttccttccaacagaggagaggaaggatgagctggcctaacctggcggcagcgcaaaagatg

SEQ ID NO: 10107 - DNA, 103 bp, Artificial Sequence
  Synthetic Polynucleotide
taatacgactcactatagggataattccttcattgagaggccagcttttcaacagaggagagaaaagatggcctctcaaaacctggcggcagcgcaaaagatg

SEQ ID NO: 10108 - DNA, 103 bp, Artificial Sequence
  Synthetic Polynucleotide
taatacgactcactatagggcagccataattccttcattgagaggccagcaacagaggagagctggcatgtcaatgaagaacctggcggcagcgcaaaagatg

SEQ ID NO: 10109 - DNA, 103 bp, Artificial Sequence
  Synthetic Polynucleotide
taatacgactcactatagggtccaacagccataattccttcattgagaggaacagaggagacctctcatggaaggaattaacctggcggcagcgcaaaagatg

SEQ ID NO: 10110 - DNA, 103 bp, Artificial Sequence
  Synthetic Polynucleotide
taatacgactcactatagggactattccaacagccataattccttcattgaacagaggagacaatgaatgaattatggcaacctggcggcagcgcaaaagatg

SEQ ID NO: 10111 - DNA, 103 bp, Artificial Sequence
  Synthetic Polynucleotide
taatacgactcactatagggggaacgccagggctgtgggcagcagcatgaaacagaggagatcatgcatgtgcccacagaacctggcggcagcgcaaaagatg

SEQ ID NO: 10112 - DNA, 103 bp, Artificial Sequence
  Synthetic Polynucleotide
taatacgactcactatagggtgctaactattccaacagccataattccttaacagaggagaaaggaaatgtggctgttgaacctggcggcagcgcaaaagatg

SEQ ID NO: 10113 - DNA, 103 bp, Artificial Sequence
  Synthetic Polynucleotide
taatacgactcactatagggaagaatgctaactattccaacagccataataacagaggagaattatgatggttggaataaacctggcggcagcgcaaaagatg

SEQ ID NO: 10114 - DNA, 103 bp, Artificial Sequence
  Synthetic Polynucleotide
taatacgactcactatagggcttagaagaatgctaactattccaacagccaacagaggagaggctgtatgaatagttagaacctggcggcagcgcaaaagatg

SEQ ID NO: 10115 - DNA, 103 bp, Artificial Sequence
  Synthetic Polynucleotide
taatacgactcactataggggtgaacttagaagaatgctaactattccaaaacagaggagattggaaatgttagcattcaacctggcggcagcgcaaaagatg

SEQ ID NO: 10116 - DNA, 103 bp, Artificial Sequence
  Synthetic Polynucleotide
taatacgactcactataggggagaagtgaacttagaagaatgctaactataacagaggagaatagttatgattcttctaaacctggcggcagcgcaaaagatg

SEQ ID NO: 10117 - DNA, 103 bp, Artificial Sequence
  Synthetic Polynucleotide
taatacgactcactatagggttcttgagaagtgaacttagaagaatgctaaacagaggagatagcatatgtctaagttcaacctggcggcagcgcaaaagatg

SEQ ID NO: 10118 - DNA, 103 bp, Artificial Sequence
  Synthetic Polynucleotide
taatacgactcactatagggcatcattcttgagaagtgaacttagaagaaaacagaggagattcttcatggttcacttcaacctggcggcagcgcaaaagatg

SEQ ID NO: 10119 - DNA, 103 bp, Artificial Sequence
  Synthetic Polynucleotide
taatacgactcactatagggtggcacatcattcttgagaagtgaacttagaacagaggagactaagtatgcttctcaagaacctggcggcagcgcaaaagatg

SEQ ID NO: 10120 - DNA, 103 bp, Artificial Sequence
  Synthetic Polynucleotide
taatacgactcactataggggctagtggcacatcattcttgagaagtgaaaacagaggagattcactatgcaagaatgaaacctggcggcagcgcaaaagatg

SEQ ID NO: 10121 - DNA, 103 bp, Artificial Sequence
  Synthetic Polynucleotide
taatacgactcactatagggggccagctagtggcacatcattcttgagaaaacagaggagattctcaatgatgatgtgcaacctggcggcagcgcaaaagatg

SEQ ID NO: 10122 - DNA, 103 bp, Artificial Sequence
  Synthetic Polynucleotide
taatacgactcactatagggcagatggaacgccagggctgtgggcagcagaacagaggagactgctgatgacagccctgaacctggcggcagcgcaaaagatg

SEQ ID NO: 10123 - DNA, 103 bp, Artificial Sequence
  Synthetic Polynucleotide
taatacgactcactatagggtagtgggccagctagtggcacatcattcttaacagaggagaaagaatatggtgccactaaacctggcggcagcgcaaaagatg

SEQ ID NO: 10124 - DNA, 103 bp, Artificial Sequence
  Synthetic Polynucleotide
taatacgactcactataggggctattagtgggccagctagtggcacatcaaacagaggagatgatgtatgactagctggaacctggcggcagcgcaaaagatg

SEQ ID NO: 10125 - DNA, 103 bp, Artificial Sequence
  Synthetic Polynucleotide
taatacgactcactatagggctccagctattagtgggccagctagtggcaaacagaggagatgccacatgctggcccacaacctggcggcagcgcaaaagatg

SEQ ID NO: 10126 - DNA, 103 bp, Artificial Sequence
  Synthetic Polynucleotide
taatacgactcactatagggcatgcctccagctattagtgggccagctagaacagaggagactagctatgccactaataaacctggcggcagcgcaaaagatg

SEQ ID NO: 10127 - DNA, 103 bp, Artificial Sequence
  Synthetic Polynucleotide
taatacgactcactatagggattagcatgcctccagctattagtgggccaaacagaggagatggcccatgaatagctggaacctggcggcagcgcaaaagatg

SEQ ID NO: 10128 - DNA, 103 bp, Artificial Sequence
  Synthetic Polynucleotide
taatacgactcactatagggatgctattagcatgcctccagctattagtgaacagaggagacactaaatgctggaggcaaacctggcggcagcgcaaaagatg

SEQ ID NO: 10129 - DNA, 103 bp, Artificial Sequence
  Synthetic Polynucleotide
taatacgactcactatagggataacatgctattagcatgcctccagctataacagaggagaatagctatgggcatgctaaacctggcggcagcgcaaaagatg

SEQ ID NO: 10130 - DNA, 103 bp, Artificial Sequence
  Synthetic Polynucleotide
taatacgactcactatagggatgacataacatgctattagcatgcctccaaacagaggagatggaggatggctaatagcaacctggcggcagcgcaaaagatg

SEQ ID NO: 10131 - DNA, 103 bp, Artificial Sequence
  Synthetic Polynucleotide
taatacgactcactatagggcagatatgacataacatgctattagcatgcaacagaggagagcatgcatgtagcatgttaacctggcggcagcgcaaaagatg

SEQ ID NO: 10132 - DNA, 103 bp, Artificial Sequence
  Synthetic Polynucleotide
taatacgactcactataggggcttccagatatgacataacatgctattagaacagaggagactaataatgtgttatgtcaacctggcggcagcgcaaaagatg

SEQ ID NO: 10133 - DNA, 103 bp, Artificial Sequence
  Synthetic Polynucleotide
taatacgactcactataggggtggtcagatggaacgccagggctgtgggcaacagaggagagcccacatgcctggcgttaacctggcggcagcgcaaaagatg

SEQ ID NO: 10134 - DNA, 103 bp, Artificial Sequence
  Synthetic Polynucleotide
taatacgactcactataggggccgagcttccagatatgacataacatgctaacagaggagaagcatgatgtgtcatatcaacctggcggcagcgcaaaagatg

SEQ ID NO: 10135 - DNA, 103 bp, Artificial Sequence
  Synthetic Polynucleotide
taatacgactcactatagggaatcggccgagcttccagatatgacataacaacagaggagagttatgatgtatctggaaaacctggcggcagcgcaaaagatg

SEQ ID NO: 10136 - DNA, 103 bp, Artificial Sequence
  Synthetic Polynucleotide
taatacgactcactatagggtgataaatcggccgagcttccagatatgacaacagaggagagtcataatgggaagctcgaacctggcggcagcgcaaaagatg

SEQ ID NO: 10137 - DNA, 103 bp, Artificial Sequence
  Synthetic Polynucleotide
taatacgactcactatagggtccagtgataaatcggccgagcttccagataacagaggagaatctggatgctcggccgaaacctggcggcagcgcaaaagatg

SEQ ID NO: 10138 - DNA, 103 bp, Artificial Sequence
  Synthetic Polynucleotide
taatacgactcactatagggctttctccagtgataaatcggccgagcttcaacagaggagagaagctatgccgatttataacctggcggcagcgcaaaagatg

SEQ ID NO: 10139 - DNA, 103 bp, Artificial Sequence
  Synthetic Polynucleotide
taatacgactcactatagggagccgctttctccagtgataaatcggccgaaacagaggagatcggccatgttatcactgaacctggcggcagcgcaaaagatg

SEQ ID NO: 10140 - DNA, 103 bp, Artificial Sequence
  Synthetic Polynucleotide
taatacgactcactatagggacctcagccgctttctccagtgataaatcgaacagaggagacgatttatgactggagaaaacctggcggcagcgcaaaagatg

SEQ ID NO: 10141 - DNA, 103 bp, Artificial Sequence
  Synthetic Polynucleotide
taatacgactcactatagggaggagacctcagccgctttctccagtgataaacagaggagatatcacatgagaaagcggaacctggcggcagcgcaaaagatg

SEQ ID NO: 10142 - DNA, 103 bp, Artificial Sequence
  Synthetic Polynucleotide
taatacgactcactatagggttcccaggagacctcagccgctttctccagaacagaggagactggagatggcggctgagaacctggcggcagcgcaaaagatg

SEQ ID NO: 10143 - DNA, 103 bp, Artificial Sequence
  Synthetic Polynucleotide
taatacgactcactatagggtcttcttcccaggagacctcagccgctttcaacagaggagagaaagcatgtgaggtctcaacctggcggcagcgcaaaagatg

SEQ ID NO: 10144 - DNA, 103 bp, Artificial Sequence
  Synthetic Polynucleotide
taatacgactcactatagggctcgggtggtcagatggaacgccagggctgaacagaggagacagcccatgcgttccatcaacctggcggcagcgcaaaagatg

SEQ ID NO: 10145 - DNA, 103 bp, Artificial Sequence
  Synthetic Polynucleotide
taatacgactcactatagggctgcttcttcttcccaggagacctcagccgaacagaggagacggctgatgtctcctgggaacctggcggcagcgcaaaagatg

SEQ ID NO: 10146 - DNA, 103 bp, Artificial Sequence
  Synthetic Polynucleotide
taatacgactcactataggggtgttctgcttcttcttcccaggagacctcaacagaggagagaggtcatgtgggaagaaaacctggcggcagcgcaaaagatg

SEQ ID NO: 10147 - DNA, 103 bp, Artificial Sequence
  Synthetic Polynucleotide
taatacgactcactatagggccagagtgttctgcttcttcttcccaggagaacagaggagactcctgatgagaagaagcaacctggcggcagcgcaaaagatg

SEQ ID NO: 10148 - DNA, 103 bp, Artificial Sequence
  Synthetic Polynucleotide
taatacgactcactatagggaggcaccagagtgttctgcttcttcttcccaacagaggagagggaagatgaagcagaacaacctggcggcagcgcaaaagatg

SEQ ID NO: 10149 - DNA, 103 bp, Artificial Sequence
  Synthetic Polynucleotide
taatacgactcactataggggtgtgaggcaccagagtgttctgcttcttcaacagaggagagaagaaatggaacactctaacctggcggcagcgcaaaagatg

SEQ ID NO: 10150 - DNA, 103 bp, Artificial Sequence
  Synthetic Polynucleotide
taatacgactcactatagggatgttgtgtgaggcaccagagtgttctgctaacagaggagaagcagaatgctctggtgcaacctggcggcagcgcaaaagatg

SEQ ID NO: 10151 - DNA, 103 bp, Artificial Sequence
  Synthetic Polynucleotide
taatacgactcactatagggctagtatgttgtgtgaggcaccagagtgttaacagaggagaaacactatggtgcctcacaacctggcggcagcgcaaaagatg

SEQ ID NO: 10152 - DNA, 103 bp, Artificial Sequence
  Synthetic Polynucleotide
taatacgactcactatagggctccactagtatgttgtgtgaggcaccagaaacagaggagatctggtatgtcacacaacaacctggcggcagcgcaaaagatg

SEQ ID NO: 10153 - DNA, 103 bp, Artificial Sequence
  Synthetic Polynucleotide
taatacgactcactatagggtggacctccactagtatgttgtgtgaggcaaacagaggagatgcctcatgcaacatactaacctggcggcagcgcaaaagatg

SEQ ID NO: 10154 - DNA, 103 bp, Artificial Sequence
  Synthetic Polynucleotide
taatacgactcactatagggcatcttggacctccactagtatgttgtgtgaacagaggagacacacaatgtactagtggaacctggcggcagcgcaaaagatg

SEQ ID NO: 10155 - DNA, 103 bp, Artificial Sequence
  Synthetic Polynucleotide
taatacgactcactatagggtccccctcgggtggtcagatggaacgccagaacagaggagactggcgatgcatctgaccaacctggcggcagcgcaaaagatg

SEQ ID NO: 10156 - DNA, 103 bp, Artificial Sequence
  Synthetic Polynucleotide
taatacgactcactatagggtccatcatcttggacctccactagtatgttaacagaggagaaacataatggtggaggtcaacctggcggcagcgcaaaagatg

SEQ ID NO: 10157 - DNA, 103 bp, Artificial Sequence
  Synthetic Polynucleotide
taatacgactcactatagggatggttccatcatcttggacctccactagtaacagaggagaactagtatgggtccaagaaacctggcggcagcgcaaaagatg

SEQ ID NO: 10158 - DNA, 103 bp, Artificial Sequence
  Synthetic Polynucleotide
taatacgactcactatagggtcttcatggttccatcatcttggacctccaaacagaggagatggaggatgaagatgatgaacctggcggcagcgcaaaagatg

SEQ ID NO: 10159 - DNA, 103 bp, Artificial Sequence
  Synthetic Polynucleotide
taatacgactcactatagggctttatcttcatggttccatcatcttggacaacagaggagagtccaaatggatggaaccaacctggcggcagcgcaaaagatg

SEQ ID NO: 10160 - DNA, 103 bp, Artificial Sequence
  Synthetic Polynucleotide
taatacgactcactatagggtcatcctttatcttcatggttccatcatctaacagaggagaagatgaatgaaccatgaaaacctggcggcagcgcaaaagatg

SEQ ID NO: 10161 - DNA, 103 bp, Artificial Sequence
  Synthetic Polynucleotide
taatacgactcactatagggtctcttcatcctttatcttcatggttccataacagaggagaatggaaatgtgaagataaaacctggcggcagcgcaaaagatg

SEQ ID NO: 10162 - DNA, 103 bp, Artificial Sequence
  Synthetic Polynucleotide
taatacgactcactatagggatctctctcttcatcctttatcttcatggtaacagaggagaaccatgatgataaaggataacctggcggcagcgcaaaagatg

SEQ ID NO: 10163 - DNA, 103 bp, Artificial Sequence
  Synthetic Polynucleotide
taatacgactcactataggggtgtcatctctctcttcatcctttatcttcaacagaggagagaagatatgggatgaagaaacctggcggcagcgcaaaagatg

SEQ ID NO: 10164 - DNA, 103 bp, Artificial Sequence
  Synthetic Polynucleotide
taatacgactcactatagggtgagtgtgtcatctctctcttcatcctttaaacagaggagataaaggatgaagagagagaacctggcggcagcgcaaaagatg

SEQ ID NO: 10165 - DNA, 103 bp, Artificial Sequence
  Synthetic Polynucleotide
taatacgactcactatagggaatggtgagtgtgtcatctctctcttcatcaacagaggagagatgaaatgagagatgacaacctggcggcagcgcaaaagatg

SEQ ID NO: 10166 - DNA, 103 bp, Artificial Sequence
  Synthetic Polynucleotide
taatacgactcactatagggggctctccccctcgggtggtcagatggaacaacagaggagagttccaatggaccacccgaacctggcggcagcgcaaaagatg

SEQ ID NO: 10167 - DNA, 103 bp, Artificial Sequence
  Synthetic Polynucleotide
taatacgactcactatagggaggagaatggtgagtgtgtcatctctctctaacagaggagaagagagatgtgacacactaacctggcggcagcgcaaaagatg

SEQ ID NO: 10168 - DNA, 103 bp, Artificial Sequence
  Synthetic Polynucleotide
taatacgactcactatagggctttgaggagaatggtgagtgtgtcatctcaacagaggagagagatgatgcactcaccaaacctggcggcagcgcaaaagatg

SEQ ID NO: 10169 - DNA, 103 bp, Artificial Sequence
  Synthetic Polynucleotide
taatacgactcactatagggagttgctttgaggagaatggtgagtgtgtcaacagaggagagacacaatgaccattctcaacctggcggcagcgcaaaagatg

SEQ ID NO: 10170 - DNA, 103 bp, Artificial Sequence
  Synthetic Polynucleotide
taatacgactcactatagggagcagagttgctttgaggagaatggtgagtaacagaggagaactcacatgtctcctcaaaacctggcggcagcgcaaaagatg

SEQ ID NO: 10171 - DNA, 103 bp, Artificial Sequence
  Synthetic Polynucleotide
taatacgactcactatagggttgctagcagagttgctttgaggagaatggaacagaggagaccattcatgtcaaagcaaaacctggcggcagcgcaaaagatg

SEQ ID NO: 10172 - DNA, 103 bp, Artificial Sequence
  Synthetic Polynucleotide
taatacgactcactatagggtgagattgctagcagagttgctttgaggagaacagaggagactcctcatggcaactctgaacctggcggcagcgcaaaagatg

SEQ ID NO: 10173 - DNA, 103 bp, Artificial Sequence
  Synthetic Polynucleotide
taatacgactcactatagggacccctgagattgctagcagagttgctttgaacagaggagacaaagcatgtctgctagcaacctggcggcagcgcaaaagatg

SEQ ID NO: 10174 - DNA, 103 bp, Artificial Sequence
  Synthetic Polynucleotide
taatacgactcactatagggggtatacccctgagattgctagcagagttgaacagaggagacaactcatgtagcaatctaacctggcggcagcgcaaaagatg

SEQ ID NO: 10175 - DNA, 103 bp, Artificial Sequence
  Synthetic Polynucleotide
taatacgactcactatagggcattgggtatacccctgagattgctagcagaacagaggagactgctaatgatctcagggaacctggcggcagcgcaaaagatg

SEQ ID NO: 10176 - DNA, 103 bp, Artificial Sequence
  Synthetic Polynucleotide
taatacgactcactatagggattgacattgggtatacccctgagattgctaacagaggagaagcaatatgaggggtataaacctggcggcagcgcaaaagatg

SEQ ID NO: 10177 - DNA, 103 bp, Artificial Sequence
  Synthetic Polynucleotide
taatacgactcactatagggtgtgcggctctccccctcgggtggtcagataacagaggagaatctgaatgcccgaggggaacctggcggcagcgcaaaagatg

SEQ ID NO: 10178 - DNA, 103 bp, Artificial Sequence
  Synthetic Polynucleotide
taatacgactcactatagggccggtattgacattgggtatacccctgagaaacagaggagatctcagatgtatacccaaaacctggcggcagcgcaaaagatg

SEQ ID NO: 10179 - DNA, 103 bp, Artificial Sequence
  Synthetic Polynucleotide
taatacgactcactatagggggtcgccggtattgacattgggtataccccaacagaggagaggggtaatgccaatgtcaaacctggcggcagcgcaaaagatg

SEQ ID NO: 10180 - DNA, 103 bp, Artificial Sequence
  Synthetic Polynucleotide
taatacgactcactatagggaagagggtcgccggtattgacattgggtataacagaggagaatacccatggtcaataccaacctggcggcagcgcaaaagatg

SEQ ID NO: 10181 - DNA, 103 bp, Artificial Sequence
  Synthetic Polynucleotide
taatacgactcactatagggacacaaagagggtcgccggtattgacattgaacagaggagacaatgtatgtaccggcgaaacctggcggcagcgcaaaagatg

SEQ ID NO: 10182 - DNA, 103 bp, Artificial Sequence
  Synthetic Polynucleotide
taatacgactcactatagggataccacacaaagagggtcgccggtattgaaacagaggagatcaataatggcgaccctcaacctggcggcagcgcaaaagatg

SEQ ID NO: 10183 - DNA, 103 bp, Artificial Sequence
  Synthetic Polynucleotide
taatacgactcactatagggcaaaaataccacacaaagagggtcgccggtaacagaggagaaccggcatgcctctttgtaacctggcggcagcgcaaaagatg

SEQ ID NO: 10184 - DNA, 103 bp, Artificial Sequence
  Synthetic Polynucleotide
taatacgactcactatagggtctgccaaaaataccacacaaagagggtcgaacagaggagacgacccatgttgtgtggtaacctggcggcagcgcaaaagatg

SEQ ID NO: 10185 - DNA, 103 bp, Artificial Sequence
  Synthetic Polynucleotide
taatacgactcactatagggctttttctgccaaaaataccacacaaagagaacagaggagactctttatgtggtattttaacctggcggcagcgcaaaagatg

SEQ ID NO: 10186 - DNA, 103 bp, Artificial Sequence
  Synthetic Polynucleotide
taatacgactcactatagggtgtttctttttctgccaaaaataccacacaaacagaggagatgtgtgatgtttttggcaaacctggcggcagcgcaaaagatg

SEQ ID NO: 10187 - DNA, 103 bp, Artificial Sequence
  Synthetic Polynucleotide
taatacgactcactatagggatctctgtttctttttctgccaaaaataccaacagaggagaggtattatgggcagaaaaaacctggcggcagcgcaaaagatg

SEQ ID NO: 10188 - DNA, 103 bp, Artificial Sequence
  Synthetic Polynucleotide
taatacgactcactatagggactgttagaactacgttaagcaagcttccgaacagaggagacggaagatggcttaacgtaacctggcggcagcgcaaaagatg

SEQ ID NO: 10189 - DNA, 103 bp, Artificial Sequence
  Synthetic Polynucleotide
taatacgactcactatagggtatcatgtgcggctctccccctcgggtggtaacagaggagaaccaccatggggggagagaacctggcggcagcgcaaaagatg

SEQ ID NO: 10190 - DNA, 103 bp, Artificial Sequence
  Synthetic Polynucleotide
taatacgactcactatagggtcctgatctctgtttctttttctgccaaaaaacagaggagattttggatgaaaaagaaaaacctggcggcagcgcaaaagatg

SEQ ID NO: 10191 - DNA, 103 bp, Artificial Sequence
  Synthetic Polynucleotide
taatacgactcactatagggagcactcctgatctctgtttctttttctgcaacagaggagagcagaaatggaaacagagaacctggcggcagcgcaaaagatg

SEQ ID NO: 10192 - DNA, 103 bp, Artificial Sequence
  Synthetic Polynucleotide
taatacgactcactatagggcccatagcactcctgatctctgtttcttttaacagaggagaaaaagaatgagagatcagaacctggcggcagcgcaaaagatg

SEQ ID NO: 10193 - DNA, 103 bp, Artificial Sequence
  Synthetic Polynucleotide
taatacgactcactatagggtgtgtcccatagcactcctgatctctgtttaacagaggagaaaacagatgtcaggagtgaacctggcggcagcgcaaaagatg

SEQ ID NO: 10194 - DNA, 103 bp, Artificial Sequence
  Synthetic Polynucleotide
taatacgactcactatagggctgggtgtgtcccatagcactcctgatctcaacagaggagagagatcatgagtgctatgaacctggcggcagcgcaaaagatg

SEQ ID NO: 10195 - DNA, 103 bp, Artificial Sequence
  Synthetic Polynucleotide
taatacgactcactataggggagggctgggtgtgtcccatagcactcctgaacagaggagacaggagatgtatgggacaaacctggcggcagcgcaaaagatg

SEQ ID NO: 10196 - DNA, 103 bp, Artificial Sequence
  Synthetic Polynucleotide
taatacgactcactatagggttctggagggctgggtgtgtcccatagcacaacagaggagagtgctaatggacacacccaacctggcggcagcgcaaaagatg

SEQ ID NO: 10197 - DNA, 103 bp, Artificial Sequence
  Synthetic Polynucleotide
taatacgactcactatagggtccacttctggagggctgggtgtgtcccataacagaggagaatgggaatgacccagcccaacctggcggcagcgcaaaagatg

SEQ ID NO: 10198 - DNA, 103 bp, Artificial Sequence
  Synthetic Polynucleotide
taatacgactcactatagggctctttccacttctggagggctgggtgtgtaacagaggagaacacacatggccctccagaacctggcggcagcgcaaaagatg

SEQ ID NO: 10199 - DNA, 103 bp, Artificial Sequence
  Synthetic Polynucleotide
taatacgactcactataggggactgctctttccacttctggagggctgggaacagaggagacccagcatgccagaagtgaacctggcggcagcgcaaaagatg

SEQ ID NO: 10200 - DNA, 103 bp, Artificial Sequence
  Synthetic Polynucleotide
taatacgactcactatagggctaactatcatgtgcggctctccccctcggaacagaggagaccgaggatgagagccgcaaacctggcggcagcgcaaaagatg

SEQ ID NO: 10201 - DNA, 103 bp, Artificial Sequence
  Synthetic Polynucleotide
taatacgactcactatagggtcaaggactgctctttccacttctggagggaacagaggagaccctccatgagtggaaagaacctggcggcagcgcaaaagatg

SEQ ID NO: 10202 - DNA, 103 bp, Artificial Sequence
  Synthetic Polynucleotide
taatacgactcactatagggcatcatcaaggactgctctttccacttctgaacagaggagacagaagatgaaagagcagaacctggcggcagcgcaaaagatg

SEQ ID NO: 10203 - DNA, 103 bp, Artificial Sequence
  Synthetic Polynucleotide
taatacgactcactatagggaatgccatcatcaaggactgctctttccacaacagaggagagtggaaatggcagtccttaacctggcggcagcgcaaaagatg

SEQ ID NO: 10204 - DNA, 103 bp, Artificial Sequence
  Synthetic Polynucleotide
taatacgactcactatagggctataaatgccatcatcaaggactgctcttaacagaggagaaagagcatgccttgatgaaacctggcggcagcgcaaaagatg

SEQ ID NO: 10205 - DNA, 103 bp, Artificial Sequence
  Synthetic Polynucleotide
taatacgactcactataggggaattctataaatgccatcatcaaggactgaacagaggagacagtccatgatgatggcaaacctggcggcagcgcaaaagatg

SEQ ID NO: 10206 - DNA, 103 bp, Artificial Sequence
  Synthetic Polynucleotide
taatacgactcactatagggttggagaattctataaatgccatcatcaagaacagaggagacttgatatgggcatttataacctggcggcagcgcaaaagatg

SEQ ID NO: 10207 - DNA, 103 bp, Artificial Sequence
  Synthetic Polynucleotide
taatacgactcactatagggcctctttggagaattctataaatgccatcaaacagaggagatgatggatgttatagaataacctggcggcagcgcaaaagatg

SEQ ID NO: 10208 - DNA, 103 bp, Artificial Sequence
  Synthetic Polynucleotide
taatacgactcactatagggacaatcctctttggagaattctataaatgcaacagaggagagcatttatggaattctccaacctggcggcagcgcaaaagatg

SEQ ID NO: 10209 - DNA, 103 bp, Artificial Sequence
  Synthetic Polynucleotide
taatacgactcactataggggcccaacaatcctctttggagaattctataaacagaggagatatagaatgctccaaagaaacctggcggcagcgcaaaagatg

SEQ ID NO: 10210 - DNA, 103 bp, Artificial Sequence
  Synthetic Polynucleotide
taatacgactcactataggggacctgcccaacaatcctctttggagaattaacagaggagaaattctatgaagaggattaacctggcggcagcgcaaaagatg

SEQ ID NO: 10211 - DNA, 103 bp, Artificial Sequence
  Synthetic Polynucleotide
taatacgactcactataggggcttgctaactatcatgtgcggctctccccaacagaggagaggggagatgcgcacatgaaacctggcggcagcgcaaaagatg

SEQ ID NO: 10212 - DNA, 103 bp, Artificial Sequence
  Synthetic Polynucleotide
taatacgactcactatagggcttgagacctgcccaacaatcctctttggaaacagaggagatccaaaatggattgttggaacctggcggcagcgcaaaagatg

SEQ ID NO: 10213 - DNA, 103 bp, Artificial Sequence
  Synthetic Polynucleotide
taatacgactcactatagggtcctacttgagacctgcccaacaatcctctaacagaggagaagaggaatgttgggcaggaacctggcggcagcgcaaaagatg

SEQ ID NO: 10214 - DNA, 103 bp, Artificial Sequence
  Synthetic Polynucleotide
taatacgactcactatagggcctactcctacttgagacctgcccaacaataacagaggagaattgttatgcaggtctcaaacctggcggcagcgcaaaagatg

SEQ ID NO: 10215 - DNA, 103 bp, Artificial Sequence
  Synthetic Polynucleotide
taatacgactcactatagggaaactcctactcctacttgagacctgcccaaacagaggagatgggcaatgctcaagtagaacctggcggcagcgcaaaagatg

SEQ ID NO: 10216 - DNA, 103 bp, Artificial Sequence
  Synthetic Polynucleotide
taatacgactcactatagggttgaaaaactcctactcctacttgagacctaacagaggagaaggtctatggtaggagtaaacctggcggcagcgcaaaagatg

SEQ ID NO: 10217 - DNA, 103 bp, Artificial Sequence
  Synthetic Polynucleotide
taatacgactcactatagggccttcttgaaaaactcctactcctacttgaaacagaggagatcaagtatgagtaggagtaacctggcggcagcgcaaaagatg

SEQ ID NO: 10218 - DNA, 103 bp, Artificial Sequence
  Synthetic Polynucleotide
taatacgactcactatagggacacgccttcttgaaaaactcctactcctaaacagaggagataggagatggagtttttcaacctggcggcagcgcaaaagatg

SEQ ID NO: 10219 - DNA, 103 bp, Artificial Sequence
  Synthetic Polynucleotide
taatacgactcactataggggtggaacacgccttcttgaaaaactcctacaacagaggagagtaggaatgtttcaagaaaacctggcggcagcgcaaaagatg

SEQ ID NO: 10220 - DNA, 103 bp, Artificial Sequence
  Synthetic Polynucleotide
taatacgactcactatagggattgtgtggaacacgccttcttgaaaaactaacagaggagaagttttatgagaaggcgtaacctggcggcagcgcaaaagatg

SEQ ID NO: 10221 - DNA, 103 bp, Artificial Sequence
  Synthetic Polynucleotide
taatacgactcactataggggccacattgtgtggaacacgccttcttgaaaacagaggagattcaagatggcgtgttccaacctggcggcagcgcaaaagatg

SEQ ID NO: 10222 - DNA, 103 bp, Artificial Sequence
  Synthetic Polynucleotide
taatacgactcactatagggttcctgcttgctaactatcatgtgcggctcaacagaggagagagccgatgatgatagttaacctggcggcagcgcaaaagatg

SEQ ID NO: 10223 - DNA, 103 bp, Artificial Sequence
  Synthetic Polynucleotide
taatacgactcactataggggacgtgccacattgtgtggaacacgccttcaacagaggagagaaggcatgttccacacaaacctggcggcagcgcaaaagatg

SEQ ID NO: 10224 - DNA, 103 bp, Artificial Sequence
  Synthetic Polynucleotide
taatacgactcactatagggctggtgacgtgccacattgtgtggaacacgaacagaggagacgtgttatgcacaatgtgaacctggcggcagcgcaaaagatg

SEQ ID NO: 10225 - DNA, 103 bp, Artificial Sequence
  Synthetic Polynucleotide
taatacgactcactatagggctcccctggtgacgtgccacattgtgtggaaacagaggagatccacaatgtgtggcacgaacctggcggcagcgcaaaagatg

SEQ ID NO: 10226 - DNA, 103 bp, Artificial Sequence
  Synthetic Polynucleotide
taatacgactcactataggggacagctcccctggtgacgtgccacattgtaacagaggagaacaatgatgcacgtcaccaacctggcggcagcgcaaaagatg

SEQ ID NO: 10227 - DNA, 103 bp, Artificial Sequence
  Synthetic Polynucleotide
taatacgactcactatagggatgaggacagctcccctggtgacgtgccacaacagaggagagtggcaatgcaccaggggaacctggcggcagcgcaaaagatg

SEQ ID NO: 10228 - DNA, 103 bp, Artificial Sequence
  Synthetic Polynucleotide
taatacgactcactatagggggtacatgaggacagctcccctggtgacgtaacagaggagaacgtcaatgggggagctgaacctggcggcagcgcaaaagatg

SEQ ID NO: 10229 - DNA, 103 bp, Artificial Sequence
  Synthetic Polynucleotide
taatacgactcactatagggcccttggtacatgaggacagctcccctggtaacagaggagaaccaggatggctgtcctcaacctggcggcagcgcaaaagatg

SEQ ID NO: 10230 - DNA, 103 bp, Artificial Sequence
  Synthetic Polynucleotide
taatacgactcactatagggctcttcccttggtacatgaggacagctcccaacagaggagagggagcatgcctcatgtaaacctggcggcagcgcaaaagatg

SEQ ID NO: 10231 - DNA, 103 bp, Artificial Sequence
  Synthetic Polynucleotide
taatacgactcactatagggccagtctcttcccttggtacatgaggacagaacagaggagactgtccatgtgtaccaagaacctggcggcagcgcaaaagatg

SEQ ID NO: 10232 - DNA, 103 bp, Artificial Sequence
  Synthetic Polynucleotide
taatacgactcactatagggtggttccagtctcttcccttggtacatgagaacagaggagactcatgatgcaagggaagaacctggcggcagcgcaaaagatg

SEQ ID NO: 10233 - DNA, 103 bp, Artificial Sequence
  Synthetic Polynucleotide
taatacgactcactatagggcctctttcctgcttgctaactatcatgtgcaacagaggagagcacatatgagttagcaaaacctggcggcagcgcaaaagatg

SEQ ID NO: 10234 - DNA, 103 bp, Artificial Sequence
  Synthetic Polynucleotide
taatacgactcactatagggcaacttggttccagtctcttcccttggtacaacagaggagagtaccaatggaagagactaacctggcggcagcgcaaaagatg

SEQ ID NO: 10235 - DNA, 103 bp, Artificial Sequence
  Synthetic Polynucleotide
taatacgactcactatagggtggcccaacttggttccagtctcttcccttaacagaggagaaagggaatggactggaacaacctggcggcagcgcaaaagatg

SEQ ID NO: 10236 - DNA, 103 bp, Artificial Sequence
  Synthetic Polynucleotide
taatacgactcactataggggacactggcccaacttggttccagtctcttaacagaggagaaagagaatggaaccaagtaacctggcggcagcgcaaaagatg

SEQ ID NO: 10237 - DNA, 103 bp, Artificial Sequence
  Synthetic Polynucleotide
taatacgactcactatagggtttttgacactggcccaacttggttccagtaacagaggagaactggaatgaagttgggcaacctggcggcagcgcaaaagatg

SEQ ID NO: 10238 - DNA, 103 bp, Artificial Sequence
  Synthetic Polynucleotide
taatacgactcactatagggagtcttttttgacactggcccaacttggttaacagaggagaaaccaaatggggccagtgaacctggcggcagcgcaaaagatg

SEQ ID NO: 10239 - DNA, 103 bp, Artificial Sequence
  Synthetic Polynucleotide
taatacgactcactataggggatcaagtcttttttgacactggcccaactaacagaggagaagttggatgagtgtcaaaaacctggcggcagcgcaaaagatg

SEQ ID NO: 10240 - DNA, 103 bp, Artificial Sequence
  Synthetic Polynucleotide
taatacgactcactatagggtatgagatcaagtcttttttgacactggccaacagaggagaggccagatgcaaaaaagaaacctggcggcagcgcaaaagatg

SEQ ID NO: 10241 - DNA, 103 bp, Artificial Sequence
  Synthetic Polynucleotide
taatacgactcactatagggctccatatgagatcaagtcttttttgacacaacagaggagagtgtcaatgaagacttgaaacctggcggcagcgcaaaagatg

SEQ ID NO: 10242 - DNA, 103 bp, Artificial Sequence
  Synthetic Polynucleotide
taatacgactcactatagggacctcctccatatgagatcaagtcttttttaacagaggagaaaaaaaatgttgatctcaaacctggcggcagcgcaaaagatg

SEQ ID NO: 10243 - DNA, 103 bp, Artificial Sequence
  Synthetic Polynucleotide
taatacgactcactatagggctccaacctcctccatatgagatcaagtctaacagaggagaagacttatgctcatatggaacctggcggcagcgcaaaagatg

SEQ ID NO: 10244 - DNA, 103 bp, Artificial Sequence
  Synthetic Polynucleotide
taatacgactcactatagggattttcctctttcctgcttgctaactatcaaacagaggagatgatagatggcaagcaggaacctggcggcagcgcaaaagatg

SEQ ID NO: 10245 - DNA, 103 bp, Artificial Sequence
  Synthetic Polynucleotide
taatacgactcactataggggaaacctccaacctcctccatatgagatcaaacagaggagatgatctatgatggaggagaacctggcggcagcgcaaaagatg

SEQ ID NO: 10246 - DNA, 103 bp, Artificial Sequence
  Synthetic Polynucleotide
taatacgactcactatagggtccttgaaacctccaacctcctccatatgaaacagaggagatcatatatgggaggttggaacctggcggcagcgcaaaagatg

SEQ ID NO: 10247 - DNA, 103 bp, Artificial Sequence
  Synthetic Polynucleotide
taatacgactcactatagggcaggatccttgaaacctccaacctcctccaaacagaggagatggaggatgttggaggttaacctggcggcagcgcaaaagatg

SEQ ID NO: 10248 - DNA, 103 bp, Artificial Sequence
  Synthetic Polynucleotide
taatacgactcactatagggcgttccaggatccttgaaacctccaacctcaacagaggagagaggttatgggtttcaagaacctggcggcagcgcaaaagatg

SEQ ID NO: 10249 - DNA, 103 bp, Artificial Sequence
  Synthetic Polynucleotide
taatacgactcactatagggtcccgcgttccaggatccttgaaacctccaaacagaggagatggaggatgcaaggatccaacctggcggcagcgcaaaagatg

SEQ ID NO: 10250 - DNA, 103 bp, Artificial Sequence
  Synthetic Polynucleotide
taatacgactcactatagggtcttctcccgcgttccaggatccttgaaacaacagaggagagtttcaatgatcctggaaaacctggcggcagcgcaaaagatg

SEQ ID NO: 10251 - DNA, 103 bp, Artificial Sequence
  Synthetic Polynucleotide
taatacgactcactataggggcacttcttctcccgcgttccaggatccttaacagaggagaaaggatatgggaacgcggaacctggcggcagcgcaaaagatg

SEQ ID NO: 10252 - DNA, 103 bp, Artificial Sequence
  Synthetic Polynucleotide
taatacgactcactatagggcacctgcacttcttctcccgcgttccaggaaacagaggagatcctggatggcgggagaaaacctggcggcagcgcaaaagatg

SEQ ID NO: 10253 - DNA, 103 bp, Artificial Sequence
  Synthetic Polynucleotide
taatacgactcactataggggcaatcacctgcacttcttctcccgcgttcaacagaggagagaacgcatgagaagaagtaacctggcggcagcgcaaaagatg

SEQ ID NO: 10254 - DNA, 103 bp, Artificial Sequence
  Synthetic Polynucleotide
taatacgactcactatagggcaacagcaatcacctgcacttcttctcccgaacagaggagacgggagatgaagtgcaggaacctggcggcagcgcaaaagatg

SEQ ID NO: 10255 - DNA, 103 bp, Artificial Sequence
  Synthetic Polynucleotide
taatacgactcactatagggaagtgattttcctctttcctgcttgctaacaacagaggagagttagcatgcaggaaagaaacctggcggcagcgcaaaagatg

SEQ ID NO: 10256 - DNA, 103 bp, Artificial Sequence
  Synthetic Polynucleotide
taatacgactcactatagggcggttcaacagcaatcacctgcacttcttcaacagaggagagaagaaatgcaggtgattaacctggcggcagcgcaaaagatg

SEQ ID NO: 10257 - DNA, 103 bp, Artificial Sequence
  Synthetic Polynucleotide
taatacgactcactatagggttccccggttcaacagcaatcacctgcactaacagaggagaagtgcaatggattgctgtaacctggcggcagcgcaaaagatg

SEQ ID NO: 10258 - DNA, 103 bp, Artificial Sequence
  Synthetic Polynucleotide
taatacgactcactatagggggttcttccccggttcaacagcaatcacctaacagaggagaaggtgaatgctgttgaacaacctggcggcagcgcaaaagatg

SEQ ID NO: 10259 - DNA, 103 bp, Artificial Sequence
  Synthetic Polynucleotide
taatacgactcactatagggtttggggttcttccccggttcaacagcaataacagaggagaattgctatggaaccggggaacctggcggcagcgcaaaagatg

SEQ ID NO: 10260 - DNA, 103 bp, Artificial Sequence
  Synthetic Polynucleotide
taatacgactcactatagggacatttttggggttcttccccggttcaacaaacagaggagatgttgaatgggggaagaaaacctggcggcagcgcaaaagatg

SEQ ID NO: 10261 - DNA, 103 bp, Artificial Sequence
  Synthetic Polynucleotide
taatacgactcactatagggtctgtacatttttggggttcttccccggttaacagaggagaaaccggatgagaaccccaaacctggcggcagcgcaaaagatg

SEQ ID NO: 10262 - DNA, 103 bp, Artificial Sequence
  Synthetic Polynucleotide
taatacgactcactatagggcgctgtctgtacatttttggggttcttcccaacagaggagagggaagatgcccaaaaataacctggcggcagcgcaaaagatg

SEQ ID NO: 10263 - DNA, 103 bp, Artificial Sequence
  Synthetic Polynucleotide
taatacgactcactatagggcccggcgctgtctgtacatttttggggttcaacagaggagagaacccatgaaatgtacaaacctggcggcagcgcaaaagatg

SEQ ID NO: 10264 - DNA, 103 bp, Artificial Sequence
  Synthetic Polynucleotide
taatacgactcactatagggaggtacccggcgctgtctgtacatttttggaacagaggagaccaaaaatgtacagacagaacctggcggcagcgcaaaagatg

SEQ ID NO: 10265 - DNA, 103 bp, Artificial Sequence
  Synthetic Polynucleotide
taatacgactcactatagggcttgaaggtacccggcgctgtctgtacattaacagaggagaaatgtaatgacagcgccgaacctggcggcagcgcaaaagatg

SEQ ID NO: 10266 - DNA, 103 bp, Artificial Sequence
  Synthetic Polynucleotide
taatacgactcactatagggaacaaaagtgattttcctctttcctgcttgaacagaggagacaagcaatgaagaggaaaaacctggcggcagcgcaaaagatg

SEQ ID NO: 10267 - DNA, 103 bp, Artificial Sequence
  Synthetic Polynucleotide
taatacgactcactatagggggggtcttgaaggtacccggcgctgtctgtaacagaggagaacagacatggccgggtacaacctggcggcagcgcaaaagatg

SEQ ID NO: 10268 - DNA, 103 bp, Artificial Sequence
  Synthetic Polynucleotide
taatacgactcactatagggcttcaggggtcttgaaggtacccggcgctgaacagaggagacagcgcatggtaccttcaaacctggcggcagcgcaaaagatg

SEQ ID NO: 10269 - DNA, 103 bp, Artificial Sequence
  Synthetic Polynucleotide
taatacgactcactatagggttcgccttcaggggtcttgaaggtacccggaacagaggagaccgggtatgttcaagaccaacctggcggcagcgcaaaagatg

SEQ ID NO: 10270 - DNA, 103 bp, Artificial Sequence
  Synthetic Polynucleotide
taatacgactcactatagggccaacttcgccttcaggggtcttgaaggtaaacagaggagataccttatggacccctgaaacctggcggcagcgcaaaagatg

SEQ ID NO: 10271 - DNA, 103 bp, Artificial Sequence
  Synthetic Polynucleotide
taatacgactcactatagggtggctccaacttcgccttcaggggtcttgaaacagaggagatcaagaatgctgaaggcgaacctggcggcagcgcaaaagatg

SEQ ID NO: 10272 - DNA, 103 bp, Artificial Sequence
  Synthetic Polynucleotide
taatacgactcactatagggagctatggctccaacttcgccttcaggggtaacagaggagaacccctatgggcgaagttaacctggcggcagcgcaaaagatg

SEQ ID NO: 10273 - DNA, 103 bp, Artificial Sequence
  Synthetic Polynucleotide
taatacgactcactatagggtctagagctatggctccaacttcgccttcaaacagaggagatgaaggatgagttggagcaacctggcggcagcgcaaaagatg

SEQ ID NO: 10274 - DNA, 103 bp, Artificial Sequence
  Synthetic Polynucleotide
taatacgactcactatagggtaaagtctagagctatggctccaacttcgcaacagaggagagcgaagatggagccatagaacctggcggcagcgcaaaagatg

SEQ ID NO: 10275 - DNA, 103 bp, Artificial Sequence
  Synthetic Polynucleotide
taatacgactcactataggggggtttaaagtctagagctatggctccaacaacagaggagagttggaatgatagctctaaacctggcggcagcgcaaaagatg

SEQ ID NO: 10276 - DNA, 103 bp, Artificial Sequence
  Synthetic Polynucleotide
taatacgactcactataggggtgccgggtttaaagtctagagctatggctaacagaggagaagccatatgtctagacttaacctggcggcagcgcaaaagatg

SEQ ID NO: 10277 - DNA, 103 bp, Artificial Sequence
  Synthetic Polynucleotide
taatacgactcactatagggtcttaaacaaaagtgattttcctctttcctaacagaggagaaggaaaatggaaaatcacaacctggcggcagcgcaaaagatg

SEQ ID NO: 10278 - DNA, 103 bp, Artificial Sequence
  Synthetic Polynucleotide
taatacgactcactatagggcagatgtgccgggtttaaagtctagagctaaacagaggagatagctcatgactttaaacaacctggcggcagcgcaaaagatg

SEQ ID NO: 10279 - DNA, 103 bp, Artificial Sequence
  Synthetic Polynucleotide
taatacgactcactatagggagatccagatgtgccgggtttaaagtctagaacagaggagactagacatgaaacccggcaacctggcggcagcgcaaaagatg

SEQ ID NO: 10280 - DNA, 103 bp, Artificial Sequence
  Synthetic Polynucleotide
taatacgactcactatagggataggagatccagatgtgccgggtttaaagaacagaggagactttaaatgcggcacatcaacctggcggcagcgcaaaagatg

SEQ ID NO: 10281 - DNA, 103 bp, Artificial Sequence
  Synthetic Polynucleotide
taatacgactcactatagggtcacgataggagatccagatgtgccgggttaacagaggagaaacccgatgcatctggataacctggcggcagcgcaaaagatg

SEQ ID NO: 10282 - DNA, 103 bp, Artificial Sequence
  Synthetic Polynucleotide
taatacgactcactatagggtctgttcacgataggagatccagatgtgccaacagaggagaggcacaatgggatctcctaacctggcggcagcgcaaaagatg

SEQ ID NO: 10283 - DNA, 103 bp, Artificial Sequence
  Synthetic Polynucleotide
taatacgactcactatagggccctctctgttcacgataggagatccagataacagaggagaatctggatgtcctatcgtaacctggcggcagcgcaaaagatg

SEQ ID NO: 10284 - DNA, 103 bp, Artificial Sequence
  Synthetic Polynucleotide
taatacgactcactatagggtttttccctctctgttcacgataggagatcaacagaggagagatctcatgtcgtgaacaaacctggcggcagcgcaaaagatg

SEQ ID NO: 10285 - DNA, 103 bp, Artificial Sequence
  Synthetic Polynucleotide
taatacgactcactatagggtactatttttccctctctgttcacgataggaacagaggagacctatcatgaacagagagaacctggcggcagcgcaaaagatg

SEQ ID NO: 10286 - DNA, 103 bp, Artificial Sequence
  Synthetic Polynucleotide
taatacgactcactatagggagacctactatttttccctctctgttcacgaacagaggagacgtgaaatgagagggaaaaacctggcggcagcgcaaaagatg

SEQ ID NO: 10287 - DNA, 103 bp, Artificial Sequence
  Synthetic Polynucleotide
taatacgactcactatagggcataaagacctactatttttccctctctgtaacagaggagaacagagatggaaaaatagaacctggcggcagcgcaaaagatg

SEQ ID NO: 10288 - DNA, 103 bp, Artificial Sequence
  Synthetic Polynucleotide
taatacgactcactatagggagaggtcttaaacaaaagtgattttcctctaacagaggagaagaggaatgtcacttttgaacctggcggcagcgcaaaagatg

SEQ ID NO: 10289 - DNA, 103 bp, Artificial Sequence
  Synthetic Polynucleotide
taatacgactcactatagggatttccataaagacctactatttttccctcaacagaggagagagggaatgatagtaggtaacctggcggcagcgcaaaagatg

SEQ ID NO: 10290 - DNA, 103 bp, Artificial Sequence
  Synthetic Polynucleotide
taatacgactcactatagggactccatttccataaagacctactatttttaacagaggagaaaaaatatgaggtctttaaacctggcggcagcgcaaaagatg

SEQ ID NO: 10291 - DNA, 103 bp, Artificial Sequence
  Synthetic Polynucleotide
taatacgactcactatagggtcaccactccatttccataaagacctactaaacagaggagatagtagatgtttatggaaaacctggcggcagcgcaaaagatg

SEQ ID NO: 10292 - DNA, 103 bp, Artificial Sequence
  Synthetic Polynucleotide
taatacgactcactatagggtgttgtcaccactccatttccataaagaccaacagaggagaggtcttatgggaaatggaaacctggcggcagcgcaaaagatg

SEQ ID NO: 10293 - DNA, 103 bp, Artificial Sequence
  Synthetic Polynucleotide
taatacgactcactatagggccacttgttgtcaccactccatttccataaaacagaggagattatggatgtggagtggtaacctggcggcagcgcaaaagatg

SEQ ID NO: 10294 - DNA, 103 bp, Artificial Sequence
  Synthetic Polynucleotide
taatacgactcactatagggaggtaccacttgttgtcaccactccatttcaacagaggagagaaatgatgtggtgacaaaacctggcggcagcgcaaaagatg

SEQ ID NO: 10295 - DNA, 103 bp, Artificial Sequence
  Synthetic Polynucleotide
taatacgactcactataggggacgtaggtaccacttgttgtcaccactccaacagaggagaggagtgatgacaacaagtaacctggcggcagcgcaaaagatg

SEQ ID NO: 10296 - DNA, 103 bp, Artificial Sequence
  Synthetic Polynucleotide
taatacgactcactataggggcactgacgtaggtaccacttgttgtcaccaacagaggagaggtgacatgaagtggtacaacctggcggcagcgcaaaagatg

SEQ ID NO: 10297 - DNA, 103 bp, Artificial Sequence
  Synthetic Polynucleotide
taatacgactcactatagggctatggcactgacgtaggtaccacttgttgaacagaggagacaacaaatggtacctacgaacctggcggcagcgcaaaagatg

SEQ ID NO: 10298 - DNA, 103 bp, Artificial Sequence
  Synthetic Polynucleotide
taatacgactcactatagggttgagctatggcactgacgtaggtaccactaacagaggagaagtggtatgtacgtcagtaacctggcggcagcgcaaaagatg

SEQ ID NO: 10299 - DNA, 103 bp, Artificial Sequence
  Synthetic Polynucleotide
taatacgactcactatagggcaaaaaaccttctttctttttgtgtgtccgaacagaggagacggacaatgaaaaagaaaaacctggcggcagcgcaaaagatg

SEQ ID NO: 10300 - DNA, 103 bp, Artificial Sequence
  Synthetic Polynucleotide
taatacgactcactataggggaaaattattaatcttcctcatagttattcaacagaggagagaataaatgtgaggaagaaacctggcggcagcgcaaaagatg

SEQ ID NO: 10301 - DNA, 103 bp, Artificial Sequence
  Synthetic Polynucleotide
taatacgactcactatagggtaatctgtttcgaaacctgatgcggtgtgcaacagaggagagcacacatgatcaggtttaacctggcggcagcgcaaaagatg

SEQ ID NO: 10302 - DNA, 103 bp, Artificial Sequence
  Synthetic Polynucleotide
taatacgactcactatagggggagtggctgggtgatcagcttcagcgctgaacagaggagacagcgcatgagctgatcaaacctggcggcagcgcaaaagatg

SEQ ID NO: 10303 - DNA, 103 bp, Artificial Sequence
  Synthetic Polynucleotide
taatacgactcactatagggcgctgggagtggctgggtgatcagcttcagaacagaggagactgaagatgatcacccagaacctggcggcagcgcaaaagatg

SEQ ID NO: 10304 - DNA, 103 bp, Artificial Sequence
  Synthetic Polynucleotide
taatacgactcactataggggttgccgctgggagtggctgggtgatcagcaacagaggagagctgatatgccagccactaacctggcggcagcgcaaaagatg

SEQ ID NO: 10305 - DNA, 103 bp, Artificial Sequence
  Synthetic Polynucleotide
taatacgactcactatagggtccaggttgccgctgggagtggctgggtgaaacagaggagatcacccatgcactcccagaacctggcggcagcgcaaaagatg

SEQ ID NO: 10306 - DNA, 103 bp, Artificial Sequence
  Synthetic Polynucleotide
taatacgactcactatagggatctgtccaggttgccgctgggagtggctgaacagaggagacagccaatgccagcggcaaacctggcggcagcgcaaaagatg

SEQ ID NO: 10307 - DNA, 103 bp, Artificial Sequence
  Synthetic Polynucleotide
taatacgactcactataggggtttcatctgtccaggttgccgctgggagtaacagaggagaactcccatgggcaacctgaacctggcggcagcgcaaaagatg

SEQ ID NO: 10308 - DNA, 103 bp, Artificial Sequence
  Synthetic Polynucleotide
taatacgactcactatagggctggagtttcatctgtccaggttgccgctgaacagaggagacagcggatgcctggacagaacctggcggcagcgcaaaagatg

SEQ ID NO: 10309 - DNA, 103 bp, Artificial Sequence
  Synthetic Polynucleotide
taatacgactcactatagggcacagctggagtttcatctgtccaggttgcaacagaggagagcaaccatgacagatgaaaacctggcggcagcgcaaaagatg

SEQ ID NO: 10310 - DNA, 103 bp, Artificial Sequence
  Synthetic Polynucleotide
taatacgactcactataggggttgacacagctggagtttcatctgtccagaacagaggagactggacatgtgaaactccaacctggcggcagcgcaaaagatg

SEQ ID NO: 10311 - DNA, 103 bp, Artificial Sequence
  Synthetic Polynucleotide
taatacgactcactatagggtgccagttgacacagctggagtttcatctgaacagaggagacagatgatgctccagctgaacctggcggcagcgcaaaagatg

SEQ ID NO: 10312 - DNA, 103 bp, Artificial Sequence
  Synthetic Polynucleotide
taatacgactcactatagggtatggtaatctgtttcgaaacctgatgcggaacagaggagaccgcatatggtttcgaaaaacctggcggcagcgcaaaagatg

SEQ ID NO: 10313 - DNA, 103 bp, Artificial Sequence
  Synthetic Polynucleotide
taatacgactcactataggggagcgtgccagttgacacagctggagtttcaacagaggagagaaactatggctgtgtcaaacctggcggcagcgcaaaagatg

SEQ ID NO: 10314 - DNA, 103 bp, Artificial Sequence
  Synthetic Polynucleotide
taatacgactcactataggggggcggagcgtgccagttgacacagctggaaacagaggagatccagcatggtcaactggaacctggcggcagcgcaaaagatg

SEQ ID NO: 10315 - DNA, 103 bp, Artificial Sequence
  Synthetic Polynucleotide
taatacgactcactatagggtccctgggcggagcgtgccagttgacacagaacagaggagactgtgtatgctggcacgcaacctggcggcagcgcaaaagatg

SEQ ID NO: 10316 - DNA, 103 bp, Artificial Sequence
  Synthetic Polynucleotide
taatacgactcactatagggtgagatccctgggcggagcgtgccagttgaaacagaggagatcaactatgacgctccgcaacctggcggcagcgcaaaagatg

SEQ ID NO: 10317 - DNA, 103 bp, Artificial Sequence
  Synthetic Polynucleotide
taatacgactcactatagggtggaatgagatccctgggcggagcgtgccaaacagaggagatggcacatgccgcccaggaacctggcggcagcgcaaaagatg

SEQ ID NO: 10318 - DNA, 103 bp, Artificial Sequence
  Synthetic Polynucleotide
taatacgactcactatagggtgggatggaatgagatccctgggcggagcgaacagaggagacgctccatgcagggatctaacctggcggcagcgcaaaagatg

SEQ ID NO: 10319 - DNA, 103 bp, Artificial Sequence
  Synthetic Polynucleotide
taatacgactcactatagggtaatttgggatggaatgagatccctgggcgaacagaggagacgcccaatgatctcattcaacctggcggcagcgcaaaagatg

SEQ ID NO: 10320 - DNA, 103 bp, Artificial Sequence
  Synthetic Polynucleotide
taatacgactcactatagggggccttaatttgggatggaatgagatccctaacagaggagaagggatatgattccatccaacctggcggcagcgcaaaagatg

SEQ ID NO: 10321 - DNA, 103 bp, Artificial Sequence
  Synthetic Polynucleotide
taatacgactcactatagggggataggccttaatttgggatggaatgagaaacagaggagatctcatatgatcccaaataacctggcggcagcgcaaaagatg

SEQ ID NO: 10322 - DNA, 103 bp, Artificial Sequence
  Synthetic Polynucleotide
taatacgactcactatagggtagcaggataggccttaatttgggatggaaaacagaggagattccatatgaaattaaggaacctggcggcagcgcaaaagatg

SEQ ID NO: 10323 - DNA, 103 bp, Artificial Sequence
  Synthetic Polynucleotide
taatacgactcactatagggaatcttatggtaatctgtttcgaaacctgaaacagaggagatcaggtatggaaacagataacctggcggcagcgcaaaagatg

SEQ ID NO: 10324 - DNA, 103 bp, Artificial Sequence
  Synthetic Polynucleotide
taatacgactcactatagggcctggtagcaggataggccttaatttgggaaacagaggagatcccaaatgaaggcctataacctggcggcagcgcaaaagatg

SEQ ID NO: 10325 - DNA, 103 bp, Artificial Sequence
  Synthetic Polynucleotide
taatacgactcactatagggctcttcctggtagcaggataggccttaattaacagaggagaaattaaatgctatcctgcaacctggcggcagcgcaaaagatg

SEQ ID NO: 10326 - DNA, 103 bp, Artificial Sequence
  Synthetic Polynucleotide
taatacgactcactatagggtccagctcttcctggtagcaggataggcctaacagaggagaaggcctatgctgctaccaaacctggcggcagcgcaaaagatg

SEQ ID NO: 10327 - DNA, 103 bp, Artificial Sequence
  Synthetic Polynucleotide
taatacgactcactatagggttctttccagctcttcctggtagcaggataaacagaggagatatcctatgaccaggaagaacctggcggcagcgcaaaagatg

SEQ ID NO: 10328 - DNA, 103 bp, Artificial Sequence
  Synthetic Polynucleotide
taatacgactcactatagggagcccttctttccagctcttcctggtagcaaacagaggagatgctacatggaagagctgaacctggcggcagcgcaaaagatg

SEQ ID NO: 10329 - DNA, 103 bp, Artificial Sequence
  Synthetic Polynucleotide
taatacgactcactataggggttggagcccttctttccagctcttcctggaacagaggagaccaggaatggctggaaagaacctggcggcagcgcaaaagatg

SEQ ID NO: 10330 - DNA, 103 bp, Artificial Sequence
  Synthetic Polynucleotide
taatacgactcactatagggtcggagttggagcccttctttccagctcttaacagaggagaaagagcatgaaagaagggaacctggcggcagcgcaaaagatg

SEQ ID NO: 10331 - DNA, 103 bp, Artificial Sequence
  Synthetic Polynucleotide
taatacgactcactatagggttagatcggagttggagcccttctttccagaacagaggagactggaaatgagggctccaaacctggcggcagcgcaaaagatg

SEQ ID NO: 10332 - DNA, 103 bp, Artificial Sequence
  Synthetic Polynucleotide
taatacgactcactatagggagatgttagatcggagttggagcccttcttaacagaggagaaagaagatgtccaactccaacctggcggcagcgcaaaagatg

SEQ ID NO: 10333 - DNA, 103 bp, Artificial Sequence
  Synthetic Polynucleotide
taatacgactcactatagggtcaggagatgttagatcggagttggagcccaacagaggagagggctcatgctccgatctaacctggcggcagcgcaaaagatg

SEQ ID NO: 10334 - DNA, 103 bp, Artificial Sequence
  Synthetic Polynucleotide
taatacgactcactataggggttaaaatcttatggtaatctgtttcgaaaaacagaggagatttcgaatgagattaccaaacctggcggcagcgcaaaagatg

SEQ ID NO: 10335 - DNA, 103 bp, Artificial Sequence
  Synthetic Polynucleotide
taatacgactcactatagggttttgtcaggagatgttagatcggagttggaacagaggagaccaactatgatctaacataacctggcggcagcgcaaaagatg

SEQ ID NO: 10336 - DNA, 103 bp, Artificial Sequence
  Synthetic Polynucleotide
taatacgactcactatagggctggattttgtcaggagatgttagatcggaaacagaggagatccgatatgacatctcctaacctggcggcagcgcaaaagatg

SEQ ID NO: 10337 - DNA, 103 bp, Artificial Sequence
  Synthetic Polynucleotide
taatacgactcactatagggatagcctggattttgtcaggagatgttagaaacagaggagatctaacatgtcctgacaaaacctggcggcagcgcaaaagatg

SEQ ID NO: 10338 - DNA, 103 bp, Artificial Sequence
  Synthetic Polynucleotide
taatacgactcactatagggtcattatagcctggattttgtcaggagatgaacagaggagacatctcatgacaaaatccaacctggcggcagcgcaaaagatg

SEQ ID NO: 10339 - DNA, 103 bp, Artificial Sequence
  Synthetic Polynucleotide
taatacgactcactataggggaaattcattatagcctggattttgtcaggaacagaggagacctgacatgatccaggctaacctggcggcagcgcaaaagatg

SEQ ID NO: 10340 - DNA, 103 bp, Artificial Sequence
  Synthetic Polynucleotide
taatacgactcactatagggtgtaggaaattcattatagcctggattttgaacagaggagacaaaatatgggctataataacctggcggcagcgcaaaagatg

SEQ ID NO: 10341 - DNA, 103 bp, Artificial Sequence
  Synthetic Polynucleotide
taatacgactcactatagggggtcttgtaggaaattcattatagcctggaaacagaggagatccaggatgtaatgaattaacctggcggcagcgcaaaagatg

SEQ ID NO: 10342 - DNA, 103 bp, Artificial Sequence
  Synthetic Polynucleotide
taatacgactcactatagggtttgaggtcttgtaggaaattcattatagcaacagaggagagctataatgaatttcctaaacctggcggcagcgcaaaagatg

SEQ ID NO: 10343 - DNA, 103 bp, Artificial Sequence
  Synthetic Polynucleotide
taatacgactcactatagggacaattttgaggtcttgtaggaaattcattaacagaggagaaatgaaatgcctacaagaaacctggcggcagcgcaaaagatg

SEQ ID NO: 10344 - DNA, 103 bp, Artificial Sequence
  Synthetic Polynucleotide
taatacgactcactatagggttggtacaattttgaggtcttgtaggaaataacagaggagaatttccatgaagacctcaaacctggcggcagcgcaaaagatg

SEQ ID NO: 10345 - DNA, 103 bp, Artificial Sequence
  Synthetic Polynucleotide
taatacgactcactatagggctgctgttaaaatcttatggtaatctgtttaacagaggagaaaacagatgaccataagaaacctggcggcagcgcaaaagatg

SEQ ID NO: 10346 - DNA, 103 bp, Artificial Sequence
  Synthetic Polynucleotide
taatacgactcactatagggatcgattggtacaattttgaggtcttgtagaacagaggagactacaaatgctcaaaattaacctggcggcagcgcaaaagatg

SEQ ID NO: 10347 - DNA, 103 bp, Artificial Sequence
  Synthetic Polynucleotide
taatacgactcactataggggttggatcgattggtacaattttgaggtctaacagaggagaagacctatgaattgtaccaacctggcggcagcgcaaaagatg

SEQ ID NO: 10348 - DNA, 103 bp, Artificial Sequence
  Synthetic Polynucleotide
taatacgactcactatagggtcttggttggatcgattggtacaattttgaaacagaggagatcaaaaatgtaccaatcgaacctggcggcagcgcaaaagatg

SEQ ID NO: 10349 - DNA, 103 bp, Artificial Sequence
  Synthetic Polynucleotide
taatacgactcactataggggatattcttggttggatcgattggtacaataacagaggagaattgtaatgatcgatccaaacctggcggcagcgcaaaagatg

SEQ ID NO: 10350 - DNA, 103 bp, Artificial Sequence
  Synthetic Polynucleotide
taatacgactcactatagggcccatgatattcttggttggatcgattggtaacagaggagaaccaatatgtccaaccaaaacctggcggcagcgcaaaagatg

SEQ ID NO: 10351 - DNA, 103 bp, Artificial Sequence
  Synthetic Polynucleotide
taatacgactcactatagggcaatacccatgatattcttggttggatcgaaacagaggagatcgatcatgccaagaataaacctggcggcagcgcaaaagatg

SEQ ID NO: 10352 - DNA, 103 bp, Artificial Sequence
  Synthetic Polynucleotide
taatacgactcactatagggcacttcaatacccatgatattcttggttggaacagaggagaccaaccatgaatatcatgaacctggcggcagcgcaaaagatg

SEQ ID NO: 10353 - DNA, 103 bp, Artificial Sequence
  Synthetic Polynucleotide
taatacgactcactatagggtctggcacttcaatacccatgatattcttgaacagaggagacaagaaatgcatgggtataacctggcggcagcgcaaaagatg

SEQ ID NO: 10354 - DNA, 103 bp, Artificial Sequence
  Synthetic Polynucleotide
taatacgactcactatagggggagttctggcacttcaatacccatgatataacagaggagaatatcaatggtattgaagaacctggcggcagcgcaaaagatg

SEQ ID NO: 10355 - DNA, 103 bp, Artificial Sequence
  Synthetic Polynucleotide
taatacgactcactatagggaaccaggagttctggcacttcaatacccataacagaggagaatgggtatggaagtgccaaacctggcggcagcgcaaaagatg

SEQ ID NO: 10356 - DNA, 103 bp, Artificial Sequence
  Synthetic Polynucleotide
taatacgactcactatagggcaatcctgctgttaaaatcttatggtaatcaacagaggagagattacatgaagattttaaacctggcggcagcgcaaaagatg

SEQ ID NO: 10357 - DNA, 103 bp, Artificial Sequence
  Synthetic Polynucleotide
taatacgactcactatagggctgtgaaccaggagttctggcacttcaataaacagaggagatattgaatggccagaactaacctggcggcagcgcaaaagatg

SEQ ID NO: 10358 - DNA, 103 bp, Artificial Sequence
  Synthetic Polynucleotide
taatacgactcactatagggtcagcctgtgaaccaggagttctggcacttaacagaggagaaagtgcatgaactcctggaacctggcggcagcgcaaaagatg

SEQ ID NO: 10359 - DNA, 103 bp, Artificial Sequence
  Synthetic Polynucleotide
taatacgactcactatagggcccagtcagcctgtgaaccaggagttctggaacagaggagaccagaaatgctggttcacaacctggcggcagcgcaaaagatg

SEQ ID NO: 10360 - DNA, 103 bp, Artificial Sequence
  Synthetic Polynucleotide
taatacgactcactatagggttcttcccagtcagcctgtgaaccaggagtaacagaggagaactcctatgtcacaggctaacctggcggcagcgcaaaagatg

SEQ ID NO: 10361 - DNA, 103 bp, Artificial Sequence
  Synthetic Polynucleotide
taatacgactcactatagggttgtcttcttcccagtcagcctgtgaaccaaacagaggagatggttcatgggctgactgaacctggcggcagcgcaaaagatg

SEQ ID NO: 10362 - DNA, 103 bp, Artificial Sequence
  Synthetic Polynucleotide
taatacgactcactatagggggtagttgtcttcttcccagtcagcctgtgaacagaggagacacaggatgactgggaagaacctggcggcagcgcaaaagatg

SEQ ID NO: 10363 - DNA, 103 bp, Artificial Sequence
  Synthetic Polynucleotide
taatacgactcactatagggttcttggtagttgtcttcttcccagtcagcaacagaggagagctgacatggaagaagacaacctggcggcagcgcaaaagatg

SEQ ID NO: 10364 - DNA, 103 bp, Artificial Sequence
  Synthetic Polynucleotide
taatacgactcactataggggaccattcttggtagttgtcttcttcccagaacagaggagactgggaatgagacaactaaacctggcggcagcgcaaaagatg

SEQ ID NO: 10365 - DNA, 103 bp, Artificial Sequence
  Synthetic Polynucleotide
taatacgactcactatagggtggttgaccattcttggtagttgtcttcttaacagaggagaaagaagatgactaccaagaacctggcggcagcgcaaaagatg

SEQ ID NO: 10366 - DNA, 103 bp, Artificial Sequence
  Synthetic Polynucleotide
taatacgactcactatagggatgattggttgaccattcttggtagttgtcaacagaggagagacaacatgcaagaatggaacctggcggcagcgcaaaagatg

SEQ ID NO: 10367 - DNA, 103 bp, Artificial Sequence
  Synthetic Polynucleotide
taatacgactcactatagggactgacaatcctgctgttaaaatcttatggaacagaggagaccataaatgtttaacagcaacctggcggcagcgcaaaagatg

SEQ ID NO: 10368 - DNA, 103 bp, Artificial Sequence
  Synthetic Polynucleotide
taatacgactcactatagggttggaatgattggttgaccattcttggtagaacagaggagactaccaatgatggtcaacaacctggcggcagcgcaaaagatg

SEQ ID NO: 10369 - DNA, 103 bp, Artificial Sequence
  Synthetic Polynucleotide
taatacgactcactatagggcagaattggaatgattggttgaccattcttaacagaggagaaagaatatgcaaccaatcaacctggcggcagcgcaaaagatg

SEQ ID NO: 10370 - DNA, 103 bp, Artificial Sequence
  Synthetic Polynucleotide
taatacgactcactatagggggtagcagaattggaatgattggttgaccaaacagaggagatggtcaatgaatcattccaacctggcggcagcgcaaaagatg

SEQ ID NO: 10371 - DNA, 103 bp, Artificial Sequence
  Synthetic Polynucleotide
taatacgactcactatagggactttggtagcagaattggaatgattggttaacagaggagaaaccaaatgttccaattcaacctggcggcagcgcaaaagatg

SEQ ID NO: 10372 - DNA, 103 bp, Artificial Sequence
  Synthetic Polynucleotide
taatacgactcactatagggaatgtactttggtagcagaattggaatgataacagaggagaatcattatgattctgctaaacctggcggcagcgcaaaagatg

SEQ ID NO: 10373 - DNA, 103 bp, Artificial Sequence
  Synthetic Polynucleotide
taatacgactcactatagggagaccaatgtactttggtagcagaattggaaacagaggagatccaatatggctaccaaaaacctggcggcagcgcaaaagatg

SEQ ID NO: 10374 - DNA, 103 bp, Artificial Sequence
  Synthetic Polynucleotide
taatacgactcactataggggatcaagaccaatgtactttggtagcagaaaacagaggagattctgcatgcaaagtacaaacctggcggcagcgcaaaagatg

SEQ ID NO: 10375 - DNA, 103 bp, Artificial Sequence
  Synthetic Polynucleotide
taatacgactcactatagggtagaggatcaagaccaatgtactttggtagaacagaggagactaccaatgtacattggtaacctggcggcagcgcaaaagatg

SEQ ID NO: 10376 - DNA, 103 bp, Artificial Sequence
  Synthetic Polynucleotide
taatacgactcactatagggtgagatagaggatcaagaccaatgtactttaacagaggagaaaagtaatgtggtcttgaaacctggcggcagcgcaaaagatg

SEQ ID NO: 10377 - DNA, 103 bp, Artificial Sequence
  Synthetic Polynucleotide
taatacgactcactatagggcaccttgagatagaggatcaagaccaatgtaacagaggagaacattgatgttgatcctcaacctggcggcagcgcaaaagatg

SEQ ID NO: 10378 - DNA, 103 bp, Artificial Sequence
  Synthetic Polynucleotide
taatacgactcactataggggttggactgacaatcctgctgttaaaatctaacagaggagaagatttatgcagcaggataacctggcggcagcgcaaaagatg

SEQ ID NO: 10379 - DNA, 103 bp, Artificial Sequence
  Synthetic Polynucleotide
taatacgactcactataggggagatcaccttgagatagaggatcaagaccaacagaggagaggtcttatgcctctatctaacctggcggcagcgcaaaagatg

SEQ ID NO: 10380 - DNA, 103 bp, Artificial Sequence
  Synthetic Polynucleotide
taatacgactcactatagggattgtgagatcaccttgagatagaggatcaaacagaggagatgatccatgatctcaaggaacctggcggcagcgcaaaagatg

SEQ ID NO: 10381 - DNA, 103 bp, Artificial Sequence
  Synthetic Polynucleotide
taatacgactcactatagggtcaccattgtgagatcaccttgagatagagaacagaggagactctatatgaaggtgatcaacctggcggcagcgcaaaagatg

SEQ ID NO: 10382 - DNA, 103 bp, Artificial Sequence
  Synthetic Polynucleotide
taatacgactcactatagggagtgatcaccattgtgagatcaccttgagaaacagaggagatctcaaatggatctcacaaacctggcggcagcgcaaaagatg

SEQ ID NO: 10383 - DNA, 103 bp, Artificial Sequence
  Synthetic Polynucleotide
taatacgactcactatagggtcctgagtgatcaccattgtgagatcacctaacagaggagaaggtgaatgcacaatggtaacctggcggcagcgcaaaagatg

SEQ ID NO: 10384 - DNA, 103 bp, Artificial Sequence
  Synthetic Polynucleotide
taatacgactcactatagggcacagtcctgagtgatcaccattgtgagataacagaggagaatctcaatgtggtgatcaaacctggcggcagcgcaaaagatg

SEQ ID NO: 10385 - DNA, 103 bp, Artificial Sequence
  Synthetic Polynucleotide
taatacgactcactatagggggaatcacagtcctgagtgatcaccattgtaacagaggagaacaatgatgatcactcagaacctggcggcagcgcaaaagatg

SEQ ID NO: 10386 - DNA, 103 bp, Artificial Sequence
  Synthetic Polynucleotide
taatacgactcactatagggtggcaggaatcacagtcctgagtgatcaccaacagaggagaggtgatatgtcaggactgaacctggcggcagcgcaaaagatg

SEQ ID NO: 10387 - DNA, 103 bp, Artificial Sequence
  Synthetic Polynucleotide
taatacgactcactataggggggagtggcaggaatcacagtcctgagtgaaacagaggagatcactcatgactgtgattaacctggcggcagcgcaaaagatg

SEQ ID NO: 10388 - DNA, 103 bp, Artificial Sequence
  Synthetic Polynucleotide
taatacgactcactatagggggccggggagtggcaggaatcacagtcctgaacagaggagacaggacatggattcctgcaacctggcggcagcgcaaaagatg

SEQ ID NO: 10389 - DNA, 103 bp, Artificial Sequence
  Synthetic Polynucleotide
taatacgactcactataggggccttgttggactgacaatcctgctgttaaaacagaggagattaacaatgggattgtcaaacctggcggcagcgcaaaagatg

SEQ ID NO: 10390 - DNA, 103 bp, Artificial Sequence
  Synthetic Polynucleotide
taatacgactcactatagggagactggccggggagtggcaggaatcacagaacagaggagactgtgaatgctgccactcaacctggcggcagcgcaaaagatg

SEQ ID NO: 10391 - DNA, 103 bp, Artificial Sequence
  Synthetic Polynucleotide
taatacgactcactatagggggggaagactggccggggagtggcaggaataacagaggagaattcctatgactccccggaacctggcggcagcgcaaaagatg

SEQ ID NO: 10392 - DNA, 103 bp, Artificial Sequence
  Synthetic Polynucleotide
taatacgactcactataggggactgggggaagactggccggggagtggcaaacagaggagatgccacatgccggccagtaacctggcggcagcgcaaaagatg

SEQ ID NO: 10393 - DNA, 103 bp, Artificial Sequence
  Synthetic Polynucleotide
taatacgactcactatagggtcattgactgggggaagactggccggggagaacagaggagactccccatgcagtcttccaacctggcggcagcgcaaaagatg

SEQ ID NO: 10394 - DNA, 103 bp, Artificial Sequence
  Synthetic Polynucleotide
taatacgactcactatagggatttttcattgactgggggaagactggccgaacagaggagacggccaatgttcccccagaacctggcggcagcgcaaaagatg

SEQ ID NO: 10395 - DNA, 103 bp, Artificial Sequence
  Synthetic Polynucleotide
taatacgactcactatagggtggtcatttttcattgactgggggaagactaacagaggagaagtcttatgccagtcaataacctggcggcagcgcaaaagatg

SEQ ID NO: 10396 - DNA, 103 bp, Artificial Sequence
  Synthetic Polynucleotide
taatacgactcactatagggtctcatggtcatttttcattgactgggggaaacagaggagatcccccatgcaatgaaaaaacctggcggcagcgcaaaagatg

SEQ ID NO: 10397 - DNA, 103 bp, Artificial Sequence
  Synthetic Polynucleotide
taatacgactcactatagggttgagtctcatggtcatttttcattgactgaacagaggagacagtcaatgaaaaatgacaacctggcggcagcgcaaaagatg

SEQ ID NO: 10398 - DNA, 103 bp, Artificial Sequence
  Synthetic Polynucleotide
taatacgactcactatagggtgatgttgagtctcatggtcatttttcattaacagaggagaaatgaaatgtgaccatgaaacctggcggcagcgcaaaagatg

SEQ ID NO: 10399 - DNA, 103 bp, Artificial Sequence
  Synthetic Polynucleotide
taatacgactcactatagggcagtgtgatgttgagtctcatggtcattttaacagaggagaaaaatgatgatgagactcaacctggcggcagcgcaaaagatg

SEQ ID NO: 10400 - DNA, 103 bp, Artificial Sequence
  Synthetic Polynucleotide
taatacgactcactatagggacaatgccttgttggactgacaatcctgctaacagaggagaagcaggatggtcagtccaaacctggcggcagcgcaaaagatg

SEQ ID NO: 10401 - DNA, 103 bp, Artificial Sequence
  Synthetic Polynucleotide
taatacgactcactatagggtctggcagtgtgatgttgagtctcatggtcaacagaggagagaccatatgactcaacataacctggcggcagcgcaaaagatg

SEQ ID NO: 10402 - DNA, 103 bp, Artificial Sequence
  Synthetic Polynucleotide
taatacgactcactatagggggtgctctggcagtgtgatgttgagtctcaaacagaggagatgagacatgacatcacacaacctggcggcagcgcaaaagatg

SEQ ID NO: 10403 - DNA, 103 bp, Artificial Sequence
  Synthetic Polynucleotide
taatacgactcactatagggggtgaggtgctctggcagtgtgatgttgagaacagaggagactcaacatgacactgccaaacctggcggcagcgcaaaagatg

SEQ ID NO: 10404 - DNA, 103 bp, Artificial Sequence
  Synthetic Polynucleotide
taatacgactcactatagggcttgcggtgaggtgctctggcagtgtgatgaacagaggagacatcacatggccagagcaaacctggcggcagcgcaaaagatg

SEQ ID NO: 10405 - DNA, 103 bp, Artificial Sequence
  Synthetic Polynucleotide
taatacgactcactatagggatagacttgcggtgaggtgctctggcagtgaacagaggagacactgcatgagcacctcaaacctggcggcagcgcaaaagatg

SEQ ID NO: 10406 - DNA, 103 bp, Artificial Sequence
  Synthetic Polynucleotide
taatacgactcactataggggttgtatagacttgcggtgaggtgctctggaacagaggagaccagagatgctcaccgcaaacctggcggcagcgcaaaagatg

SEQ ID NO: 10407 - DNA, 103 bp, Artificial Sequence
  Synthetic Polynucleotide
taatacgactcactatagggtgattgttgtatagacttgcggtgaggtgcaacagaggagagcacctatgcgcaagtctaacctggcggcagcgcaaaagatg

SEQ ID NO: 10408 - DNA, 103 bp, Artificial Sequence
  Synthetic Polynucleotide
taatacgactcactatagggggggttgattgttgtatagacttgcggtgaaacagaggagatcaccgatggtctatacaaacctggcggcagcgcaaaagatg

SEQ ID NO: 10409 - DNA, 103 bp, Artificial Sequence
  Synthetic Polynucleotide
taatacgactcactatagggatgccggggttgattgttgtatagacttgcaacagaggagagcaagtatgtacaacaataacctggcggcagcgcaaaagatg

SEQ ID NO: 10410 - DNA, 103 bp, Artificial Sequence
  Synthetic Polynucleotide
taatacgactcactatagggtgtagatgccggggttgattgttgtatagaaacagaggagatctataatgcaatcaaccaacctggcggcagcgcaaaagatg

SEQ ID NO: 10411 - DNA, 103 bp, Artificial Sequence
  Synthetic Polynucleotide
taatacgactcactataggggagaggaaaattattaatcttcctcatagtaacagaggagaactatgatgaagattaataacctggcggcagcgcaaaagatg

SEQ ID NO: 10412 - DNA, 103 bp, Artificial Sequence
  Synthetic Polynucleotide
taatacgactcactataggggtctcacaatgccttgttggactgacaatcaacagaggagagattgtatgtccaacaagaacctggcggcagcgcaaaagatg

SEQ ID NO: 10413 - DNA, 103 bp, Artificial Sequence
  Synthetic Polynucleotide
taatacgactcactatagggcaggttgtagatgccggggttgattgttgtaacagaggagaacaacaatgaaccccggcaacctggcggcagcgcaaaagatg

SEQ ID NO: 10414 - DNA, 103 bp, Artificial Sequence
  Synthetic Polynucleotide
taatacgactcactatagggttttgcaggttgtagatgccggggttgattaacagaggagaaatcaaatgcggcatctaaacctggcggcagcgcaaaagatg

SEQ ID NO: 10415 - DNA, 103 bp, Artificial Sequence
  Synthetic Polynucleotide
taatacgactcactatagggctggtttttgcaggttgtagatgccggggtaacagaggagaaccccgatgtctacaaccaacctggcggcagcgcaaaagatg

SEQ ID NO: 10416 - DNA, 103 bp, Artificial Sequence
  Synthetic Polynucleotide
taatacgactcactatagggatgggctggtttttgcaggttgtagatgccaacagaggagaggcatcatgaacctgcaaaacctggcggcagcgcaaaagatg

SEQ ID NO: 10417 - DNA, 103 bp, Artificial Sequence
  Synthetic Polynucleotide
taatacgactcactatagggatcagatgggctggtttttgcaggttgtagaacagaggagactacaaatggcaaaaaccaacctggcggcagcgcaaaagatg

SEQ ID NO: 10418 - DNA, 103 bp, Artificial Sequence
  Synthetic Polynucleotide
taatacgactcactatagggggagtatcagatgggctggtttttgcaggtaacagaggagaacctgcatgaaccagcccaacctggcggcagcgcaaaagatg

SEQ ID NO: 10419 - DNA, 103 bp, Artificial Sequence
  Synthetic Polynucleotide
taatacgactcactatagggtgccaggagtatcagatgggctggtttttgaacagaggagacaaaaaatggcccatctgaacctggcggcagcgcaaaagatg

SEQ ID NO: 10420 - DNA, 103 bp, Artificial Sequence
  Synthetic Polynucleotide
taatacgactcactatagggcccgatgccaggagtatcagatgggctggtaacagaggagaaccagcatgtctgatactaacctggcggcagcgcaaaagatg

SEQ ID NO: 10421 - DNA, 103 bp, Artificial Sequence
  Synthetic Polynucleotide
taatacgactcactatagggttgcccccgatgccaggagtatcagatgggaacagaggagacccatcatgtactcctggaacctggcggcagcgcaaaagatg

SEQ ID NO: 10422 - DNA, 103 bp, Artificial Sequence
  Synthetic Polynucleotide
taatacgactcactatagggttgtcttgcccccgatgccaggagtatcagaacagaggagactgataatgctggcatcgaacctggcggcagcgcaaaagatg

SEQ ID NO: 10423 - DNA, 103 bp, Artificial Sequence
  Synthetic Polynucleotide
taatacgactcactatagggccgttgtctcacaatgccttgttggactgaaacagaggagatcagtcatgcaaggcattaacctggcggcagcgcaaaagatg

SEQ ID NO: 10424 - DNA, 103 bp, Artificial Sequence
  Synthetic Polynucleotide
taatacgactcactatagggctgccttgtcttgcccccgatgccaggagtaacagaggagaactcctatgatcgggggcaacctggcggcagcgcaaaagatg

SEQ ID NO: 10425 - DNA, 103 bp, Artificial Sequence
  Synthetic Polynucleotide
taatacgactcactatagggcttggctgccttgtcttgcccccgatgccaaacagaggagatggcatatggggcaagacaacctggcggcagcgcaaaagatg

SEQ ID NO: 10426 - DNA, 103 bp, Artificial Sequence
  Synthetic Polynucleotide
taatacgactcactatagggtgctgcttggctgccttgtcttgcccccgaaacagaggagatcggggatgagacaaggcaacctggcggcagcgcaaaagatg

SEQ ID NO: 10427 - DNA, 103 bp, Artificial Sequence
  Synthetic Polynucleotide
taatacgactcactatagggggggctgctgcttggctgccttgtcttgccaacagaggagaggcaagatgaggcagccaaacctggcggcagcgcaaaagatg

SEQ ID NO: 10428 - DNA, 103 bp, Artificial Sequence
  Synthetic Polynucleotide
taatacgactcactataggggctcgggggctgctgcttggctgccttgtcaacagaggagagacaagatggccaagcagaacctggcggcagcgcaaaagatg

SEQ ID NO: 10429 - DNA, 103 bp, Artificial Sequence
  Synthetic Polynucleotide
taatacgactcactataggggctcggctcgggggctgctgcttggctgccaacagaggagaggcagcatggcagcagccaacctggcggcagcgcaaaagatg

SEQ ID NO: 10430 - DNA, 103 bp, Artificial Sequence
  Synthetic Polynucleotide
taatacgactcactatagggtttgggctcggctcgggggctgctgcttggaacagaggagaccaagcatgagcccccgaaacctggcggcagcgcaaaagatg

SEQ ID NO: 10431 - DNA, 103 bp, Artificial Sequence
  Synthetic Polynucleotide
taatacgactcactatagggatgggtttgggctcggctcgggggctgctgaacagaggagacagcagatgccgagccgaaacctggcggcagcgcaaaagatg

SEQ ID NO: 10432 - DNA, 103 bp, Artificial Sequence
  Synthetic Polynucleotide
taatacgactcactataggggtgtaatgggtttgggctcggctcgggggcaacagaggagagcccccatgccgagcccaaacctggcggcagcgcaaaagatg

SEQ ID NO: 10433 - DNA, 103 bp, Artificial Sequence
  Synthetic Polynucleotide
taatacgactcactatagggctcgggtgtaatgggtttgggctcggctcgaacagaggagacgagccatgcccaaacccaacctggcggcagcgcaaaagatg

SEQ ID NO: 10434 - DNA, 103 bp, Artificial Sequence
  Synthetic Polynucleotide
taatacgactcactatagggatgacccgttgtctcacaatgccttgttggaacagaggagaccaacaatgcattgtgagaacctggcggcagcgcaaaagatg

SEQ ID NO: 10435 - DNA, 103 bp, Artificial Sequence
  Synthetic Polynucleotide
taatacgactcactatagggttgggctcgggtgtaatgggtttgggctcgaacagaggagacgagccatgacccattacaacctggcggcagcgcaaaagatg

SEQ ID NO: 10436 - DNA, 103 bp, Artificial Sequence
  Synthetic Polynucleotide
taatacgactcactataggggggtgttgggctcgggtgtaatgggtttggaacagaggagaccaaacatgttacacccgaacctggcggcagcgcaaaagatg

SEQ ID NO: 10437 - DNA, 103 bp, Artificial Sequence
  Synthetic Polynucleotide
taatacgactcactatagggtggatgggtgttgggctcgggtgtaatgggaacagaggagacccattatgcccgagcccaacctggcggcagcgcaaaagatg

SEQ ID NO: 10438 - DNA, 103 bp, Artificial Sequence
  Synthetic Polynucleotide
taatacgactcactataggggttgctggatgggtgttgggctcgggtgtaaacagaggagatacaccatggcccaacacaacctggcggcagcgcaaaagatg

SEQ ID NO: 10439 - DNA, 103 bp, Artificial Sequence
  Synthetic Polynucleotide
taatacgactcactatagggtgtgggttgctggatgggtgttgggctcggaacagaggagaccgagcatgacacccatcaacctggcggcagcgcaaaagatg

SEQ ID NO: 10440 - DNA, 103 bp, Artificial Sequence
  Synthetic Polynucleotide
taatacgactcactatagggacggttgtgggttgctggatgggtgttgggaacagaggagacccaacatgcatccagcaaacctggcggcagcgcaaaagatg

SEQ ID NO: 10441 - DNA, 103 bp, Artificial Sequence
  Synthetic Polynucleotide
taatacgactcactataggggtttgacggttgtgggttgctggatgggtgaacagaggagacacccaatgagcaacccaaacctggcggcagcgcaaaagatg

SEQ ID NO: 10442 - DNA, 103 bp, Artificial Sequence
  Synthetic Polynucleotide
taatacgactcactatagggtgtgcgtttgacggttgtgggttgctggataacagaggagaatccagatgcccacaaccaacctggcggcagcgcaaaagatg

SEQ ID NO: 10443 - DNA, 103 bp, Artificial Sequence
  Synthetic Polynucleotide
taatacgactcactatagggccatctgtgcgtttgacggttgtgggttgcaacagaggagagcaaccatgaaccgtcaaaacctggcggcagcgcaaaagatg

SEQ ID NO: 10444 - DNA, 103 bp, Artificial Sequence
  Synthetic Polynucleotide
taatacgactcactatagggcttgtccatctgtgcgtttgacggttgtggaacagaggagaccacaaatgtcaaacgcaaacctggcggcagcgcaaaagatg

SEQ ID NO: 10445 - DNA, 103 bp, Artificial Sequence
  Synthetic Polynucleotide
taatacgactcactatagggcttgaatgacccgttgtctcacaatgccttaacagaggagaaaggcaatgtgagacaacaacctggcggcagcgcaaaagatg

SEQ ID NO: 10446 - DNA, 103 bp, Artificial Sequence
  Synthetic Polynucleotide
taatacgactcactatagggctttgcttgtccatctgtgcgtttgacggtaacagaggagaaccgtcatgcgcacagataacctggcggcagcgcaaaagatg

SEQ ID NO: 10447 - DNA, 103 bp, Artificial Sequence
  Synthetic Polynucleotide
taatacgactcactatagggatgttctttgcttgtccatctgtgcgtttgaacagaggagacaaacgatgagatggacaaacctggcggcagcgcaaaagatg

SEQ ID NO: 10448 - DNA, 103 bp, Artificial Sequence
  Synthetic Polynucleotide
taatacgactcactataggggcttgatgttctttgcttgtccatctgtgcaacagaggagagcacagatggacaagcaaaacctggcggcagcgcaaaagatg

SEQ ID NO: 10449 - DNA, 103 bp, Artificial Sequence
  Synthetic Polynucleotide
taatacgactcactatagggtcctggcttgatgttctttgcttgtccatcaacagaggagagatggaatggcaaagaacaacctggcggcagcgcaaaagatg

SEQ ID NO: 10450 - DNA, 103 bp, Artificial Sequence
  Synthetic Polynucleotide
taatacgactcactataggggttgctcctggcttgatgttctttgcttgtaacagaggagaacaagcatggaacatcaaaacctggcggcagcgcaaaagatg

SEQ ID NO: 10451 - DNA, 103 bp, Artificial Sequence
  Synthetic Polynucleotide
taatacgactcactatagggtctgtgttgctcctggcttgatgttctttgaacagaggagacaaagaatgtcaagccagaacctggcggcagcgcaaaagatg

SEQ ID NO: 10452 - DNA, 103 bp, Artificial Sequence
  Synthetic Polynucleotide
taatacgactcactatagggtggggtctgtgttgctcctggcttgatgttaacagaggagaaacatcatgccaggagcaaacctggcggcagcgcaaaagatg

SEQ ID NO: 10453 - DNA, 103 bp, Artificial Sequence
  Synthetic Polynucleotide
taatacgactcactatagggagacttggggtctgtgttgctcctggcttgaacagaggagacaagccatgagcaacacaaacctggcggcagcgcaaaagatg

SEQ ID NO: 10454 - DNA, 103 bp, Artificial Sequence
  Synthetic Polynucleotide
taatacgactcactatagggagcttagacttggggtctgtgttgctcctgaacagaggagacaggagatgcacagacccaacctggcggcagcgcaaaagatg

SEQ ID NO: 10455 - DNA, 103 bp, Artificial Sequence
  Synthetic Polynucleotide
taatacgactcactatagggtgatcagcttagacttggggtctgtgttgcaacagaggagagcaacaatgaccccaagtaacctggcggcagcgcaaaagatg

SEQ ID NO: 10456 - DNA, 103 bp, Artificial Sequence
  Synthetic Polynucleotide
taatacgactcactataggggtggacttgaatgacccgttgtctcacaataacagaggagaattgtgatgcaacgggtcaacctggcggcagcgcaaaagatg

SEQ ID NO: 10457 - DNA, 103 bp, Artificial Sequence
  Synthetic Polynucleotide
taatacgactcactatagggggggttgatcagcttagacttggggtctgtaacagaggagaacagacatgaagtctaagaacctggcggcagcgcaaaagatg

SEQ ID NO: 10458 - DNA, 103 bp, Artificial Sequence
  Synthetic Polynucleotide
taatacgactcactatagggcgggaggggttgatcagcttagacttggggaacagaggagaccccaaatgtaagctgataacctggcggcagcgcaaaagatg

SEQ ID NO: 10459 - DNA, 103 bp, Artificial Sequence
  Synthetic Polynucleotide
taatacgactcactataggggattgcgggaggggttgatcagcttagactaacagaggagaagtctaatgtgatcaaccaacctggcggcagcgcaaaagatg

SEQ ID NO: 10460 - DNA, 103 bp, Artificial Sequence
  Synthetic Polynucleotide
taatacgactcactatagggggtgggattgcgggaggggttgatcagcttaacagaggagaaagctgatgaacccctccaacctggcggcagcgcaaaagatg

SEQ ID NO: 10461 - DNA, 103 bp, Artificial Sequence
  Synthetic Polynucleotide
taatacgactcactataggggcgttggtgggattgcgggaggggttgatcaacagaggagagatcaaatgctcccgcaaaacctggcggcagcgcaaaagatg

SEQ ID NO: 10462 - DNA, 103 bp, Artificial Sequence
  Synthetic Polynucleotide
taatacgactcactatagggtgctggcgttggtgggattgcgggaggggtaacagaggagaacccctatggcaatcccaaacctggcggcagcgcaaaagatg

SEQ ID NO: 10463 - DNA, 103 bp, Artificial Sequence
  Synthetic Polynucleotide
taatacgactcactatagggatttttgctggcgttggtgggattgcgggaaacagaggagatcccgcatgcccaccaacaacctggcggcagcgcaaaagatg

SEQ ID NO: 10464 - DNA, 103 bp, Artificial Sequence
  Synthetic Polynucleotide
taatacgactcactataggggggggatttttgctggcgttggtgggattgaacagaggagacaatccatgcaacgccagaacctggcggcagcgcaaaagatg

SEQ ID NO: 10465 - DNA, 103 bp, Artificial Sequence
  Synthetic Polynucleotide
taatacgactcactataggggagttgggggatttttgctggcgttggtggaacagaggagaccaccaatgccagcaaaaaacctggcggcagcgcaaaagatg

SEQ ID NO: 10466 - DNA, 103 bp, Artificial Sequence
  Synthetic Polynucleotide
taatacgactcactataggggtatcgagttgggggatttttgctggcgttaacagaggagaaacgccatgaaaaatcccaacctggcggcagcgcaaaagatg

SEQ ID NO: 10467 - DNA, 103 bp, Artificial Sequence
  Synthetic Polynucleotide
taatacgactcactatagggacctggtggacttgaatgacccgttgtctcaacagaggagagagacaatgggtcattcaaacctggcggcagcgcaaaagatg

SEQ ID NO: 10468 - DNA, 103 bp, Artificial Sequence
  Synthetic Polynucleotide
taatacgactcactatagggggttggtatcgagttgggggatttttgctgaacagaggagacagcaaatgtcccccaacaacctggcggcagcgcaaaagatg

SEQ ID NO: 10469 - DNA, 103 bp, Artificial Sequence
  Synthetic Polynucleotide
taatacgactcactatagggcttggggttggtatcgagttgggggattttaacagaggagaaaaatcatgcaactcgataacctggcggcagcgcaaaagatg

SEQ ID NO: 10470 - DNA, 103 bp, Artificial Sequence
  Synthetic Polynucleotide
taatacgactcactatagggatttgcttggggttggtatcgagttgggggaacagaggagacccccaatgcgataccaaaacctggcggcagcgcaaaagatg

SEQ ID NO: 10471 - DNA, 103 bp, Artificial Sequence
  Synthetic Polynucleotide
taatacgactcactatagggagctgatttgcttggggttggtatcgagttaacagaggagaaactcgatgccaaccccaaacctggcggcagcgcaaaagatg

SEQ ID NO: 10472 - DNA, 103 bp, Artificial Sequence
  Synthetic Polynucleotide
taatacgactcactataggggtttgagctgatttgcttggggttggtatcaacagaggagagataccatgcccaagcaaaacctggcggcagcgcaaaagatg

SEQ ID NO: 10473 - DNA, 103 bp, Artificial Sequence
  Synthetic Polynucleotide
taatacgactcactatagggagacggtttgagctgatttgcttggggttgaacagaggagacaacccatggcaaatcagaacctggcggcagcgcaaaagatg

SEQ ID NO: 10474 - DNA, 103 bp, Artificial Sequence
  Synthetic Polynucleotide
taatacgactcactataggggagatagacggtttgagctgatttgcttggaacagaggagaccaagcatgtcagctcaaaacctggcggcagcgcaaaagatg

SEQ ID NO: 10475 - DNA, 103 bp, Artificial Sequence
  Synthetic Polynucleotide
taatacgactcactatagggggggagagatagacggtttgagctgatttgaacagaggagacaaatcatgtcaaaccgtaacctggcggcagcgcaaaagatg

SEQ ID NO: 10476 - DNA, 103 bp, Artificial Sequence
  Synthetic Polynucleotide
taatacgactcactataggggaagcggggagagatagacggtttgagctgaacagaggagacagctcatgccgtctatcaacctggcggcagcgcaaaagatg

SEQ ID NO: 10477 - DNA, 103 bp, Artificial Sequence
  Synthetic Polynucleotide
taatacgactcactatagggggagtgaagcggggagagatagacggtttgaacagaggagacaaaccatgtatctctccaacctggcggcagcgcaaaagatg

SEQ ID NO: 10478 - DNA, 103 bp, Artificial Sequence
  Synthetic Polynucleotide
taatacgactcactatagggttgtaacctggtggacttgaatgacccgttaacagaggagaaacgggatgttcaagtccaacctggcggcagcgcaaaagatg

SEQ ID NO: 10479 - DNA, 103 bp, Artificial Sequence
  Synthetic Polynucleotide
taatacgactcactatagggggtgtggagtgaagcggggagagatagacgaacagaggagacgtctaatgctccccgctaacctggcggcagcgcaaaagatg

SEQ ID NO: 10480 - DNA, 103 bp, Artificial Sequence
  Synthetic Polynucleotide
taatacgactcactatagggtctggggtgtggagtgaagcggggagagataacagaggagaatctctatgcgcttcactaacctggcggcagcgcaaaagatg

SEQ ID NO: 10481 - DNA, 103 bp, Artificial Sequence
  Synthetic Polynucleotide
taatacgactcactatagggctgaatctggggtgtggagtgaagcggggaaacagaggagatccccgatgcactccacaaacctggcggcagcgcaaaagatg

SEQ ID NO: 10482 - DNA, 103 bp, Artificial Sequence
  Synthetic Polynucleotide
taatacgactcactataggggtttgctgaatctggggtgtggagtgaagcaacagaggagagcttcaatgcacaccccaaacctggcggcagcgcaaaagatg

SEQ ID NO: 10483 - DNA, 103 bp, Artificial Sequence
  Synthetic Polynucleotide
taatacgactcactatagggtgatcgtttgctgaatctggggtgtggagtaacagaggagaactccaatgcccagattcaacctggcggcagcgcaaaagatg

SEQ ID NO: 10484 - DNA, 103 bp, Artificial Sequence
  Synthetic Polynucleotide
taatacgactcactatagggtgcgttgatcgtttgctgaatctggggtgtaacagaggagaacacccatgattcagcaaaacctggcggcagcgcaaaagatg

SEQ ID NO: 10485 - DNA, 103 bp, Artificial Sequence
  Synthetic Polynucleotide
taatacgactcactatagggagaagtgcgttgatcgtttgctgaatctggaacagaggagaccagatatggcaaacgataacctggcggcagcgcaaaagatg

SEQ ID NO: 10486 - DNA, 103 bp, Artificial Sequence
  Synthetic Polynucleotide
taatacgactcactataggggcataagaagtgcgttgatcgtttgctgaaaacagaggagattcagcatgcgatcaacgaacctggcggcagcgcaaaagatg

SEQ ID NO: 10487 - DNA, 103 bp, Artificial Sequence
  Synthetic Polynucleotide
taatacgactcactatagggctgtggcataagaagtgcgttgatcgtttgaacagaggagacaaacgatgaacgcacttaacctggcggcagcgcaaaagatg

SEQ ID NO: 10488 - DNA, 103 bp, Artificial Sequence
  Synthetic Polynucleotide
taatacgactcactatagggataagctgtggcataagaagtgcgttgatcaacagaggagagatcaaatgacttcttataacctggcggcagcgcaaaagatg

SEQ ID NO: 10489 - DNA, 103 bp, Artificial Sequence
  Synthetic Polynucleotide
taatacgactcactatagggtaggtttgtaacctggtggacttgaatgacaacagaggagagtcattatggtccaccagaacctggcggcagcgcaaaagatg

SEQ ID NO: 10490 - DNA, 103 bp, Artificial Sequence
  Synthetic Polynucleotide
taatacgactcactatagggttaatataagctgtggcataagaagtgcgtaacagaggagaacgcacatgttatgccacaacctggcggcagcgcaaaagatg

SEQ ID NO: 10491 - DNA, 103 bp, Artificial Sequence
  Synthetic Polynucleotide
taatacgactcactatagggttttcttaatataagctgtggcataagaagaacagaggagacttcttatgccacagcttaacctggcggcagcgcaaaagatg

SEQ ID NO: 10492 - DNA, 103 bp, Artificial Sequence
  Synthetic Polynucleotide
taatacgactcactataggggttctttttcttaatataagctgtggcataaacagaggagatatgccatggcttatattaacctggcggcagcgcaaaagatg

SEQ ID NO: 10493 - DNA, 103 bp, Artificial Sequence
  Synthetic Polynucleotide
taatacgactcactatagggatcaagttctttttcttaatataagctgtgaacagaggagacacagcatgtattaagaaaacctggcggcagcgcaaaagatg

SEQ ID NO: 10494 - DNA, 103 bp, Artificial Sequence
  Synthetic Polynucleotide
taatacgactcactatagggtcttcatcaagttctttttcttaatataagaacagaggagacttataatgagaaaaagaaacctggcggcagcgcaaaagatg

SEQ ID NO: 10495 - DNA, 103 bp, Artificial Sequence
  Synthetic Polynucleotide
taatacgactcactatagggcttaatcttcatcaagttctttttcttaataacagaggagaattaagatgaagaacttgaacctggcggcagcgcaaaagatg

SEQ ID NO: 10496 - DNA, 103 bp, Artificial Sequence
  Synthetic Polynucleotide
taatacgactcactataggggttgccttaatcttcatcaagttctttttcaacagaggagagaaaaaatgcttgatgaaaacctggcggcagcgcaaaagatg

SEQ ID NO: 10497 - DNA, 103 bp, Artificial Sequence
  Synthetic Polynucleotide
taatacgactcactatagggcactggttgccttaatcttcatcaagttctaacagaggagaagaactatgtgaagattaaacctggcggcagcgcaaaagatg

SEQ ID NO: 10498 - DNA, 103 bp, Artificial Sequence
  Synthetic Polynucleotide
taatacgactcactatagggagcaccactggttgccttaatcttcatcaaaacagaggagattgatgatgattaaggcaaacctggcggcagcgcaaaagatg

SEQ ID NO: 10499 - DNA, 103 bp, Artificial Sequence
  Synthetic Polynucleotide
taatacgactcactatagggaagatagcaccactggttgccttaatcttcaacagaggagagaagatatgggcaaccagaacctggcggcagcgcaaaagatg

SEQ ID NO: 10500 - DNA, 103 bp, Artificial Sequence
  Synthetic Polynucleotide
taatacgactcactatagggtcttctaggtttgtaacctggtggacttgaaacagaggagatcaagtatgccaggttacaacctggcggcagcgcaaaagatg

SEQ ID NO: 10501 - DNA, 103 bp, Artificial Sequence
  Synthetic Polynucleotide
taatacgactcactatagggagatgaagatagcaccactggttgccttaaaacagaggagattaaggatgccagtggtgaacctggcggcagcgcaaaagatg

SEQ ID NO: 10502 - DNA, 103 bp, Artificial Sequence
  Synthetic Polynucleotide
taatacgactcactatagggcaaagagatgaagatagcaccactggttgcaacagaggagagcaaccatgggtgctatcaacctggcggcagcgcaaaagatg

SEQ ID NO: 10503 - DNA, 103 bp, Artificial Sequence
  Synthetic Polynucleotide
taatacgactcactatagggcaaatcaaagagatgaagatagcaccactgaacagaggagacagtggatgtatcttcataacctggcggcagcgcaaaagatg

SEQ ID NO: 10504 - DNA, 103 bp, Artificial Sequence
  Synthetic Polynucleotide
taatacgactcactatagggagactcaaatcaaagagatgaagatagcacaacagaggagagtgctaatgtcatctcttaacctggcggcagcgcaaaagatg

SEQ ID NO: 10505 - DNA, 103 bp, Artificial Sequence
  Synthetic Polynucleotide
taatacgactcactatagggacttaagactcaaatcaaagagatgaagataacagaggagaatcttcatgtctttgattaacctggcggcagcgcaaaagatg

SEQ ID NO: 10506 - DNA, 103 bp, Artificial Sequence
  Synthetic Polynucleotide
taatacgactcactatagggtattcacttaagactcaaatcaaagagatgaacagaggagacatctcatggatttgagtaacctggcggcagcgcaaaagatg

SEQ ID NO: 10507 - DNA, 103 bp, Artificial Sequence
  Synthetic Polynucleotide
taatacgactcactatagggctgtgtattcacttaagactcaaatcaaagaacagaggagactttgaatggagtcttaaaacctggcggcagcgcaaaagatg

SEQ ID NO: 10508 - DNA, 103 bp, Artificial Sequence
  Synthetic Polynucleotide
taatacgactcactatagggagaacctgtgtattcacttaagactcaaataacagaggagaatttgaatgttaagtgaaaacctggcggcagcgcaaaagatg

SEQ ID NO: 10509 - DNA, 103 bp, Artificial Sequence
  Synthetic Polynucleotide
taatacgactcactataggggtattagaacctgtgtattcacttaagactaacagaggagaagtcttatgtgaatacacaacctggcggcagcgcaaaagatg

SEQ ID NO: 10510 - DNA, 103 bp, Artificial Sequence
  Synthetic Polynucleotide
taatacgactcactataggggaacagtattagaacctgtgtattcacttaaacagaggagataagtgatgacacaggttaacctggcggcagcgcaaaagatg

SEQ ID NO: 10511 - DNA, 103 bp, Artificial Sequence
  Synthetic Polynucleotide
taatacgactcactatagggatatttcttctaggtttgtaacctggtggaaacagaggagatccaccatgttacaaaccaacctggcggcagcgcaaaagatg

SEQ ID NO: 10512 - DNA, 103 bp, Artificial Sequence
  Synthetic Polynucleotide
taatacgactcactatagggcagaagaacagtattagaacctgtgtattcaacagaggagagaatacatgggttctaataacctggcggcagcgcaaaagatg

SEQ ID NO: 10513 - DNA, 103 bp, Artificial Sequence
  Synthetic Polynucleotide
taatacgactcactatagggttggacagaagaacagtattagaacctgtgaacagaggagacacaggatgtaatactgtaacctggcggcagcgcaaaagatg

SEQ ID NO: 10514 - DNA, 103 bp, Artificial Sequence
  Synthetic Polynucleotide
taatacgactcactatagggtaccgttggacagaagaacagtattagaacaacagaggagagttctaatgctgttcttcaacctggcggcagcgcaaaagatg

SEQ ID NO: 10515 - DNA, 103 bp, Artificial Sequence
  Synthetic Polynucleotide
taatacgactcactatagggaattataccgttggacagaagaacagtattaacagaggagaaatactatgcttctgtccaacctggcggcagcgcaaaagatg

SEQ ID NO: 10516 - DNA, 103 bp, Artificial Sequence
  Synthetic Polynucleotide
taatacgactcactatagggggctgaattataccgttggacagaagaacaaacagaggagatgttctatggtccaacggaacctggcggcagcgcaaaagatg

SEQ ID NO: 10517 - DNA, 103 bp, Artificial Sequence
  Synthetic Polynucleotide
taatacgactcactatagggggcctggctgaattataccgttggacagaaaacagaggagattctgtatgacggtataaaacctggcggcagcgcaaaagatg

SEQ ID NO: 10518 - DNA, 103 bp, Artificial Sequence
  Synthetic Polynucleotide
taatacgactcactatagggtcttaggcctggctgaattataccgttggaaacagaggagatccaacatgataattcagaacctggcggcagcgcaaaagatg

SEQ ID NO: 10519 - DNA, 103 bp, Artificial Sequence
  Synthetic Polynucleotide
taatacgactcactatagggtactgtcttaggcctggctgaattataccgaacagaggagacggtatatgtcagccaggaacctggcggcagcgcaaaagatg

SEQ ID NO: 10520 - DNA, 103 bp, Artificial Sequence
  Synthetic Polynucleotide
taatacgactcactatagggttagctactgtcttaggcctggctgaattaaacagaggagataattcatgcaggcctaaaacctggcggcagcgcaaaagatg

SEQ ID NO: 10521 - DNA, 103 bp, Artificial Sequence
  Synthetic Polynucleotide
taatacgactcactatagggtgtgattagctactgtcttaggcctggctgaacagaggagacagccaatgctaagacagaacctggcggcagcgcaaaagatg

SEQ ID NO: 10522 - DNA, 103 bp, Artificial Sequence
  Synthetic Polynucleotide
taatacgactcactatagggtcaatgagaggaaaattattaatcttcctcaacagaggagagaggaaatgtaataatttaacctggcggcagcgcaaaagatg

SEQ ID NO: 10523 - DNA, 103 bp, Artificial Sequence
  Synthetic Polynucleotide
taatacgactcactatagggttggcatatttcttctaggtttgtaacctgaacagaggagacaggttatgaacctagaaaacctggcggcagcgcaaaagatg

SEQ ID NO: 10524 - DNA, 103 bp, Artificial Sequence
  Synthetic Polynucleotide
taatacgactcactatagggatgactgtgattagctactgtcttaggcctaacagaggagaaggcctatgacagtagctaacctggcggcagcgcaaaagatg

SEQ ID NO: 10525 - DNA, 103 bp, Artificial Sequence
  Synthetic Polynucleotide
taatacgactcactatagggccatgatgactgtgattagctactgtcttaaacagaggagataagacatgagctaatcaaacctggcggcagcgcaaaagatg

SEQ ID NO: 10526 - DNA, 103 bp, Artificial Sequence
  Synthetic Polynucleotide
taatacgactcactatagggcgctcccatgatgactgtgattagctactgaacagaggagacagtagatgatcacagtcaacctggcggcagcgcaaaagatg

SEQ ID NO: 10527 - DNA, 103 bp, Artificial Sequence
  Synthetic Polynucleotide
taatacgactcactatagggcctgacgctcccatgatgactgtgattagcaacagaggagagctaatatgagtcatcataacctggcggcagcgcaaaagatg

SEQ ID NO: 10528 - DNA, 103 bp, Artificial Sequence
  Synthetic Polynucleotide
taatacgactcactataggggaatccctgacgctcccatgatgactgtgaaacagaggagatcacagatgtcatgggagaacctggcggcagcgcaaaagatg

SEQ ID NO: 10529 - DNA, 103 bp, Artificial Sequence
  Synthetic Polynucleotide
taatacgactcactatagggttgcagaatccctgacgctcccatgatgacaacagaggagagtcatcatgggagcgtcaaacctggcggcagcgcaaaagatg

SEQ ID NO: 10530 - DNA, 103 bp, Artificial Sequence
  Synthetic Polynucleotide
taatacgactcactatagggggcaattgcagaatccctgacgctcccatgaacagaggagacatgggatggtcagggataacctggcggcagcgcaaaagatg

SEQ ID NO: 10531 - DNA, 103 bp, Artificial Sequence
  Synthetic Polynucleotide
taatacgactcactatagggcacggggcaattgcagaatccctgacgctcaacagaggagagagcgtatgggattctgcaacctggcggcagcgcaaaagatg

SEQ ID NO: 10532 - DNA, 103 bp, Artificial Sequence
  Synthetic Polynucleotide
taatacgactcactataggggcgctcacggggcaattgcagaatccctgaaacagaggagatcagggatgctgcaattgaacctggcggcagcgcaaaagatg

SEQ ID NO: 10533 - DNA, 103 bp, Artificial Sequence
  Synthetic Polynucleotide
taatacgactcactatagggctgaagcgctcacggggcaattgcagaatcaacagaggagagattctatgattgccccgaacctggcggcagcgcaaaagatg

SEQ ID NO: 10534 - DNA, 103 bp, Artificial Sequence
  Synthetic Polynucleotide
taatacgactcactatagggatcaattggcatatttcttctaggtttgtaaacagaggagatacaaaatgagaagaaataacctggcggcagcgcaaaagatg

SEQ ID NO: 10535 - DNA, 103 bp, Artificial Sequence
  Synthetic Polynucleotide
taatacgactcactatagggttttcctgaagcgctcacggggcaattgcaaacagaggagatgcaatatgcccgtgagcaacctggcggcagcgcaaaagatg

SEQ ID NO: 10536 - DNA, 103 bp, Artificial Sequence
  Synthetic Polynucleotide
taatacgactcactatagggagatgttttcctgaagcgctcacggggcaaaacagaggagattgcccatggagcgcttcaacctggcggcagcgcaaaagatg

SEQ ID NO: 10537 - DNA, 103 bp, Artificial Sequence
  Synthetic Polynucleotide
taatacgactcactatagggaagaaagatgttttcctgaagcgctcacggaacagaggagaccgtgaatgcttcaggaaaacctggcggcagcgcaaaagatg

SEQ ID NO: 10538 - DNA, 103 bp, Artificial Sequence
  Synthetic Polynucleotide
taatacgactcactatagggaaacaaagaaagatgttttcctgaagcgctaacagaggagaagcgctatgggaaaacataacctggcggcagcgcaaaagatg

SEQ ID NO: 10539 - DNA, 103 bp, Artificial Sequence
  Synthetic Polynucleotide
taatacgactcactatagggtacccaaacaaagaaagatgttttcctgaaaacagaggagattcaggatgacatctttcaacctggcggcagcgcaaaagatg

SEQ ID NO: 10540 - DNA, 103 bp, Artificial Sequence
  Synthetic Polynucleotide
taatacgactcactatagggattattacccaaacaaagaaagatgttttcaacagaggagagaaaacatgtttctttgtaacctggcggcagcgcaaaagatg

SEQ ID NO: 10541 - DNA, 103 bp, Artificial Sequence
  Synthetic Polynucleotide
taatacgactcactatagggataggattattacccaaacaaagaaagatgaacagaggagacatcttatgttgtttgggaacctggcggcagcgcaaaagatg

SEQ ID NO: 10542 - DNA, 103 bp, Artificial Sequence
  Synthetic Polynucleotide
taatacgactcactatagggatggaataggattattacccaaacaaagaaaacagaggagattctttatgtgggtaataaacctggcggcagcgcaaaagatg

SEQ ID NO: 10543 - DNA, 103 bp, Artificial Sequence
  Synthetic Polynucleotide
taatacgactcactatagggactttatggaataggattattacccaaacaaacagaggagatgtttgatgaataatcctaacctggcggcagcgcaaaagatg

SEQ ID NO: 10544 - DNA, 103 bp, Artificial Sequence
  Synthetic Polynucleotide
taatacgactcactatagggaaaagactttatggaataggattattacccaacagaggagagggtaaatgtcctattccaacctggcggcagcgcaaaagatg

SEQ ID NO: 10545 - DNA, 103 bp, Artificial Sequence
  Synthetic Polynucleotide
taatacgactcactataggggaatgatcaattggcatatttcttctaggtaacagaggagaacctagatgaaatatgccaacctggcggcagcgcaaaagatg

SEQ ID NO: 10546 - DNA, 103 bp, Artificial Sequence
  Synthetic Polynucleotide
taatacgactcactataggggattgaaaagactttatggaataggattataacagaggagaataatcatgttccataaaaacctggcggcagcgcaaaagatg

SEQ ID NO: 10547 - DNA, 103 bp, Artificial Sequence
  Synthetic Polynucleotide
taatacgactcactatagggaacgggattgaaaagactttatggaataggaacagaggagacctattatgtaaagtcttaacctggcggcagcgcaaaagatg

SEQ ID NO: 10548 - DNA, 103 bp, Artificial Sequence
  Synthetic Polynucleotide
taatacgactcactatagggcccccaacgggattgaaaagactttatggaaacagaggagatccataatgtcttttcaaaacctggcggcagcgcaaaagatg

SEQ ID NO: 10549 - DNA, 103 bp, Artificial Sequence
  Synthetic Polynucleotide
taatacgactcactatagggtacaacccccaacgggattgaaaagactttaacagaggagaaaagtcatgtcaatcccgaacctggcggcagcgcaaaagatg

SEQ ID NO: 10550 - DNA, 103 bp, Artificial Sequence
  Synthetic Polynucleotide
taatacgactcactatagggttgtgtacaacccccaacgggattgaaaagaacagaggagacttttcatgcccgttgggaacctggcggcagcgcaaaagatg

SEQ ID NO: 10551 - DNA, 103 bp, Artificial Sequence
  Synthetic Polynucleotide
taatacgactcactatagggtattgttgtgtacaacccccaacgggattgaacagaggagacaatccatgtgggggttgaacctggcggcagcgcaaaagatg

SEQ ID NO: 10552 - DNA, 103 bp, Artificial Sequence
  Synthetic Polynucleotide
taatacgactcactatagggtagggtattgttgtgtacaacccccaacggaacagaggagaccgttgatggttgtacacaacctggcggcagcgcaaaagatg

SEQ ID NO: 10553 - DNA, 103 bp, Artificial Sequence
  Synthetic Polynucleotide
taatacgactcactatagggacttgtagggtattgttgtgtacaacccccaacagaggagagggggtatgacacaacaaaacctggcggcagcgcaaaagatg

SEQ ID NO: 10554 - DNA, 103 bp, Artificial Sequence
  Synthetic Polynucleotide
taatacgactcactatagggcactcacttgtagggtattgttgtgtacaaaacagaggagattgtacatgacaatacccaacctggcggcagcgcaaaagatg

SEQ ID NO: 10555 - DNA, 103 bp, Artificial Sequence
  Synthetic Polynucleotide
taatacgactcactatagggaatatcactcacttgtagggtattgttgtgaacagaggagacacaacatgaccctacaaaacctggcggcagcgcaaaagatg

SEQ ID NO: 10556 - DNA, 103 bp, Artificial Sequence
  Synthetic Polynucleotide
taatacgactcactatagggggcttgaatgatcaattggcatatttcttcaacagaggagagaagaaatgtgccaattgaacctggcggcagcgcaaaagatg

SEQ ID NO: 10557 - DNA, 103 bp, Artificial Sequence
  Synthetic Polynucleotide
taatacgactcactatagggttgtcaatatcactcacttgtagggtattgaacagaggagacaatacatgacaagtgagaacctggcggcagcgcaaaagatg

SEQ ID NO: 10558 - DNA, 103 bp, Artificial Sequence
  Synthetic Polynucleotide
taatacgactcactatagggcaaacttgtcaatatcactcacttgtagggaacagaggagaccctacatgtgagtgataaacctggcggcagcgcaaaagatg

SEQ ID NO: 10559 - DNA, 103 bp, Artificial Sequence
  Synthetic Polynucleotide
taatacgactcactataggggcacacaaacttgtcaatatcactcacttgaacagaggagacaagtgatggatattgacaacctggcggcagcgcaaaagatg

SEQ ID NO: 10560 - DNA, 103 bp, Artificial Sequence
  Synthetic Polynucleotide
taatacgactcactatagggtctcggcacacaaacttgtcaatatcactcaacagaggagagagtgaatgtgacaagttaacctggcggcagcgcaaaagatg

SEQ ID NO: 10561 - DNA, 103 bp, Artificial Sequence
  Synthetic Polynucleotide
taatacgactcactataggggtttgtctcggcacacaaacttgtcaatataacagaggagaatattgatgagtttgtgtaacctggcggcagcgcaaaagatg

SEQ ID NO: 10562 - DNA, 103 bp, Artificial Sequence
  Synthetic Polynucleotide
taatacgactcactatagggagagagtttgtctcggcacacaaacttgtcaacagaggagagacaagatggtgtgccgaaacctggcggcagcgcaaaagatg

SEQ ID NO: 10563 - DNA, 103 bp, Artificial Sequence
  Synthetic Polynucleotide
taatacgactcactataggggttgaagagagtttgtctcggcacacaaacaacagaggagagtttgtatgccgagacaaaacctggcggcagcgcaaaagatg

SEQ ID NO: 10564 - DNA, 103 bp, Artificial Sequence
  Synthetic Polynucleotide
taatacgactcactatagggggctagttgaagagagtttgtctcggcacaaacagaggagatgtgccatgacaaactctaacctggcggcagcgcaaaagatg

SEQ ID NO: 10565 - DNA, 103 bp, Artificial Sequence
  Synthetic Polynucleotide
taatacgactcactatagggcaattggctagttgaagagagtttgtctcgaacagaggagacgagacatgctctcttcaaacctggcggcagcgcaaaagatg

SEQ ID NO: 10566 - DNA, 103 bp, Artificial Sequence
  Synthetic Polynucleotide
taatacgactcactataggggacttcaattggctagttgaagagagtttgaacagaggagacaaactatgttcaactagaacctggcggcagcgcaaaagatg

SEQ ID NO: 10567 - DNA, 103 bp, Artificial Sequence
  Synthetic Polynucleotide
taatacgactcactatagggtcaaaggcttgaatgatcaattggcatattaacagaggagaaatatgatgattgatcataacctggcggcagcgcaaaagatg

SEQ ID NO: 10568 - DNA, 103 bp, Artificial Sequence
  Synthetic Polynucleotide
taatacgactcactatagggcgactgacttcaattggctagttgaagagaaacagaggagatctcttatgctagccaataacctggcggcagcgcaaaagatg

SEQ ID NO: 10569 - DNA, 103 bp, Artificial Sequence
  Synthetic Polynucleotide
taatacgactcactatagggcaacccgactgacttcaattggctagttgaaacagaggagatcaactatgcaattgaagaacctggcggcagcgcaaaagatg

SEQ ID NO: 10570 - DNA, 103 bp, Artificial Sequence
  Synthetic Polynucleotide
taatacgactcactatagggaagttcaacccgactgacttcaattggctaaacagaggagatagccaatggaagtcagtaacctggcggcagcgcaaaagatg

SEQ ID NO: 10571 - DNA, 103 bp, Artificial Sequence
  Synthetic Polynucleotide
taatacgactcactatagggcctccaagttcaacccgactgacttcaattaacagaggagaaattgaatgcagtcgggtaacctggcggcagcgcaaaagatg

SEQ ID NO: 10572 - DNA, 103 bp, Artificial Sequence
  Synthetic Polynucleotide
taatacgactcactatagggattgccctccaagttcaacccgactgacttaacagaggagaaagtcaatggggttgaacaacctggcggcagcgcaaaagatg

SEQ ID NO: 10573 - DNA, 103 bp, Artificial Sequence
  Synthetic Polynucleotide
taatacgactcactatagggactccattgccctccaagttcaacccgactaacagaggagaagtcggatggaacttggaaacctggcggcagcgcaaaagatg

SEQ ID NO: 10574 - DNA, 103 bp, Artificial Sequence
  Synthetic Polynucleotide
taatacgactcactatagggttgctactccattgccctccaagttcaaccaacagaggagaggttgaatgtggagggcaaacctggcggcagcgcaaaagatg

SEQ ID NO: 10575 - DNA, 103 bp, Artificial Sequence
  Synthetic Polynucleotide
taatacgactcactatagggatcagttgctactccattgccctccaagttaacagaggagaaacttgatgggcaatggaaacctggcggcagcgcaaaagatg

SEQ ID NO: 10576 - DNA, 103 bp, Artificial Sequence
  Synthetic Polynucleotide
taatacgactcactatagggggtacatcagttgctactccattgccctccaacagaggagaggagggatgtggagtagcaacctggcggcagcgcaaaagatg

SEQ ID NO: 10577 - DNA, 103 bp, Artificial Sequence
  Synthetic Polynucleotide
taatacgactcactatagggccgttggtacatcagttgctactccattgcaacagaggagagcaatgatgtagcaactgaacctggcggcagcgcaaaagatg

SEQ ID NO: 10578 - DNA, 103 bp, Artificial Sequence
  Synthetic Polynucleotide
taatacgactcactatagggcagcttcaaaggcttgaatgatcaattggcaacagaggagagccaatatgtcattcaagaacctggcggcagcgcaaaagatg

SEQ ID NO: 10579 - DNA, 103 bp, Artificial Sequence
  Synthetic Polynucleotide
taatacgactcactatagggggttgccgttggtacatcagttgctactccaacagaggagaggagtaatgactgatgtaaacctggcggcagcgcaaaagatg

SEQ ID NO: 10580 - DNA, 103 bp, Artificial Sequence
  Synthetic Polynucleotide
taatacgactcactatagggcttttggttgccgttggtacatcagttgctaacagaggagaagcaacatgtgtaccaacaacctggcggcagcgcaaaagatg

SEQ ID NO: 10581 - DNA, 103 bp, Artificial Sequence
  Synthetic Polynucleotide
taatacgactcactatagggcccatcttttggttgccgttggtacatcagaacagaggagactgatgatgcaacggcaaaacctggcggcagcgcaaaagatg

SEQ ID NO: 10582 - DNA, 103 bp, Artificial Sequence
  Synthetic Polynucleotide
taatacgactcactatagggaaaaccccatcttttggttgccgttggtacaacagaggagagtaccaatggcaaccaaaaacctggcggcagcgcaaaagatg

SEQ ID NO: 10583 - DNA, 103 bp, Artificial Sequence
  Synthetic Polynucleotide
taatacgactcactataggggctcgaaaaccccatcttttggttgccgttaacagaggagaaacggcatgcaaaagatgaacctggcggcagcgcaaaagatg

SEQ ID NO: 10584 - DNA, 103 bp, Artificial Sequence
  Synthetic Polynucleotide
taatacgactcactatagggcaccagctcgaaaaccccatcttttggttgaacagaggagacaaccaatggatggggttaacctggcggcagcgcaaaagatg

SEQ ID NO: 10585 - DNA, 103 bp, Artificial Sequence
  Synthetic Polynucleotide
taatacgactcactatagggtggaacaccagctcgaaaaccccatcttttaacagaggagaaaaagaatgggttttcgaaacctggcggcagcgcaaaagatg

SEQ ID NO: 10586 - DNA, 103 bp, Artificial Sequence
  Synthetic Polynucleotide
taatacgactcactatagggtttggtggaacaccagctcgaaaaccccataacagaggagaatggggatgtcgagctggaacctggcggcagcgcaaaagatg

SEQ ID NO: 10587 - DNA, 103 bp, Artificial Sequence
  Synthetic Polynucleotide
taatacgactcactatagggccacctttggtggaacaccagctcgaaaacaacagaggagagttttcatgctggtgttcaacctggcggcagcgcaaaagatg

SEQ ID NO: 10588 - DNA, 103 bp, Artificial Sequence
  Synthetic Polynucleotide
taatacgactcactatagggatttaccacctttggtggaacaccagctcgaacagaggagacgagctatggttccaccaaacctggcggcagcgcaaaagatg

SEQ ID NO: 10589 - DNA, 103 bp, Artificial Sequence
  Synthetic Polynucleotide
taatacgactcactatagggaacaccagcttcaaaggcttgaatgatcaaaacagaggagattgatcatgcaagcctttaacctggcggcagcgcaaaagatg

SEQ ID NO: 10590 - DNA, 103 bp, Artificial Sequence
  Synthetic Polynucleotide
taatacgactcactatagggtcgcaatttaccacctttggtggaacaccaaacagaggagatggtgtatgaccaaaggtaacctggcggcagcgcaaaagatg

SEQ ID NO: 10591 - DNA, 103 bp, Artificial Sequence
  Synthetic Polynucleotide
taatacgactcactatagggcagcttcgcaatttaccacctttggtggaaaacagaggagattccacatgaggtggtaaaacctggcggcagcgcaaaagatg

SEQ ID NO: 10592 - DNA, 103 bp, Artificial Sequence
  Synthetic Polynucleotide
taatacgactcactatagggttctccagcttcgcaatttaccacctttggaacagaggagaccaaagatggtaaattgcaacctggcggcagcgcaaaagatg

SEQ ID NO: 10593 - DNA, 103 bp, Artificial Sequence
  Synthetic Polynucleotide
taatacgactcactataggggcccattctccagcttcgcaatttaccaccaacagaggagaggtggtatgttgcgaagcaacctggcggcagcgcaaaagatg

SEQ ID NO: 10594 - DNA, 103 bp, Artificial Sequence
  Synthetic Polynucleotide
taatacgactcactatagggtctcagcccattctccagcttcgcaatttaaacagaggagataaattatgaagctggagaacctggcggcagcgcaaaagatg

SEQ ID NO: 10595 - DNA, 103 bp, Artificial Sequence
  Synthetic Polynucleotide
taatacgactcactatagggacagttctcagcccattctccagcttcgcaaacagaggagatgcgaaatgggagaatggaacctggcggcagcgcaaaagatg

SEQ ID NO: 10596 - DNA, 103 bp, Artificial Sequence
  Synthetic Polynucleotide
taatacgactcactatagggttataacagttctcagcccattctccagctaacagaggagaagctggatgatgggctgaaacctggcggcagcgcaaaagatg

SEQ ID NO: 10597 - DNA, 103 bp, Artificial Sequence
  Synthetic Polynucleotide
taatacgactcactatagggccaggttataacagttctcagcccattctcaacagaggagagagaatatgctgagaactaacctggcggcagcgcaaaagatg

SEQ ID NO: 10598 - DNA, 103 bp, Artificial Sequence
  Synthetic Polynucleotide
taatacgactcactatagggtatagccaggttataacagttctcagcccaaacagaggagatgggctatgaactgttataacctggcggcagcgcaaaagatg

SEQ ID NO: 10599 - DNA, 103 bp, Artificial Sequence
  Synthetic Polynucleotide
taatacgactcactatagggttctttatagccaggttataacagttctcaaacagaggagatgagaaatgttataacctaacctggcggcagcgcaaaagatg

SEQ ID NO: 10600 - DNA, 103 bp, Artificial Sequence
  Synthetic Polynucleotide
taatacgactcactatagggaaatcaacaccagcttcaaaggcttgaatgaacagaggagacattcaatgctttgaagcaacctggcggcagcgcaaaagatg

SEQ ID NO: 10601 - DNA, 103 bp, Artificial Sequence
  Synthetic Polynucleotide
taatacgactcactatagggcaactttctttatagccaggttataacagtaacagaggagaactgttatgacctggctaaacctggcggcagcgcaaaagatg

SEQ ID NO: 10602 - DNA, 103 bp, Artificial Sequence
  Synthetic Polynucleotide
taatacgactcactatagggaccatcaactttctttatagccaggttataaacagaggagatataacatggctataaagaacctggcggcagcgcaaaagatg

SEQ ID NO: 10603 - DNA, 103 bp, Artificial Sequence
  Synthetic Polynucleotide
taatacgactcactatagggtcactaccatcaactttctttatagccaggaacagaggagacctggcatgaaagaaagtaacctggcggcagcgcaaaagatg

SEQ ID NO: 10604 - DNA, 103 bp, Artificial Sequence
  Synthetic Polynucleotide
taatacgactcactatagggggcactcactaccatcaactttctttatagaacagaggagactataaatgaagttgatgaacctggcggcagcgcaaaagatg

SEQ ID NO: 10605 - DNA, 103 bp, Artificial Sequence
  Synthetic Polynucleotide
taatacgactcactatagggtggtaggcactcactaccatcaactttcttaacagaggagaaagaaaatggatggtagtaacctggcggcagcgcaaaagatg

SEQ ID NO: 10606 - DNA, 103 bp, Artificial Sequence
  Synthetic Polynucleotide
taatacgactcactataggggcttctggtaggcactcactaccatcaactaacagaggagaagttgaatgtagtgagtgaacctggcggcagcgcaaaagatg

SEQ ID NO: 10607 - DNA, 103 bp, Artificial Sequence
  Synthetic Polynucleotide
taatacgactcactatagggcaggggcttctggtaggcactcactaccataacagaggagaatggtaatgagtgcctacaacctggcggcagcgcaaaagatg

SEQ ID NO: 10608 - DNA, 103 bp, Artificial Sequence
  Synthetic Polynucleotide
taatacgactcactatagggtccctcaggggcttctggtaggcactcactaacagaggagaagtgagatgctaccagaaaacctggcggcagcgcaaaagatg

SEQ ID NO: 10609 - DNA, 103 bp, Artificial Sequence
  Synthetic Polynucleotide
taatacgactcactatagggctcactccctcaggggcttctggtaggcacaacagaggagagtgcctatgagaagccccaacctggcggcagcgcaaaagatg

SEQ ID NO: 10610 - DNA, 103 bp, Artificial Sequence
  Synthetic Polynucleotide
taatacgactcactatagggaatccctcactccctcaggggcttctggtaaacagaggagataccagatgcccctgaggaacctggcggcagcgcaaaagatg

SEQ ID NO: 10611 - DNA, 103 bp, Artificial Sequence
  Synthetic Polynucleotide
taatacgactcactatagggcttgaaaatcaacaccagcttcaaaggcttaacagaggagaaagcctatgaagctggtgaacctggcggcagcgcaaaagatg

SEQ ID NO: 10612 - DNA, 103 bp, Artificial Sequence
  Synthetic Polynucleotide
taatacgactcactataggggggaaaatccctcactccctcaggggcttcaacagaggagagaagccatggagggagtgaacctggcggcagcgcaaaagatg

SEQ ID NO: 10613 - DNA, 103 bp, Artificial Sequence
  Synthetic Polynucleotide
taatacgactcactatagggcaacggggaaaatccctcactccctcagggaacagaggagaccctgaatgagtgagggaaacctggcggcagcgcaaaagatg

SEQ ID NO: 10614 - DNA, 103 bp, Artificial Sequence
  Synthetic Polynucleotide
taatacgactcactatagggagcggcaacggggaaaatccctcactccctaacagaggagaagggagatggggattttcaacctggcggcagcgcaaaagatg

SEQ ID NO: 10615 - DNA, 103 bp, Artificial Sequence
  Synthetic Polynucleotide
taatacgactcactatagggtacatagcggcaacggggaaaatccctcacaacagaggagagtgaggatgtttccccgtaacctggcggcagcgcaaaagatg

SEQ ID NO: 10616 - DNA, 103 bp, Artificial Sequence
  Synthetic Polynucleotide
taatacgactcactatagggttgtgtacatagcggcaacggggaaaatccaacagaggagaggatttatgccgttgccgaacctggcggcagcgcaaaagatg

SEQ ID NO: 10617 - DNA, 103 bp, Artificial Sequence
  Synthetic Polynucleotide
taatacgactcactatagggagactttgtgtacatagcggcaacggggaaaacagaggagattccccatggccgctatgaacctggcggcagcgcaaaagatg

SEQ ID NO: 10618 - DNA, 103 bp, Artificial Sequence
  Synthetic Polynucleotide
taatacgactcactatagggtcctgagactttgtgtacatagcggcaacgaacagaggagacgttgcatgtatgtacacaacctggcggcagcgcaaaagatg

SEQ ID NO: 10619 - DNA, 103 bp, Artificial Sequence
  Synthetic Polynucleotide
taatacgactcactatagggccagttcctgagactttgtgtacatagcggaacagaggagaccgctaatgacacaaagtaacctggcggcagcgcaaaagatg

SEQ ID NO: 10620 - DNA, 103 bp, Artificial Sequence
  Synthetic Polynucleotide
taatacgactcactatagggatggtccagttcctgagactttgtgtacataacagaggagaatgtacatgaagtctcagaacctggcggcagcgcaaaagatg

SEQ ID NO: 10621 - DNA, 103 bp, Artificial Sequence
  Synthetic Polynucleotide
taatacgactcactatagggtgggcatggtccagttcctgagactttgtgaacagaggagacacaaaatgtcaggaactaacctggcggcagcgcaaaagatg

SEQ ID NO: 10622 - DNA, 103 bp, Artificial Sequence
  Synthetic Polynucleotide
taatacgactcactatagggactctcttgaaaatcaacaccagcttcaaaaacagaggagatttgaaatgggtgttgataacctggcggcagcgcaaaagatg

SEQ ID NO: 10623 - DNA, 103 bp, Artificial Sequence
  Synthetic Polynucleotide
taatacgactcactatagggcctcctgggcatggtccagttcctgagactaacagaggagaagtctcatgaactggaccaacctggcggcagcgcaaaagatg

SEQ ID NO: 10624 - DNA, 103 bp, Artificial Sequence
  Synthetic Polynucleotide
taatacgactcactatagggcgagtcctcctgggcatggtccagttcctgaacagaggagacaggaaatggaccatgccaacctggcggcagcgcaaaagatg

SEQ ID NO: 10625 - DNA, 103 bp, Artificial Sequence
  Synthetic Polynucleotide
taatacgactcactatagggaaaggcgagtcctcctgggcatggtccagtaacagaggagaactggaatgtgcccaggaaacctggcggcagcgcaaaagatg

SEQ ID NO: 10626 - DNA, 103 bp, Artificial Sequence
  Synthetic Polynucleotide
taatacgactcactatagggttgtgaaaggcgagtcctcctgggcatggtaacagaggagaaccatgatgaggaggactaacctggcggcagcgcaaaagatg

SEQ ID NO: 10627 - DNA, 103 bp, Artificial Sequence
  Synthetic Polynucleotide
taatacgactcactatagggcttctttgtgaaaggcgagtcctcctgggcaacagaggagagcccagatggactcgcctaacctggcggcagcgcaaaagatg

SEQ ID NO: 10628 - DNA, 103 bp, Artificial Sequence
  Synthetic Polynucleotide
taatacgactcactatagggggctccttctttgtgaaaggcgagtcctccaacagaggagaggaggaatggcctttcacaacctggcggcagcgcaaaagatg

SEQ ID NO: 10629 - DNA, 103 bp, Artificial Sequence
  Synthetic Polynucleotide
taatacgactcactatagggaagaaggctccttctttgtgaaaggcgagtaacagaggagaactcgcatgtcacaaagaaacctggcggcagcgcaaaagatg

SEQ ID NO: 10630 - DNA, 103 bp, Artificial Sequence
  Synthetic Polynucleotide
taatacgactcactatagggacaggaagaaggctccttctttgtgaaaggaacagaggagacctttcatgaagaaggagaacctggcggcagcgcaaaagatg

SEQ ID NO: 10631 - DNA, 103 bp, Artificial Sequence
  Synthetic Polynucleotide
taatacgactcactataggggtcatacaggaagaaggctccttctttgtgaacagaggagacacaaaatgggagccttcaacctggcggcagcgcaaaagatg

SEQ ID NO: 10632 - DNA, 103 bp, Artificial Sequence
  Synthetic Polynucleotide
taatacgactcactatagggagtcggtcatacaggaagaaggctccttctaacagaggagaagaaggatgcttcttcctaacctggcggcagcgcaaaagatg

SEQ ID NO: 10633 - DNA, 103 bp, Artificial Sequence
  Synthetic Polynucleotide
taatacgactcactatagggaagtgtcaatgagaggaaaattattaatctaacagaggagaagattaatgattttcctcaacctggcggcagcgcaaaagatg

SEQ ID NO: 10634 - DNA, 103 bp, Artificial Sequence
  Synthetic Polynucleotide
taatacgactcactatagggtctgcactctcttgaaaatcaacaccagctaacagaggagaagctggatgtgattttcaaacctggcggcagcgcaaaagatg

SEQ ID NO: 10635 - DNA, 103 bp, Artificial Sequence
  Synthetic Polynucleotide
taatacgactcactatagggatgcgagtcggtcatacaggaagaaggctcaacagaggagagagcctatgtcctgtatgaacctggcggcagcgcaaaagatg

SEQ ID NO: 10636 - DNA, 103 bp, Artificial Sequence
  Synthetic Polynucleotide
taatacgactcactatagggtgttgatgcgagtcggtcatacaggaagaaaacagaggagattcttcatgtatgaccgaaacctggcggcagcgcaaaagatg

SEQ ID NO: 10637 - DNA, 103 bp, Artificial Sequence
  Synthetic Polynucleotide
taatacgactcactatagggatgattgttgatgcgagtcggtcatacaggaacagaggagacctgtaatgccgactcgcaacctggcggcagcgcaaaagatg

SEQ ID NO: 10638 - DNA, 103 bp, Artificial Sequence
  Synthetic Polynucleotide
taatacgactcactataggggataaatgattgttgatgcgagtcggtcataacagaggagaatgaccatgtcgcatcaaaacctggcggcagcgcaaaagatg

SEQ ID NO: 10639 - DNA, 103 bp, Artificial Sequence
  Synthetic Polynucleotide
taatacgactcactatagggaccccgataaatgattgttgatgcgagtcgaacagaggagacgactcatgtcaacaatcaacctggcggcagcgcaaaagatg

SEQ ID NO: 10640 - DNA, 103 bp, Artificial Sequence
  Synthetic Polynucleotide
taatacgactcactataggggttgtaccccgataaatgattgttgatgcgaacagaggagacgcatcatgaatcatttaaacctggcggcagcgcaaaagatg

SEQ ID NO: 10641 - DNA, 103 bp, Artificial Sequence
  Synthetic Polynucleotide
taatacgactcactatagggcaaaggttgtaccccgataaatgattgttgaacagaggagacaacaaatgtttatcgggaacctggcggcagcgcaaaagatg

SEQ ID NO: 10642 - DNA, 103 bp, Artificial Sequence
  Synthetic Polynucleotide
taatacgactcactatagggttcggcaaaggttgtaccccgataaatgataacagaggagaatcattatgcggggtacaaacctggcggcagcgcaaaagatg

SEQ ID NO: 10643 - DNA, 103 bp, Artificial Sequence
  Synthetic Polynucleotide
taatacgactcactatagggactccttcggcaaaggttgtaccccgataaaacagaggagattatcgatgtacaaccttaacctggcggcagcgcaaaagatg

SEQ ID NO: 10644 - DNA, 103 bp, Artificial Sequence
  Synthetic Polynucleotide
taatacgactcactatagggcaataactccttcggcaaaggttgtaccccaacagaggagaggggtaatgcctttgccgaacctggcggcagcgcaaaagatg

SEQ ID NO: 10645 - DNA, 103 bp, Artificial Sequence
  Synthetic Polynucleotide
taatacgactcactatagggaactgtctgcactctcttgaaaatcaacacaacagaggagagtgttgatgttcaagagaaacctggcggcagcgcaaaagatg

SEQ ID NO: 10646 - DNA, 103 bp, Artificial Sequence
  Synthetic Polynucleotide
taatacgactcactatagggaaatgcaataactccttcggcaaaggttgtaacagaggagaacaaccatggccgaaggaaacctggcggcagcgcaaaagatg

SEQ ID NO: 10647 - DNA, 103 bp, Artificial Sequence
  Synthetic Polynucleotide
taatacgactcactatagggatcagaaatgcaataactccttcggcaaagaacagaggagactttgcatgaggagttataacctggcggcagcgcaaaagatg

SEQ ID NO: 10648 - DNA, 103 bp, Artificial Sequence
  Synthetic Polynucleotide
taatacgactcactataggggcaagatcagaaatgcaataactccttcggaacagaggagaccgaagatgttattgcataacctggcggcagcgcaaaagatg

SEQ ID NO: 10649 - DNA, 103 bp, Artificial Sequence
  Synthetic Polynucleotide
taatacgactcactatagggcttaggcaagatcagaaatgcaataactccaacagaggagaggagttatggcatttctgaacctggcggcagcgcaaaagatg

SEQ ID NO: 10650 - DNA, 103 bp, Artificial Sequence
  Synthetic Polynucleotide
taatacgactcactatagggcgcgccttaggcaagatcagaaatgcaataaacagaggagatattgcatgtctgatcttaacctggcggcagcgcaaaagatg

SEQ ID NO: 10651 - DNA, 103 bp, Artificial Sequence
  Synthetic Polynucleotide
taatacgactcactatagggcctttcgcgccttaggcaagatcagaaatgaacagaggagacatttcatgtcttgcctaaacctggcggcagcgcaaaagatg

SEQ ID NO: 10652 - DNA, 103 bp, Artificial Sequence
  Synthetic Polynucleotide
taatacgactcactatagggaaaatcctttcgcgccttaggcaagatcagaacagaggagactgatcatgcctaaggcgaacctggcggcagcgcaaaagatg

SEQ ID NO: 10653 - DNA, 103 bp, Artificial Sequence
  Synthetic Polynucleotide
taatacgactcactatagggtggaaaaaatcctttcgcgccttaggcaagaacagaggagacttgccatgggcgcgaaaaacctggcggcagcgcaaaagatg

SEQ ID NO: 10654 - DNA, 103 bp, Artificial Sequence
  Synthetic Polynucleotide
taatacgactcactataggggagactggaaaaaatcctttcgcgccttagaacagaggagactaaggatggaaaggattaacctggcggcagcgcaaaagatg

SEQ ID NO: 10655 - DNA, 103 bp, Artificial Sequence
  Synthetic Polynucleotide
taatacgactcactatagggtggaggagactggaaaaaatcctttcgcgcaacagaggagagcgcgaatggattttttcaacctggcggcagcgcaaaagatg

SEQ ID NO: 10656 - DNA, 103 bp, Artificial Sequence
  Synthetic Polynucleotide
taatacgactcactatagggcaagaaactgtctgcactctcttgaaaatcaacagaggagagattttatggagagtgcaaacctggcggcagcgcaaaagatg

SEQ ID NO: 10657 - DNA, 103 bp, Artificial Sequence
  Synthetic Polynucleotide
taatacgactcactatagggtgcaatggaggagactggaaaaaatcctttaacagaggagaaaaggaatgtttccagtcaacctggcggcagcgcaaaagatg

SEQ ID NO: 10658 - DNA, 103 bp, Artificial Sequence
  Synthetic Polynucleotide
taatacgactcactataggggctcatgcaatggaggagactggaaaaaataacagaggagaatttttatgagtctcctcaacctggcggcagcgcaaaagatg

SEQ ID NO: 10659 - DNA, 103 bp, Artificial Sequence
  Synthetic Polynucleotide
taatacgactcactatagggggcaggctcatgcaatggaggagactggaaaacagaggagattccagatgcctccattgaacctggcggcagcgcaaaagatg

SEQ ID NO: 10660 - DNA, 103 bp, Artificial Sequence
  Synthetic Polynucleotide
taatacgactcactatagggatgttggcaggctcatgcaatggaggagacaacagaggagagtctccatgattgcatgaaacctggcggcagcgcaaaagatg

SEQ ID NO: 10661 - DNA, 103 bp, Artificial Sequence
  Synthetic Polynucleotide
taatacgactcactatagggtggtcatgttggcaggctcatgcaatggagaacagaggagactccatatgatgagcctgaacctggcggcagcgcaaaagatg

SEQ ID NO: 10662 - DNA, 103 bp, Artificial Sequence
  Synthetic Polynucleotide
taatacgactcactatagggatccgtggtcatgttggcaggctcatgcaaaacagaggagattgcatatgcctgccaacaacctggcggcagcgcaaaagatg

SEQ ID NO: 10663 - DNA, 103 bp, Artificial Sequence
  Synthetic Polynucleotide
taatacgactcactataggggagggatccgtggtcatgttggcaggctcaaacagaggagatgagccatgcaacatgacaacctggcggcagcgcaaaagatg

SEQ ID NO: 10664 - DNA, 103 bp, Artificial Sequence
  Synthetic Polynucleotide
taatacgactcactatagggaactggagggatccgtggtcatgttggcagaacagaggagactgccaatgtgaccacggaacctggcggcagcgcaaaagatg

SEQ ID NO: 10665 - DNA, 103 bp, Artificial Sequence
  Synthetic Polynucleotide
taatacgactcactatagggatagtaactggagggatccgtggtcatgttaacagaggagaaacatgatgacggatcccaacctggcggcagcgcaaaagatg

SEQ ID NO: 10666 - DNA, 103 bp, Artificial Sequence
  Synthetic Polynucleotide
taatacgactcactataggggtgtgatagtaactggagggatccgtggtcaacagaggagagaccacatgtccctccagaacctggcggcagcgcaaaagatg

SEQ ID NO: 10667 - DNA, 103 bp, Artificial Sequence
  Synthetic Polynucleotide
taatacgactcactatagggatcagcaagaaactgtctgcactctcttgaaacagaggagatcaagaatgtgcagacagaacctggcggcagcgcaaaagatg

SEQ ID NO: 10668 - DNA, 103 bp, Artificial Sequence
  Synthetic Polynucleotide
taatacgactcactatagggttgtcgtgtgatagtaactggagggatccgaacagaggagacggatcatgccagttactaacctggcggcagcgcaaaagatg

SEQ ID NO: 10669 - DNA, 103 bp, Artificial Sequence
  Synthetic Polynucleotide
taatacgactcactatagggtattgttgtcgtgtgatagtaactggagggaacagaggagaccctccatgtactatcacaacctggcggcagcgcaaaagatg

SEQ ID NO: 10670 - DNA, 103 bp, Artificial Sequence
  Synthetic Polynucleotide
taatacgactcactatagggtagtttattgttgtcgtgtgatagtaactgaacagaggagacagttaatgtcacacgacaacctggcggcagcgcaaaagatg

SEQ ID NO: 10671 - DNA, 103 bp, Artificial Sequence
  Synthetic Polynucleotide
taatacgactcactatagggccacgtagtttattgttgtcgtgtgatagtaacagaggagaactatcatgcgacaacaaaacctggcggcagcgcaaaagatg

SEQ ID NO: 10672 - DNA, 103 bp, Artificial Sequence
  Synthetic Polynucleotide
taatacgactcactatagggatcaaccacgtagtttattgttgtcgtgtgaacagaggagacacacgatgacaataaacaacctggcggcagcgcaaaagatg

SEQ ID NO: 10673 - DNA, 103 bp, Artificial Sequence
  Synthetic Polynucleotide
taatacgactcactatagggaaattatcaaccacgtagtttattgttgtcaacagaggagagacaacatgaaactacgtaacctggcggcagcgcaaaagatg

SEQ ID NO: 10674 - DNA, 103 bp, Artificial Sequence
  Synthetic Polynucleotide
taatacgactcactatagggttccaaaattatcaaccacgtagtttattgaacagaggagacaataaatgacgtggttgaacctggcggcagcgcaaaagatg

SEQ ID NO: 10675 - DNA, 103 bp, Artificial Sequence
  Synthetic Polynucleotide
taatacgactcactataggggttggttccaaaattatcaaccacgtagttaacagaggagaaactacatggttgataataacctggcggcagcgcaaaagatg

SEQ ID NO: 10676 - DNA, 103 bp, Artificial Sequence
  Synthetic Polynucleotide
taatacgactcactataggggtggtgttggttccaaaattatcaaccacgaacagaggagacgtggtatgtaattttggaacctggcggcagcgcaaaagatg

SEQ ID NO: 10677 - DNA, 103 bp, Artificial Sequence
  Synthetic Polynucleotide
taatacgactcactatagggactctgtggtgttggttccaaaattatcaaaacagaggagattgataatgttggaaccaaacctggcggcagcgcaaaagatg

SEQ ID NO: 10678 - DNA, 103 bp, Artificial Sequence
  Synthetic Polynucleotide
taatacgactcactatagggatagcatcagcaagaaactgtctgcactctaacagaggagaagagtgatgacagtttctaacctggcggcagcgcaaaagatg

SEQ ID NO: 10679 - DNA, 103 bp, Artificial Sequence
  Synthetic Polynucleotide
taatacgactcactatagggcagaaactctgtggtgttggttccaaaattaacagaggagaaattttatgaccaacaccaacctggcggcagcgcaaaagatg

SEQ ID NO: 10680 - DNA, 103 bp, Artificial Sequence
  Synthetic Polynucleotide
taatacgactcactatagggtggaacagaaactctgtggtgttggttccaaacagaggagatggaacatgcaccacagaaacctggcggcagcgcaaaagatg

SEQ ID NO: 10681 - DNA, 103 bp, Artificial Sequence
  Synthetic Polynucleotide
taatacgactcactatagggcgacttggaacagaaactctgtggtgttggaacagaggagaccaacaatgcagagtttcaacctggcggcagcgcaaaagatg

SEQ ID NO: 10682 - DNA, 103 bp, Artificial Sequence
  Synthetic Polynucleotide
taatacgactcactatagggatgatcgacttggaacagaaactctgtggtaacagaggagaaccacaatgtttctgttcaacctggcggcagcgcaaaagatg

SEQ ID NO: 10683 - DNA, 103 bp, Artificial Sequence
  Synthetic Polynucleotide
taatacgactcactataggggtcaaatgatcgacttggaacagaaactctaacagaggagaagagttatggttccaagtaacctggcggcagcgcaaaagatg

SEQ ID NO: 10684 - DNA, 103 bp, Artificial Sequence
  Synthetic Polynucleotide
taatacgactcactatagggcatacgtcaaatgatcgacttggaacagaaaacagaggagattctgtatgaagtcgatcaacctggcggcagcgcaaaagatg

SEQ ID NO: 10685 - DNA, 103 bp, Artificial Sequence
  Synthetic Polynucleotide
taatacgactcactatagggctgcacatacgtcaaatgatcgacttggaaaacagaggagattccaaatggatcatttgaacctggcggcagcgcaaaagatg

SEQ ID NO: 10686 - DNA, 103 bp, Artificial Sequence
  Synthetic Polynucleotide
taatacgactcactatagggtcgagctgcacatacgtcaaatgatcgactaacagaggagaagtcgaatgtttgacgtaaacctggcggcagcgcaaaagatg

SEQ ID NO: 10687 - DNA, 103 bp, Artificial Sequence
  Synthetic Polynucleotide
taatacgactcactatagggttgcctcgagctgcacatacgtcaaatgataacagaggagaatcattatgcgtatgtgcaacctggcggcagcgcaaaagatg

SEQ ID NO: 10688 - DNA, 103 bp, Artificial Sequence
  Synthetic Polynucleotide
taatacgactcactataggggaatcttgcctcgagctgcacatacgtcaaaacagaggagattgacgatggtgcagctcaacctggcggcagcgcaaaagatg

SEQ ID NO: 10689 - DNA, 103 bp, Artificial Sequence
  Synthetic Polynucleotide
taatacgactcactatagggtaaacatagcatcagcaagaaactgtctgcaacagaggagagcagacatgttcttgctgaacctggcggcagcgcaaaagatg

SEQ ID NO: 10690 - DNA, 103 bp, Artificial Sequence
  Synthetic Polynucleotide
taatacgactcactatagggggtgtgaatcttgcctcgagctgcacatacaacagaggagagtatgtatggctcgaggcaacctggcggcagcgcaaaagatg

SEQ ID NO: 10691 - DNA, 103 bp, Artificial Sequence
  Synthetic Polynucleotide
taatacgactcactatagggattgtggtgtgaatcttgcctcgagctgcaaacagaggagatgcagcatgaggcaagataacctggcggcagcgcaaaagatg

SEQ ID NO: 10692 - DNA, 103 bp, Artificial Sequence
  Synthetic Polynucleotide
taatacgactcactatagggaaggaattgtggtgtgaatcttgcctcgagaacagaggagactcgagatgagattcacaaacctggcggcagcgcaaaagatg

SEQ ID NO: 10693 - DNA, 103 bp, Artificial Sequence
  Synthetic Polynucleotide
taatacgactcactatagggaggacaaggaattgtggtgtgaatcttgccaacagaggagaggcaagatgcacaccacaaacctggcggcagcgcaaaagatg

SEQ ID NO: 10694 - DNA, 103 bp, Artificial Sequence
  Synthetic Polynucleotide
taatacgactcactatagggttaggaggacaaggaattgtggtgtgaatcaacagaggagagattcaatgcacaattccaacctggcggcagcgcaaaagatg

SEQ ID NO: 10695 - DNA, 103 bp, Artificial Sequence
  Synthetic Polynucleotide
taatacgactcactatagggttcatttaggaggacaaggaattgtggtgtaacagaggagaacaccaatgttccttgtcaacctggcggcagcgcaaaagatg

SEQ ID NO: 10696 - DNA, 103 bp, Artificial Sequence
  Synthetic Polynucleotide
taatacgactcactatagggatggtttcatttaggaggacaaggaattgtaacagaggagaacaattatgtgtcctcctaacctggcggcagcgcaaaagatg

SEQ ID NO: 10697 - DNA, 103 bp, Artificial Sequence
  Synthetic Polynucleotide
taatacgactcactatagggagtagatggtttcatttaggaggacaaggaaacagaggagatccttgatgtcctaaatgaacctggcggcagcgcaaaagatg

SEQ ID NO: 10698 - DNA, 103 bp, Artificial Sequence
  Synthetic Polynucleotide
taatacgactcactatagggatcagagtagatggtttcatttaggaggacaacagaggagagtcctcatgaatgaaaccaacctggcggcagcgcaaaagatg

SEQ ID NO: 10699 - DNA, 103 bp, Artificial Sequence
  Synthetic Polynucleotide
taatacgactcactatagggcggttatcagagtagatggtttcatttaggaacagaggagacctaaaatgaaccatctaaacctggcggcagcgcaaaagatg

SEQ ID NO: 10700 - DNA, 103 bp, Artificial Sequence
  Synthetic Polynucleotide
taatacgactcactatagggtgatgtaaacatagcatcagcaagaaactgaacagaggagacagtttatggctgatgctaacctggcggcagcgcaaaagatg

SEQ ID NO: 10701 - DNA, 103 bp, Artificial Sequence
  Synthetic Polynucleotide
taatacgactcactatagggttctgcggttatcagagtagatggtttcataacagaggagaatgaaaatgtctactctgaacctggcggcagcgcaaaagatg

SEQ ID NO: 10702 - DNA, 103 bp, Artificial Sequence
  Synthetic Polynucleotide
taatacgactcactataggggttacttctgcggttatcagagtagatggtaacagaggagaaccatcatgtctgataacaacctggcggcagcgcaaaagatg

SEQ ID NO: 10703 - DNA, 103 bp, Artificial Sequence
  Synthetic Polynucleotide
taatacgactcactataggggttgtgttacttctgcggttatcagagtagaacagaggagactactcatgtaaccgcagaacctggcggcagcgcaaaagatg

SEQ ID NO: 10704 - DNA, 103 bp, Artificial Sequence
  Synthetic Polynucleotide
taatacgactcactatagggttcctgttgtgttacttctgcggttatcagaacagaggagactgataatggcagaagtaaacctggcggcagcgcaaaagatg

SEQ ID NO: 10705 - DNA, 103 bp, Artificial Sequence
  Synthetic Polynucleotide
taatacgactcactatagggtagttttcctgttgtgttacttctgcggttaacagaggagaaaccgcatgagtaacacaaacctggcggcagcgcaaaagatg

SEQ ID NO: 10706 - DNA, 103 bp, Artificial Sequence
  Synthetic Polynucleotide
taatacgactcactatagggcagattagttttcctgttgtgttacttctgaacagaggagacagaagatgcacaacaggaacctggcggcagcgcaaaagatg

SEQ ID NO: 10707 - DNA, 103 bp, Artificial Sequence
  Synthetic Polynucleotide
taatacgactcactatagggttttccagattagttttcctgttgtgttacaacagaggagagtaacaatgcaggaaaacaacctggcggcagcgcaaaagatg

SEQ ID NO: 10708 - DNA, 103 bp, Artificial Sequence
  Synthetic Polynucleotide
taatacgactcactatagggatttattttccagattagttttcctgttgtaacagaggagaacaacaatgaaactaatcaacctggcggcagcgcaaaagatg

SEQ ID NO: 10709 - DNA, 103 bp, Artificial Sequence
  Synthetic Polynucleotide
taatacgactcactataggggtgggatttattttccagattagttttcctaacagaggagaaggaaaatgaatctggaaaacctggcggcagcgcaaaagatg

SEQ ID NO: 10710 - DNA, 103 bp, Artificial Sequence
  Synthetic Polynucleotide
taatacgactcactatagggcaacagtgggatttattttccagattagttaacagaggagaaactaaatgggaaaataaaacctggcggcagcgcaaaagatg

SEQ ID NO: 10711 - DNA, 103 bp, Artificial Sequence
  Synthetic Polynucleotide
taatacgactcactatagggaagcatgatgtaaacatagcatcagcaagaaacagaggagatcttgcatgtgctatgttaacctggcggcagcgcaaaagatg

SEQ ID NO: 10712 - DNA, 103 bp, Artificial Sequence
  Synthetic Polynucleotide
taatacgactcactatagggggtatcaacagtgggatttattttccagataacagaggagaatctggatgataaatcccaacctggcggcagcgcaaaagatg

SEQ ID NO: 10713 - DNA, 103 bp, Artificial Sequence
  Synthetic Polynucleotide
taatacgactcactatagggatgctggtatcaacagtgggatttattttcaacagaggagagaaaatatgtcccactgtaacctggcggcagcgcaaaagatg

SEQ ID NO: 10714 - DNA, 103 bp, Artificial Sequence
  Synthetic Polynucleotide
taatacgactcactatagggcacccatgctggtatcaacagtgggatttaaacagaggagataaatcatgctgttgataaacctggcggcagcgcaaaagatg

SEQ ID NO: 10715 - DNA, 103 bp, Artificial Sequence
  Synthetic Polynucleotide
taatacgactcactatagggccactcacccatgctggtatcaacagtgggaacagaggagacccactatggataccagcaacctggcggcagcgcaaaagatg

SEQ ID NO: 10716 - DNA, 103 bp, Artificial Sequence
  Synthetic Polynucleotide
taatacgactcactatagggaaagcccactcacccatgctggtatcaacaaacagaggagatgttgaatgcagcatgggaacctggcggcagcgcaaaagatg

SEQ ID NO: 10717 - DNA, 103 bp, Artificial Sequence
  Synthetic Polynucleotide
taatacgactcactatagggcccagaaagcccactcacccatgctggtataacagaggagaataccaatgtgggtgagtaacctggcggcagcgcaaaagatg

SEQ ID NO: 10718 - DNA, 103 bp, Artificial Sequence
  Synthetic Polynucleotide
taatacgactcactatagggattttcccagaaagcccactcacccatgctaacagaggagaagcatgatggagtgggctaacctggcggcagcgcaaaagatg

SEQ ID NO: 10719 - DNA, 103 bp, Artificial Sequence
  Synthetic Polynucleotide
taatacgactcactatagggtttttattttcccagaaagcccactcacccaacagaggagagggtgaatgggctttctgaacctggcggcagcgcaaaagatg

SEQ ID NO: 10720 - DNA, 103 bp, Artificial Sequence
  Synthetic Polynucleotide
taatacgactcactatagggaagtttttttattttcccagaaagcccactaacagaggagaagtgggatgtctgggaaaaacctggcggcagcgcaaaagatg

SEQ ID NO: 10721 - DNA, 103 bp, Artificial Sequence
  Synthetic Polynucleotide
taatacgactcactatagggttgtgaagtttttttattttcccagaaagcaacagaggagagctttcatggaaaataaaaacctggcggcagcgcaaaagatg

SEQ ID NO: 10722 - DNA, 103 bp, Artificial Sequence
  Synthetic Polynucleotide
taatacgactcactatagggctgataagcatgatgtaaacatagcatcagaacagaggagactgatgatgtgtttacataacctggcggcagcgcaaaagatg

SEQ ID NO: 10723 - DNA, 103 bp, Artificial Sequence
  Synthetic Polynucleotide
taatacgactcactatagggggtttttgtgaagtttttttattttcccagaacagaggagactgggaatgtaaaaaaacaacctggcggcagcgcaaaagatg

SEQ ID NO: 10724 - DNA, 103 bp, Artificial Sequence
  Synthetic Polynucleotide
taatacgactcactataggggaaagggtttttgtgaagtttttttattttaacagaggagaaaaataatgaaacttcacaacctggcggcagcgcaaaagatg

SEQ ID NO: 10725 - DNA, 103 bp, Artificial Sequence
  Synthetic Polynucleotide
taatacgactcactatagggcacttgaaagggtttttgtgaagtttttttaacagaggagaaaaaaaatgtcacaaaaaaacctggcggcagcgcaaaagatg

SEQ ID NO: 10726 - DNA, 103 bp, Artificial Sequence
  Synthetic Polynucleotide
taatacgactcactatagggctcttcacttgaaagggtttttgtgaagttaacagaggagaaacttcatgaaaacccttaacctggcggcagcgcaaaagatg

SEQ ID NO: 10727 - DNA, 103 bp, Artificial Sequence
  Synthetic Polynucleotide
taatacgactcactataggggacaactcttcacttgaaagggtttttgtgaacagaggagacacaaaatgcctttcaagaacctggcggcagcgcaaaagatg

SEQ ID NO: 10728 - DNA, 103 bp, Artificial Sequence
  Synthetic Polynucleotide
taatacgactcactatagggcgaaagacaactcttcacttgaaagggtttaacagaggagaaaacccatgcaagtgaagaacctggcggcagcgcaaaagatg

SEQ ID NO: 10729 - DNA, 103 bp, Artificial Sequence
  Synthetic Polynucleotide
taatacgactcactatagggaggtacgaaagacaactcttcacttgaaagaacagaggagactttcaatggaagagttgaacctggcggcagcgcaaaagatg

SEQ ID NO: 10730 - DNA, 103 bp, Artificial Sequence
  Synthetic Polynucleotide
taatacgactcactatagggggtacaggtacgaaagacaactcttcacttaacagaggagaaagtgaatggttgtctttaacctggcggcagcgcaaaagatg

SEQ ID NO: 10731 - DNA, 103 bp, Artificial Sequence
  Synthetic Polynucleotide
taatacgactcactatagggtttctggtacaggtacgaaagacaactcttaacagaggagaaagagtatgctttcgtacaacctggcggcagcgcaaaagatg

SEQ ID NO: 10732 - DNA, 103 bp, Artificial Sequence
  Synthetic Polynucleotide
taatacgactcactatagggctgggtttctggtacaggtacgaaagacaaaacagaggagattgtctatggtacctgtaaacctggcggcagcgcaaaagatg

SEQ ID NO: 10733 - DNA, 103 bp, Artificial Sequence
  Synthetic Polynucleotide
taatacgactcactatagggtcaccctgataagcatgatgtaaacatagcaacagaggagagctatgatgacatcatgcaacctggcggcagcgcaaaagatg

SEQ ID NO: 10734 - DNA, 103 bp, Artificial Sequence
  Synthetic Polynucleotide
taatacgactcactatagggtggttctgggtttctggtacaggtacgaaaaacagaggagatttcgtatgtgtaccagaaacctggcggcagcgcaaaagatg

SEQ ID NO: 10735 - DNA, 103 bp, Artificial Sequence
  Synthetic Polynucleotide
taatacgactcactatagggggacctggttctgggtttctggtacaggtaaacagaggagatacctgatgcagaaacccaacctggcggcagcgcaaaagatg

SEQ ID NO: 10736 - DNA, 103 bp, Artificial Sequence
  Synthetic Polynucleotide
taatacgactcactataggggtcaaggacctggttctgggtttctggtacaacagaggagagtaccaatgacccagaacaacctggcggcagcgcaaaagatg

SEQ ID NO: 10737 - DNA, 103 bp, Artificial Sequence
  Synthetic Polynucleotide
taatacgactcactataggggtcgtgtcaaggacctggttctgggtttctaacagaggagaagaaacatggaaccaggtaacctggcggcagcgcaaaagatg

SEQ ID NO: 10738 - DNA, 103 bp, Artificial Sequence
  Synthetic Polynucleotide
taatacgactcactatagggtcgctgtcgtgtcaaggacctggttctgggaacagaggagacccagaatgaggtccttgaacctggcggcagcgcaaaagatg

SEQ ID NO: 10739 - DNA, 103 bp, Artificial Sequence
  Synthetic Polynucleotide
taatacgactcactataggggaccgtcgctgtcgtgtcaaggacctggttaacagaggagaaaccagatgcttgacacgaacctggcggcagcgcaaaagatg

SEQ ID NO: 10740 - DNA, 103 bp, Artificial Sequence
  Synthetic Polynucleotide
taatacgactcactatagggggagagaccgtcgctgtcgtgtcaaggaccaacagaggagaggtcctatgcacgacagcaacctggcggcagcgcaaaagatg

SEQ ID NO: 10741 - DNA, 103 bp, Artificial Sequence
  Synthetic Polynucleotide
taatacgactcactatagggtgggaggagagaccgtcgctgtcgtgtcaaaacagaggagattgacaatgcagcgacggaacctggcggcagcgcaaaagatg

SEQ ID NO: 10742 - DNA, 103 bp, Artificial Sequence
  Synthetic Polynucleotide
taatacgactcactatagggggagatgggaggagagaccgtcgctgtcgtaacagaggagaacgacaatgacggtctctaacctggcggcagcgcaaaagatg

SEQ ID NO: 10743 - DNA, 103 bp, Artificial Sequence
  Synthetic Polynucleotide
taatacgactcactatagggtgggcggagatgggaggagagaccgtcgctaacagaggagaagcgacatgctctcctccaacctggcggcagcgcaaaagatg

SEQ ID NO: 10744 - DNA, 103 bp, Artificial Sequence
  Synthetic Polynucleotide
taatacgactcactatagggaatgtaagtgtcaatgagaggaaaattattaacagaggagaaataatatgcctctcattaacctggcggcagcgcaaaagatg

SEQ ID NO: 10745 - DNA, 103 bp, Artificial Sequence
  Synthetic Polynucleotide
taatacgactcactatagggtgtagtcaccctgataagcatgatgtaaacaacagaggagagtttacatgatgcttatcaacctggcggcagcgcaaaagatg

SEQ ID NO: 10746 - DNA, 103 bp, Artificial Sequence
  Synthetic Polynucleotide
taatacgactcactatagggggttgtgggcggagatgggaggagagaccgaacagaggagacggtctatgctcccatctaacctggcggcagcgcaaaagatg

SEQ ID NO: 10747 - DNA, 103 bp, Artificial Sequence
  Synthetic Polynucleotide
taatacgactcactatagggtgcgtggttgtgggcggagatgggaggagaaacagaggagatctcctatgatctccgccaacctggcggcagcgcaaaagatg

SEQ ID NO: 10748 - DNA, 103 bp, Artificial Sequence
  Synthetic Polynucleotide
taatacgactcactatagggtcggctgcgtggttgtgggcggagatgggaaacagaggagatcccatatgcgcccacaaaacctggcggcagcgcaaaagatg

SEQ ID NO: 10749 - DNA, 103 bp, Artificial Sequence
  Synthetic Polynucleotide
taatacgactcactatagggggtcttcggctgcgtggttgtgggcggagaaacagaggagatctccgatgacaaccacgaacctggcggcagcgcaaaagatg

SEQ ID NO: 10750 - DNA, 103 bp, Artificial Sequence
  Synthetic Polynucleotide
taatacgactcactatagggtttgtggtcttcggctgcgtggttgtgggcaacagaggagagcccacatgcacgcagccaacctggcggcagcgcaaaagatg

SEQ ID NO: 10751 - DNA, 103 bp, Artificial Sequence
  Synthetic Polynucleotide
taatacgactcactatagggaattctttgtggtcttcggctgcgtggttgaacagaggagacaaccaatgagccgaagaaacctggcggcagcgcaaaagatg

SEQ ID NO: 10752 - DNA, 103 bp, Artificial Sequence
  Synthetic Polynucleotide
taatacgactcactatagggaaaccaattctttgtggtcttcggctgcgtaacagaggagaacgcagatgaagaccacaaacctggcggcagcgcaaaagatg

SEQ ID NO: 10753 - DNA, 103 bp, Artificial Sequence
  Synthetic Polynucleotide
taatacgactcactatagggctctgaaaccaattctttgtggtcttcggcaacagaggagagccgaaatgcacaaagaaaacctggcggcagcgcaaaagatg

SEQ ID NO: 10754 - DNA, 103 bp, Artificial Sequence
  Synthetic Polynucleotide
taatacgactcactataggggaatcctctgaaaccaattctttgtggtctaacagaggagaagaccaatgagaattggtaacctggcggcagcgcaaaagatg

SEQ ID NO: 10755 - DNA, 103 bp, Artificial Sequence
  Synthetic Polynucleotide
taatacgactcactataggggagtggaatcctctgaaaccaattctttgtaacagaggagaacaaagatgtggtttcagaacctggcggcagcgcaaaagatg

SEQ ID NO: 10756 - DNA, 103 bp, Artificial Sequence
  Synthetic Polynucleotide
taatacgactcactatagggttgcttgtagtcaccctgataagcatgatgaacagaggagacatcatatgtatcagggtaacctggcggcagcgcaaaagatg

SEQ ID NO: 10757 - DNA, 103 bp, Artificial Sequence
  Synthetic Polynucleotide
taatacgactcactatagggcactggagtggaatcctctgaaaccaattcaacagaggagagaattgatgtcagaggataacctggcggcagcgcaaaagatg

SEQ ID NO: 10758 - DNA, 103 bp, Artificial Sequence
  Synthetic Polynucleotide
taatacgactcactatagggtgaaccactggagtggaatcctctgaaaccaacagaggagaggtttcatgggattccacaacctggcggcagcgcaaaagatg

SEQ ID NO: 10759 - DNA, 103 bp, Artificial Sequence
  Synthetic Polynucleotide
taatacgactcactataggggcatctgaaccactggagtggaatcctctgaacagaggagacagaggatgccactccagaacctggcggcagcgcaaaagatg

SEQ ID NO: 10760 - DNA, 103 bp, Artificial Sequence
  Synthetic Polynucleotide
taatacgactcactataggggttttgcatctgaaccactggagtggaatcaacagaggagagattccatgccagtggttaacctggcggcagcgcaaaagatg

SEQ ID NO: 10761 - DNA, 103 bp, Artificial Sequence
  Synthetic Polynucleotide
taatacgactcactatagggttgatgttttgcatctgaaccactggagtgaacagaggagacactccatgggttcagataacctggcggcagcgcaaaagatg

SEQ ID NO: 10762 - DNA, 103 bp, Artificial Sequence
  Synthetic Polynucleotide
taatacgactcactatagggttcccttgatgttttgcatctgaaccactgaacagaggagacagtggatgagatgcaaaaacctggcggcagcgcaaaagatg

SEQ ID NO: 10763 - DNA, 103 bp, Artificial Sequence
  Synthetic Polynucleotide
taatacgactcactataggggtcctttcccttgatgttttgcatctgaacaacagaggagagttcagatgcaaaacatcaacctggcggcagcgcaaaagatg

SEQ ID NO: 10764 - DNA, 103 bp, Artificial Sequence
  Synthetic Polynucleotide
taatacgactcactatagggattgtgtcctttcccttgatgttttgcatcaacagaggagagatgcaatgcatcaagggaacctggcggcagcgcaaaagatg

SEQ ID NO: 10765 - DNA, 103 bp, Artificial Sequence
  Synthetic Polynucleotide
taatacgactcactatagggttggcattgtgtcctttcccttgatgttttaacagaggagaaaaacaatgagggaaaggaacctggcggcagcgcaaaagatg

SEQ ID NO: 10766 - DNA, 103 bp, Artificial Sequence
  Synthetic Polynucleotide
taatacgactcactatagggtgtggttggcattgtgtcctttcccttgataacagaggagaatcaagatgaaggacacaaacctggcggcagcgcaaaagatg

SEQ ID NO: 10767 - DNA, 103 bp, Artificial Sequence
  Synthetic Polynucleotide
taatacgactcactatagggaagaattgcttgtagtcaccctgataagcaaacagaggagatgcttaatggggtgactaaacctggcggcagcgcaaaagatg

SEQ ID NO: 10768 - DNA, 103 bp, Artificial Sequence
  Synthetic Polynucleotide
taatacgactcactataggggtcactgtggttggcattgtgtcctttcccaacagaggagagggaaaatgcacaatgccaacctggcggcagcgcaaaagatg

SEQ ID NO: 10769 - DNA, 103 bp, Artificial Sequence
  Synthetic Polynucleotide
taatacgactcactatagggcacccgtcactgtggttggcattgtgtcctaacagaggagaaggacaatgtgccaaccaaacctggcggcagcgcaaaagatg

SEQ ID NO: 10770 - DNA, 103 bp, Artificial Sequence
  Synthetic Polynucleotide
taatacgactcactatagggtggtacacccgtcactgtggttggcattgtaacagaggagaacaatgatgaccacagtgaacctggcggcagcgcaaaagatg

SEQ ID NO: 10771 - DNA, 103 bp, Artificial Sequence
  Synthetic Polynucleotide
taatacgactcactataggggttgttggtacacccgtcactgtggttggcaacagaggagagccaacatgagtgacgggaacctggcggcagcgcaaaagatg

SEQ ID NO: 10772 - DNA, 103 bp, Artificial Sequence
  Synthetic Polynucleotide
taatacgactcactataggggtgtggttgttggtacacccgtcactgtggaacagaggagaccacagatgcgggtgtacaacctggcggcagcgcaaaagatg

SEQ ID NO: 10773 - DNA, 103 bp, Artificial Sequence
  Synthetic Polynucleotide
taatacgactcactatagggagagggtgtggttgttggtacacccgtcacaacagaggagagtgacgatggtaccaacaaacctggcggcagcgcaaaagatg

SEQ ID NO: 10774 - DNA, 103 bp, Artificial Sequence
  Synthetic Polynucleotide
taatacgactcactatagggaatggagagggtgtggttgttggtacacccaacagaggagagggtgtatgaacaaccacaacctggcggcagcgcaaaagatg

SEQ ID NO: 10775 - DNA, 103 bp, Artificial Sequence
  Synthetic Polynucleotide
taatacgactcactatagggttggaaatggagagggtgtggttgttggtaaacagaggagataccaaatgccacaccctaacctggcggcagcgcaaaagatg

SEQ ID NO: 10776 - DNA, 103 bp, Artificial Sequence
  Synthetic Polynucleotide
taatacgactcactatagggattgattggaaatggagagggtgtggttgtaacagaggagaacaaccatgccctctccaaacctggcggcagcgcaaaagatg

SEQ ID NO: 10777 - DNA, 103 bp, Artificial Sequence
  Synthetic Polynucleotide
taatacgactcactatagggcgagcattgattggaaatggagagggtgtgaacagaggagacacaccatgtccatttccaacctggcggcagcgcaaaagatg

SEQ ID NO: 10778 - DNA, 103 bp, Artificial Sequence
  Synthetic Polynucleotide
taatacgactcactatagggtttccaagaattgcttgtagtcaccctgataacagaggagaatcaggatgactacaagcaacctggcggcagcgcaaaagatg

SEQ ID NO: 10779 - DNA, 103 bp, Artificial Sequence
  Synthetic Polynucleotide
taatacgactcactatagggtgttgcgagcattgattggaaatggagaggaacagaggagacctctcatgttccaatcaaacctggcggcagcgcaaaagatg

SEQ ID NO: 10780 - DNA, 103 bp, Artificial Sequence
  Synthetic Polynucleotide
taatacgactcactatagggatcagtgttgcgagcattgattggaaatggaacagaggagaccatttatgatcaatgctaacctggcggcagcgcaaaagatg

SEQ ID NO: 10781 - DNA, 103 bp, Artificial Sequence
  Synthetic Polynucleotide
taatacgactcactataggggtatgatcagtgttgcgagcattgattggaaacagaggagatccaatatgtgctcgcaaaacctggcggcagcgcaaaagatg

SEQ ID NO: 10782 - DNA, 103 bp, Artificial Sequence
  Synthetic Polynucleotide
taatacgactcactatagggatttggtatgatcagtgttgcgagcattgaaacagaggagatcaatgatggcaacactgaacctggcggcagcgcaaaagatg

SEQ ID NO: 10783 - DNA, 103 bp, Artificial Sequence
  Synthetic Polynucleotide
taatacgactcactatagggaaatgatttggtatgatcagtgttgcgagcaacagaggagagctcgcatgactgatcataacctggcggcagcgcaaaagatg

SEQ ID NO: 10784 - DNA, 103 bp, Artificial Sequence
  Synthetic Polynucleotide
taatacgactcactatagggccgataaatgatttggtatgatcagtgttgaacagaggagacaacacatgtcataccaaaacctggcggcagcgcaaaagatg

SEQ ID NO: 10785 - DNA, 103 bp, Artificial Sequence
  Synthetic Polynucleotide
taatacgactcactatagggccaggccgataaatgatttggtatgatcagaacagaggagactgatcatgccaaatcataacctggcggcagcgcaaaagatg

SEQ ID NO: 10786 - DNA, 103 bp, Artificial Sequence
  Synthetic Polynucleotide
taatacgactcactatagggcccctccaggccgataaatgatttggtatgaacagaggagacataccatgtcatttatcaacctggcggcagcgcaaaagatg

SEQ ID NO: 10787 - DNA, 103 bp, Artificial Sequence
  Synthetic Polynucleotide
taatacgactcactatagggtggggcccctccaggccgataaatgatttgaacagaggagacaaatcatgtatcggcctaacctggcggcagcgcaaaagatg

SEQ ID NO: 10788 - DNA, 103 bp, Artificial Sequence
  Synthetic Polynucleotide
taatacgactcactatagggcttcttggggcccctccaggccgataaatgaacagaggagacatttaatggcctggaggaacctggcggcagcgcaaaagatg

SEQ ID NO: 10789 - DNA, 103 bp, Artificial Sequence
  Synthetic Polynucleotide
taatacgactcactatagggattgctttccaagaattgcttgtagtcaccaacagaggagaggtgacatgaagcaattcaacctggcggcagcgcaaaagatg

SEQ ID NO: 10790 - DNA, 103 bp, Artificial Sequence
  Synthetic Polynucleotide
taatacgactcactataggggtggtcttcttggggcccctccaggccgataacagaggagaatcggcatggaggggcccaacctggcggcagcgcaaaagatg

SEQ ID NO: 10791 - DNA, 103 bp, Artificial Sequence
  Synthetic Polynucleotide
taatacgactcactataggggtgctgtggtcttcttggggcccctccaggaacagaggagacctggaatggccccaagaaacctggcggcagcgcaaaagatg

SEQ ID NO: 10792 - DNA, 103 bp, Artificial Sequence
  Synthetic Polynucleotide
taatacgactcactataggggtgtggtgctgtggtcttcttggggcccctaacagaggagaaggggcatgaagaagaccaacctggcggcagcgcaaaagatg

SEQ ID NO: 10793 - DNA, 103 bp, Artificial Sequence
  Synthetic Polynucleotide
taatacgactcactatagggaggctgtgtggtgctgtggtcttcttggggaacagaggagaccccaaatggaccacagcaacctggcggcagcgcaaaagatg

SEQ ID NO: 10794 - DNA, 103 bp, Artificial Sequence
  Synthetic Polynucleotide
taatacgactcactatagggttggcaggctgtgtggtgctgtggtcttctaacagaggagaagaagaatgcagcaccacaacctggcggcagcgcaaaagatg

SEQ ID NO: 10795 - DNA, 103 bp, Artificial Sequence
  Synthetic Polynucleotide
taatacgactcactatagggtggtcttggcaggctgtgtggtgctgtggtaacagaggagaaccacaatgccacacagcaacctggcggcagcgcaaaagatg

SEQ ID NO: 10796 - DNA, 103 bp, Artificial Sequence
  Synthetic Polynucleotide
taatacgactcactataggggctggtggtcttggcaggctgtgtggtgctaacagaggagaagcaccatgcagcctgccaacctggcggcagcgcaaaagatg

SEQ ID NO: 10797 - DNA, 103 bp, Artificial Sequence
  Synthetic Polynucleotide
taatacgactcactatagggggttggctggtggtcttggcaggctgtgtgaacagaggagacacacaatgtgccaagacaacctggcggcagcgcaaaagatg

SEQ ID NO: 10798 - DNA, 103 bp, Artificial Sequence
  Synthetic Polynucleotide
taatacgactcactatagggtggttggttggctggtggtcttggcaggctaacagaggagaagcctgatgagaccaccaaacctggcggcagcgcaaaagatg

SEQ ID NO: 10799 - DNA, 103 bp, Artificial Sequence
  Synthetic Polynucleotide
taatacgactcactataggggctgttggttggttggctggtggtcttggcaacagaggagagccaagatgaccagccaaaacctggcggcagcgcaaaagatg

SEQ ID NO: 10800 - DNA, 103 bp, Artificial Sequence
  Synthetic Polynucleotide
taatacgactcactatagggactgcattgctttccaagaattgcttgtagaacagaggagactacaaatgattcttggaaacctggcggcagcgcaaaagatg

SEQ ID NO: 10801 - DNA, 103 bp, Artificial Sequence
  Synthetic Polynucleotide
taatacgactcactatagggtctgtgctgttggttggttggctggtggtcaacagaggagagaccacatgccaaccaacaacctggcggcagcgcaaaagatg

SEQ ID NO: 10802 - DNA, 103 bp, Artificial Sequence
  Synthetic Polynucleotide
taatacgactcactatagggtcgattctgtgctgttggttggttggctggaacagaggagaccagccatgcaaccaacaaacctggcggcagcgcaaaagatg

SEQ ID NO: 10803 - DNA, 103 bp, Artificial Sequence
  Synthetic Polynucleotide
taatacgactcactatagggtgtcgtcgattctgtgctgttggttggttgaacagaggagacaaccaatgaacagcacaaacctggcggcagcgcaaaagatg

SEQ ID NO: 10804 - DNA, 103 bp, Artificial Sequence
  Synthetic Polynucleotide
taatacgactcactatagggtttagtgtcgtcgattctgtgctgttggttaacagaggagaaaccaaatgcacagaatcaacctggcggcagcgcaaaagatg

SEQ ID NO: 10805 - DNA, 103 bp, Artificial Sequence
  Synthetic Polynucleotide
taatacgactcactatagggttgggtttagtgtcgtcgattctgtgctgtaacagaggagaacagcaatgaatcgacgaaacctggcggcagcgcaaaagatg

SEQ ID NO: 10806 - DNA, 103 bp, Artificial Sequence
  Synthetic Polynucleotide
taatacgactcactatagggtgatgttgggtttagtgtcgtcgattctgtaacagaggagaacagaaatgacgacactaaacctggcggcagcgcaaaagatg

SEQ ID NO: 10807 - DNA, 103 bp, Artificial Sequence
  Synthetic Polynucleotide
taatacgactcactatagggggctctgatgttgggtttagtgtcgtcgataacagaggagaatcgacatgactaaacccaacctggcggcagcgcaaaagatg

SEQ ID NO: 10808 - DNA, 103 bp, Artificial Sequence
  Synthetic Polynucleotide
taatacgactcactatagggtggagggctctgatgttgggtttagtgtcgaacagaggagacgacacatgacccaacataacctggcggcagcgcaaaagatg

SEQ ID NO: 10809 - DNA, 103 bp, Artificial Sequence
  Synthetic Polynucleotide
taatacgactcactatagggtctactggagggctctgatgttgggtttagaacagaggagactaaacatgacatcagagaacctggcggcagcgcaaaagatg

SEQ ID NO: 10810 - DNA, 103 bp, Artificial Sequence
  Synthetic Polynucleotide
taatacgactcactataggggtgcctctactggagggctctgatgttgggaacagaggagacccaacatgagagccctcaacctggcggcagcgcaaaagatg

SEQ ID NO: 10811 - DNA, 103 bp, Artificial Sequence
  Synthetic Polynucleotide
taatacgactcactatagggacttgactgcattgctttccaagaattgctaacagaggagaagcaatatgtggaaagcaaacctggcggcagcgcaaaagatg

SEQ ID NO: 10812 - DNA, 103 bp, Artificial Sequence
  Synthetic Polynucleotide
taatacgactcactataggggtcccgtgcctctactggagggctctgatgaacagaggagacatcagatgcctccagtaaacctggcggcagcgcaaaagatg

SEQ ID NO: 10813 - DNA, 103 bp, Artificial Sequence
  Synthetic Polynucleotide
taatacgactcactatagggggatggtcccgtgcctctactggagggctcaacagaggagagagcccatgagtagaggcaacctggcggcagcgcaaaagatg

SEQ ID NO: 10814 - DNA, 103 bp, Artificial Sequence
  Synthetic Polynucleotide
taatacgactcactataggggggctggatggtcccgtgcctctactggagaacagaggagactccagatgaggcacgggaacctggcggcagcgcaaaagatg

SEQ ID NO: 10815 - DNA, 103 bp, Artificial Sequence
  Synthetic Polynucleotide
taatacgactcactatagggccgtggggctggatggtcccgtgcctctacaacagaggagagtagagatgcgggaccataacctggcggcagcgcaaaagatg

SEQ ID NO: 10816 - DNA, 103 bp, Artificial Sequence
  Synthetic Polynucleotide
taatacgactcactatagggggggaccgtggggctggatggtcccgtgccaacagaggagaggcacgatgccatccagcaacctggcggcagcgcaaaagatg

SEQ ID NO: 10817 - DNA, 103 bp, Artificial Sequence
  Synthetic Polynucleotide
taatacgactcactataggggtgttggggaccgtggggctggatggtcccaacagaggagagggaccatgcagccccacaacctggcggcagcgcaaaagatg

SEQ ID NO: 10818 - DNA, 103 bp, Artificial Sequence
  Synthetic Polynucleotide
taatacgactcactatagggctgtggtgttggggaccgtggggctggatgaacagaggagacatccaatgccacggtccaacctggcggcagcgcaaaagatg

SEQ ID NO: 10819 - DNA, 103 bp, Artificial Sequence
  Synthetic Polynucleotide
taatacgactcactataggggctttctgtggtgttggggaccgtggggctaacagaggagaagccccatggtccccaacaacctggcggcagcgcaaaagatg

SEQ ID NO: 10820 - DNA, 103 bp, Artificial Sequence
  Synthetic Polynucleotide
taatacgactcactataggggcgtggctttctgtggtgttggggaccgtgaacagaggagacacggtatgcaacaccacaacctggcggcagcgcaaaagatg

SEQ ID NO: 10821 - DNA, 103 bp, Artificial Sequence
  Synthetic Polynucleotide
taatacgactcactataggggttcggcgtggctttctgtggtgttggggaaacagaggagatccccaatgccacagaaaaacctggcggcagcgcaaaagatg

SEQ ID NO: 10822 - DNA, 103 bp, Artificial Sequence
  Synthetic Polynucleotide
taatacgactcactatagggaaggtacttgactgcattgctttccaagaaaacagaggagattcttgatgagcaatgcaaacctggcggcagcgcaaaagatg

SEQ ID NO: 10823 - DNA, 103 bp, Artificial Sequence
  Synthetic Polynucleotide
taatacgactcactataggggccaagttcggcgtggctttctgtggtgttaacagaggagaaacaccatggaaagccacaacctggcggcagcgcaaaagatg

SEQ ID NO: 10824 - DNA, 103 bp, Artificial Sequence
  Synthetic Polynucleotide
taatacgactcactataggggtcttgccaagttcggcgtggctttctgtgaacagaggagacacagaatgccacgccgaaacctggcggcagcgcaaaagatg

SEQ ID NO: 10825 - DNA, 103 bp, Artificial Sequence
  Synthetic Polynucleotide
taatacgactcactataggggggttgtcttgccaagttcggcgtggctttaacagaggagaaaagccatgccgaacttgaacctggcggcagcgcaaaagatg

SEQ ID NO: 10826 - DNA, 103 bp, Artificial Sequence
  Synthetic Polynucleotide
taatacgactcactatagggggttggggttgtcttgccaagttcggcgtgaacagaggagacacgccatgcttggcaagaacctggcggcagcgcaaaagatg

SEQ ID NO: 10827 - DNA, 103 bp, Artificial Sequence
  Synthetic Polynucleotide
taatacgactcactatagggagtgtggttggggttgtcttgccaagttcgaacagaggagacgaactatgcaagacaacaacctggcggcagcgcaaaagatg

SEQ ID NO: 10828 - DNA, 103 bp, Artificial Sequence
  Synthetic Polynucleotide
taatacgactcactatagggctgggagtgtggttggggttgtcttgccaaaacagaggagattggcaatgcaaccccaaaacctggcggcagcgcaaaagatg

SEQ ID NO: 10829 - DNA, 103 bp, Artificial Sequence
  Synthetic Polynucleotide
taatacgactcactatagggctgttctgggagtgtggttggggttgtcttaacagaggagaaagacaatgccaaccacaaacctggcggcagcgcaaaagatg

SEQ ID NO: 10830 - DNA, 103 bp, Artificial Sequence
  Synthetic Polynucleotide
taatacgactcactataggggtgtgctgttctgggagtgtggttggggttaacagaggagaaaccccatgcacactcccaacctggcggcagcgcaaaagatg

SEQ ID NO: 10831 - DNA, 103 bp, Artificial Sequence
  Synthetic Polynucleotide
taatacgactcactatagggcggcagtgtgctgttctgggagtgtggttgaacagaggagacaaccaatgtcccagaacaacctggcggcagcgcaaaagatg

SEQ ID NO: 10832 - DNA, 103 bp, Artificial Sequence
  Synthetic Polynucleotide
taatacgactcactatagggactggcggcagtgtgctgttctgggagtgtaacagaggagaacactcatggaacagcacaacctggcggcagcgcaaaagatg

SEQ ID NO: 10833 - DNA, 103 bp, Artificial Sequence
  Synthetic Polynucleotide
taatacgactcactatagggccctcaaggtacttgactgcattgctttccaacagaggagaggaaagatgtgcagtcaaaacctggcggcagcgcaaaagatg

SEQ ID NO: 10834 - DNA, 103 bp, Artificial Sequence
  Synthetic Polynucleotide
taatacgactcactatagggatggcactggcggcagtgtgctgttctgggaacagaggagacccagaatggcacactgcaacctggcggcagcgcaaaagatg

SEQ ID NO: 10835 - DNA, 103 bp, Artificial Sequence
  Synthetic Polynucleotide
taatacgactcactatagggttggaatggcactggcggcagtgtgctgttaacagaggagaaacagcatgctgccgccaaacctggcggcagcgcaaaagatg

SEQ ID NO: 10836 - DNA, 103 bp, Artificial Sequence
  Synthetic Polynucleotide
taatacgactcactatagggggctcttggaatggcactggcggcagtgtgaacagaggagacacactatggccagtgccaacctggcggcagcgcaaaagatg

SEQ ID NO: 10837 - DNA, 103 bp, Artificial Sequence
  Synthetic Polynucleotide
taatacgactcactatagggtgcacggctcttggaatggcactggcggcaaacagaggagatgccgcatgtgccattccaacctggcggcagcgcaaaagatg

SEQ ID NO: 10838 - DNA, 103 bp, Artificial Sequence
  Synthetic Polynucleotide
taatacgactcactatagggcggggtgcacggctcttggaatggcactggaacagaggagaccagtgatgttccaagagaacctggcggcagcgcaaaagatg

SEQ ID NO: 10839 - DNA, 103 bp, Artificial Sequence
  Synthetic Polynucleotide
taatacgactcactatagggttcgtcggggtgcacggctcttggaatggcaacagaggagagccattatgagagccgtgaacctggcggcagcgcaaaagatg

SEQ ID NO: 10840 - DNA, 103 bp, Artificial Sequence
  Synthetic Polynucleotide
taatacgactcactatagggctgagttcgtcggggtgcacggctcttggaaacagaggagatccaagatgcgtgcacccaacctggcggcagcgcaaaagatg

SEQ ID NO: 10841 - DNA, 103 bp, Artificial Sequence
  Synthetic Polynucleotide
taatacgactcactataggggtccactgagttcgtcggggtgcacggctcaacagaggagagagccgatgaccccgacgaacctggcggcagcgcaaaagatg

SEQ ID NO: 10842 - DNA, 103 bp, Artificial Sequence
  Synthetic Polynucleotide
taatacgactcactataggggccaggtccactgagttcgtcggggtgcacaacagaggagagtgcacatggacgaactcaacctggcggcagcgcaaaagatg

SEQ ID NO: 10843 - DNA, 103 bp, Artificial Sequence
  Synthetic Polynucleotide
taatacgactcactatagggaggaagccaggtccactgagttcgtcggggaacagaggagaccccgaatgactcagtggaacctggcggcagcgcaaaagatg

SEQ ID NO: 10844 - DNA, 103 bp, Artificial Sequence
  Synthetic Polynucleotide
taatacgactcactatagggcatgaccctcaaggtacttgactgcattgcaacagaggagagcaatgatgtcaagtaccaacctggcggcagcgcaaaagatg

SEQ ID NO: 10845 - DNA, 103 bp, Artificial Sequence
  Synthetic Polynucleotide
taatacgactcactatagggtcgtcaggaagccaggtccactgagttcgtaacagaggagaacgaacatggtggacctgaacctggcggcagcgcaaaagatg

SEQ ID NO: 10846 - DNA, 103 bp, Artificial Sequence
  Synthetic Polynucleotide
taatacgactcactatagggtgtgttcgtcaggaagccaggtccactgagaacagaggagactcagtatgcctggcttcaacctggcggcagcgcaaaagatg

SEQ ID NO: 10847 - DNA, 103 bp, Artificial Sequence
  Synthetic Polynucleotide
taatacgactcactatagggcgtattgtgttcgtcaggaagccaggtccaaacagaggagatggaccatgcttcctgacaacctggcggcagcgcaaaagatg

SEQ ID NO: 10848 - DNA, 103 bp, Artificial Sequence
  Synthetic Polynucleotide
taatacgactcactatagggccccccgtattgtgttcgtcaggaagccagaacagaggagactggctatgtgacgaacaaacctggcggcagcgcaaaagatg

SEQ ID NO: 10849 - DNA, 103 bp, Artificial Sequence
  Synthetic Polynucleotide
taatacgactcactatagggtgtaaccccccgtattgtgttcgtcaggaaaacagaggagattcctgatgaacacaataaacctggcggcagcgcaaaagatg

SEQ ID NO: 10850 - DNA, 103 bp, Artificial Sequence
  Synthetic Polynucleotide
taatacgactcactatagggagatttgtaaccccccgtattgtgttcgtcaacagaggagagacgaaatgaatacggggaacctggcggcagcgcaaaagatg

SEQ ID NO: 10851 - DNA, 103 bp, Artificial Sequence
  Synthetic Polynucleotide
taatacgactcactatagggtcaggagatttgtaaccccccgtattgtgtaacagaggagaacacaaatgggggggttaaacctggcggcagcgcaaaagatg

SEQ ID NO: 10852 - DNA, 103 bp, Artificial Sequence
  Synthetic Polynucleotide
taatacgactcactatagggtcctgtcaggagatttgtaaccccccgtataacagaggagaatacggatggttacaaataacctggcggcagcgcaaaagatg

SEQ ID NO: 10853 - DNA, 103 bp, Artificial Sequence
  Synthetic Polynucleotide
taatacgactcactatagggctggatcctgtcaggagatttgtaacccccaacagaggagagggggtatgaaatctcctaacctggcggcagcgcaaaagatg

SEQ ID NO: 10854 - DNA, 103 bp, Artificial Sequence
  Synthetic Polynucleotide
taatacgactcactatagggttcttctggatcctgtcaggagatttgtaaaacagaggagattacaaatgtcctgacagaacctggcggcagcgcaaaagatg

SEQ ID NO: 10855 - DNA, 103 bp, Artificial Sequence
  Synthetic Polynucleotide
taatacgactcactatagggatcttaatgtaagtgtcaatgagaggaaaaaacagaggagattttccatgcattgacacaacctggcggcagcgcaaaagatg

SEQ ID NO: 10856 - DNA, 103 bp, Artificial Sequence
  Synthetic Polynucleotide
taatacgactcactatagggaaagccatgaccctcaaggtacttgactgcaacagaggagagcagtcatgtaccttgagaacctggcggcagcgcaaaagatg

SEQ ID NO: 10857 - DNA, 103 bp, Artificial Sequence
  Synthetic Polynucleotide
taatacgactcactatagggtcgctttcttctggatcctgtcaggagattaacagaggagaaatctcatgacaggatccaacctggcggcagcgcaaaagatg

SEQ ID NO: 10858 - DNA, 103 bp, Artificial Sequence
  Synthetic Polynucleotide
taatacgactcactatagggtcccttcgctttcttctggatcctgtcaggaacagaggagacctgacatgatccagaagaacctggcggcagcgcaaaagatg

SEQ ID NO: 10859 - DNA, 103 bp, Artificial Sequence
  Synthetic Polynucleotide
taatacgactcactatagggtgacatcccttcgctttcttctggatcctgaacagaggagacaggatatggaagaaagcaacctggcggcagcgcaaaagatg

SEQ ID NO: 10860 - DNA, 103 bp, Artificial Sequence
  Synthetic Polynucleotide
taatacgactcactataggggggagtgacatcccttcgctttcttctggaaacagaggagatccagaatgaagcgaaggaacctggcggcagcgcaaaagatg

SEQ ID NO: 10861 - DNA, 103 bp, Artificial Sequence
  Synthetic Polynucleotide
taatacgactcactataggggtattgggagtgacatcccttcgctttcttaacagaggagaaagaaaatgaagggatgtaacctggcggcagcgcaaaagatg

SEQ ID NO: 10862 - DNA, 103 bp, Artificial Sequence
  Synthetic Polynucleotide
taatacgactcactataggggttgtgtattgggagtgacatcccttcgctaacagaggagaagcgaaatgatgtcactcaacctggcggcagcgcaaaagatg

SEQ ID NO: 10863 - DNA, 103 bp, Artificial Sequence
  Synthetic Polynucleotide
taatacgactcactatagggtttgggttgtgtattgggagtgacatccctaacagaggagaagggatatgactcccaataacctggcggcagcgcaaaagatg

SEQ ID NO: 10864 - DNA, 103 bp, Artificial Sequence
  Synthetic Polynucleotide
taatacgactcactatagggttgcatttgggttgtgtattgggagtgacaaacagaggagatgtcacatgcaatacacaaacctggcggcagcgcaaaagatg

SEQ ID NO: 10865 - DNA, 103 bp, Artificial Sequence
  Synthetic Polynucleotide
taatacgactcactatagggttgggttgcatttgggttgtgtattgggagaacagaggagactcccaatgcacaacccaaacctggcggcagcgcaaaagatg

SEQ ID NO: 10866 - DNA, 103 bp, Artificial Sequence
  Synthetic Polynucleotide
taatacgactcactatagggcaggtttgggttgcatttgggttgtgtattaacagaggagaaatacaatgcccaaatgcaacctggcggcagcgcaaaagatg

SEQ ID NO: 10867 - DNA, 103 bp, Artificial Sequence
  Synthetic Polynucleotide
taatacgactcactatagggaagcgaaagccatgaccctcaaggtacttgaacagaggagacaagtaatgtgagggtcaaacctggcggcagcgcaaaagatg

SEQ ID NO: 10868 - DNA, 103 bp, Artificial Sequence
  Synthetic Polynucleotide
taatacgactcactatagggtagtgcaggtttgggttgcatttgggttgtaacagaggagaacaaccatgatgcaacccaacctggcggcagcgcaaaagatg

SEQ ID NO: 10869 - DNA, 103 bp, Artificial Sequence
  Synthetic Polynucleotide
taatacgactcactatagggtccaatagtgcaggtttgggttgcatttggaacagaggagaccaaatatgacccaaaccaacctggcggcagcgcaaaagatg

SEQ ID NO: 10870 - DNA, 103 bp, Artificial Sequence
  Synthetic Polynucleotide
taatacgactcactatagggggctgtccaatagtgcaggtttgggttgcaaacagaggagatgcaacatgaacctgcacaacctggcggcagcgcaaaagatg

SEQ ID NO: 10871 - DNA, 103 bp, Artificial Sequence
  Synthetic Polynucleotide
taatacgactcactatagggtccaaggctgtccaatagtgcaggtttgggaacagaggagacccaaaatggcactattgaacctggcggcagcgcaaaagatg

SEQ ID NO: 10872 - DNA, 103 bp, Artificial Sequence
  Synthetic Polynucleotide
taatacgactcactatagggcctcatccaaggctgtccaatagtgcaggtaacagaggagaacctgcatgattggacagaacctggcggcagcgcaaaagatg

SEQ ID NO: 10873 - DNA, 103 bp, Artificial Sequence
  Synthetic Polynucleotide
taatacgactcactatagggagcaccctcatccaaggctgtccaatagtgaacagaggagacactatatgacagccttgaacctggcggcagcgcaaaagatg

SEQ ID NO: 10874 - DNA, 103 bp, Artificial Sequence
  Synthetic Polynucleotide
taatacgactcactatagggatggcagcaccctcatccaaggctgtccaaaacagaggagattggacatgcttggatgaaacctggcggcagcgcaaaagatg

SEQ ID NO: 10875 - DNA, 103 bp, Artificial Sequence
  Synthetic Polynucleotide
taatacgactcactatagggaacctatggcagcaccctcatccaaggctgaacagaggagacagcctatgatgagggtgaacctggcggcagcgcaaaagatg

SEQ ID NO: 10876 - DNA, 103 bp, Artificial Sequence
  Synthetic Polynucleotide
taatacgactcactatagggggctaaacctatggcagcaccctcatccaaaacagaggagattggatatgggtgctgccaacctggcggcagcgcaaaagatg

SEQ ID NO: 10877 - DNA, 103 bp, Artificial Sequence
  Synthetic Polynucleotide
taatacgactcactatagggatccaggctaaacctatggcagcaccctcaaacagaggagatgagggatgtgccataggaacctggcggcagcgcaaaagatg

SEQ ID NO: 10878 - DNA, 103 bp, Artificial Sequence
  Synthetic Polynucleotide
taatacgactcactatagggcctcaaagcgaaagccatgaccctcaaggtaacagaggagaaccttgatggtcatggctaacctggcggcagcgcaaaagatg

SEQ ID NO: 10879 - DNA, 103 bp, Artificial Sequence
  Synthetic Polynucleotide
taatacgactcactatagggatggtatccaggctaaacctatggcagcacaacagaggagagtgctgatgtaggtttagaacctggcggcagcgcaaaagatg

SEQ ID NO: 10880 - DNA, 103 bp, Artificial Sequence
  Synthetic Polynucleotide
taatacgactcactataggggaagtatggtatccaggctaaacctatggcaacagaggagagccataatgttagcctggaacctggcggcagcgcaaaagatg

SEQ ID NO: 10881 - DNA, 103 bp, Artificial Sequence
  Synthetic Polynucleotide
taatacgactcactatagggggcccgaagtatggtatccaggctaaacctaacagaggagaaggtttatgctggataccaacctggcggcagcgcaaaagatg

SEQ ID NO: 10882 - DNA, 103 bp, Artificial Sequence
  Synthetic Polynucleotide
taatacgactcactatagggctgctggcccgaagtatggtatccaggctaaacagaggagatagcctatgtaccatactaacctggcggcagcgcaaaagatg

SEQ ID NO: 10883 - DNA, 103 bp, Artificial Sequence
  Synthetic Polynucleotide
taatacgactcactatagggctcagctgctggcccgaagtatggtatccaaacagaggagatggataatgtacttcgggaacctggcggcagcgcaaaagatg

SEQ ID NO: 10884 - DNA, 103 bp, Artificial Sequence
  Synthetic Polynucleotide
taatacgactcactatagggattccctcagctgctggcccgaagtatggtaacagaggagaaccataatgcgggccagcaacctggcggcagcgcaaaagatg

SEQ ID NO: 10885 - DNA, 103 bp, Artificial Sequence
  Synthetic Polynucleotide
taatacgactcactatagggtgtaaattccctcagctgctggcccgaagtaacagaggagaacttcgatgcagcagctgaacctggcggcagcgcaaaagatg

SEQ ID NO: 10886 - DNA, 103 bp, Artificial Sequence
  Synthetic Polynucleotide
taatacgactcactatagggttcagtgtaaattccctcagctgctggcccaacagaggagagggccaatggctgagggaaacctggcggcagcgcaaaagatg

SEQ ID NO: 10887 - DNA, 103 bp, Artificial Sequence
  Synthetic Polynucleotide
taatacgactcactatagggatgccttcagtgtaaattccctcagctgctaacagaggagaagcagcatggggaatttaaacctggcggcagcgcaaaagatg

SEQ ID NO: 10888 - DNA, 103 bp, Artificial Sequence
  Synthetic Polynucleotide
taatacgactcactatagggccattatgccttcagtgtaaattccctcagaacagaggagactgaggatgtttacactgaacctggcggcagcgcaaaagatg

SEQ ID NO: 10889 - DNA, 103 bp, Artificial Sequence
  Synthetic Polynucleotide
taatacgactcactatagggcctgacctcaaagcgaaagccatgaccctcaacagaggagagagggtatgggctttcgcaacctggcggcagcgcaaaagatg

SEQ ID NO: 10890 - DNA, 103 bp, Artificial Sequence
  Synthetic Polynucleotide
taatacgactcactatagggattctccattatgccttcagtgtaaattccaacagaggagaggaattatgactgaaggcaacctggcggcagcgcaaaagatg

SEQ ID NO: 10891 - DNA, 103 bp, Artificial Sequence
  Synthetic Polynucleotide
taatacgactcactatagggttttgattctccattatgccttcagtgtaaaacagaggagattacacatgaggcataataacctggcggcagcgcaaaagatg

SEQ ID NO: 10892 - DNA, 103 bp, Artificial Sequence
  Synthetic Polynucleotide
taatacgactcactatagggatccattttgattctccattatgccttcagaacagaggagactgaagatgtaatggagaaacctggcggcagcgcaaaagatg

SEQ ID NO: 10893 - DNA, 103 bp, Artificial Sequence
  Synthetic Polynucleotide
taatacgactcactataggggatcaatccattttgattctccattatgccaacagaggagaggcataatggagaatcaaaacctggcggcagcgcaaaagatg

SEQ ID NO: 10894 - DNA, 103 bp, Artificial Sequence
  Synthetic Polynucleotide
taatacgactcactatagggccacagatcaatccattttgattctccattaacagaggagaaatggaatgtcaaaatggaacctggcggcagcgcaaaagatg

SEQ ID NO: 10895 - DNA, 103 bp, Artificial Sequence
  Synthetic Polynucleotide
taatacgactcactatagggtcaatccacagatcaatccattttgattctaacagaggagaagaatcatgatggattgaaacctggcggcagcgcaaaagatg

SEQ ID NO: 10896 - DNA, 103 bp, Artificial Sequence
  Synthetic Polynucleotide
taatacgactcactatagggctgcctcaatccacagatcaatccattttgaacagaggagacaaaatatgttgatctgtaacctggcggcagcgcaaaagatg

SEQ ID NO: 10897 - DNA, 103 bp, Artificial Sequence
  Synthetic Polynucleotide
taatacgactcactataggggccagctgcctcaatccacagatcaatccaaacagaggagatggattatgctgtggattaacctggcggcagcgcaaaagatg

SEQ ID NO: 10898 - DNA, 103 bp, Artificial Sequence
  Synthetic Polynucleotide
taatacgactcactatagggcgttggccagctgcctcaatccacagatcaaacagaggagatgatctatggattgaggcaacctggcggcagcgcaaaagatg

SEQ ID NO: 10899 - DNA, 103 bp, Artificial Sequence
  Synthetic Polynucleotide
taatacgactcactatagggcgtttcgttggccagctgcctcaatccacaaacagaggagatgtggaatgaggcagctgaacctggcggcagcgcaaaagatg

SEQ ID NO: 10900 - DNA, 103 bp, Artificial Sequence
  Synthetic Polynucleotide
taatacgactcactatagggtttttcctgacctcaaagcgaaagccatgaaacagaggagatcatggatgtcgctttgaaacctggcggcagcgcaaaagatg

SEQ ID NO: 10901 - DNA, 103 bp, Artificial Sequence
  Synthetic Polynucleotide
taatacgactcactatagggtgtgtcgtttcgttggccagctgcctcaataacagaggagaattgagatggctggccaaaacctggcggcagcgcaaaagatg

SEQ ID NO: 10902 - DNA, 103 bp, Artificial Sequence
  Synthetic Polynucleotide
taatacgactcactataggggagcttgtgtcgtttcgttggccagctgccaacagaggagaggcagcatgccaacgaaaaacctggcggcagcgcaaaagatg

SEQ ID NO: 10903 - DNA, 103 bp, Artificial Sequence
  Synthetic Polynucleotide
taatacgactcactatagggttgaagagcttgtgtcgtttcgttggccagaacagaggagactggccatggaaacgacaaacctggcggcagcgcaaaagatg

SEQ ID NO: 10904 - DNA, 103 bp, Artificial Sequence
  Synthetic Polynucleotide
taatacgactcactatagggaacaattgaagagcttgtgtcgtttcgttgaacagaggagacaacgaatggacacaagcaacctggcggcagcgcaaaagatg

SEQ ID NO: 10905 - DNA, 103 bp, Artificial Sequence
  Synthetic Polynucleotide
taatacgactcactatagggttaagaacaattgaagagcttgtgtcgtttaacagaggagaaaacgaatgaagctcttcaacctggcggcagcgcaaaagatg

SEQ ID NO: 10906 - DNA, 103 bp, Artificial Sequence
  Synthetic Polynucleotide
taatacgactcactatagggtgcccttaagaacaattgaagagcttgtgtaacagaggagaacacaaatgcttcaattgaacctggcggcagcgcaaaagatg

SEQ ID NO: 10907 - DNA, 103 bp, Artificial Sequence
  Synthetic Polynucleotide
taatacgactcactataggggtagttgcccttaagaacaattgaagagctaacagaggagaagctctatgattgttcttaacctggcggcagcgcaaaagatg

SEQ ID NO: 10908 - DNA, 103 bp, Artificial Sequence
  Synthetic Polynucleotide
taatacgactcactatagggactcagtagttgcccttaagaacaattgaaaacagaggagattcaatatgtcttaagggaacctggcggcagcgcaaaagatg

SEQ ID NO: 10909 - DNA, 103 bp, Artificial Sequence
  Synthetic Polynucleotide
taatacgactcactatagggacgcaactcagtagttgcccttaagaacaaaacagaggagattgttcatgagggcaactaacctggcggcagcgcaaaagatg

SEQ ID NO: 10910 - DNA, 103 bp, Artificial Sequence
  Synthetic Polynucleotide
taatacgactcactatagggaatgtacgcaactcagtagttgcccttaagaacagaggagacttaagatgaactactgaaacctggcggcagcgcaaaagatg

SEQ ID NO: 10911 - DNA, 103 bp, Artificial Sequence
  Synthetic Polynucleotide
taatacgactcactatagggcttcctttttcctgacctcaaagcgaaagcaacagaggagagctttcatgttgaggtcaaacctggcggcagcgcaaaagatg

SEQ ID NO: 10912 - DNA, 103 bp, Artificial Sequence
  Synthetic Polynucleotide
taatacgactcactatagggtagagaatgtacgcaactcagtagttgcccaacagaggagagggcaaatgctgagttgcaacctggcggcagcgcaaaagatg

SEQ ID NO: 10913 - DNA, 103 bp, Artificial Sequence
  Synthetic Polynucleotide
taatacgactcactatagggtagtatagagaatgtacgcaactcagtagtaacagaggagaactactatgttgcgtacaaacctggcggcagcgcaaaagatg

SEQ ID NO: 10914 - DNA, 103 bp, Artificial Sequence
  Synthetic Polynucleotide
taatacgactcactatagggcgatttagtatagagaatgtacgcaactcaaacagaggagatgagttatgtacattctcaacctggcggcagcgcaaaagatg

SEQ ID NO: 10915 - DNA, 103 bp, Artificial Sequence
  Synthetic Polynucleotide
taatacgactcactatagggctttccgatttagtatagagaatgtacgcaaacagaggagatgcgtaatgtctctatacaacctggcggcagcgcaaaagatg

SEQ ID NO: 10916 - DNA, 103 bp, Artificial Sequence
  Synthetic Polynucleotide
taatacgactcactatagggtattgctttccgatttagtatagagaatgtaacagaggagaacattcatgatactaaataacctggcggcagcgcaaaagatg

SEQ ID NO: 10917 - DNA, 103 bp, Artificial Sequence
  Synthetic Polynucleotide
taatacgactcactatagggaagtctattgctttccgatttagtatagagaacagaggagactctatatgaaatcggaaaacctggcggcagcgcaaaagatg

SEQ ID NO: 10918 - DNA, 103 bp, Artificial Sequence
  Synthetic Polynucleotide
taatacgactcactataggggcaagaagtctattgctttccgatttagtaaacagaggagatactaaatgggaaagcaaaacctggcggcagcgcaaaagatg

SEQ ID NO: 10919 - DNA, 103 bp, Artificial Sequence
  Synthetic Polynucleotide
taatacgactcactatagggttggagcaagaagtctattgctttccgattaacagaggagaaatcggatggcaatagacaacctggcggcagcgcaaaagatg

SEQ ID NO: 10920 - DNA, 103 bp, Artificial Sequence
  Synthetic Polynucleotide
taatacgactcactatagggcatctttggagcaagaagtctattgctttcaacagaggagagaaagcatgagacttcttaacctggcggcagcgcaaaagatg

SEQ ID NO: 10921 - DNA, 103 bp, Artificial Sequence
  Synthetic Polynucleotide
taatacgactcactatagggctccccatctttggagcaagaagtctattgaacagaggagacaatagatgtcttgctccaacctggcggcagcgcaaaagatg

SEQ ID NO: 10922 - DNA, 103 bp, Artificial Sequence
  Synthetic Polynucleotide
taatacgactcactataggggactccttcctttttcctgacctcaaagcgaacagaggagacgctttatggtcaggaaaaacctggcggcagcgcaaaagatg

SEQ ID NO: 10923 - DNA, 103 bp, Artificial Sequence
  Synthetic Polynucleotide
taatacgactcactatagggtgttcctccccatctttggagcaagaagtcaacagaggagagacttcatgctccaaagaaacctggcggcagcgcaaaagatg

SEQ ID NO: 10924 - DNA, 103 bp, Artificial Sequence
  Synthetic Polynucleotide
taatacgactcactatagggtgacatgttcctccccatctttggagcaagaacagaggagacttgctatgaagatggggaacctggcggcagcgcaaaagatg

SEQ ID NO: 10925 - DNA, 103 bp, Artificial Sequence
  Synthetic Polynucleotide
taatacgactcactataggggaatgtgacatgttcctccccatctttggaaacagaggagatccaaaatgggggaggaaaacctggcggcagcgcaaaagatg

SEQ ID NO: 10926 - DNA, 103 bp, Artificial Sequence
  Synthetic Polynucleotide
taatacgactcactatagggccctagaatgtgacatgttcctccccatctaacagaggagaagatggatgggaacatgtaacctggcggcagcgcaaaagatg

SEQ ID NO: 10927 - DNA, 103 bp, Artificial Sequence
  Synthetic Polynucleotide
taatacgactcactatagggtcaggccctagaatgtgacatgttcctcccaacagaggagagggaggatgatgtcacataacctggcggcagcgcaaaagatg

SEQ ID NO: 10928 - DNA, 103 bp, Artificial Sequence
  Synthetic Polynucleotide
taatacgactcactatagggaacaatcaggccctagaatgtgacatgttcaacagaggagagaacatatgacattctagaacctggcggcagcgcaaaagatg

SEQ ID NO: 10929 - DNA, 103 bp, Artificial Sequence
  Synthetic Polynucleotide
taatacgactcactatagggaatgcaacaatcaggccctagaatgtgacaaacagaggagatgtcacatgctagggcctaacctggcggcagcgcaaaagatg

SEQ ID NO: 10930 - DNA, 103 bp, Artificial Sequence
  Synthetic Polynucleotide
taatacgactcactatagggggttcaatgcaacaatcaggccctagaatgaacagaggagacattctatggcctgattgaacctggcggcagcgcaaaagatg

SEQ ID NO: 10931 - DNA, 103 bp, Artificial Sequence
  Synthetic Polynucleotide
taatacgactcactatagggcttggggttcaatgcaacaatcaggccctaaacagaggagatagggcatgattgttgcaaacctggcggcagcgcaaaagatg

SEQ ID NO: 10932 - DNA, 103 bp, Artificial Sequence
  Synthetic Polynucleotide
taatacgactcactatagggccaatcttggggttcaatgcaacaatcaggaacagaggagacctgatatgtgcattgaaaacctggcggcagcgcaaaagatg

SEQ ID NO: 10933 - DNA, 103 bp, Artificial Sequence
  Synthetic Polynucleotide
taatacgactcactatagggcgcttgactccttcctttttcctgacctcaaacagaggagatgaggtatggaaaaaggaaacctggcggcagcgcaaaagatg

SEQ ID NO: 10934 - DNA, 103 bp, Artificial Sequence
  Synthetic Polynucleotide
taatacgactcactatagggttggtccaatcttggggttcaatgcaacaaaacagaggagattgttgatgtgaaccccaaacctggcggcagcgcaaaagatg

SEQ ID NO: 10935 - DNA, 103 bp, Artificial Sequence
  Synthetic Polynucleotide
taatacgactcactatagggtatttttggtccaatcttggggttcaatgcaacagaggagagcattgatgcccaagattaacctggcggcagcgcaaaagatg

SEQ ID NO: 10936 - DNA, 103 bp, Artificial Sequence
  Synthetic Polynucleotide
taatacgactcactatagggagtgatatttttggtccaatcttggggttcaacagaggagagaacccatggattggaccaacctggcggcagcgcaaaagatg

SEQ ID NO: 10937 - DNA, 103 bp, Artificial Sequence
  Synthetic Polynucleotide
taatacgactcactatagggttatcagtgatatttttggtccaatcttggaacagaggagaccaagaatggaccaaaaaaacctggcggcagcgcaaaagatg

SEQ ID NO: 10938 - DNA, 103 bp, Artificial Sequence
  Synthetic Polynucleotide
taatacgactcactatagggcaattttatcagtgatatttttggtccaataacagaggagaattggaatgaaaatatcaaacctggcggcagcgcaaaagatg

SEQ ID NO: 10939 - DNA, 103 bp, Artificial Sequence
  Synthetic Polynucleotide
taatacgactcactatagggttgatcaattttatcagtgatatttttggtaacagaggagaaccaaaatgatcactgataacctggcggcagcgcaaaagatg

SEQ ID NO: 10940 - DNA, 103 bp, Artificial Sequence
  Synthetic Polynucleotide
taatacgactcactatagggattatttgatcaattttatcagtgatatttaacagaggagaaaatatatgtgataaaataacctggcggcagcgcaaaagatg

SEQ ID NO: 10941 - DNA, 103 bp, Artificial Sequence
  Synthetic Polynucleotide
taatacgactcactatagggcatggattatttgatcaattttatcagtgaaacagaggagatcactgatgaaattgatcaacctggcggcagcgcaaaagatg

SEQ ID NO: 10942 - DNA, 103 bp, Artificial Sequence
  Synthetic Polynucleotide
taatacgactcactatagggaaagtcatggattatttgatcaattttatcaacagaggagagataaaatggatcaaataaacctggcggcagcgcaaaagatg

SEQ ID NO: 10943 - DNA, 103 bp, Artificial Sequence
  Synthetic Polynucleotide
taatacgactcactatagggtcgacaaagtcatggattatttgatcaattaacagaggagaaattgaatgaataatccaaacctggcggcagcgcaaaagatg

SEQ ID NO: 10944 - DNA, 103 bp, Artificial Sequence
  Synthetic Polynucleotide
taatacgactcactatagggcgagtcgcttgactccttcctttttcctgaaacagaggagatcaggaatgaggaaggagaacctggcggcagcgcaaaagatg

SEQ ID NO: 10945 - DNA, 103 bp, Artificial Sequence
  Synthetic Polynucleotide
taatacgactcactatagggtattatcgacaaagtcatggattatttgataacagaggagaatcaaaatgtccatgactaacctggcggcagcgcaaaagatg

SEQ ID NO: 10946 - DNA, 103 bp, Artificial Sequence
  Synthetic Polynucleotide
taatacgactcactatagggaagattattatcgacaaagtcatggattataacagaggagaataatcatggactttgtcaacctggcggcagcgcaaaagatg

SEQ ID NO: 10947 - DNA, 103 bp, Artificial Sequence
  Synthetic Polynucleotide
taatacgactcactatagggtttggaagattattatcgacaaagtcatggaacagaggagaccatgaatgtgtcgataaaacctggcggcagcgcaaaagatg

SEQ ID NO: 10948 - DNA, 103 bp, Artificial Sequence
  Synthetic Polynucleotide
taatacgactcactatagggtctgatttggaagattattatcgacaaagtaacagaggagaactttgatgataataatcaacctggcggcagcgcaaaagatg

SEQ ID NO: 10949 - DNA, 103 bp, Artificial Sequence
  Synthetic Polynucleotide
taatacgactcactatagggatcattctgatttggaagattattatcgacaacagaggagagtcgatatgaatcttccaaacctggcggcagcgcaaaagatg

SEQ ID NO: 10950 - DNA, 103 bp, Artificial Sequence
  Synthetic Polynucleotide
taatacgactcactatagggctgccatcattctgatttggaagattattaaacagaggagataataaatgtccaaatcaaacctggcggcagcgcaaaagatg

SEQ ID NO: 10951 - DNA, 103 bp, Artificial Sequence
  Synthetic Polynucleotide
taatacgactcactatagggagttgctgccatcattctgatttggaagataacagaggagaatcttcatgatcagaatgaacctggcggcagcgcaaaagatg

SEQ ID NO: 10952 - DNA, 103 bp, Artificial Sequence
  Synthetic Polynucleotide
taatacgactcactatagggccaccagttgctgccatcattctgatttggaacagaggagaccaaatatgaatgatggcaacctggcggcagcgcaaaagatg

SEQ ID NO: 10953 - DNA, 103 bp, Artificial Sequence
  Synthetic Polynucleotide
taatacgactcactatagggccagtccaccagttgctgccatcattctgaaacagaggagatcagaaatgtggcagcaaaacctggcggcagcgcaaaagatg

SEQ ID NO: 10954 - DNA, 103 bp, Artificial Sequence
  Synthetic Polynucleotide
taatacgactcactatagggtccatccagtccaccagttgctgccatcataacagaggagaatgatgatggcaactggtaacctggcggcagcgcaaaagatg

SEQ ID NO: 10955 - DNA, 103 bp, Artificial Sequence
  Synthetic Polynucleotide
taatacgactcactatagggttcttcgagtcgcttgactccttcctttttaacagaggagaaaaaagatgggagtcaagaacctggcggcagcgcaaaagatg

SEQ ID NO: 10956 - DNA, 103 bp, Artificial Sequence
  Synthetic Polynucleotide
taatacgactcactatagggttgtttccatccagtccaccagttgctgccaacagaggagaggcagcatgtggtggactaacctggcggcagcgcaaaagatg

SEQ ID NO: 10957 - DNA, 103 bp, Artificial Sequence
  Synthetic Polynucleotide
taatacgactcactatagggacccattgtttccatccagtccaccagttgaacagaggagacaactgatggactggatgaacctggcggcagcgcaaaagatg

SEQ ID NO: 10958 - DNA, 103 bp, Artificial Sequence
  Synthetic Polynucleotide
taatacgactcactatagggcaggaacccattgtttccatccagtccaccaacagaggagaggtggaatggatggaaacaacctggcggcagcgcaaaagatg

SEQ ID NO: 10959 - DNA, 103 bp, Artificial Sequence
  Synthetic Polynucleotide
taatacgactcactatagggtccagcaggaacccattgtttccatccagtaacagaggagaactggaatgaaacaatggaacctggcggcagcgcaaaagatg

SEQ ID NO: 10960 - DNA, 103 bp, Artificial Sequence
  Synthetic Polynucleotide
taatacgactcactatagggcctattccagcaggaacccattgtttccataacagaggagaatggaaatgatgggttccaacctggcggcagcgcaaaagatg

SEQ ID NO: 10961 - DNA, 103 bp, Artificial Sequence
  Synthetic Polynucleotide
taatacgactcactatagggtgattcctattccagcaggaacccattgttaacagaggagaaacaatatgttcctgctgaacctggcggcagcgcaaaagatg

SEQ ID NO: 10962 - DNA, 103 bp, Artificial Sequence
  Synthetic Polynucleotide
taatacgactcactatagggtcctgtgattcctattccagcaggaacccaaacagaggagatgggttatggctggaataaacctggcggcagcgcaaaagatg

SEQ ID NO: 10963 - DNA, 103 bp, Artificial Sequence
  Synthetic Polynucleotide
taatacgactcactatagggattactcctgtgattcctattccagcaggaaacagaggagatcctgcatgaataggaataacctggcggcagcgcaaaagatg

SEQ ID NO: 10964 - DNA, 103 bp, Artificial Sequence
  Synthetic Polynucleotide
taatacgactcactatagggcaatgattactcctgtgattcctattccagaacagaggagactggaaatggaatcacagaacctggcggcagcgcaaaagatg

SEQ ID NO: 10965 - DNA, 103 bp, Artificial Sequence
  Synthetic Polynucleotide
taatacgactcactatagggaatagcaatgattactcctgtgattcctataacagaggagaataggaatgacaggagtaaacctggcggcagcgcaaaagatg

SEQ ID NO: 10966 - DNA, 103 bp, Artificial Sequence
  Synthetic Polynucleotide
taatacgactcactatagggtcttaatcttaatgtaagtgtcaatgagagaacagaggagactctcaatgacacttacaaacctggcggcagcgcaaaagatg

SEQ ID NO: 10967 - DNA, 103 bp, Artificial Sequence
  Synthetic Polynucleotide
taatacgactcactatagggagcaattcttcgagtcgcttgactccttccaacagaggagaggaaggatgcaagcgactaacctggcggcagcgcaaaagatg

SEQ ID NO: 10968 - DNA, 103 bp, Artificial Sequence
  Synthetic Polynucleotide
taatacgactcactataggggcaataatagcaatgattactcctgtgattaacagaggagaaatcacatgagtaatcataacctggcggcagcgcaaaagatg

SEQ ID NO: 10969 - DNA, 103 bp, Artificial Sequence
  Synthetic Polynucleotide
taatacgactcactataggggcaaagcaataatagcaatgattactcctgaacagaggagacaggagatgtcattgctaaacctggcggcagcgcaaaagatg

SEQ ID NO: 10970 - DNA, 103 bp, Artificial Sequence
  Synthetic Polynucleotide
taatacgactcactataggggcacagcaaagcaataatagcaatgattacaacagaggagagtaatcatggctattattaacctggcggcagcgcaaaagatg

SEQ ID NO: 10971 - DNA, 103 bp, Artificial Sequence
  Synthetic Polynucleotide
taatacgactcactatagggcaaatgcacagcaaagcaataatagcaatgaacagaggagacattgcatgtattgctttaacctggcggcagcgcaaaagatg

SEQ ID NO: 10972 - DNA, 103 bp, Artificial Sequence
  Synthetic Polynucleotide
taatacgactcactatagggatttgcaaatgcacagcaaagcaataatagaacagaggagactattaatgctttgctgtaacctggcggcagcgcaaaagatg

SEQ ID NO: 10973 - DNA, 103 bp, Artificial Sequence
  Synthetic Polynucleotide
taatacgactcactatagggcatgaatttgcaaatgcacagcaaagcaataacagaggagaattgctatgctgtgcattaacctggcggcagcgcaaaagatg

SEQ ID NO: 10974 - DNA, 103 bp, Artificial Sequence
  Synthetic Polynucleotide
taatacgactcactatagggcaaagcatgaatttgcaaatgcacagcaaaaacagaggagatttgctatgcatttgcaaaacctggcggcagcgcaaaagatg

SEQ ID NO: 10975 - DNA, 103 bp, Artificial Sequence
  Synthetic Polynucleotide
taatacgactcactatagggtagttcaaagcatgaatttgcaaatgcacaaacagaggagatgtgcaatggcaaattcaaacctggcggcagcgcaaaagatg

SEQ ID NO: 10976 - DNA, 103 bp, Artificial Sequence
  Synthetic Polynucleotide
taatacgactcactatagggtatattagttcaaagcatgaatttgcaaataacagaggagaatttgcatgttcatgcttaacctggcggcagcgcaaaagatg

SEQ ID NO: 10977 - DNA, 103 bp, Artificial Sequence
  Synthetic Polynucleotide
taatacgactcactataggggatgctatattagttcaaagcatgaatttgaacagaggagacaaattatggctttgaacaacctggcggcagcgcaaaagatg

SEQ ID NO: 10978 - DNA, 103 bp, Artificial Sequence
  Synthetic Polynucleotide
taatacgactcactatagggcaggaagcaattcttcgagtcgcttgactcaacagaggagagagtcaatggactcgaagaacctggcggcagcgcaaaagatg

SEQ ID NO: 10979 - DNA, 103 bp, Artificial Sequence
  Synthetic Polynucleotide
taatacgactcactatagggagtatgatgctatattagttcaaagcatgaaacagaggagatcatgcatggaactaataaacctggcggcagcgcaaaagatg

SEQ ID NO: 10980 - DNA, 103 bp, Artificial Sequence
  Synthetic Polynucleotide
taatacgactcactatagggtagaaagtatgatgctatattagttcaaagaacagaggagactttgaatgaatatagcaaacctggcggcagcgcaaaagatg

SEQ ID NO: 10981 - DNA, 103 bp, Artificial Sequence
  Synthetic Polynucleotide
taatacgactcactatagggaatattagaaagtatgatgctatattagttaacagaggagaaactaaatgagcatcataaacctggcggcagcgcaaaagatg

SEQ ID NO: 10982 - DNA, 103 bp, Artificial Sequence
  Synthetic Polynucleotide
taatacgactcactataggggggggaatattagaaagtatgatgctatataacagaggagaatatagatgcatactttcaacctggcggcagcgcaaaagatg

SEQ ID NO: 10983 - DNA, 103 bp, Artificial Sequence
  Synthetic Polynucleotide
taatacgactcactatagggatattgggggaatattagaaagtatgatgcaacagaggagagcatcaatgtttctaataaacctggcggcagcgcaaaagatg

SEQ ID NO: 10984 - DNA, 103 bp, Artificial Sequence
  Synthetic Polynucleotide
taatacgactcactatagggaattcatattgggggaatattagaaagtataacagaggagaatacttatgaatattcccaacctggcggcagcgcaaaagatg

SEQ ID NO: 10985 - DNA, 103 bp, Artificial Sequence
  Synthetic Polynucleotide
taatacgactcactatagggacaaaaattcatattgggggaatattagaaaacagaggagattctaaatgtcccccaataacctggcggcagcgcaaaagatg

SEQ ID NO: 10986 - DNA, 103 bp, Artificial Sequence
  Synthetic Polynucleotide
taatacgactcactatagggcgaaaacaaaaattcatattgggggaatataacagaggagaatattcatgcaatatgaaaacctggcggcagcgcaaaagatg

SEQ ID NO: 10987 - DNA, 103 bp, Artificial Sequence
  Synthetic Polynucleotide
taatacgactcactatagggaaaatcgaaaacaaaaattcatattgggggaacagaggagacccccaatgtgaatttttaacctggcggcagcgcaaaagatg

SEQ ID NO: 10988 - DNA, 103 bp, Artificial Sequence
  Synthetic Polynucleotide
taatacgactcactatagggtaaataaaatcgaaaacaaaaattcatattaacagaggagaaatatgatgttttgttttaacctggcggcagcgcaaaagatg

SEQ ID NO: 10989 - DNA, 103 bp, Artificial Sequence
  Synthetic Polynucleotide
taatacgactcactatagggtgcagcaggaagcaattcttcgagtcgcttaacagaggagaaagcgaatggaagaattgaacctggcggcagcgcaaaagatg

SEQ ID NO: 10990 - DNA, 103 bp, Artificial Sequence
  Synthetic Polynucleotide
taatacgactcactatagggatcattaaataaaatcgaaaacaaaaattcaacagaggagagaatttatgttttcgattaacctggcggcagcgcaaaagatg

SEQ ID NO: 10991 - DNA, 103 bp, Artificial Sequence
  Synthetic Polynucleotide
taatacgactcactataggggatatatcattaaataaaatcgaaaacaaaaacagaggagatttgttatggattttattaacctggcggcagcgcaaaagatg

SEQ ID NO: 10992 - DNA, 103 bp, Artificial Sequence
  Synthetic Polynucleotide
taatacgactcactatagggcagaggatatatcattaaataaaatcgaaaaacagaggagatttcgaatgtatttaatgaacctggcggcagcgcaaaagatg

SEQ ID NO: 10993 - DNA, 103 bp, Artificial Sequence
  Synthetic Polynucleotide
taatacgactcactataggggtatacagaggatatatcattaaataaaataacagaggagaattttaatgaatgatataaacctggcggcagcgcaaaagatg

SEQ ID NO: 10994 - DNA, 103 bp, Artificial Sequence
  Synthetic Polynucleotide
taatacgactcactataggggtgaggtatacagaggatatatcattaaataacagaggagaatttaaatgtatatcctcaacctggcggcagcgcaaaagatg

SEQ ID NO: 10995 - DNA, 103 bp, Artificial Sequence
  Synthetic Polynucleotide
taatacgactcactatagggcattagtgaggtatacagaggatatatcataacagaggagaatgataatgcctctgtataacctggcggcagcgcaaaagatg

SEQ ID NO: 10996 - DNA, 103 bp, Artificial Sequence
  Synthetic Polynucleotide
taatacgactcactataggggagtacattagtgaggtatacagaggatataacagaggagaatatccatggtatacctcaacctggcggcagcgcaaaagatg

SEQ ID NO: 10997 - DNA, 103 bp, Artificial Sequence
  Synthetic Polynucleotide
taatacgactcactatagggtgctcgagtacattagtgaggtatacagagaacagaggagactctgtatgcctcactaaaacctggcggcagcgcaaaagatg

SEQ ID NO: 10998 - DNA, 103 bp, Artificial Sequence
  Synthetic Polynucleotide
taatacgactcactatagggaattatgctcgagtacattagtgaggtataaacagaggagatataccatgctaatgtacaacctggcggcagcgcaaaagatg

SEQ ID NO: 10999 - DNA, 103 bp, Artificial Sequence
  Synthetic Polynucleotide
taatacgactcactatagggagggaaattatgctcgagtacattagtgagaacagaggagactcactatggtactcgagaacctggcggcagcgcaaaagatg

SEQ ID NO: 11000 - DNA, 103 bp, Artificial Sequence
  Synthetic Polynucleotide
taatacgactcactatagggctggatgcagcaggaagcaattcttcgagtaacagaggagaactcgaatgattgcttccaacctggcggcagcgcaaaagatg

SEQ ID NO: 11001 - DNA, 103 bp, Artificial Sequence
  Synthetic Polynucleotide
taatacgactcactatagggctatcagggaaattatgctcgagtacattaaacagaggagataatgtatgcgagcataaaacctggcggcagcgcaaaagatg

SEQ ID NO: 11002 - DNA, 103 bp, Artificial Sequence
  Synthetic Polynucleotide
taatacgactcactatagggcaagtctatcagggaaattatgctcgagtaaacagaggagatactcgatgataatttccaacctggcggcagcgcaaaagatg

SEQ ID NO: 11003 - DNA, 103 bp, Artificial Sequence
  Synthetic Polynucleotide
taatacgactcactatagggacaatcaagtctatcagggaaattatgctcaacagaggagagagcatatgttccctgataacctggcggcagcgcaaaagatg

SEQ ID NO: 11004 - DNA, 103 bp, Artificial Sequence
  Synthetic Polynucleotide
taatacgactcactatagggcaaatacaatcaagtctatcagggaaattaaacagaggagataatttatgtgatagactaacctggcggcagcgcaaaagatg

SEQ ID NO: 11005 - DNA, 103 bp, Artificial Sequence
  Synthetic Polynucleotide
taatacgactcactatagggatcatcaaatacaatcaagtctatcagggaaacagaggagatccctgatggacttgattaacctggcggcagcgcaaaagatg

SEQ ID NO: 11006 - DNA, 103 bp, Artificial Sequence
  Synthetic Polynucleotide
taatacgactcactatagggccttaatcatcaaatacaatcaagtctatcaacagaggagagatagaatggattgtattaacctggcggcagcgcaaaagatg

SEQ ID NO: 11007 - DNA, 103 bp, Artificial Sequence
  Synthetic Polynucleotide
taatacgactcactataggggaggtccttaatcatcaaatacaatcaagtaacagaggagaacttgaatgtatttgatgaacctggcggcagcgcaaaagatg

SEQ ID NO: 11008 - DNA, 103 bp, Artificial Sequence
  Synthetic Polynucleotide
taatacgactcactatagggtttgtgaggtccttaatcatcaaatacaataacagaggagaattgtaatggatgattaaaacctggcggcagcgcaaaagatg

SEQ ID NO: 11009 - DNA, 103 bp, Artificial Sequence
  Synthetic Polynucleotide
taatacgactcactatagggggaattttgtgaggtccttaatcatcaaataacagaggagaatttgaatgttaaggaccaacctggcggcagcgcaaaagatg

SEQ ID NO: 11010 - DNA, 103 bp, Artificial Sequence
  Synthetic Polynucleotide
taatacgactcactatagggccccaggaattttgtgaggtccttaatcataacagaggagaatgattatggacctcacaaacctggcggcagcgcaaaagatg

SEQ ID NO: 11011 - DNA, 103 bp, Artificial Sequence
  Synthetic Polynucleotide
taatacgactcactatagggtgccactggatgcagcaggaagcaattcttaacagaggagaaagaatatgttcctgctgaacctggcggcagcgcaaaagatg

SEQ ID NO: 11012 - DNA, 103 bp, Artificial Sequence
  Synthetic Polynucleotide
taatacgactcactatagggtcaatccccaggaattttgtgaggtccttaaacagaggagataaggaatgcacaaaattaacctggcggcagcgcaaaagatg

SEQ ID NO: 11013 - DNA, 103 bp, Artificial Sequence
  Synthetic Polynucleotide
taatacgactcactatagggtcttttcaatccccaggaattttgtgaggtaacagaggagaacctcaatgaattcctggaacctggcggcagcgcaaaagatg

SEQ ID NO: 11014 - DNA, 103 bp, Artificial Sequence
  Synthetic Polynucleotide
taatacgactcactatagggccagttcttttcaatccccaggaattttgtaacagaggagaacaaaaatgctggggattaacctggcggcagcgcaaaagatg

SEQ ID NO: 11015 - DNA, 103 bp, Artificial Sequence
  Synthetic Polynucleotide
taatacgactcactataggggttatccagttcttttcaatccccaggaataacagaggagaattcctatggattgaaaaaacctggcggcagcgcaaaagatg

SEQ ID NO: 11016 - DNA, 103 bp, Artificial Sequence
  Synthetic Polynucleotide
taatacgactcactatagggattgagttatccagttcttttcaatccccaaacagaggagatggggaatgaaaagaactaacctggcggcagcgcaaaagatg

SEQ ID NO: 11017 - DNA, 103 bp, Artificial Sequence
  Synthetic Polynucleotide
taatacgactcactatagggaatttattgagttatccagttcttttcaataacagaggagaattgaaatgaactggataaacctggcggcagcgcaaaagatg

SEQ ID NO: 11018 - DNA, 103 bp, Artificial Sequence
  Synthetic Polynucleotide
taatacgactcactatagggcataaaatttattgagttatccagttctttaacagaggagaaaagaaatggataactcaaacctggcggcagcgcaaaagatg

SEQ ID NO: 11019 - DNA, 103 bp, Artificial Sequence
  Synthetic Polynucleotide
taatacgactcactatagggcctagcataaaatttattgagttatccagtaacagaggagaactggaatgctcaataaaaacctggcggcagcgcaaaagatg

SEQ ID NO: 11020 - DNA, 103 bp, Artificial Sequence
  Synthetic Polynucleotide
taatacgactcactataggggtggtcctagcataaaatttattgagttataacagaggagaataactatgtaaattttaaacctggcggcagcgcaaaagatg

SEQ ID NO: 11021 - DNA, 103 bp, Artificial Sequence
  Synthetic Polynucleotide
taatacgactcactatagggtatttgtggtcctagcataaaatttattgaaacagaggagatcaataatgtttatgctaaacctggcggcagcgcaaaagatg

SEQ ID NO: 11022 - DNA, 103 bp, Artificial Sequence
  Synthetic Polynucleotide
taatacgactcactataggggctcttgccactggatgcagcaggaagcaaaacagaggagattgcttatggctgcatccaacctggcggcagcgcaaaagatg

SEQ ID NO: 11023 - DNA, 103 bp, Artificial Sequence
  Synthetic Polynucleotide
taatacgactcactatagggaagtgtatttgtggtcctagcataaaatttaacagaggagaaaatttatggctaggaccaacctggcggcagcgcaaaagatg

SEQ ID NO: 11024 - DNA, 103 bp, Artificial Sequence
  Synthetic Polynucleotide
taatacgactcactatagggtcatcaagtgtatttgtggtcctagcataaaacagaggagattatgcatggaccacaaaaacctggcggcagcgcaaaagatg

SEQ ID NO: 11025 - DNA, 103 bp, Artificial Sequence
  Synthetic Polynucleotide
taatacgactcactatagggaatcttcatcaagtgtatttgtggtcctagaacagaggagactaggaatgcaaatacacaacctggcggcagcgcaaaagatg

SEQ ID NO: 11026 - DNA, 103 bp, Artificial Sequence
  Synthetic Polynucleotide
taatacgactcactatagggttcttaatcttcatcaagtgtatttgtggtaacagaggagaaccacaatgacacttgataacctggcggcagcgcaaaagatg

SEQ ID NO: 11027 - DNA, 103 bp, Artificial Sequence
  Synthetic Polynucleotide
taatacgactcactatagggtctttttcttaatcttcatcaagtgtatttaacagaggagaaaatacatgtgatgaagaaacctggcggcagcgcaaaagatg

SEQ ID NO: 11028 - DNA, 103 bp, Artificial Sequence
  Synthetic Polynucleotide
taatacgactcactataggggattatctttttcttaatcttcatcaagtgaacagaggagacacttgatgaagattaagaacctggcggcagcgcaaaagatg

SEQ ID NO: 11029 - DNA, 103 bp, Artificial Sequence
  Synthetic Polynucleotide
taatacgactcactatagggcataagattatctttttcttaatcttcatcaacagaggagagatgaaatgtaagaaaaaaacctggcggcagcgcaaaagatg

SEQ ID NO: 11030 - DNA, 103 bp, Artificial Sequence
  Synthetic Polynucleotide
taatacgactcactatagggataatcataagattatctttttcttaatctaacagaggagaagattaatgaaaagataaaacctggcggcagcgcaaaagatg

SEQ ID NO: 11031 - DNA, 103 bp, Artificial Sequence
  Synthetic Polynucleotide
taatacgactcactatagggcaatgataatcataagattatctttttcttaacagaggagaaagaaaatgataatcttaaacctggcggcagcgcaaaagatg

SEQ ID NO: 11032 - DNA, 103 bp, Artificial Sequence
  Synthetic Polynucleotide
taatacgactcactatagggaagatcaatgataatcataagattatctttaacagaggagaaaagatatgcttatgattaacctggcggcagcgcaaaagatg

SEQ ID NO: 11033 - DNA, 103 bp, Artificial Sequence
  Synthetic Polynucleotide
taatacgactcactatagggctgatgctcttgccactggatgcagcaggaaacagaggagatcctgcatgatccagtggaacctggcggcagcgcaaaagatg

SEQ ID NO: 11034 - DNA, 103 bp, Artificial Sequence
  Synthetic Polynucleotide
taatacgactcactatagggagatgaagatcaatgataatcataagattaaacagaggagataatctatggattatcataacctggcggcagcgcaaaagatg

SEQ ID NO: 11035 - DNA, 103 bp, Artificial Sequence
  Synthetic Polynucleotide
taatacgactcactatagggggtatagatgaagatcaatgataatcataaaacagaggagattatgaatgtcattgatcaacctggcggcagcgcaaaagatg

SEQ ID NO: 11036 - DNA, 103 bp, Artificial Sequence
  Synthetic Polynucleotide
taatacgactcactatagggtttaaggtatagatgaagatcaatgataataacagaggagaattatcatggatcttcataacctggcggcagcgcaaaagatg

SEQ ID NO: 11037 - DNA, 103 bp, Artificial Sequence
  Synthetic Polynucleotide
taatacgactcactataggggagtatttaaggtatagatgaagatcaatgaacagaggagacattgaatgtcatctataaacctggcggcagcgcaaaagatg

SEQ ID NO: 11038 - DNA, 103 bp, Artificial Sequence
  Synthetic Polynucleotide
taatacgactcactataggggaatagagtatttaaggtatagatgaagataacagaggagaatcttcatgtataccttaaacctggcggcagcgcaaaagatg

SEQ ID NO: 11039 - DNA, 103 bp, Artificial Sequence
  Synthetic Polynucleotide
taatacgactcactatagggtccttgaatagagtatttaaggtatagatgaacagaggagacatctaatgcttaaatacaacctggcggcagcgcaaaagatg

SEQ ID NO: 11040 - DNA, 103 bp, Artificial Sequence
  Synthetic Polynucleotide
taatacgactcactatagggtactctccttgaatagagtatttaaggtataacagaggagaatacctatgatactctataacctggcggcagcgcaaaagatg

SEQ ID NO: 11041 - DNA, 103 bp, Artificial Sequence
  Synthetic Polynucleotide
taatacgactcactatagggtgtcatactctccttgaatagagtatttaaaacagaggagattaaatatgctattcaagaacctggcggcagcgcaaaagatg

SEQ ID NO: 11042 - DNA, 103 bp, Artificial Sequence
  Synthetic Polynucleotide
taatacgactcactatagggggttttgtcatactctccttgaatagagtaaacagaggagatactctatgcaaggagagaacctggcggcagcgcaaaagatg

SEQ ID NO: 11043 - DNA, 103 bp, Artificial Sequence
  Synthetic Polynucleotide
taatacgactcactatagggtacttggttttgtcatactctccttgaataaacagaggagatattcaatgagagtatgaaacctggcggcagcgcaaaagatg

SEQ ID NO: 11044 - DNA, 103 bp, Artificial Sequence
  Synthetic Polynucleotide
taatacgactcactatagggttctcctgatgctcttgccactggatgcagaacagaggagactgcatatggtggcaagaaacctggcggcagcgcaaaagatg

SEQ ID NO: 11045 - DNA, 103 bp, Artificial Sequence
  Synthetic Polynucleotide
taatacgactcactatagggaatactacttggttttgtcatactctccttaacagaggagaaaggagatgatgacaaaaaacctggcggcagcgcaaaagatg

SEQ ID NO: 11046 - DNA, 103 bp, Artificial Sequence
  Synthetic Polynucleotide
taatacgactcactatagggtatccaatactacttggttttgtcatactcaacagaggagagagtatatgaaaaccaagaacctggcggcagcgcaaaagatg

SEQ ID NO: 11047 - DNA, 103 bp, Artificial Sequence
  Synthetic Polynucleotide
taatacgactcactatagggaagtttatccaatactacttggttttgtcaaacagaggagatgacaaatgcaagtagtaaacctggcggcagcgcaaaagatg

SEQ ID NO: 11048 - DNA, 103 bp, Artificial Sequence
  Synthetic Polynucleotide
taatacgactcactatagggaggacaagtttatccaatactacttggtttaacagaggagaaaaccaatgagtattggaaacctggcggcagcgcaaaagatg

SEQ ID NO: 11049 - DNA, 103 bp, Artificial Sequence
  Synthetic Polynucleotide
taatacgactcactatagggaatgcaggacaagtttatccaatactacttaacagaggagaaagtagatgtggataaacaacctggcggcagcgcaaaagatg

SEQ ID NO: 11050 - DNA, 103 bp, Artificial Sequence
  Synthetic Polynucleotide
taatacgactcactatagggatttgaatgcaggacaagtttatccaatacaacagaggagagtattgatgaaacttgtcaacctggcggcagcgcaaaagatg

SEQ ID NO: 11051 - DNA, 103 bp, Artificial Sequence
  Synthetic Polynucleotide
taatacgactcactatagggttcagatttgaatgcaggacaagtttatccaacagaggagaggataaatgtgtcctgcaaacctggcggcagcgcaaaagatg

SEQ ID NO: 11052 - DNA, 103 bp, Artificial Sequence
  Synthetic Polynucleotide
taatacgactcactatagggatgtcttcagatttgaatgcaggacaagttaacagaggagaaacttgatgtgcattcaaaacctggcggcagcgcaaaagatg

SEQ ID NO: 11053 - DNA, 103 bp, Artificial Sequence
  Synthetic Polynucleotide
taatacgactcactataggggccgtatgtcttcagatttgaatgcaggacaacagaggagagtcctgatgtcaaatctgaacctggcggcagcgcaaaagatg

SEQ ID NO: 11054 - DNA, 103 bp, Artificial Sequence
  Synthetic Polynucleotide
taatacgactcactataggggataagccgtatgtcttcagatttgaatgcaacagaggagagcattcatgtctgaagacaacctggcggcagcgcaaaagatg

SEQ ID NO: 11055 - DNA, 103 bp, Artificial Sequence
  Synthetic Polynucleotide
taatacgactcactatagggcagtgttctcctgatgctcttgccactggaaacagaggagatccagtatgaagagcatcaacctggcggcagcgcaaaagatg

SEQ ID NO: 11056 - DNA, 103 bp, Artificial Sequence
  Synthetic Polynucleotide
taatacgactcactataggggaatagataagccgtatgtcttcagatttgaacagaggagacaaatcatgagacatacgaacctggcggcagcgcaaaagatg

SEQ ID NO: 11057 - DNA, 103 bp, Artificial Sequence
  Synthetic Polynucleotide
taatacgactcactatagggatagtgaatagataagccgtatgtcttcagaacagaggagactgaagatgtacggcttaaacctggcggcagcgcaaaagatg

SEQ ID NO: 11058 - DNA, 103 bp, Artificial Sequence
  Synthetic Polynucleotide
taatacgactcactatagggatacaatagtgaatagataagccgtatgtcaacagaggagagacataatgcttatctataacctggcggcagcgcaaaagatg

SEQ ID NO: 11059 - DNA, 103 bp, Artificial Sequence
  Synthetic Polynucleotide
taatacgactcactatagggttctaatacaatagtgaatagataagccgtaacagaggagaacggctatgctattcactaacctggcggcagcgcaaaagatg

SEQ ID NO: 11060 - DNA, 103 bp, Artificial Sequence
  Synthetic Polynucleotide
taatacgactcactatagggagattttctaatacaatagtgaatagataaaacagaggagattatctatgcactattgtaacctggcggcagcgcaaaagatg

SEQ ID NO: 11061 - DNA, 103 bp, Artificial Sequence
  Synthetic Polynucleotide
taatacgactcactatagggtccctagattttctaatacaatagtgaataaacagaggagatattcaatgttgtattagaacctggcggcagcgcaaaagatg

SEQ ID NO: 11062 - DNA, 103 bp, Artificial Sequence
  Synthetic Polynucleotide
taatacgactcactataggggatattccctagattttctaatacaatagtaacagaggagaactattatgttagaaaataacctggcggcagcgcaaaagatg

SEQ ID NO: 11063 - DNA, 103 bp, Artificial Sequence
  Synthetic Polynucleotide
taatacgactcactatagggcaaatgatattccctagattttctaatacaaacagaggagatgtattatgaaatctaggaacctggcggcagcgcaaaagatg

SEQ ID NO: 11064 - DNA, 103 bp, Artificial Sequence
  Synthetic Polynucleotide
taatacgactcactatagggagtttcaaatgatattccctagattttctaaacagaggagatagaaaatgtagggaataaacctggcggcagcgcaaaagatg

SEQ ID NO: 11065 - DNA, 103 bp, Artificial Sequence
  Synthetic Polynucleotide
taatacgactcactatagggtaattagtttcaaatgatattccctagattaacagaggagaaatctaatgaatatcattaacctggcggcagcgcaaaagatg

SEQ ID NO: 11066 - DNA, 103 bp, Artificial Sequence
  Synthetic Polynucleotide
taatacgactcactataggggcagccagtgttctcctgatgctcttgccaaacagaggagatggcaaatgcatcaggagaacctggcggcagcgcaaaagatg

SEQ ID NO: 11067 - DNA, 103 bp, Artificial Sequence
  Synthetic Polynucleotide
taatacgactcactataggggtcactaattagtttcaaatgatattccctaacagaggagaagggaaatgcatttgaaaaacctggcggcagcgcaaaagatg

SEQ ID NO: 11068 - DNA, 103 bp, Artificial Sequence
  Synthetic Polynucleotide
taatacgactcactatagggttttagtcactaattagtttcaaatgatataacagaggagaatatcaatggaaactaataacctggcggcagcgcaaaagatg

SEQ ID NO: 11069 - DNA, 103 bp, Artificial Sequence
  Synthetic Polynucleotide
taatacgactcactataggggtgtgttttagtcactaattagtttcaaataacagaggagaatttgaatgtaattagtgaacctggcggcagcgcaaaagatg

SEQ ID NO: 11070 - DNA, 103 bp, Artificial Sequence
  Synthetic Polynucleotide
taatacgactcactataggggagttgtgtgttttagtcactaattagtttaacagaggagaaaactaatgagtgactaaaacctggcggcagcgcaaaagatg

SEQ ID NO: 11071 - DNA, 103 bp, Artificial Sequence
  Synthetic Polynucleotide
taatacgactcactataggggacttgagttgtgtgttttagtcactaattaacagaggagaaattagatgctaaaacacaacctggcggcagcgcaaaagatg

SEQ ID NO: 11072 - DNA, 103 bp, Artificial Sequence
  Synthetic Polynucleotide
taatacgactcactatagggtggccgacttgagttgtgtgttttagtcacaacagaggagagtgactatgacacacaacaacctggcggcagcgcaaaagatg

SEQ ID NO: 11073 - DNA, 103 bp, Artificial Sequence
  Synthetic Polynucleotide
taatacgactcactatagggcattctggccgacttgagttgtgtgttttaaacagaggagataaaacatgcaactcaagaacctggcggcagcgcaaaagatg

SEQ ID NO: 11074 - DNA, 103 bp, Artificial Sequence
  Synthetic Polynucleotide
taatacgactcactatagggacttccattctggccgacttgagttgtgtgaacagaggagacacacaatgcaagtcggcaacctggcggcagcgcaaaagatg

SEQ ID NO: 11075 - DNA, 103 bp, Artificial Sequence
  Synthetic Polynucleotide
taatacgactcactataggggaacaacttccattctggccgacttgagttaacagaggagaaactcaatgcggccagaaaacctggcggcagcgcaaaagatg

SEQ ID NO: 11076 - DNA, 103 bp, Artificial Sequence
  Synthetic Polynucleotide
taatacgactcactatagggttcatgaacaacttccattctggccgacttaacagaggagaaagtcgatgagaatggaaaacctggcggcagcgcaaaagatg

SEQ ID NO: 11077 - DNA, 103 bp, Artificial Sequence
  Synthetic Polynucleotide
taatacgactcactataggggagaatcttaatcttaatgtaagtgtcaataacagaggagaattgacatgtacattaagaacctggcggcagcgcaaaagatg

SEQ ID NO: 11078 - DNA, 103 bp, Artificial Sequence
  Synthetic Polynucleotide
taatacgactcactataggggcattgcagccagtgttctcctgatgctctaacagaggagaagagcaatgggagaacacaacctggcggcagcgcaaaagatg

SEQ ID NO: 11079 - DNA, 103 bp, Artificial Sequence
  Synthetic Polynucleotide
taatacgactcactatagggcctctttcatgaacaacttccattctggccaacagaggagaggccagatgggaagttgtaacctggcggcagcgcaaaagatg

SEQ ID NO: 11080 - DNA, 103 bp, Artificial Sequence
  Synthetic Polynucleotide
taatacgactcactatagggagcgacctctttcatgaacaacttccattcaacagaggagagaatggatgttgttcatgaacctggcggcagcgcaaaagatg

SEQ ID NO: 11081 - DNA, 103 bp, Artificial Sequence
  Synthetic Polynucleotide
taatacgactcactatagggcctggagcgacctctttcatgaacaacttcaacagaggagagaagttatgcatgaaagaaacctggcggcagcgcaaaagatg

SEQ ID NO: 11082 - DNA, 103 bp, Artificial Sequence
  Synthetic Polynucleotide
taatacgactcactataggggagatcctggagcgacctctttcatgaacaaacagaggagatgttcaatgaagaggtcgaacctggcggcagcgcaaaagatg

SEQ ID NO: 11083 - DNA, 103 bp, Artificial Sequence
  Synthetic Polynucleotide
taatacgactcactataggggtcgggagatcctggagcgacctctttcataacagaggagaatgaaaatggtcgctccaaacctggcggcagcgcaaaagatg

SEQ ID NO: 11084 - DNA, 103 bp, Artificial Sequence
  Synthetic Polynucleotide
taatacgactcactataggggttttgtcgggagatcctggagcgacctctaacagaggagaagaggtatgtccaggatcaacctggcggcagcgcaaaagatg

SEQ ID NO: 11085 - DNA, 103 bp, Artificial Sequence
  Synthetic Polynucleotide
taatacgactcactatagggcttgtgttttgtcgggagatcctggagcgaaacagaggagatcgctcatggatctcccgaacctggcggcagcgcaaaagatg

SEQ ID NO: 11086 - DNA, 103 bp, Artificial Sequence
  Synthetic Polynucleotide
taatacgactcactatagggcatcccttgtgttttgtcgggagatcctggaacagaggagaccaggaatgcccgacaaaaacctggcggcagcgcaaaagatg

SEQ ID NO: 11087 - DNA, 103 bp, Artificial Sequence
  Synthetic Polynucleotide
taatacgactcactatagggaggtccatcccttgtgttttgtcgggagataacagaggagaatctccatgcaaaacacaaacctggcggcagcgcaaaagatg

SEQ ID NO: 11088 - DNA, 103 bp, Artificial Sequence
  Synthetic Polynucleotide
taatacgactcactatagggtgactaggtccatcccttgtgttttgtcggaacagaggagaccgacaatgcacaagggaaacctggcggcagcgcaaaagatg

SEQ ID NO: 11089 - DNA, 103 bp, Artificial Sequence
  Synthetic Polynucleotide
taatacgactcactatagggttcaggcattgcagccagtgttctcctgataacagaggagaatcaggatgacactggctaacctggcggcagcgcaaaagatg

SEQ ID NO: 11090 - DNA, 103 bp, Artificial Sequence
  Synthetic Polynucleotide
taatacgactcactatagggctaaatgactaggtccatcccttgtgttttaacagaggagaaaaacaatggggatggacaacctggcggcagcgcaaaagatg

SEQ ID NO: 11091 - DNA, 103 bp, Artificial Sequence
  Synthetic Polynucleotide
taatacgactcactatagggccgtactaaatgactaggtccatcccttgtaacagaggagaacaaggatgggacctagtaacctggcggcagcgcaaaagatg

SEQ ID NO: 11092 - DNA, 103 bp, Artificial Sequence
  Synthetic Polynucleotide
taatacgactcactatagggctcgcccgtactaaatgactaggtccatccaacagaggagaggatggatgtagtcatttaacctggcggcagcgcaaaagatg

SEQ ID NO: 11093 - DNA, 103 bp, Artificial Sequence
  Synthetic Polynucleotide
taatacgactcactatagggatgatctcgcccgtactaaatgactaggtcaacagaggagagacctaatgatttagtacaacctggcggcagcgcaaaagatg

SEQ ID NO: 11094 - DNA, 103 bp, Artificial Sequence
  Synthetic Polynucleotide
taatacgactcactatagggagaggatgatctcgcccgtactaaatgactaacagaggagaagtcatatggtacgggcgaacctggcggcagcgcaaaagatg

SEQ ID NO: 11095 - DNA, 103 bp, Artificial Sequence
  Synthetic Polynucleotide
taatacgactcactataggggctcgagaggatgatctcgcccgtactaaaaacagaggagatttagtatgggcgagatcaacctggcggcagcgcaaaagatg

SEQ ID NO: 11096 - DNA, 103 bp, Artificial Sequence
  Synthetic Polynucleotide
taatacgactcactatagggaactagctcgagaggatgatctcgcccgtaaacagaggagatacgggatggatcatcctaacctggcggcagcgcaaaagatg

SEQ ID NO: 11097 - DNA, 103 bp, Artificial Sequence
  Synthetic Polynucleotide
taatacgactcactatagggtcgataactagctcgagaggatgatctcgcaacagaggagagcgagaatgtcctctcgaaacctggcggcagcgcaaaagatg

SEQ ID NO: 11098 - DNA, 103 bp, Artificial Sequence
  Synthetic Polynucleotide
taatacgactcactatagggtcacttcgataactagctcgagaggatgataacagaggagaatcatcatgtcgagctagaacctggcggcagcgcaaaagatg

SEQ ID NO: 11099 - DNA, 103 bp, Artificial Sequence
  Synthetic Polynucleotide
taatacgactcactatagggggtattcacttcgataactagctcgagaggaacagaggagacctctcatgctagttatcaacctggcggcagcgcaaaagatg

SEQ ID NO: 11100 - DNA, 103 bp, Artificial Sequence
  Synthetic Polynucleotide
taatacgactcactatagggtcctcttcaggcattgcagccagtgttctcaacagaggagagagaacatgggctgcaataacctggcggcagcgcaaaagatg

SEQ ID NO: 11101 - DNA, 103 bp, Artificial Sequence
  Synthetic Polynucleotide
taatacgactcactatagggtgtatggtattcacttcgataactagctcgaacagaggagacgagctatgtatcgaagtaacctggcggcagcgcaaaagatg

SEQ ID NO: 11102 - DNA, 103 bp, Artificial Sequence
  Synthetic Polynucleotide
taatacgactcactatagggcttggtgtatggtattcacttcgataactaaacagaggagatagttaatgaagtgaataaacctggcggcagcgcaaaagatg

SEQ ID NO: 11103 - DNA, 103 bp, Artificial Sequence
  Synthetic Polynucleotide
taatacgactcactatagggcactccttggtgtatggtattcacttcgataacagaggagaatcgaaatgaataccataaacctggcggcagcgcaaaagatg

SEQ ID NO: 11104 - DNA, 103 bp, Artificial Sequence
  Synthetic Polynucleotide
taatacgactcactatagggcgaggcactccttggtgtatggtattcactaacagaggagaagtgaaatgcatacaccaaacctggcggcagcgcaaaagatg

SEQ ID NO: 11105 - DNA, 103 bp, Artificial Sequence
  Synthetic Polynucleotide
taatacgactcactatagggatctgcgaggcactccttggtgtatggtataacagaggagaataccaatgaccaaggagaacctggcggcagcgcaaaagatg

SEQ ID NO: 11106 - DNA, 103 bp, Artificial Sequence
  Synthetic Polynucleotide
taatacgactcactatagggcacggatctgcgaggcactccttggtgtataacagaggagaatacacatgggagtgcctaacctggcggcagcgcaaaagatg

SEQ ID NO: 11107 - DNA, 103 bp, Artificial Sequence
  Synthetic Polynucleotide
taatacgactcactatagggggggacacggatctgcgaggcactccttggaacagaggagaccaaggatggcctcgcagaacctggcggcagcgcaaaagatg

SEQ ID NO: 11108 - DNA, 103 bp, Artificial Sequence
  Synthetic Polynucleotide
taatacgactcactatagggacagtggggacacggatctgcgaggcactcaacagaggagagagtgcatggcagatccgaacctggcggcagcgcaaaagatg

SEQ ID NO: 11109 - DNA, 103 bp, Artificial Sequence
  Synthetic Polynucleotide
taatacgactcactataggggaaagacagtggggacacggatctgcgaggaacagaggagacctcgcatgtccgtgtccaacctggcggcagcgcaaaagatg

SEQ ID NO: 11110 - DNA, 103 bp, Artificial Sequence
  Synthetic Polynucleotide
taatacgactcactatagggccgatgaaagacagtggggacacggatctgaacagaggagacagatcatggtccccactaacctggcggcagcgcaaaagatg

SEQ ID NO: 11111 - DNA, 103 bp, Artificial Sequence
  Synthetic Polynucleotide
taatacgactcactatagggttgtctcctcttcaggcattgcagccagtgaacagaggagacactggatgcaatgcctgaacctggcggcagcgcaaaagatg

SEQ ID NO: 11112 - DNA, 103 bp, Artificial Sequence
  Synthetic Polynucleotide
taatacgactcactatagggtttttccgatgaaagacagtggggacacggaacagaggagaccgtgtatgcactgtcttaacctggcggcagcgcaaaagatg

SEQ ID NO: 11113 - DNA, 103 bp, Artificial Sequence
  Synthetic Polynucleotide
taatacgactcactatagggctgtctttttccgatgaaagacagtggggaaacagaggagatccccaatgtctttcatcaacctggcggcagcgcaaaagatg

SEQ ID NO: 11114 - DNA, 103 bp, Artificial Sequence
  Synthetic Polynucleotide
taatacgactcactatagggtaaatctgtctttttccgatgaaagacagtaacagaggagaactgtcatgcatcggaaaaacctggcggcagcgcaaaagatg

SEQ ID NO: 11115 - DNA, 103 bp, Artificial Sequence
  Synthetic Polynucleotide
taatacgactcactataggggtcaataaatctgtctttttccgatgaaagaacagaggagactttcaatggaaaaagacaacctggcggcagcgcaaaagatg

SEQ ID NO: 11116 - DNA, 103 bp, Artificial Sequence
  Synthetic Polynucleotide
taatacgactcactataggggaactgtcaataaatctgtctttttccgataacagaggagaatcggaatgagacagattaacctggcggcagcgcaaaagatg

SEQ ID NO: 11117 - DNA, 103 bp, Artificial Sequence
  Synthetic Polynucleotide
taatacgactcactatagggtggtggaactgtcaataaatctgtctttttaacagaggagaaaaaagatggatttattgaacctggcggcagcgcaaaagatg

SEQ ID NO: 11118 - DNA, 103 bp, Artificial Sequence
  Synthetic Polynucleotide
taatacgactcactatagggggtgctggtggaactgtcaataaatctgtcaacagaggagagacagaatgattgacagtaacctggcggcagcgcaaaagatg

SEQ ID NO: 11119 - DNA, 103 bp, Artificial Sequence
  Synthetic Polynucleotide
taatacgactcactatagggctttaggtgctggtggaactgtcaataaataacagaggagaatttatatgcagttccacaacctggcggcagcgcaaaagatg

SEQ ID NO: 11120 - DNA, 103 bp, Artificial Sequence
  Synthetic Polynucleotide
taatacgactcactatagggtacatctttaggtgctggtggaactgtcaaaacagaggagattgacaatgccaccagcaaacctggcggcagcgcaaaagatg

SEQ ID NO: 11121 - DNA, 103 bp, Artificial Sequence
  Synthetic Polynucleotide
taatacgactcactataggggggcatacatctttaggtgctggtggaactaacagaggagaagttccatgagcacctaaaacctggcggcagcgcaaaagatg

SEQ ID NO: 11122 - DNA, 103 bp, Artificial Sequence
  Synthetic Polynucleotide
taatacgactcactatagggttctgttgtctcctcttcaggcattgcagcaacagaggagagctgcaatgcctgaagagaacctggcggcagcgcaaaagatg

SEQ ID NO: 11123 - DNA, 103 bp, Artificial Sequence
  Synthetic Polynucleotide
taatacgactcactatagggaagtcgggcatacatctttaggtgctggtgaacagaggagacaccagatgctaaagatgaacctggcggcagcgcaaaagatg

SEQ ID NO: 11124 - DNA, 103 bp, Artificial Sequence
  Synthetic Polynucleotide
taatacgactcactatagggctttaaagtcgggcatacatctttaggtgcaacagaggagagcacctatggatgtatgcaacctggcggcagcgcaaaagatg

SEQ ID NO: 11125 - DNA, 103 bp, Artificial Sequence
  Synthetic Polynucleotide
taatacgactcactatagggcctttctttaaagtcgggcatacatctttaaacagaggagataaagaatgatgcccgacaacctggcggcagcgcaaaagatg

SEQ ID NO: 11126 - DNA, 103 bp, Artificial Sequence
  Synthetic Polynucleotide
taatacgactcactataggggaaaccctttctttaaagtcgggcatacataacagaggagaatgtatatgcgactttaaaacctggcggcagcgcaaaagatg

SEQ ID NO: 11127 - DNA, 103 bp, Artificial Sequence
  Synthetic Polynucleotide
taatacgactcactatagggacatagaaaccctttctttaaagtcgggcaaacagaggagatgcccgatgttaaagaaaaacctggcggcagcgcaaaagatg

SEQ ID NO: 11128 - DNA, 103 bp, Artificial Sequence
  Synthetic Polynucleotide
taatacgactcactatagggctgtcacatagaaaccctttctttaaagtcaacagaggagagactttatggaaagggttaacctggcggcagcgcaaaagatg

SEQ ID NO: 11129 - DNA, 103 bp, Artificial Sequence
  Synthetic Polynucleotide
taatacgactcactatagggaattgctgtcacatagaaaccctttctttaaacagaggagataaagaatgggtttctataacctggcggcagcgcaaaagatg

SEQ ID NO: 11130 - DNA, 103 bp, Artificial Sequence
  Synthetic Polynucleotide
taatacgactcactatagggacagaaattgctgtcacatagaaaccctttaacagaggagaaaagggatgctatgtgacaacctggcggcagcgcaaaagatg

SEQ ID NO: 11131 - DNA, 103 bp, Artificial Sequence
  Synthetic Polynucleotide
taatacgactcactatagggtttttacagaaattgctgtcacatagaaacaacagaggagagtttctatgtgacagcaaaacctggcggcagcgcaaaagatg

SEQ ID NO: 11132 - DNA, 103 bp, Artificial Sequence
  Synthetic Polynucleotide
taatacgactcactataggggatcctttttacagaaattgctgtcacataaacagaggagatatgtgatggcaatttctaacctggcggcagcgcaaaagatg

SEQ ID NO: 11133 - DNA, 103 bp, Artificial Sequence
  Synthetic Polynucleotide
taatacgactcactatagggtttgcttctgttgtctcctcttcaggcattaacagaggagaaatgccatgagaggagacaacctggcggcagcgcaaaagatg

SEQ ID NO: 11134 - DNA, 103 bp, Artificial Sequence
  Synthetic Polynucleotide
taatacgactcactatagggttggtgatcctttttacagaaattgctgtcaacagaggagagacagcatgttctgtaaaaacctggcggcagcgcaaaagatg

SEQ ID NO: 11135 - DNA, 103 bp, Artificial Sequence
  Synthetic Polynucleotide
taatacgactcactatagggtcaagttggtgatcctttttacagaaattgaacagaggagacaatttatgtaaaaaggaaacctggcggcagcgcaaaagatg

SEQ ID NO: 11136 - DNA, 103 bp, Artificial Sequence
  Synthetic Polynucleotide
taatacgactcactatagggagctttcaagttggtgatcctttttacagaaacagaggagatctgtaatgaggatcaccaacctggcggcagcgcaaaagatg

SEQ ID NO: 11137 - DNA, 103 bp, Artificial Sequence
  Synthetic Polynucleotide
taatacgactcactatagggtgttaagctttcaagttggtgatcctttttaacagaggagaaaaaagatgcaccaacttaacctggcggcagcgcaaaagatg

SEQ ID NO: 11138 - DNA, 103 bp, Artificial Sequence
  Synthetic Polynucleotide
taatacgactcactatagggctatctgttaagctttcaagttggtgatccaacagaggagaggatcaatgacttgaaagaacctggcggcagcgcaaaagatg

SEQ ID NO: 11139 - DNA, 103 bp, Artificial Sequence
  Synthetic Polynucleotide
taatacgactcactatagggactctctatctgttaagctttcaagttggtaacagaggagaaccaacatgaaagcttaaaacctggcggcagcgcaaaagatg

SEQ ID NO: 11140 - DNA, 103 bp, Artificial Sequence
  Synthetic Polynucleotide
taatacgactcactataggggagtaactctctatctgttaagctttcaagaacagaggagacttgaaatgttaacagataacctggcggcagcgcaaaagatg

SEQ ID NO: 11141 - DNA, 103 bp, Artificial Sequence
  Synthetic Polynucleotide
taatacgactcactatagggagcaagagtaactctctatctgttaagcttaacagaggagaaagcttatgagatagagaaacctggcggcagcgcaaaagatg

SEQ ID NO: 11142 - DNA, 103 bp, Artificial Sequence
  Synthetic Polynucleotide
taatacgactcactatagggcaatcagcaagagtaactctctatctgttaaacagaggagataacagatggagagttacaacctggcggcagcgcaaaagatg

SEQ ID NO: 11143 - DNA, 103 bp, Artificial Sequence
  Synthetic Polynucleotide
taatacgactcactataggggcgtgcaatcagcaagagtaactctctatcaacagaggagagatagaatgttactcttgaacctggcggcagcgcaaaagatg

SEQ ID NO: 11144 - DNA, 103 bp, Artificial Sequence
  Synthetic Polynucleotide
taatacgactcactatagggcggcatttgcttctgttgtctcctcttcagaacagaggagactgaagatgagacaacagaacctggcggcagcgcaaaagatg

SEQ ID NO: 11145 - DNA, 103 bp, Artificial Sequence
  Synthetic Polynucleotide
taatacgactcactataggggtcttgcgtgcaatcagcaagagtaactctaacagaggagaagagttatgcttgctgataacctggcggcagcgcaaaagatg

SEQ ID NO: 11146 - DNA, 103 bp, Artificial Sequence
  Synthetic Polynucleotide
taatacgactcactatagggcacatgtcttgcgtgcaatcagcaagagtaaacagaggagatactctatgtgattgcacaacctggcggcagcgcaaaagatg

SEQ ID NO: 11147 - DNA, 103 bp, Artificial Sequence
  Synthetic Polynucleotide
taatacgactcactatagggggatccacatgtcttgcgtgcaatcagcaaaacagaggagattgctgatggcacgcaagaacctggcggcagcgcaaaagatg

SEQ ID NO: 11148 - DNA, 103 bp, Artificial Sequence
  Synthetic Polynucleotide
taatacgactcactatagggtccgtggatccacatgtcttgcgtgcaatcaacagaggagagattgcatgcaagacatgaacctggcggcagcgcaaaagatg

SEQ ID NO: 11149 - DNA, 103 bp, Artificial Sequence
  Synthetic Polynucleotide
taatacgactcactataggggttgttccgtggatccacatgtcttgcgtgaacagaggagacacgcaatgcatgtggataacctggcggcagcgcaaaagatg

SEQ ID NO: 11150 - DNA, 103 bp, Artificial Sequence
  Synthetic Polynucleotide
taatacgactcactatagggtagttgttgttccgtggatccacatgtcttaacagaggagaaagacaatgggatccacgaacctggcggcagcgcaaaagatg

SEQ ID NO: 11151 - DNA, 103 bp, Artificial Sequence
  Synthetic Polynucleotide
taatacgactcactatagggatgcttagttgttgttccgtggatccacataacagaggagaatgtggatgcacggaacaaacctggcggcagcgcaaaagatg

SEQ ID NO: 11152 - DNA, 103 bp, Artificial Sequence
  Synthetic Polynucleotide
taatacgactcactatagggcaactatgcttagttgttgttccgtggatcaacagaggagagatccaatgaacaacaacaacctggcggcagcgcaaaagatg

SEQ ID NO: 11153 - DNA, 103 bp, Artificial Sequence
  Synthetic Polynucleotide
taatacgactcactatagggtggagcaactatgcttagttgttgttccgtaacagaggagaacggaaatgcaactaagcaacctggcggcagcgcaaaagatg

SEQ ID NO: 11154 - DNA, 103 bp, Artificial Sequence
  Synthetic Polynucleotide
taatacgactcactatagggtcttttggagcaactatgcttagttgttgtaacagaggagaacaacaatgaagcatagtaacctggcggcagcgcaaaagatg

SEQ ID NO: 11155 - DNA, 103 bp, Artificial Sequence
  Synthetic Polynucleotide
taatacgactcactatagggctgtccggcatttgcttctgttgtctcctcaacagaggagagaggagatgacagaagcaaacctggcggcagcgcaaaagatg

SEQ ID NO: 11156 - DNA, 103 bp, Artificial Sequence
  Synthetic Polynucleotide
taatacgactcactataggggtgaatcttttggagcaactatgcttagttaacagaggagaaactaaatgtagttgctcaacctggcggcagcgcaaaagatg

SEQ ID NO: 11157 - DNA, 103 bp, Artificial Sequence
  Synthetic Polynucleotide
taatacgactcactatagggcagacgtgaatcttttggagcaactatgctaacagaggagaagcataatggctccaaaaaacctggcggcagcgcaaaagatg

SEQ ID NO: 11158 - DNA, 103 bp, Artificial Sequence
  Synthetic Polynucleotide
taatacgactcactatagggttagccagacgtgaatcttttggagcaactaacagaggagaagttgcatgaaaagattcaacctggcggcagcgcaaaagatg

SEQ ID NO: 11159 - DNA, 103 bp, Artificial Sequence
  Synthetic Polynucleotide
taatacgactcactatagggtaggattagccagacgtgaatcttttggagaacagaggagactccaaatgattcacgtcaacctggcggcagcgcaaaagatg

SEQ ID NO: 11160 - DNA, 103 bp, Artificial Sequence
  Synthetic Polynucleotide
taatacgactcactatagggagcaataggattagccagacgtgaatctttaacagaggagaaaagatatgcgtctggctaacctggcggcagcgcaaaagatg

SEQ ID NO: 11161 - DNA, 103 bp, Artificial Sequence
  Synthetic Polynucleotide
taatacgactcactatagggtcctcagcaataggattagccagacgtgaaaacagaggagattcacgatgggctaatccaacctggcggcagcgcaaaagatg

SEQ ID NO: 11162 - DNA, 103 bp, Artificial Sequence
  Synthetic Polynucleotide
taatacgactcactatagggggaaatcctcagcaataggattagccagacaacagaggagagtctggatgatcctattgaacctggcggcagcgcaaaagatg

SEQ ID NO: 11163 - DNA, 103 bp, Artificial Sequence
  Synthetic Polynucleotide
taatacgactcactatagggttgttggaaatcctcagcaataggattagcaacagaggagagctaatatgattgctgagaacctggcggcagcgcaaaagatg

SEQ ID NO: 11164 - DNA, 103 bp, Artificial Sequence
  Synthetic Polynucleotide
taatacgactcactatagggtctttttgttggaaatcctcagcaataggaaacagaggagatcctatatgtgaggatttaacctggcggcagcgcaaaagatg

SEQ ID NO: 11165 - DNA, 103 bp, Artificial Sequence
  Synthetic Polynucleotide
taatacgactcactataggggcccatctttttgttggaaatcctcagcaaaacagaggagattgctgatgatttccaacaacctggcggcagcgcaaaagatg

SEQ ID NO: 11166 - DNA, 103 bp, Artificial Sequence
  Synthetic Polynucleotide
taatacgactcactatagggaggaactgtccggcatttgcttctgttgtcaacagaggagagacaacatgagcaaatgcaacctggcggcagcgcaaaagatg

SEQ ID NO: 11167 - DNA, 103 bp, Artificial Sequence
  Synthetic Polynucleotide
taatacgactcactatagggcttaggcccatctttttgttggaaatcctcaacagaggagagaggatatgcaacaaaaaaacctggcggcagcgcaaaagatg

SEQ ID NO: 11168 - DNA, 103 bp, Artificial Sequence
  Synthetic Polynucleotide
taatacgactcactataggggttaccttaggcccatctttttgttggaaaaacagaggagatttccaatgaaaagatggaacctggcggcagcgcaaaagatg

SEQ ID NO: 11169 - DNA, 103 bp, Artificial Sequence
  Synthetic Polynucleotide
taatacgactcactatagggacagtgttaccttaggcccatctttttgttaacagaggagaaacaaaatgatgggcctaaacctggcggcagcgcaaaagatg

SEQ ID NO: 11170 - DNA, 103 bp, Artificial Sequence
  Synthetic Polynucleotide
taatacgactcactatagggcatcgacagtgttaccttaggcccatctttaacagaggagaaaagatatgcctaaggtaaacctggcggcagcgcaaaagatg

SEQ ID NO: 11171 - DNA, 103 bp, Artificial Sequence
  Synthetic Polynucleotide
taatacgactcactatagggataagcatcgacagtgttaccttaggcccaaacagaggagatgggccatgggtaacactaacctggcggcagcgcaaaagatg

SEQ ID NO: 11172 - DNA, 103 bp, Artificial Sequence
  Synthetic Polynucleotide
taatacgactcactatagggtctctataagcatcgacagtgttaccttagaacagaggagactaaggatgcactgtcgaaacctggcggcagcgcaaaagatg

SEQ ID NO: 11173 - DNA, 103 bp, Artificial Sequence
  Synthetic Polynucleotide
taatacgactcactatagggtgctgtctctataagcatcgacagtgttacaacagaggagagtaacaatgtcgatgcttaacctggcggcagcgcaaaagatg

SEQ ID NO: 11174 - DNA, 103 bp, Artificial Sequence
  Synthetic Polynucleotide
taatacgactcactatagggtactctgctgtctctataagcatcgacagtaacagaggagaactgtcatggcttatagaaacctggcggcagcgcaaaagatg

SEQ ID NO: 11175 - DNA, 103 bp, Artificial Sequence
  Synthetic Polynucleotide
taatacgactcactatagggaccaatactctgctgtctctataagcatcgaacagaggagacgatgcatgtagagacagaacctggcggcagcgcaaaagatg

SEQ ID NO: 11176 - DNA, 103 bp, Artificial Sequence
  Synthetic Polynucleotide
taatacgactcactatagggtttggaccaatactctgctgtctctataagaacagaggagacttataatgacagcagagaacctggcggcagcgcaaaagatg

SEQ ID NO: 11177 - DNA, 103 bp, Artificial Sequence
  Synthetic Polynucleotide
taatacgactcactatagggaagagaggaactgtccggcatttgcttctgaacagaggagacagaagatgatgccggacaacctggcggcagcgcaaaagatg

SEQ ID NO: 11178 - DNA, 103 bp, Artificial Sequence
  Synthetic Polynucleotide
taatacgactcactatagggtcctgtttggaccaatactctgctgtctctaacagaggagaagagacatgagagtattgaacctggcggcagcgcaaaagatg

SEQ ID NO: 11179 - DNA, 103 bp, Artificial Sequence
  Synthetic Polynucleotide
taatacgactcactatagggtaatgtcctgtttggaccaatactctgctgaacagaggagacagcagatgattggtccaaacctggcggcagcgcaaaagatg

SEQ ID NO: 11180 - DNA, 103 bp, Artificial Sequence
  Synthetic Polynucleotide
taatacgactcactataggggttcttaatgtcctgtttggaccaatactcaacagaggagagagtatatgtccaaacagaacctggcggcagcgcaaaagatg

SEQ ID NO: 11181 - DNA, 103 bp, Artificial Sequence
  Synthetic Polynucleotide
taatacgactcactatagggtcgatgttcttaatgtcctgtttggaccaaaacagaggagattggtcatgacaggacataacctggcggcagcgcaaaagatg

SEQ ID NO: 11182 - DNA, 103 bp, Artificial Sequence
  Synthetic Polynucleotide
taatacgactcactatagggaatcatcgatgttcttaatgtcctgtttggaacagaggagaccaaacatgacattaagaaacctggcggcagcgcaaaagatg

SEQ ID NO: 11183 - DNA, 103 bp, Artificial Sequence
  Synthetic Polynucleotide
taatacgactcactatagggtcttgaatcatcgatgttcttaatgtcctgaacagaggagacaggacatgaagaacatcaacctggcggcagcgcaaaagatg

SEQ ID NO: 11184 - DNA, 103 bp, Artificial Sequence
  Synthetic Polynucleotide
taatacgactcactatagggcttaatcttgaatcatcgatgttcttaatgaacagaggagacattaaatgcatcgatgaaacctggcggcagcgcaaaagatg

SEQ ID NO: 11185 - DNA, 103 bp, Artificial Sequence
  Synthetic Polynucleotide
taatacgactcactatagggaagctcttaatcttgaatcatcgatgttctaacagaggagaagaacaatgatgattcaaaacctggcggcagcgcaaaagatg

SEQ ID NO: 11186 - DNA, 103 bp, Artificial Sequence
  Synthetic Polynucleotide
taatacgactcactatagggcaataaagctcttaatcttgaatcatcgataacagaggagaatcgatatgtcaagattaaacctggcggcagcgcaaaagatg

SEQ ID NO: 11187 - DNA, 103 bp, Artificial Sequence
  Synthetic Polynucleotide
taatacgactcactatagggagggtcaataaagctcttaatcttgaatcaaacagaggagatgattcatgattaagagcaacctggcggcagcgcaaaagatg

SEQ ID NO: 11188 - DNA, 103 bp, Artificial Sequence
  Synthetic Polynucleotide
taatacgactcactatagggtcaatgagaatcttaatcttaatgtaagtgaacagaggagacacttaatgtaagattaaaacctggcggcagcgcaaaagatg

SEQ ID NO: 11189 - DNA, 103 bp, Artificial Sequence
  Synthetic Polynucleotide
taatacgactcactatagggagcaaaagagaggaactgtccggcatttgcaacagaggagagcaaatatgggacagttcaacctggcggcagcgcaaaagatg

SEQ ID NO: 11190 - DNA, 103 bp, Artificial Sequence
  Synthetic Polynucleotide
taatacgactcactatagggcacaaagggtcaataaagctcttaatcttgaacagaggagacaagatatggagctttataacctggcggcagcgcaaaagatg

SEQ ID NO: 11191 - DNA, 103 bp, Artificial Sequence
  Synthetic Polynucleotide
taatacgactcactatagggaacagcacaaagggtcaataaagctcttaaaacagaggagattaagaatgttattgaccaacctggcggcagcgcaaaagatg

SEQ ID NO: 11192 - DNA, 103 bp, Artificial Sequence
  Synthetic Polynucleotide
taatacgactcactataggggtcataacagcacaaagggtcaataaagctaacagaggagaagctttatggaccctttgaacctggcggcagcgcaaaagatg

SEQ ID NO: 11193 - DNA, 103 bp, Artificial Sequence
  Synthetic Polynucleotide
taatacgactcactatagggtgcgcgtcataacagcacaaagggtcaataaacagaggagatattgaatgtttgtgctgaacctggcggcagcgcaaaagatg

SEQ ID NO: 11194 - DNA, 103 bp, Artificial Sequence
  Synthetic Polynucleotide
taatacgactcactatagggaaatttgcgcgtcataacagcacaaagggtaacagaggagaacccttatggctgttatgaacctggcggcagcgcaaaagatg

SEQ ID NO: 11195 - DNA, 103 bp, Artificial Sequence
  Synthetic Polynucleotide
taatacgactcactatagggtttgaaaatttgcgcgtcataacagcacaaaacagaggagattgtgcatgtatgacgcgaacctggcggcagcgcaaaagatg

SEQ ID NO: 11196 - DNA, 103 bp, Artificial Sequence
  Synthetic Polynucleotide
taatacgactcactataggggagattttgaaaatttgcgcgtcataacagaacagaggagactgttaatgcgcgcaaataacctggcggcagcgcaaaagatg

SEQ ID NO: 11197 - DNA, 103 bp, Artificial Sequence
  Synthetic Polynucleotide
taatacgactcactatagggaagttgagattttgaaaatttgcgcgtcataacagaggagaatgacgatgaaattttcaaacctggcggcagcgcaaaagatg

SEQ ID NO: 11198 - DNA, 103 bp, Artificial Sequence
  Synthetic Polynucleotide
taatacgactcactatagggaagctaagttgagattttgaaaatttgcgcaacagaggagagcgcaaatgttcaaaatcaacctggcggcagcgcaaaagatg

SEQ ID NO: 11199 - DNA, 103 bp, Artificial Sequence
  Synthetic Polynucleotide
taatacgactcactatagggatagcaagctaagttgagattttgaaaattaacagaggagaaattttatgaatctcaacaacctggcggcagcgcaaaagatg

SEQ ID NO: 11200 - DNA, 103 bp, Artificial Sequence
  Synthetic Polynucleotide
taatacgactcactatagggaagctagcaaaagagaggaactgtccggcaaacagaggagatgccggatggttcctctcaacctggcggcagcgcaaaagatg

SEQ ID NO: 11201 - DNA, 103 bp, Artificial Sequence
  Synthetic Polynucleotide
taatacgactcactatagggttcacatagcaagctaagttgagattttgaaacagaggagatcaaaaatgcaacttagcaacctggcggcagcgcaaaagatg

SEQ ID NO: 11202 - DNA, 103 bp, Artificial Sequence
  Synthetic Polynucleotide
taatacgactcactatagggtggctttcacatagcaagctaagttgagataacagaggagaatctcaatgtagcttgctaacctggcggcagcgcaaaagatg

SEQ ID NO: 11203 - DNA, 103 bp, Artificial Sequence
  Synthetic Polynucleotide
taatacgactcactataggggtaagtggctttcacatagcaagctaagttaacagaggagaaacttaatgtgctatgtgaacctggcggcagcgcaaaagatg

SEQ ID NO: 11204 - DNA, 103 bp, Artificial Sequence
  Synthetic Polynucleotide
taatacgactcactatagggtcgccgtaagtggctttcacatagcaagctaacagaggagaagcttgatgtgtgaaagcaacctggcggcagcgcaaaagatg

SEQ ID NO: 11205 - DNA, 103 bp, Artificial Sequence
  Synthetic Polynucleotide
taatacgactcactatagggccttctcgccgtaagtggctttcacatagcaacagaggagagctatgatgaagccacttaacctggcggcagcgcaaaagatg

SEQ ID NO: 11206 - DNA, 103 bp, Artificial Sequence
  Synthetic Polynucleotide
taatacgactcactatagggcaagtccttctcgccgtaagtggctttcacaacagaggagagtgaaaatgacttacggcaacctggcggcagcgcaaaagatg

SEQ ID NO: 11207 - DNA, 103 bp, Artificial Sequence
  Synthetic Polynucleotide
taatacgactcactatagggttgaccaagtccttctcgccgtaagtggctaacagaggagaagccacatgcggcgagaaaacctggcggcagcgcaaaagatg

SEQ ID NO: 11208 - DNA, 103 bp, Artificial Sequence
  Synthetic Polynucleotide
taatacgactcactatagggtggtcttgaccaagtccttctcgccgtaagaacagaggagacttacgatgagaaggactaacctggcggcagcgcaaaagatg

SEQ ID NO: 11209 - DNA, 103 bp, Artificial Sequence
  Synthetic Polynucleotide
taatacgactcactatagggctgattggtcttgaccaagtccttctcgccaacagaggagaggcgagatggacttggtcaacctggcggcagcgcaaaagatg

SEQ ID NO: 11210 - DNA, 103 bp, Artificial Sequence
  Synthetic Polynucleotide
taatacgactcactatagggtgactctgattggtcttgaccaagtccttcaacagaggagagaaggaatgggtcaagacaacctggcggcagcgcaaaagatg

SEQ ID NO: 11211 - DNA, 103 bp, Artificial Sequence
  Synthetic Polynucleotide
taatacgactcactataggggaaataagctagcaaaagagaggaactgtcaacagaggagagacagtatgtctcttttgaacctggcggcagcgcaaaagatg

SEQ ID NO: 11212 - DNA, 103 bp, Artificial Sequence
  Synthetic Polynucleotide
taatacgactcactatagggagaactgactctgattggtcttgaccaagtaacagaggagaacttggatgagaccaatcaacctggcggcagcgcaaaagatg

SEQ ID NO: 11213 - DNA, 103 bp, Artificial Sequence
  Synthetic Polynucleotide
taatacgactcactatagggcctccagaactgactctgattggtcttgacaacagaggagagtcaagatgaatcagagtaacctggcggcagcgcaaaagatg

SEQ ID NO: 11214 - DNA, 103 bp, Artificial Sequence
  Synthetic Polynucleotide
taatacgactcactatagggatatacctccagaactgactctgattggtcaacagaggagagaccaaatggagtcagttaacctggcggcagcgcaaaagatg

SEQ ID NO: 11215 - DNA, 103 bp, Artificial Sequence
  Synthetic Polynucleotide
taatacgactcactatagggcgttgatatacctccagaactgactctgataacagaggagaatcagaatgagttctggaaacctggcggcagcgcaaaagatg

SEQ ID NO: 11216 - DNA, 103 bp, Artificial Sequence
  Synthetic Polynucleotide
taatacgactcactataggggtaagcgttgatatacctccagaactgactaacagaggagaagtcagatgtggaggtataacctggcggcagcgcaaaagatg

SEQ ID NO: 11217 - DNA, 103 bp, Artificial Sequence
  Synthetic Polynucleotide
taatacgactcactataggggctgtgtaagcgttgatatacctccagaacaacagaggagagttctgatggtatatcaaaacctggcggcagcgcaaaagatg

SEQ ID NO: 11218 - DNA, 103 bp, Artificial Sequence
  Synthetic Polynucleotide
taatacgactcactatagggttatcgctgtgtaagcgttgatatacctccaacagaggagaggaggtatgtcaacgcttaacctggcggcagcgcaaaagatg

SEQ ID NO: 11219 - DNA, 103 bp, Artificial Sequence
  Synthetic Polynucleotide
taatacgactcactatagggcacctttatcgctgtgtaagcgttgatataaacagaggagatatatcatggcttacacaaacctggcggcagcgcaaaagatg

SEQ ID NO: 11220 - DNA, 103 bp, Artificial Sequence
  Synthetic Polynucleotide
taatacgactcactatagggattcccacctttatcgctgtgtaagcgttgaacagaggagacaacgcatgcacagcgataacctggcggcagcgcaaaagatg

SEQ ID NO: 11221 - DNA, 103 bp, Artificial Sequence
  Synthetic Polynucleotide
taatacgactcactatagggtcgaaattcccacctttatcgctgtgtaagaacagaggagacttacaatgcgataaaggaacctggcggcagcgcaaaagatg

SEQ ID NO: 11222 - DNA, 103 bp, Artificial Sequence
  Synthetic Polynucleotide
taatacgactcactatagggaggaagaaataagctagcaaaagagaggaaaacagaggagattcctcatgtttgctagcaacctggcggcagcgcaaaagatg

SEQ ID NO: 11223 - DNA, 103 bp, Artificial Sequence
  Synthetic Polynucleotide
taatacgactcactatagggctgcctcgaaattcccacctttatcgctgtaacagaggagaacagcgatgaaggtgggaaacctggcggcagcgcaaaagatg

SEQ ID NO: 11224 - DNA, 103 bp, Artificial Sequence
  Synthetic Polynucleotide
taatacgactcactatagggtagtgctgcctcgaaattcccacctttatcaacagaggagagataaaatggggaatttcaacctggcggcagcgcaaaagatg

SEQ ID NO: 11225 - DNA, 103 bp, Artificial Sequence
  Synthetic Polynucleotide
taatacgactcactatagggtgccatagtgctgcctcgaaattcccacctaacagaggagaaggtggatgtttcgaggcaacctggcggcagcgcaaaagatg

SEQ ID NO: 11226 - DNA, 103 bp, Artificial Sequence
  Synthetic Polynucleotide
taatacgactcactatagggactgctgccatagtgctgcctcgaaattccaacagaggagaggaattatgaggcagcacaacctggcggcagcgcaaaagatg

SEQ ID NO: 11227 - DNA, 103 bp, Artificial Sequence
  Synthetic Polynucleotide
taatacgactcactatagggatcccactgctgccatagtgctgcctcgaaaacagaggagattcgagatggcactatggaacctggcggcagcgcaaaagatg

SEQ ID NO: 11228 - DNA, 103 bp, Artificial Sequence
  Synthetic Polynucleotide
taatacgactcactatagggtgccgatcccactgctgccatagtgctgccaacagaggagaggcagcatgatggcagcaaacctggcggcagcgcaaaagatg

SEQ ID NO: 11229 - DNA, 103 bp, Artificial Sequence
  Synthetic Polynucleotide
taatacgactcactatagggatgattgccgatcccactgctgccatagtgaacagaggagacactatatgagcagtgggaacctggcggcagcgcaaaagatg

SEQ ID NO: 11230 - DNA, 103 bp, Artificial Sequence
  Synthetic Polynucleotide
taatacgactcactatagggtatcaatgattgccgatcccactgctgccaaacagaggagatggcagatgtgggatcggaacctggcggcagcgcaaaagatg

SEQ ID NO: 11231 - DNA, 103 bp, Artificial Sequence
  Synthetic Polynucleotide
taatacgactcactatagggaacattatcaatgattgccgatcccactgcaacagaggagagcagtgatgtcggcaatcaacctggcggcagcgcaaaagatg

SEQ ID NO: 11232 - DNA, 103 bp, Artificial Sequence
  Synthetic Polynucleotide
taatacgactcactatagggttatgaacattatcaatgattgccgatcccaacagaggagagggatcatgaatcattgaaacctggcggcagcgcaaaagatg

SEQ ID NO: 11233 - DNA, 103 bp, Artificial Sequence
  Synthetic Polynucleotide
taatacgactcactatagggagcttaggaagaaataagctagcaaaagagaacagaggagactctttatgtagcttattaacctggcggcagcgcaaaagatg

SEQ ID NO: 11234 - DNA, 103 bp, Artificial Sequence
  Synthetic Polynucleotide
taatacgactcactatagggtgctgttatgaacattatcaatgattgccgaacagaggagacggcaaatgttgataatgaacctggcggcagcgcaaaagatg

SEQ ID NO: 11235 - DNA, 103 bp, Artificial Sequence
  Synthetic Polynucleotide
taatacgactcactatagggaaaaatgctgttatgaacattatcaatgataacagaggagaatcattatgaatgttcataacctggcggcagcgcaaaagatg

SEQ ID NO: 11236 - DNA, 103 bp, Artificial Sequence
  Synthetic Polynucleotide
taatacgactcactatagggtatttaaaaatgctgttatgaacattatcaaacagaggagatgataaatgtcataacagaacctggcggcagcgcaaaagatg

SEQ ID NO: 11237 - DNA, 103 bp, Artificial Sequence
  Synthetic Polynucleotide
taatacgactcactatagggtgcaatatttaaaaatgctgttatgaacataacagaggagaatgttcatgacagcatttaacctggcggcagcgcaaaagatg

SEQ ID NO: 11238 - DNA, 103 bp, Artificial Sequence
  Synthetic Polynucleotide
taatacgactcactatagggtgtaatgcaatatttaaaaatgctgttatgaacagaggagacataacatgatttttaaaaacctggcggcagcgcaaaagatg

SEQ ID NO: 11239 - DNA, 103 bp, Artificial Sequence
  Synthetic Polynucleotide
taatacgactcactataggggtaattgtaatgcaatatttaaaaatgctgaacagaggagacagcatatgtaaatattgaacctggcggcagcgcaaaagatg

SEQ ID NO: 11240 - DNA, 103 bp, Artificial Sequence
  Synthetic Polynucleotide
taatacgactcactatagggacatggtaattgtaatgcaatatttaaaaaaacagaggagatttttaatgattgcattaaacctggcggcagcgcaaaagatg

SEQ ID NO: 11241 - DNA, 103 bp, Artificial Sequence
  Synthetic Polynucleotide
taatacgactcactatagggctctcacatggtaattgtaatgcaatatttaacagaggagaaaatatatgattacaattaacctggcggcagcgcaaaagatg

SEQ ID NO: 11242 - DNA, 103 bp, Artificial Sequence
  Synthetic Polynucleotide
taatacgactcactatagggatgaactctcacatggtaattgtaatgcaaaacagaggagattgcatatgaattaccataacctggcggcagcgcaaaagatg

SEQ ID NO: 11243 - DNA, 103 bp, Artificial Sequence
  Synthetic Polynucleotide
taatacgactcactatagggaacagatgaactctcacatggtaattgtaaaacagaggagattacaaatgccatgtgagaacctggcggcagcgcaaaagatg

SEQ ID NO: 11244 - DNA, 103 bp, Artificial Sequence
  Synthetic Polynucleotide
taatacgactcactatagggcaactagcttaggaagaaataagctagcaaaacagaggagattgctaatgtatttcttcaacctggcggcagcgcaaaagatg

SEQ ID NO: 11245 - DNA, 103 bp, Artificial Sequence
  Synthetic Polynucleotide
taatacgactcactatagggataacaacagatgaactctcacatggtaataacagaggagaattaccatgtgagagttcaacctggcggcagcgcaaaagatg

SEQ ID NO: 11246 - DNA, 103 bp, Artificial Sequence
  Synthetic Polynucleotide
taatacgactcactatagggctgaaataacaacagatgaactctcacatgaacagaggagacatgtgatggttcatctgaacctggcggcagcgcaaaagatg

SEQ ID NO: 11247 - DNA, 103 bp, Artificial Sequence
  Synthetic Polynucleotide
taatacgactcactatagggcaaacctgaaataacaacagatgaactctcaacagaggagagagagtatgtctgttgttaacctggcggcagcgcaaaagatg

SEQ ID NO: 11248 - DNA, 103 bp, Artificial Sequence
  Synthetic Polynucleotide
taatacgactcactatagggattctcaaacctgaaataacaacagatgaaaacagaggagattcatcatgtgttatttcaacctggcggcagcgcaaaagatg

SEQ ID NO: 11249 - DNA, 103 bp, Artificial Sequence
  Synthetic Polynucleotide
taatacgactcactatagggtcagcattctcaaacctgaaataacaacagaacagaggagactgttgatgtttcaggttaacctggcggcagcgcaaaagatg

SEQ ID NO: 11250 - DNA, 103 bp, Artificial Sequence
  Synthetic Polynucleotide
taatacgactcactataggggggtatcagcattctcaaacctgaaataacaacagaggagagttattatgggtttgagaaacctggcggcagcgcaaaagatg

SEQ ID NO: 11251 - DNA, 103 bp, Artificial Sequence
  Synthetic Polynucleotide
taatacgactcactataggggactggggtatcagcattctcaaacctgaaaacagaggagattcaggatggagaatgctaacctggcggcagcgcaaaagatg

SEQ ID NO: 11252 - DNA, 103 bp, Artificial Sequence
  Synthetic Polynucleotide
taatacgactcactatagggcttccgactggggtatcagcattctcaaacaacagaggagagtttgaatgtgctgatacaacctggcggcagcgcaaaagatg

SEQ ID NO: 11253 - DNA, 103 bp, Artificial Sequence
  Synthetic Polynucleotide
taatacgactcactatagggagtggcttccgactggggtatcagcattctaacagaggagaagaatgatgataccccagaacctggcggcagcgcaaaagatg

SEQ ID NO: 11254 - DNA, 103 bp, Artificial Sequence
  Synthetic Polynucleotide
taatacgactcactatagggacctcagtggcttccgactggggtatcagcaacagaggagagctgatatgccagtcggaaacctggcggcagcgcaaaagatg

SEQ ID NO: 11255 - DNA, 103 bp, Artificial Sequence
  Synthetic Polynucleotide
taatacgactcactatagggtccgacaactagcttaggaagaaataagctaacagaggagaagcttaatgcttcctaagaacctggcggcagcgcaaaagatg

SEQ ID NO: 11256 - DNA, 103 bp, Artificial Sequence
  Synthetic Polynucleotide
taatacgactcactatagggttacaacctcagtggcttccgactggggtaaacagaggagataccccatgcggaagccaaacctggcggcagcgcaaaagatg

SEQ ID NO: 11257 - DNA, 103 bp, Artificial Sequence
  Synthetic Polynucleotide
taatacgactcactataggggggggttacaacctcagtggcttccgactgaacagaggagacagtcgatggccactgagaacctggcggcagcgcaaaagatg

SEQ ID NO: 11258 - DNA, 103 bp, Artificial Sequence
  Synthetic Polynucleotide
taatacgactcactatagggtcggagggggttacaacctcagtggcttccaacagaggagaggaagcatgtgaggttgtaacctggcggcagcgcaaaagatg

SEQ ID NO: 11259 - DNA, 103 bp, Artificial Sequence
  Synthetic Polynucleotide
taatacgactcactatagggaggtttcggagggggttacaacctcagtggaacagaggagaccactgatgttgtaacccaacctggcggcagcgcaaaagatg

SEQ ID NO: 11260 - DNA, 103 bp, Artificial Sequence
  Synthetic Polynucleotide
taatacgactcactatagggtgtgcaggtttcggagggggttacaacctcaacagaggagagaggttatgaccccctccaacctggcggcagcgcaaaagatg

SEQ ID NO: 11261 - DNA, 103 bp, Artificial Sequence
  Synthetic Polynucleotide
taatacgactcactataggggaccatgtgcaggtttcggagggggttacaaacagaggagatgtaacatgctccgaaacaacctggcggcagcgcaaaagatg

SEQ ID NO: 11262 - DNA, 103 bp, Artificial Sequence
  Synthetic Polynucleotide
taatacgactcactatagggcttctgaccatgtgcaggtttcggagggggaacagaggagaccccctatgaaacctgcaaacctggcggcagcgcaaaagatg

SEQ ID NO: 11263 - DNA, 103 bp, Artificial Sequence
  Synthetic Polynucleotide
taatacgactcactatagggtcctccttctgaccatgtgcaggtttcggaaacagaggagatccgaaatgtgcacatggaacctggcggcagcgcaaaagatg

SEQ ID NO: 11264 - DNA, 103 bp, Artificial Sequence
  Synthetic Polynucleotide
taatacgactcactataggggaacttcctccttctgaccatgtgcaggttaacagaggagaaacctgatgatggtcagaaacctggcggcagcgcaaaagatg

SEQ ID NO: 11265 - DNA, 103 bp, Artificial Sequence
  Synthetic Polynucleotide
taatacgactcactatagggaatgggaacttcctccttctgaccatgtgcaacagaggagagcacatatgcagaaggagaacctggcggcagcgcaaaagatg

SEQ ID NO: 11266 - DNA, 103 bp, Artificial Sequence
  Synthetic Polynucleotide
taatacgactcactatagggttttctccgacaactagcttaggaagaaataacagaggagaatttctatgtaagctagtaacctggcggcagcgcaaaagatg

SEQ ID NO: 11267 - DNA, 103 bp, Artificial Sequence
  Synthetic Polynucleotide
taatacgactcactataggggcttcaatgggaacttcctccttctgaccaaacagaggagatggtcaatgggaggaagtaacctggcggcagcgcaaaagatg

SEQ ID NO: 11268 - DNA, 103 bp, Artificial Sequence
  Synthetic Polynucleotide
taatacgactcactatagggttggggcttcaatgggaacttcctccttctaacagaggagaagaaggatgaagttcccaaacctggcggcagcgcaaaagatg

SEQ ID NO: 11269 - DNA, 103 bp, Artificial Sequence
  Synthetic Polynucleotide
taatacgactcactataggggtgatttggggcttcaatgggaacttcctcaacagaggagagaggaaatgcccattgaaaacctggcggcagcgcaaaagatg

SEQ ID NO: 11270 - DNA, 103 bp, Artificial Sequence
  Synthetic Polynucleotide
taatacgactcactataggggccttgtgatttggggcttcaatgggaactaacagaggagaagttccatgtgaagccccaacctggcggcagcgcaaaagatg

SEQ ID NO: 11271 - DNA, 103 bp, Artificial Sequence
  Synthetic Polynucleotide
taatacgactcactatagggagctcgccttgtgatttggggcttcaatggaacagaggagaccattgatgccccaaatcaacctggcggcagcgcaaaagatg

SEQ ID NO: 11272 - DNA, 103 bp, Artificial Sequence
  Synthetic Polynucleotide
taatacgactcactatagggtttttagctcgccttgtgatttggggcttcaacagaggagagaagccatgaatcacaagaacctggcggcagcgcaaaagatg

SEQ ID NO: 11273 - DNA, 103 bp, Artificial Sequence
  Synthetic Polynucleotide
taatacgactcactataggggggattttttagctcgccttgtgatttgggaacagaggagacccaaaatgcaaggcgagaacctggcggcagcgcaaaagatg

SEQ ID NO: 11274 - DNA, 103 bp, Artificial Sequence
  Synthetic Polynucleotide
taatacgactcactatagggcaaaagggattttttagctcgccttgtgataacagaggagaatcacaatgcgagctaaaaacctggcggcagcgcaaaagatg

SEQ ID NO: 11275 - DNA, 103 bp, Artificial Sequence
  Synthetic Polynucleotide
taatacgactcactatagggatgttcaaaagggattttttagctcgccttaacagaggagaaaggcgatgtaaaaaatcaacctggcggcagcgcaaaagatg

SEQ ID NO: 11276 - DNA, 103 bp, Artificial Sequence
  Synthetic Polynucleotide
taatacgactcactatagggtatgcatgttcaaaagggattttttagctcaacagaggagagagctaatgaatccctttaacctggcggcagcgcaaaagatg

SEQ ID NO: 11277 - DNA, 103 bp, Artificial Sequence
  Synthetic Polynucleotide
taatacgactcactatagggaggctttttctccgacaactagcttaggaaaacagaggagattcctaatgtagttgtcgaacctggcggcagcgcaaaagatg

SEQ ID NO: 11278 - DNA, 103 bp, Artificial Sequence
  Synthetic Polynucleotide
taatacgactcactataggggatgttatgcatgttcaaaagggattttttaacagaggagaaaaaaaatgcttttgaacaacctggcggcagcgcaaaagatg

SEQ ID NO: 11279 - DNA, 103 bp, Artificial Sequence
  Synthetic Polynucleotide
taatacgactcactatagggtatgtgatgttatgcatgttcaaaagggataacagaggagaatccctatggaacatgcaaacctggcggcagcgcaaaagatg

SEQ ID NO: 11280 - DNA, 103 bp, Artificial Sequence
  Synthetic Polynucleotide
taatacgactcactatagggaattgtatgtgatgttatgcatgttcaaaaaacagaggagattttgaatgtgcataacaaacctggcggcagcgcaaaagatg

SEQ ID NO: 11281 - DNA, 103 bp, Artificial Sequence
  Synthetic Polynucleotide
taatacgactcactatagggtttgaaattgtatgtgatgttatgcatgttaacagaggagaaacatgatgaacatcacaaacctggcggcagcgcaaaagatg

SEQ ID NO: 11282 - DNA, 103 bp, Artificial Sequence
  Synthetic Polynucleotide
taatacgactcactatagggatgcctttgaaattgtatgtgatgttatgcaacagaggagagcataaatgcacatacaaaacctggcggcagcgcaaaagatg

SEQ ID NO: 11283 - DNA, 103 bp, Artificial Sequence
  Synthetic Polynucleotide
taatacgactcactatagggttccaatgcctttgaaattgtatgtgatgtaacagaggagaacatcaatgacaatttcaaacctggcggcagcgcaaaagatg

SEQ ID NO: 11284 - DNA, 103 bp, Artificial Sequence
  Synthetic Polynucleotide
taatacgactcactatagggatttattccaatgcctttgaaattgtatgtaacagaggagaacatacatgttcaaaggcaacctggcggcagcgcaaaagatg

SEQ ID NO: 11285 - DNA, 103 bp, Artificial Sequence
  Synthetic Polynucleotide
taatacgactcactatagggtcaccatttattccaatgcctttgaaattgaacagaggagacaatttatgaggcattggaacctggcggcagcgcaaaagatg

SEQ ID NO: 11286 - DNA, 103 bp, Artificial Sequence
  Synthetic Polynucleotide
taatacgactcactatagggtgaaatcaccatttattccaatgcctttgaaacagaggagatcaaagatgttggaataaaacctggcggcagcgcaaaagatg

SEQ ID NO: 11287 - DNA, 103 bp, Artificial Sequence
  Synthetic Polynucleotide
taatacgactcactatagggcttcctgaaatcaccatttattccaatgccaacagaggagaggcattatgataaatggtaacctggcggcagcgcaaaagatg

SEQ ID NO: 11288 - DNA, 103 bp, Artificial Sequence
  Synthetic Polynucleotide
taatacgactcactatagggtagacaggctttttctccgacaactagcttaacagaggagaaagctaatggtcggagaaaacctggcggcagcgcaaaagatg

SEQ ID NO: 11289 - DNA, 103 bp, Artificial Sequence
  Synthetic Polynucleotide
taatacgactcactatagggctaatcttcctgaaatcaccatttattccaaacagaggagatggaatatgtggtgatttaacctggcggcagcgcaaaagatg

SEQ ID NO: 11290 - DNA, 103 bp, Artificial Sequence
  Synthetic Polynucleotide
taatacgactcactatagggaaacactaatcttcctgaaatcaccatttaaacagaggagataaatgatgatttcaggaaacctggcggcagcgcaaaagatg

SEQ ID NO: 11291 - DNA, 103 bp, Artificial Sequence
  Synthetic Polynucleotide
taatacgactcactatagggagggcaaacactaatcttcctgaaatcaccaacagaggagaggtgatatgaggaagattaacctggcggcagcgcaaaagatg

SEQ ID NO: 11292 - DNA, 103 bp, Artificial Sequence
  Synthetic Polynucleotide
taatacgactcactatagggttttgagggcaaacactaatcttcctgaaaaacagaggagatttcagatggattagtgtaacctggcggcagcgcaaaagatg

SEQ ID NO: 11293 - DNA, 103 bp, Artificial Sequence
  Synthetic Polynucleotide
taatacgactcactatagggtctgattttgagggcaaacactaatcttccaacagaggagaggaagaatggtgtttgccaacctggcggcagcgcaaaagatg

SEQ ID NO: 11294 - DNA, 103 bp, Artificial Sequence
  Synthetic Polynucleotide
taatacgactcactatagggtcggatctgattttgagggcaaacactaataacagaggagaattagtatgtgccctcaaaacctggcggcagcgcaaaagatg

SEQ ID NO: 11295 - DNA, 103 bp, Artificial Sequence
  Synthetic Polynucleotide
taatacgactcactatagggattgctcggatctgattttgagggcaaacaaacagaggagatgtttgatgtcaaaatcaaacctggcggcagcgcaaaagatg

SEQ ID NO: 11296 - DNA, 103 bp, Artificial Sequence
  Synthetic Polynucleotide
taatacgactcactatagggtgattattgctcggatctgattttgagggcaacagaggagagccctcatgatcagatccaacctggcggcagcgcaaaagatg

SEQ ID NO: 11297 - DNA, 103 bp, Artificial Sequence
  Synthetic Polynucleotide
taatacgactcactataggggtagatgattattgctcggatctgattttgaacagaggagacaaaatatgatccgagcaaacctggcggcagcgcaaaagatg

SEQ ID NO: 11298 - DNA, 103 bp, Artificial Sequence
  Synthetic Polynucleotide
taatacgactcactataggggtagagtagatgattattgctcggatctgaaacagaggagatcagatatgagcaataataacctggcggcagcgcaaaagatg

SEQ ID NO: 11299 - DNA, 103 bp, Artificial Sequence
  Synthetic Polynucleotide
taatacgactcactatagggacagatcaatgagaatcttaatcttaatgtaacagaggagaacattaatgttaagattcaacctggcggcagcgcaaaagatg

SEQ ID NO: 11300 - DNA, 103 bp, Artificial Sequence
  Synthetic Polynucleotide
taatacgactcactatagggttttctagacaggctttttctccgacaactaacagaggagaagttgtatgagaaaaagcaacctggcggcagcgcaaaagatg

SEQ ID NO: 11301 - DNA, 103 bp, Artificial Sequence
  Synthetic Polynucleotide
taatacgactcactatagggtggctgtagagtagatgattattgctcggaaacagaggagatccgagatgtaatcatctaacctggcggcagcgcaaaagatg

SEQ ID NO: 11302 - DNA, 103 bp, Artificial Sequence
  Synthetic Polynucleotide
taatacgactcactatagggttaactggctgtagagtagatgattattgcaacagaggagagcaataatgatctactctaacctggcggcagcgcaaaagatg

SEQ ID NO: 11303 - DNA, 103 bp, Artificial Sequence
  Synthetic Polynucleotide
taatacgactcactatagggagaaattaactggctgtagagtagatgattaacagaggagaaatcatatgctctacagcaacctggcggcagcgcaaaagatg

SEQ ID NO: 11304 - DNA, 103 bp, Artificial Sequence
  Synthetic Polynucleotide
taatacgactcactatagggatattagaaattaactggctgtagagtagaaacagaggagatctactatgcagccagttaacctggcggcagcgcaaaagatg

SEQ ID NO: 11305 - DNA, 103 bp, Artificial Sequence
  Synthetic Polynucleotide
taatacgactcactatagggcctttatattagaaattaactggctgtagaaacagaggagatctacaatgagttaatttaacctggcggcagcgcaaaagatg

SEQ ID NO: 11306 - DNA, 103 bp, Artificial Sequence
  Synthetic Polynucleotide
taatacgactcactatagggtttaacctttatattagaaattaactggctaacagaggagaagccagatgatttctaataacctggcggcagcgcaaaagatg

SEQ ID NO: 11307 - DNA, 103 bp, Artificial Sequence
  Synthetic Polynucleotide
taatacgactcactatagggatttttttaacctttatattagaaattaacaacagaggagagttaatatgtaatataaaaacctggcggcagcgcaaaagatg

SEQ ID NO: 11308 - DNA, 103 bp, Artificial Sequence
  Synthetic Polynucleotide
taatacgactcactataggggcagcatttttttaacctttatattagaaaaacagaggagatttctaatgtaaaggttaaacctggcggcagcgcaaaagatg

SEQ ID NO: 11309 - DNA, 103 bp, Artificial Sequence
  Synthetic Polynucleotide
taatacgactcactatagggggcctgcagcatttttttaacctttatattaacagaggagaaatataatggttaaaaaaaacctggcggcagcgcaaaagatg

SEQ ID NO: 11310 - DNA, 103 bp, Artificial Sequence
  Synthetic Polynucleotide
taatacgactcactatagggtagctggcctgcagcatttttttaacctttaacagaggagaaaaggtatgaaaaatgctaacctggcggcagcgcaaaagatg

SEQ ID NO: 11311 - DNA, 103 bp, Artificial Sequence
  Synthetic Polynucleotide
taatacgactcactataggggcaccttttctagacaggctttttctccgaaacagaggagatcggagatgaagcctgtcaacctggcggcagcgcaaaagatg

SEQ ID NO: 11312 - DNA, 103 bp, Artificial Sequence
  Synthetic Polynucleotide
taatacgactcactatagggaacaatagctggcctgcagcatttttttaaaacagaggagattaaaaatgtgctgcaggaacctggcggcagcgcaaaagatg

SEQ ID NO: 11313 - DNA, 103 bp, Artificial Sequence
  Synthetic Polynucleotide
taatacgactcactatagggtgtggaacaatagctggcctgcagcattttaacagaggagaaaaatgatgcaggccagcaacctggcggcagcgcaaaagatg

SEQ ID NO: 11314 - DNA, 103 bp, Artificial Sequence
  Synthetic Polynucleotide
taatacgactcactatagggggacctgtggaacaatagctggcctgcagcaacagaggagagctgcaatgcagctattgaacctggcggcagcgcaaaagatg

SEQ ID NO: 11315 - DNA, 103 bp, Artificial Sequence
  Synthetic Polynucleotide
taatacgactcactatagggaattgggacctgtggaacaatagctggcctaacagaggagaaggccaatgattgttccaaacctggcggcagcgcaaaagatg

SEQ ID NO: 11316 - DNA, 103 bp, Artificial Sequence
  Synthetic Polynucleotide
taatacgactcactatagggagaagaattgggacctgtggaacaatagctaacagaggagaagctatatgtccacaggtaacctggcggcagcgcaaaagatg

SEQ ID NO: 11317 - DNA, 103 bp, Artificial Sequence
  Synthetic Polynucleotide
taatacgactcactatagggtaacaagaagaattgggacctgtggaacaaaacagaggagattgttcatgaggtcccaaaacctggcggcagcgcaaaagatg

SEQ ID NO: 11318 - DNA, 103 bp, Artificial Sequence
  Synthetic Polynucleotide
taatacgactcactatagggcaatttaacaagaagaattgggacctgtggaacagaggagaccacagatgccaattcttaacctggcggcagcgcaaaagatg

SEQ ID NO: 11319 - DNA, 103 bp, Artificial Sequence
  Synthetic Polynucleotide
taatacgactcactatagggtcctacaatttaacaagaagaattgggaccaacagaggagaggtcccatgtcttcttgtaacctggcggcagcgcaaaagatg

SEQ ID NO: 11320 - DNA, 103 bp, Artificial Sequence
  Synthetic Polynucleotide
taatacgactcactatagggctagctcctacaatttaacaagaagaattgaacagaggagacaattcatgttgttaaataacctggcggcagcgcaaaagatg

SEQ ID NO: 11321 - DNA, 103 bp, Artificial Sequence
  Synthetic Polynucleotide
taatacgactcactatagggttgtgctagctcctacaatttaacaagaagaacagaggagacttcttatgaaattgtagaacctggcggcagcgcaaaagatg

SEQ ID NO: 11322 - DNA, 103 bp, Artificial Sequence
  Synthetic Polynucleotide
taatacgactcactatagggccgctgcaccttttctagacaggctttttcaacagaggagagaaaaaatgtgtctagaaaacctggcggcagcgcaaaagatg

SEQ ID NO: 11323 - DNA, 103 bp, Artificial Sequence
  Synthetic Polynucleotide
taatacgactcactatagggatcacttgtgctagctcctacaatttaacaaacagaggagatgttaaatggtaggagctaacctggcggcagcgcaaaagatg

SEQ ID NO: 11324 - DNA, 103 bp, Artificial Sequence
  Synthetic Polynucleotide
taatacgactcactatagggattgcatcacttgtgctagctcctacaattaacagaggagaaattgtatgagctagcacaacctggcggcagcgcaaaagatg

SEQ ID NO: 11325 - DNA, 103 bp, Artificial Sequence
  Synthetic Polynucleotide
taatacgactcactatagggatttaattgcatcacttgtgctagctcctaaacagaggagataggagatggcacaagtgaacctggcggcagcgcaaaagatg

SEQ ID NO: 11326 - DNA, 103 bp, Artificial Sequence
  Synthetic Polynucleotide
taatacgactcactataggggtatcatttaattgcatcacttgtgctagcaacagaggagagctagcatgagtgatgcaaacctggcggcagcgcaaaagatg

SEQ ID NO: 11327 - DNA, 103 bp, Artificial Sequence
  Synthetic Polynucleotide
taatacgactcactatagggtactagtatcatttaattgcatcacttgtgaacagaggagacacaagatgtgcaattaaaacctggcggcagcgcaaaagatg

SEQ ID NO: 11328 - DNA, 103 bp, Artificial Sequence
  Synthetic Polynucleotide
taatacgactcactataggggtatatactagtatcatttaattgcatcacaacagaggagagtgatgatgttaaatgataacctggcggcagcgcaaaagatg

SEQ ID NO: 11329 - DNA, 103 bp, Artificial Sequence
  Synthetic Polynucleotide
taatacgactcactataggggcattgtatatactagtatcatttaattgcaacagaggagagcaattatgtgatactagaacctggcggcagcgcaaaagatg

SEQ ID NO: 11330 - DNA, 103 bp, Artificial Sequence
  Synthetic Polynucleotide
taatacgactcactatagggtggtggcattgtatatactagtatcatttaaacagaggagataaatgatgctagtatataacctggcggcagcgcaaaagatg

SEQ ID NO: 11331 - DNA, 103 bp, Artificial Sequence
  Synthetic Polynucleotide
taatacgactcactatagggtaagttggtggcattgtatatactagtatcaacagaggagagatactatgatatacaataacctggcggcagcgcaaaagatg

SEQ ID NO: 11332 - DNA, 103 bp, Artificial Sequence
  Synthetic Polynucleotide
taatacgactcactatagggagaattaagttggtggcattgtatatactaaacagaggagatagtatatgcaatgccacaacctggcggcagcgcaaaagatg

SEQ ID NO: 11333 - DNA, 103 bp, Artificial Sequence
  Synthetic Polynucleotide
taatacgactcactatagggatttgccgctgcaccttttctagacaggctaacagaggagaagcctgatgagaaaaggtaacctggcggcagcgcaaaagatg

SEQ ID NO: 11334 - DNA, 103 bp, Artificial Sequence
  Synthetic Polynucleotide
taatacgactcactatagggatcttagaattaagttggtggcattgtataaacagaggagatatacaatgccaccaactaacctggcggcagcgcaaaagatg

SEQ ID NO: 11335 - DNA, 103 bp, Artificial Sequence
  Synthetic Polynucleotide
taatacgactcactatagggacaaaatcttagaattaagttggtggcattaacagaggagaaatgccatgaacttaattaacctggcggcagcgcaaaagatg

SEQ ID NO: 11336 - DNA, 103 bp, Artificial Sequence
  Synthetic Polynucleotide
taatacgactcactataggggatatacaaaatcttagaattaagttggtgaacagaggagacaccaaatgaattctaagaacctggcggcagcgcaaaagatg

SEQ ID NO: 11337 - DNA, 103 bp, Artificial Sequence
  Synthetic Polynucleotide
taatacgactcactatagggtccgagatatacaaaatcttagaattaagtaacagaggagaacttaaatgtaagattttaacctggcggcagcgcaaaagatg

SEQ ID NO: 11338 - DNA, 103 bp, Artificial Sequence
  Synthetic Polynucleotide
taatacgactcactataggggaatttccgagatatacaaaatcttagaataacagaggagaattctaatgttttgtataaacctggcggcagcgcaaaagatg

SEQ ID NO: 11339 - DNA, 103 bp, Artificial Sequence
  Synthetic Polynucleotide
taatacgactcactatagggattttgaatttccgagatatacaaaatcttaacagaggagaaagattatgtatatctcgaacctggcggcagcgcaaaagatg

SEQ ID NO: 11340 - DNA, 103 bp, Artificial Sequence
  Synthetic Polynucleotide
taatacgactcactatagggatttaattttgaatttccgagatatacaaaaacagaggagatttgtaatgctcggaaataacctggcggcagcgcaaaagatg

SEQ ID NO: 11341 - DNA, 103 bp, Artificial Sequence
  Synthetic Polynucleotide
taatacgactcactataggggtagcatttaattttgaatttccgagatataacagaggagaatatctatgaaattcaaaaacctggcggcagcgcaaaagatg

SEQ ID NO: 11342 - DNA, 103 bp, Artificial Sequence
  Synthetic Polynucleotide
taatacgactcactatagggataacgtagcatttaattttgaatttccgaaacagaggagatcggaaatgcaaaattaaaacctggcggcagcgcaaaagatg

SEQ ID NO: 11343 - DNA, 103 bp, Artificial Sequence
  Synthetic Polynucleotide
taatacgactcactatagggaatcaataacgtagcatttaattttgaattaacagaggagaaattcaatgttaaatgctaacctggcggcagcgcaaaagatg

SEQ ID NO: 11344 - DNA, 103 bp, Artificial Sequence
  Synthetic Polynucleotide
taatacgactcactatagggcttgaatttgccgctgcaccttttctagacaacagaggagagtctagatgaggtgcagcaacctggcggcagcgcaaaagatg

SEQ ID NO: 11345 - DNA, 103 bp, Artificial Sequence
  Synthetic Polynucleotide
taatacgactcactatagggaattgaatcaataacgtagcatttaattttaacagaggagaaaaattatgtgctacgttaacctggcggcagcgcaaaagatg

SEQ ID NO: 11346 - DNA, 103 bp, Artificial Sequence
  Synthetic Polynucleotide
taatacgactcactatagggttcttaattgaatcaataacgtagcatttaaacagaggagataaatgatgcgttattgaaacctggcggcagcgcaaaagatg

SEQ ID NO: 11347 - DNA, 103 bp, Artificial Sequence
  Synthetic Polynucleotide
taatacgactcactatagggtctttttcttaattgaatcaataacgtagcaacagaggagagctacgatgttgattcaaaacctggcggcagcgcaaaagatg

SEQ ID NO: 11348 - DNA, 103 bp, Artificial Sequence
  Synthetic Polynucleotide
taatacgactcactatagggcattgtctttttcttaattgaatcaataacaacagaggagagttattatgtcaattaagaacctggcggcagcgcaaaagatg

SEQ ID NO: 11349 - DNA, 103 bp, Artificial Sequence
  Synthetic Polynucleotide
taatacgactcactatagggtggtccattgtctttttcttaattgaatcaaacagaggagatgattcatgtaagaaaaaaacctggcggcagcgcaaaagatg

SEQ ID NO: 11350 - DNA, 103 bp, Artificial Sequence
  Synthetic Polynucleotide
taatacgactcactatagggtttgatggtccattgtctttttcttaattgaacagaggagacaattaatgaaaagacaaaacctggcggcagcgcaaaagatg

SEQ ID NO: 11351 - DNA, 103 bp, Artificial Sequence
  Synthetic Polynucleotide
taatacgactcactatagggctaattttgatggtccattgtctttttcttaacagaggagaaagaaaatgacaatggacaacctggcggcagcgcaaaagatg

SEQ ID NO: 11352 - DNA, 103 bp, Artificial Sequence
  Synthetic Polynucleotide
taatacgactcactatagggttgaactaattttgatggtccattgtctttaacagaggagaaaagacatgggaccatcaaacctggcggcagcgcaaaagatg

SEQ ID NO: 11353 - DNA, 103 bp, Artificial Sequence
  Synthetic Polynucleotide
taatacgactcactatagggaggtattgaactaattttgatggtccattgaacagaggagacaatggatgatcaaaattaacctggcggcagcgcaaaagatg

SEQ ID NO: 11354 - DNA, 103 bp, Artificial Sequence
  Synthetic Polynucleotide
taatacgactcactatagggagttcaggtattgaactaattttgatggtcaacagaggagagaccatatgaattagttcaacctggcggcagcgcaaaagatg

SEQ ID NO: 11355 - DNA, 103 bp, Artificial Sequence
  Synthetic Polynucleotide
taatacgactcactatagggatgaacttgaatttgccgctgcaccttttcaacagaggagagaaaagatgcagcggcaaaacctggcggcagcgcaaaagatg

SEQ ID NO: 11356 - DNA, 103 bp, Artificial Sequence
  Synthetic Polynucleotide
taatacgactcactataggggcattagttcaggtattgaactaattttgaaacagaggagatcaaaaatggttcaatacaacctggcggcagcgcaaaagatg

SEQ ID NO: 11357 - DNA, 103 bp, Artificial Sequence
  Synthetic Polynucleotide
taatacgactcactatagggtaagtgcattagttcaggtattgaactaataacagaggagaattagtatgatacctgaaaacctggcggcagcgcaaaagatg

SEQ ID NO: 11358 - DNA, 103 bp, Artificial Sequence
  Synthetic Polynucleotide
taatacgactcactatagggttctataagtgcattagttcaggtattgaaaacagaggagattcaatatgtgaactaataacctggcggcagcgcaaaagatg

SEQ ID NO: 11359 - DNA, 103 bp, Artificial Sequence
  Synthetic Polynucleotide
taatacgactcactatagggcctgtttctataagtgcattagttcaggtaaacagaggagatacctgatgtaatgcactaacctggcggcagcgcaaaagatg

SEQ ID NO: 11360 - DNA, 103 bp, Artificial Sequence
  Synthetic Polynucleotide
taatacgactcactataggggttctcctgtttctataagtgcattagttcaacagaggagagaactaatgcacttatagaacctggcggcagcgcaaaagatg

SEQ ID NO: 11361 - DNA, 103 bp, Artificial Sequence
  Synthetic Polynucleotide
taatacgactcactatagggggctggttctcctgtttctataagtgcattaacagaggagaaatgcaatgatagaaacaaacctggcggcagcgcaaaagatg

SEQ ID NO: 11362 - DNA, 103 bp, Artificial Sequence
  Synthetic Polynucleotide
taatacgactcactatagggtgtctggctggttctcctgtttctataagtaacagaggagaacttatatgaacaggagaaacctggcggcagcgcaaaagatg

SEQ ID NO: 11363 - DNA, 103 bp, Artificial Sequence
  Synthetic Polynucleotide
taatacgactcactatagggtctgctgtctggctggttctcctgtttctaaacagaggagatagaaaatggagaaccagaacctggcggcagcgcaaaagatg

SEQ ID NO: 11364 - DNA, 103 bp, Artificial Sequence
  Synthetic Polynucleotide
taatacgactcactatagggatttgtctgctgtctggctggttctcctgtaacagaggagaacaggaatgccagccagaaacctggcggcagcgcaaaagatg

SEQ ID NO: 11365 - DNA, 103 bp, Artificial Sequence
  Synthetic Polynucleotide
taatacgactcactatagggttgttatttgtctgctgtctggctggttctaacagaggagaagaaccatgcagacagcaaacctggcggcagcgcaaaagatg

SEQ ID NO: 11366 - DNA, 103 bp, Artificial Sequence
  Synthetic Polynucleotide
taatacgactcactatagggtcagaatgaacttgaatttgccgctgcaccaacagaggagaggtgcaatggcaaattcaaacctggcggcagcgcaaaagatg

SEQ ID NO: 11367 - DNA, 103 bp, Artificial Sequence
  Synthetic Polynucleotide
taatacgactcactataggggttcattgttatttgtctgctgtctggctgaacagaggagacagccaatgagcagacaaaacctggcggcagcgcaaaagatg

SEQ ID NO: 11368 - DNA, 103 bp, Artificial Sequence
  Synthetic Polynucleotide
taatacgactcactatagggttgtggttcattgttatttgtctgctgtctaacagaggagaagacagatgacaaataacaacctggcggcagcgcaaaagatg

SEQ ID NO: 11369 - DNA, 103 bp, Artificial Sequence
  Synthetic Polynucleotide
taatacgactcactatagggacatattgtggttcattgttatttgtctgcaacagaggagagcagacatgtaacaatgaaacctggcggcagcgcaaaagatg

SEQ ID NO: 11370 - DNA, 103 bp, Artificial Sequence
  Synthetic Polynucleotide
taatacgactcactatagggcagtaacatattgtggttcattgttatttgaacagaggagacaaataatgatgaaccacaacctggcggcagcgcaaaagatg

SEQ ID NO: 11371 - DNA, 103 bp, Artificial Sequence
  Synthetic Polynucleotide
taatacgactcactatagggtatagcagtaacatattgtggttcattgttaacagaggagaaacaatatgccacaatataacctggcggcagcgcaaaagatg

SEQ ID NO: 11372 - DNA, 103 bp, Artificial Sequence
  Synthetic Polynucleotide
taatacgactcactatagggttcattatagcagtaacatattgtggttcaaacagaggagatgaaccatgatatgttacaacctggcggcagcgcaaaagatg

SEQ ID NO: 11373 - DNA, 103 bp, Artificial Sequence
  Synthetic Polynucleotide
taatacgactcactatagggcgaacttcattatagcagtaacatattgtgaacagaggagacacaatatgttactgctaaacctggcggcagcgcaaaagatg

SEQ ID NO: 11374 - DNA, 103 bp, Artificial Sequence
  Synthetic Polynucleotide
taatacgactcactatagggattaacgaacttcattatagcagtaacataaacagaggagatatgttatggctataatgaacctggcggcagcgcaaaagatg

SEQ ID NO: 11375 - DNA, 103 bp, Artificial Sequence
  Synthetic Polynucleotide
taatacgactcactatagggtttgaattaacgaacttcattatagcagtaaacagaggagatactgcatgaatgaagttaacctggcggcagcgcaaaagatg

SEQ ID NO: 11376 - DNA, 103 bp, Artificial Sequence
  Synthetic Polynucleotide
taatacgactcactatagggttgtttttgaattaacgaacttcattatagaacagaggagactataaatgagttcgttaaacctggcggcagcgcaaaagatg

SEQ ID NO: 11377 - DNA, 103 bp, Artificial Sequence
  Synthetic Polynucleotide
taatacgactcactatagggcctgctcagaatgaacttgaatttgccgctaacagaggagaagcggcatgttcaagttcaacctggcggcagcgcaaaagatg

SEQ ID NO: 11378 - DNA, 103 bp, Artificial Sequence
  Synthetic Polynucleotide
taatacgactcactatagggatcatttgtttttgaattaacgaacttcataacagaggagaatgaagatggttaattcaaacctggcggcagcgcaaaagatg

SEQ ID NO: 11379 - DNA, 103 bp, Artificial Sequence
  Synthetic Polynucleotide
taatacgactcactatagggtcttcatcatttgtttttgaattaacgaacaacagaggagagttcgtatgttcaaaaacaacctggcggcagcgcaaaagatg

SEQ ID NO: 11380 - DNA, 103 bp, Artificial Sequence
  Synthetic Polynucleotide
taatacgactcactatagggattaatcttcatcatttgtttttgaattaaaacagaggagattaattatgaaacaaatgaacctggcggcagcgcaaaagatg

SEQ ID NO: 11381 - DNA, 103 bp, Artificial Sequence
  Synthetic Polynucleotide
taatacgactcactatagggtctgcattaatcttcatcatttgtttttgaaacagaggagatcaaaaatgaatgatgaaaacctggcggcagcgcaaaagatg

SEQ ID NO: 11382 - DNA, 103 bp, Artificial Sequence
  Synthetic Polynucleotide
taatacgactcactatagggagacatctgcattaatcttcatcatttgttaacagaggagaaacaaaatgtgaagattaaacctggcggcagcgcaaaagatg

SEQ ID NO: 11383 - DNA, 103 bp, Artificial Sequence
  Synthetic Polynucleotide
taatacgactcactatagggcctttagacatctgcattaatcttcatcataacagaggagaatgatgatgattaatgcaaacctggcggcagcgcaaaagatg

SEQ ID NO: 11384 - DNA, 103 bp, Artificial Sequence
  Synthetic Polynucleotide
taatacgactcactatagggtttatcctttagacatctgcattaatcttcaacagaggagagaagatatgtgcagatgtaacctggcggcagcgcaaaagatg

SEQ ID NO: 11385 - DNA, 103 bp, Artificial Sequence
  Synthetic Polynucleotide
taatacgactcactataggggagtgtttatcctttagacatctgcattaaaacagaggagattaatgatgatgtctaaaaacctggcggcagcgcaaaagatg

SEQ ID NO: 11386 - DNA, 103 bp, Artificial Sequence
  Synthetic Polynucleotide
taatacgactcactataggggcatggagtgtttatcctttagacatctgcaacagaggagagcagatatgtaaaggataaacctggcggcagcgcaaaagatg

SEQ ID NO: 11387 - DNA, 103 bp, Artificial Sequence
  Synthetic Polynucleotide
taatacgactcactatagggctgatgcatggagtgtttatcctttagacaaacagaggagatgtctaatggataaacacaacctggcggcagcgcaaaagatg

SEQ ID NO: 11388 - DNA, 103 bp, Artificial Sequence
  Synthetic Polynucleotide
taatacgactcactatagggcaatccctgctcagaatgaacttgaatttgaacagaggagacaaattatggttcattctaacctggcggcagcgcaaaagatg

SEQ ID NO: 11389 - DNA, 103 bp, Artificial Sequence
  Synthetic Polynucleotide
taatacgactcactatagggtaacactgatgcatggagtgtttatcctttaacagaggagaaaaggaatgacactccataacctggcggcagcgcaaaagatg

SEQ ID NO: 11390 - DNA, 103 bp, Artificial Sequence
  Synthetic Polynucleotide
taatacgactcactatagggaattataacactgatgcatggagtgtttataacagaggagaataaacatgccatgcatcaacctggcggcagcgcaaaagatg

SEQ ID NO: 11391 - DNA, 103 bp, Artificial Sequence
  Synthetic Polynucleotide
taatacgactcactatagggagcccaattataacactgatgcatggagtgaacagaggagacactccatgcatcagtgtaacctggcggcagcgcaaaagatg

SEQ ID NO: 11392 - DNA, 103 bp, Artificial Sequence
  Synthetic Polynucleotide
taatacgactcactatagggtacagagcccaattataacactgatgcatgaacagaggagacatgcaatggtgttataaaacctggcggcagcgcaaaagatg

SEQ ID NO: 11393 - DNA, 103 bp, Artificial Sequence
  Synthetic Polynucleotide
taatacgactcactatagggttttctacagagcccaattataacactgataacagaggagaatcagtatgataattgggaacctggcggcagcgcaaaagatg

SEQ ID NO: 11394 - DNA, 103 bp, Artificial Sequence
  Synthetic Polynucleotide
taatacgactcactataggggaagattttctacagagcccaattataacaaacagaggagatgttatatgtgggctctgaacctggcggcagcgcaaaagatg

SEQ ID NO: 11395 - DNA, 103 bp, Artificial Sequence
  Synthetic Polynucleotide
taatacgactcactataggggagatgaagattttctacagagcccaattaaacagaggagataattgatgtctgtagaaaacctggcggcagcgcaaaagatg

SEQ ID NO: 11396 - DNA, 103 bp, Artificial Sequence
  Synthetic Polynucleotide
taatacgactcactatagggtggaggagatgaagattttctacagagcccaacagaggagagggctcatgagaaaatctaacctggcggcagcgcaaaagatg

SEQ ID NO: 11397 - DNA, 103 bp, Artificial Sequence
  Synthetic Polynucleotide
taatacgactcactatagggtaggttggaggagatgaagattttctacagaacagaggagactgtagatgatcttcatcaacctggcggcagcgcaaaagatg

SEQ ID NO: 11398 - DNA, 103 bp, Artificial Sequence
  Synthetic Polynucleotide
taatacgactcactatagggtgaggtaggttggaggagatgaagattttcaacagaggagagaaaatatgcatctcctcaacctggcggcagcgcaaaagatg

SEQ ID NO: 11399 - DNA, 103 bp, Artificial Sequence
  Synthetic Polynucleotide
taatacgactcactatagggtggatcaatccctgctcagaatgaacttgaaacagaggagatcaagtatgttctgagcaaacctggcggcagcgcaaaagatg

SEQ ID NO: 11400 - DNA, 103 bp, Artificial Sequence
  Synthetic Polynucleotide
taatacgactcactatagggttctttgaggtaggttggaggagatgaagaaacagaggagatcttcaatgcctccaaccaacctggcggcagcgcaaaagatg

SEQ ID NO: 11401 - DNA, 103 bp, Artificial Sequence
  Synthetic Polynucleotide
taatacgactcactatagggaatccttctttgaggtaggttggaggagataacagaggagaatctccatgaacctacctaacctggcggcagcgcaaaagatg

SEQ ID NO: 11402 - DNA, 103 bp, Artificial Sequence
  Synthetic Polynucleotide
taatacgactcactatagggggtaaaatccttctttgaggtaggttggagaacagaggagactccaaatgacctcaaagaacctggcggcagcgcaaaagatg

SEQ ID NO: 11403 - DNA, 103 bp, Artificial Sequence
  Synthetic Polynucleotide
taatacgactcactatagggatcgcggtaaaatccttctttgaggtaggtaacagaggagaacctacatgaaagaaggaaacctggcggcagcgcaaaagatg

SEQ ID NO: 11404 - DNA, 103 bp, Artificial Sequence
  Synthetic Polynucleotide
taatacgactcactatagggtcccaatcgcggtaaaatccttctttgaggaacagaggagacctcaaatgaggattttaaacctggcggcagcgcaaaagatg

SEQ ID NO: 11405 - DNA, 103 bp, Artificial Sequence
  Synthetic Polynucleotide
taatacgactcactatagggataactcccaatcgcggtaaaatccttcttaacagaggagaaagaagatgtttaccgcgaacctggcggcagcgcaaaagatg

SEQ ID NO: 11406 - DNA, 103 bp, Artificial Sequence
  Synthetic Polynucleotide
taatacgactcactatagggtcgttataactcccaatcgcggtaaaatccaacagaggagaggatttatgcgcgattggaacctggcggcagcgcaaaagatg

SEQ ID NO: 11407 - DNA, 103 bp, Artificial Sequence
  Synthetic Polynucleotide
taatacgactcactatagggtattgtcgttataactcccaatcgcggtaaaacagaggagattaccgatgttgggagttaacctggcggcagcgcaaaagatg

SEQ ID NO: 11408 - DNA, 103 bp, Artificial Sequence
  Synthetic Polynucleotide
taatacgactcactataggggtccctattgtcgttataactcccaatcgcaacagaggagagcgattatgagttataacaacctggcggcagcgcaaaagatg

SEQ ID NO: 11409 - DNA, 103 bp, Artificial Sequence
  Synthetic Polynucleotide
taatacgactcactatagggtggttgtccctattgtcgttataactcccaaacagaggagatgggagatgtaacgacaaaacctggcggcagcgcaaaagatg

SEQ ID NO: 11410 - DNA, 103 bp, Artificial Sequence
  Synthetic Polynucleotide
taatacgactcactatagggaagatcaaaaaaccttctttctttttgtgtaacagaggagaacacaaatggaaagaaggaacctggcggcagcgcaaaagatg

SEQ ID NO: 11411 - DNA, 103 bp, Artificial Sequence
  Synthetic Polynucleotide
taatacgactcactatagggaagtaacagatcaatgagaatcttaatcttaacagaggagaaagattatgattctcattaacctggcggcagcgcaaaagatg

SEQ ID NO: 11412 - DNA, 103 bp, Artificial Sequence
  Synthetic Polynucleotide
taatacgactcactatagggggtattggatcaatccctgctcagaatgaaaacagaggagattcattatgagcagggataacctggcggcagcgcaaaagatg

SEQ ID NO: 11413 - DNA, 103 bp, Artificial Sequence
  Synthetic Polynucleotide
taatacgactcactatagggaaaggtggttgtccctattgtcgttataacaacagaggagagttataatgacaatagggaacctggcggcagcgcaaaagatg

SEQ ID NO: 11414 - DNA, 103 bp, Artificial Sequence
  Synthetic Polynucleotide
taatacgactcactataggggtgtcaaaggtggttgtccctattgtcgttaacagaggagaaacgacatgagggacaacaacctggcggcagcgcaaaagatg

SEQ ID NO: 11415 - DNA, 103 bp, Artificial Sequence
  Synthetic Polynucleotide
taatacgactcactatagggggctagtgtcaaaggtggttgtccctattgaacagaggagacaatagatgcaaccacctaacctggcggcagcgcaaaagatg

SEQ ID NO: 11416 - DNA, 103 bp, Artificial Sequence
  Synthetic Polynucleotide
taatacgactcactatagggagcttggctagtgtcaaaggtggttgtcccaacagaggagagggacaatgacctttgacaacctggcggcagcgcaaaagatg

SEQ ID NO: 11417 - DNA, 103 bp, Artificial Sequence
  Synthetic Polynucleotide
taatacgactcactatagggcgacaagcttggctagtgtcaaaggtggttaacagaggagaaaccacatgtgacactagaacctggcggcagcgcaaaagatg

SEQ ID NO: 11418 - DNA, 103 bp, Artificial Sequence
  Synthetic Polynucleotide
taatacgactcactataggggcccacgacaagcttggctagtgtcaaaggaacagaggagacctttgatgctagccaagaacctggcggcagcgcaaaagatg

SEQ ID NO: 11419 - DNA, 103 bp, Artificial Sequence
  Synthetic Polynucleotide
taatacgactcactatagggtgtgtgcccacgacaagcttggctagtgtcaacagaggagagacactatgcaagcttgtaacctggcggcagcgcaaaagatg

SEQ ID NO: 11420 - DNA, 103 bp, Artificial Sequence
  Synthetic Polynucleotide
taatacgactcactatagggaatgctgtgtgcccacgacaagcttggctaaacagaggagatagccaatgttgtcgtggaacctggcggcagcgcaaaagatg

SEQ ID NO: 11421 - DNA, 103 bp, Artificial Sequence
  Synthetic Polynucleotide
taatacgactcactataggggataaaatgctgtgtgcccacgacaagcttaacagaggagaaagcttatggtgggcacaaacctggcggcagcgcaaaagatg

SEQ ID NO: 11422 - DNA, 103 bp, Artificial Sequence
  Synthetic Polynucleotide
taatacgactcactatagggtgcaagataaaatgctgtgtgcccacgacaaacagaggagatgtcgtatgcacacagcaaacctggcggcagcgcaaaagatg

SEQ ID NO: 11423 - DNA, 103 bp, Artificial Sequence
  Synthetic Polynucleotide
taatacgactcactatagggtgtggggtattggatcaatccctgctcagaaacagaggagatctgagatgggattgatcaacctggcggcagcgcaaaagatg

SEQ ID NO: 11424 - DNA, 103 bp, Artificial Sequence
  Synthetic Polynucleotide
taatacgactcactataggggacgttgcaagataaaatgctgtgtgcccaaacagaggagatgggcaatgagcattttaaacctggcggcagcgcaaaagatg

SEQ ID NO: 11425 - DNA, 103 bp, Artificial Sequence
  Synthetic Polynucleotide
taatacgactcactatagggatgtcgacgttgcaagataaaatgctgtgtaacagaggagaacacagatgtttatcttgaacctggcggcagcgcaaaagatg

SEQ ID NO: 11426 - DNA, 103 bp, Artificial Sequence
  Synthetic Polynucleotide
taatacgactcactatagggtgggaatgtcgacgttgcaagataaaatgcaacagaggagagcatttatgcttgcaacgaacctggcggcagcgcaaaagatg

SEQ ID NO: 11427 - DNA, 103 bp, Artificial Sequence
  Synthetic Polynucleotide
taatacgactcactatagggattgatgggaatgtcgacgttgcaagataaaacagaggagattatctatgaacgtcgacaacctggcggcagcgcaaaagatg

SEQ ID NO: 11428 - DNA, 103 bp, Artificial Sequence
  Synthetic Polynucleotide
taatacgactcactatagggctcagattgatgggaatgtcgacgttgcaaaacagaggagattgcaaatgcgacattccaacctggcggcagcgcaaaagatg

SEQ ID NO: 11429 - DNA, 103 bp, Artificial Sequence
  Synthetic Polynucleotide
taatacgactcactatagggtactcctcagattgatgggaatgtcgacgtaacagaggagaacgtcgatgttcccatcaaacctggcggcagcgcaaaagatg

SEQ ID NO: 11430 - DNA, 103 bp, Artificial Sequence
  Synthetic Polynucleotide
taatacgactcactataggggctgttactcctcagattgatgggaatgtcaacagaggagagacattatgatcaatctgaacctggcggcagcgcaaaagatg

SEQ ID NO: 11431 - DNA, 103 bp, Artificial Sequence
  Synthetic Polynucleotide
taatacgactcactatagggtgatagctgttactcctcagattgatgggaaacagaggagatcccatatgtctgaggagaacctggcggcagcgcaaaagatg

SEQ ID NO: 11432 - DNA, 103 bp, Artificial Sequence
  Synthetic Polynucleotide
taatacgactcactatagggtgttttgatagctgttactcctcagattgaaacagaggagatcaatcatgggagtaacaaacctggcggcagcgcaaaagatg

SEQ ID NO: 11433 - DNA, 103 bp, Artificial Sequence
  Synthetic Polynucleotide
taatacgactcactatagggtgcgttgttttgatagctgttactcctcagaacagaggagactgaggatgaacagctataacctggcggcagcgcaaaagatg

SEQ ID NO: 11434 - DNA, 103 bp, Artificial Sequence
  Synthetic Polynucleotide
taatacgactcactatagggcaggctgtggggtattggatcaatccctgcaacagaggagagcagggatggatccaataaacctggcggcagcgcaaaagatg

SEQ ID NO: 11435 - DNA, 103 bp, Artificial Sequence
  Synthetic Polynucleotide
taatacgactcactatagggacatatgcgttgttttgatagctgttactcaacagaggagagagtaaatgctatcaaaaaacctggcggcagcgcaaaagatg

SEQ ID NO: 11436 - DNA, 103 bp, Artificial Sequence
  Synthetic Polynucleotide
taatacgactcactatagggtgtctacatatgcgttgttttgatagctgtaacagaggagaacagctatgaaaacaacgaacctggcggcagcgcaaaagatg

SEQ ID NO: 11437 - DNA, 103 bp, Artificial Sequence
  Synthetic Polynucleotide
taatacgactcactataggggacaatgtctacatatgcgttgttttgataaacagaggagatatcaaatgaacgcatataacctggcggcagcgcaaaagatg

SEQ ID NO: 11438 - DNA, 103 bp, Artificial Sequence
  Synthetic Polynucleotide
taatacgactcactatagggttaccgacaatgtctacatatgcgttgtttaacagaggagaaaacaaatgatatgtagaaacctggcggcagcgcaaaagatg

SEQ ID NO: 11439 - DNA, 103 bp, Artificial Sequence
  Synthetic Polynucleotide
taatacgactcactatagggtactattaccgacaatgtctacatatgcgtaacagaggagaacgcatatgtagacattgaacctggcggcagcgcaaaagatg

SEQ ID NO: 11440 - DNA, 103 bp, Artificial Sequence
  Synthetic Polynucleotide
taatacgactcactatagggggcagtactattaccgacaatgtctacataaacagaggagatatgtaatgattgtcggtaacctggcggcagcgcaaaagatg

SEQ ID NO: 11441 - DNA, 103 bp, Artificial Sequence
  Synthetic Polynucleotide
taatacgactcactatagggtcttaggcagtactattaccgacaatgtctaacagaggagaagacatatgcggtaatagaacctggcggcagcgcaaaagatg

SEQ ID NO: 11442 - DNA, 103 bp, Artificial Sequence
  Synthetic Polynucleotide
taatacgactcactatagggagttgtcttaggcagtactattaccgacaaaacagaggagattgtcgatgatagtactgaacctggcggcagcgcaaaagatg

SEQ ID NO: 11443 - DNA, 103 bp, Artificial Sequence
  Synthetic Polynucleotide
taatacgactcactatagggtaaatagttgtcttaggcagtactattaccaacagaggagaggtaatatgactgcctaaaacctggcggcagcgcaaaagatg

SEQ ID NO: 11444 - DNA, 103 bp, Artificial Sequence
  Synthetic Polynucleotide
taatacgactcactatagggtattataaatagttgtcttaggcagtactaaacagaggagatagtacatgctaagacaaaacctggcggcagcgcaaaagatg

SEQ ID NO: 11445 - DNA, 103 bp, Artificial Sequence
  Synthetic Polynucleotide
taatacgactcactatagggactgccaggctgtggggtattggatcaatcaacagaggagagattgaatgaataccccaaacctggcggcagcgcaaaagatg

SEQ ID NO: 11446 - DNA, 103 bp, Artificial Sequence
  Synthetic Polynucleotide
taatacgactcactatagggactgttattataaatagttgtcttaggcagaacagaggagactgcctatgacaactattaacctggcggcagcgcaaaagatg

SEQ ID NO: 11447 - DNA, 103 bp, Artificial Sequence
  Synthetic Polynucleotide
taatacgactcactatagggttccaactgttattataaatagttgtcttaaacagaggagataagacatgtatttataaaacctggcggcagcgcaaaagatg

SEQ ID NO: 11448 - DNA, 103 bp, Artificial Sequence
  Synthetic Polynucleotide
taatacgactcactatagggatgaattccaactgttattataaatagttgaacagaggagacaactaatgataataacaaacctggcggcagcgcaaaagatg

SEQ ID NO: 11449 - DNA, 103 bp, Artificial Sequence
  Synthetic Polynucleotide
taatacgactcactatagggaaaaaatgaattccaactgttattataaataacagaggagaatttatatgaacagttggaacctggcggcagcgcaaaagatg

SEQ ID NO: 11450 - DNA, 103 bp, Artificial Sequence
  Synthetic Polynucleotide
taatacgactcactataggggggtgaaaaaatgaattccaactgttattaaacagaggagataataaatgttggaattcaacctggcggcagcgcaaaagatg

SEQ ID NO: 11451 - DNA, 103 bp, Artificial Sequence
  Synthetic Polynucleotide
taatacgactcactatagggagcttgggtgaaaaaatgaattccaactgtaacagaggagaacagttatgattcattttaacctggcggcagcgcaaaagatg

SEQ ID NO: 11452 - DNA, 103 bp, Artificial Sequence
  Synthetic Polynucleotide
taatacgactcactatagggagaatagcttgggtgaaaaaatgaattccaaacagaggagatggaatatgttttttcacaacctggcggcagcgcaaaagatg

SEQ ID NO: 11453 - DNA, 103 bp, Artificial Sequence
  Synthetic Polynucleotide
taatacgactcactatagggacttgagaatagcttgggtgaaaaaatgaaaacagaggagattcattatgtcacccaagaacctggcggcagcgcaaaagatg

SEQ ID NO: 11454 - DNA, 103 bp, Artificial Sequence
  Synthetic Polynucleotide
taatacgactcactatagggtgttaacttgagaatagcttgggtgaaaaaaacagaggagatttttcatgcaagctattaacctggcggcagcgcaaaagatg

SEQ ID NO: 11455 - DNA, 103 bp, Artificial Sequence
  Synthetic Polynucleotide
taatacgactcactatagggtcaactgttaacttgagaatagcttgggtgaacagaggagacacccaatgtattctcaaaacctggcggcagcgcaaaagatg

SEQ ID NO: 11456 - DNA, 103 bp, Artificial Sequence
  Synthetic Polynucleotide
taatacgactcactatagggaactgactgccaggctgtggggtattggataacagaggagaatccaaatgcccacagccaacctggcggcagcgcaaaagatg

SEQ ID NO: 11457 - DNA, 103 bp, Artificial Sequence
  Synthetic Polynucleotide
taatacgactcactatagggctgtttcaactgttaacttgagaatagcttaacagaggagaaagctaatgtcaagttaaaacctggcggcagcgcaaaagatg

SEQ ID NO: 11458 - DNA, 103 bp, Artificial Sequence
  Synthetic Polynucleotide
taatacgactcactataggggagtcctgtttcaactgttaacttgagaataacagaggagaattctcatgttaacagttaacctggcggcagcgcaaaagatg

SEQ ID NO: 11459 - DNA, 103 bp, Artificial Sequence
  Synthetic Polynucleotide
taatacgactcactataggggggtcgagtcctgtttcaactgttaacttgaacagaggagacaagttatgagttgaaacaacctggcggcagcgcaaaagatg

SEQ ID NO: 11460 - DNA, 103 bp, Artificial Sequence
  Synthetic Polynucleotide
taatacgactcactataggggtcctgggtcgagtcctgtttcaactgttaaacagaggagataacagatgaaacaggacaacctggcggcagcgcaaaagatg

SEQ ID NO: 11461 - DNA, 103 bp, Artificial Sequence
  Synthetic Polynucleotide
taatacgactcactataggggagttgtcctgggtcgagtcctgtttcaacaacagaggagagttgaaatgggactcgacaacctggcggcagcgcaaaagatg

SEQ ID NO: 11462 - DNA, 103 bp, Artificial Sequence
  Synthetic Polynucleotide
taatacgactcactatagggatccggagttgtcctgggtcgagtcctgttaacagaggagaaacaggatgcgacccaggaacctggcggcagcgcaaaagatg

SEQ ID NO: 11463 - DNA, 103 bp, Artificial Sequence
  Synthetic Polynucleotide
taatacgactcactatagggtacgtatccggagttgtcctgggtcgagtcaacagaggagagactcgatgcaggacaacaacctggcggcagcgcaaaagatg

SEQ ID NO: 11464 - DNA, 103 bp, Artificial Sequence
  Synthetic Polynucleotide
taatacgactcactatagggtatgttacgtatccggagttgtcctgggtcaacagaggagagacccaatgcaactccggaacctggcggcagcgcaaaagatg

SEQ ID NO: 11465 - DNA, 103 bp, Artificial Sequence
  Synthetic Polynucleotide
taatacgactcactatagggtttcttatgttacgtatccggagttgtcctaacagaggagaaggacaatgccggatacgaacctggcggcagcgcaaaagatg

SEQ ID NO: 11466 - DNA, 103 bp, Artificial Sequence
  Synthetic Polynucleotide
taatacgactcactataggggttcttttcttatgttacgtatccggagttaacagaggagaaactccatgtacgtaacaaacctggcggcagcgcaaaagatg

SEQ ID NO: 11467 - DNA, 103 bp, Artificial Sequence
  Synthetic Polynucleotide
taatacgactcactatagggtgtccaactgactgccaggctgtggggtataacagaggagaatacccatgagcctggcaaacctggcggcagcgcaaaagatg

SEQ ID NO: 11468 - DNA, 103 bp, Artificial Sequence
  Synthetic Polynucleotide
taatacgactcactataggggggttgttcttttcttatgttacgtatccgaacagaggagacggataatgaacataagaaacctggcggcagcgcaaaagatg

SEQ ID NO: 11469 - DNA, 103 bp, Artificial Sequence
  Synthetic Polynucleotide
taatacgactcactataggggtcaagggttgttcttttcttatgttacgtaacagaggagaacgtaaatgaagaaaagaaacctggcggcagcgcaaaagatg

SEQ ID NO: 11470 - DNA, 103 bp, Artificial Sequence
  Synthetic Polynucleotide
taatacgactcactatagggtctgggtcaagggttgttcttttcttatgtaacagaggagaacataaatgaagaacaacaacctggcggcagcgcaaaagatg

SEQ ID NO: 11471 - DNA, 103 bp, Artificial Sequence
  Synthetic Polynucleotide
taatacgactcactatagggttcactctgggtcaagggttgttcttttctaacagaggagaagaaaaatgcaacccttgaacctggcggcagcgcaaaagatg

SEQ ID NO: 11472 - DNA, 103 bp, Artificial Sequence
  Synthetic Polynucleotide
taatacgactcactataggggcttgttcactctgggtcaagggttgttctaacagaggagaagaacaatgcttgacccaaacctggcggcagcgcaaaagatg

SEQ ID NO: 11473 - DNA, 103 bp, Artificial Sequence
  Synthetic Polynucleotide
taatacgactcactatagggtatgagcttgttcactctgggtcaagggttaacagaggagaaaccctatgcccagagtgaacctggcggcagcgcaaaagatg

SEQ ID NO: 11474 - DNA, 103 bp, Artificial Sequence
  Synthetic Polynucleotide
taatacgactcactataggggatagtatgagcttgttcactctgggtcaaaacagaggagattgaccatgagtgaacaaaacctggcggcagcgcaaaagatg

SEQ ID NO: 11475 - DNA, 103 bp, Artificial Sequence
  Synthetic Polynucleotide
taatacgactcactataggggccttgatagtatgagcttgttcactctggaacagaggagaccagagatgacaagctcaaacctggcggcagcgcaaaagatg

SEQ ID NO: 11476 - DNA, 103 bp, Artificial Sequence
  Synthetic Polynucleotide
taatacgactcactataggggattagccttgatagtatgagcttgttcacaacagaggagagtgaacatgctcatactaaacctggcggcagcgcaaaagatg

SEQ ID NO: 11477 - DNA, 103 bp, Artificial Sequence
  Synthetic Polynucleotide
taatacgactcactatagggccgaggattagccttgatagtatgagcttgaacagaggagacaagctatgactatcaagaacctggcggcagcgcaaaagatg

SEQ ID NO: 11478 - DNA, 103 bp, Artificial Sequence
  Synthetic Polynucleotide
taatacgactcactatagggtcatgtgtccaactgactgccaggctgtggaacagaggagaccacagatgggcagtcagaacctggcggcagcgcaaaagatg

SEQ ID NO: 11479 - DNA, 103 bp, Artificial Sequence
  Synthetic Polynucleotide
taatacgactcactatagggcaggcccgaggattagccttgatagtatgaaacagaggagatcatacatgcaaggctaaaacctggcggcagcgcaaaagatg

SEQ ID NO: 11480 - DNA, 103 bp, Artificial Sequence
  Synthetic Polynucleotide
taatacgactcactatagggccaggcaggcccgaggattagccttgatagaacagaggagactatcaatgctaatcctcaacctggcggcagcgcaaaagatg

SEQ ID NO: 11481 - DNA, 103 bp, Artificial Sequence
  Synthetic Polynucleotide
taatacgactcactatagggggactccaggcaggcccgaggattagccttaacagaggagaaaggctatgcctcgggccaacctggcggcagcgcaaaagatg

SEQ ID NO: 11482 - DNA, 103 bp, Artificial Sequence
  Synthetic Polynucleotide
taatacgactcactatagggattgtggactccaggcaggcccgaggattaaacagaggagataatccatgggcctgcctaacctggcggcagcgcaaaagatg

SEQ ID NO: 11483 - DNA, 103 bp, Artificial Sequence
  Synthetic Polynucleotide
taatacgactcactatagggtggccattgtggactccaggcaggcccgagaacagaggagactcgggatggcctggagtaacctggcggcagcgcaaaagatg

SEQ ID NO: 11484 - DNA, 103 bp, Artificial Sequence
  Synthetic Polynucleotide
taatacgactcactatagggagccttggccattgtggactccaggcaggcaacagaggagagcctgcatggagtccacaaacctggcggcagcgcaaaagatg

SEQ ID NO: 11485 - DNA, 103 bp, Artificial Sequence
  Synthetic Polynucleotide
taatacgactcactatagggccagtagccttggccattgtggactccaggaacagaggagacctggaatgcacaatggcaacctggcggcagcgcaaaagatg

SEQ ID NO: 11486 - DNA, 103 bp, Artificial Sequence
  Synthetic Polynucleotide
taatacgactcactatagggacctcccagtagccttggccattgtggactaacagaggagaagtccaatgtggccaaggaacctggcggcagcgcaaaagatg

SEQ ID NO: 11487 - DNA, 103 bp, Artificial Sequence
  Synthetic Polynucleotide
taatacgactcactataggggttgtacctcccagtagccttggccattgtaacagaggagaacaatgatgaaggctactaacctggcggcagcgcaaaagatg

SEQ ID NO: 11488 - DNA, 103 bp, Artificial Sequence
  Synthetic Polynucleotide
taatacgactcactatagggataaggttgtacctcccagtagccttggccaacagaggagaggccaaatgtactgggagaacctggcggcagcgcaaaagatg

SEQ ID NO: 11489 - DNA, 103 bp, Artificial Sequence
  Synthetic Polynucleotide
taatacgactcactataggggaccatcatgtgtccaactgactgccaggcaacagaggagagcctggatgtcagttggaaacctggcggcagcgcaaaagatg

SEQ ID NO: 11490 - DNA, 103 bp, Artificial Sequence
  Synthetic Polynucleotide
taatacgactcactataggggggagataaggttgtacctcccagtagcctaacagaggagaaggctaatgggaggtacaaacctggcggcagcgcaaaagatg

SEQ ID NO: 11491 - DNA, 103 bp, Artificial Sequence
  Synthetic Polynucleotide
taatacgactcactatagggctttggggagataaggttgtacctcccagtaacagaggagaactgggatgtacaaccttaacctggcggcagcgcaaaagatg

SEQ ID NO: 11492 - DNA, 103 bp, Artificial Sequence
  Synthetic Polynucleotide
taatacgactcactatagggtctttctttggggagataaggttgtacctcaacagaggagagaggtaatgccttatctcaacctggcggcagcgcaaaagatg

SEQ ID NO: 11493 - DNA, 103 bp, Artificial Sequence
  Synthetic Polynucleotide
taatacgactcactatagggcaagatctttctttggggagataaggttgtaacagaggagaacaaccatgtctccccaaaacctggcggcagcgcaaaagatg

SEQ ID NO: 11494 - DNA, 103 bp, Artificial Sequence
  Synthetic Polynucleotide
taatacgactcactatagggtttttcaagatctttctttggggagataagaacagaggagacttatcatgccaaagaaaaacctggcggcagcgcaaaagatg

SEQ ID NO: 11495 - DNA, 103 bp, Artificial Sequence
  Synthetic Polynucleotide
taatacgactcactatagggagccctttttcaagatctttctttggggagaacagaggagactccccatggaaagatctaacctggcggcagcgcaaaagatg

SEQ ID NO: 11496 - DNA, 103 bp, Artificial Sequence
  Synthetic Polynucleotide
taatacgactcactataggggaaccagccctttttcaagatctttctttgaacagaggagacaaagaatgatcttgaaaaacctggcggcagcgcaaaagatg

SEQ ID NO: 11497 - DNA, 103 bp, Artificial Sequence
  Synthetic Polynucleotide
taatacgactcactatagggattcagaaccagccctttttcaagatctttaacagaggagaaaagatatggaaaaagggaacctggcggcagcgcaaaagatg

SEQ ID NO: 11498 - DNA, 103 bp, Artificial Sequence
  Synthetic Polynucleotide
taatacgactcactatagggaggtcattcagaaccagccctttttcaagaaacagaggagatcttgaatgagggctggtaacctggcggcagcgcaaaagatg

SEQ ID NO: 11499 - DNA, 103 bp, Artificial Sequence
  Synthetic Polynucleotide
taatacgactcactatagggtgcaaaggtcattcagaaccagccctttttaacagaggagaaaaaagatgtggttctgaaacctggcggcagcgcaaaagatg

SEQ ID NO: 11500 - DNA, 103 bp, Artificial Sequence
  Synthetic Polynucleotide
taatacgactcactatagggaaaatgaccatcatgtgtccaactgactgcaacagaggagagcagtcatgtggacacataacctggcggcagcgcaaaagatg

SEQ ID NO: 11501 - DNA, 103 bp, Artificial Sequence
  Synthetic Polynucleotide
taatacgactcactataggggagagtgcaaaggtcattcagaaccagcccaacagaggagagggctgatgctgaatgacaacctggcggcagcgcaaaagatg

SEQ ID NO: 11502 - DNA, 103 bp, Artificial Sequence
  Synthetic Polynucleotide
taatacgactcactatagggactgagagagtgcaaaggtcattcagaaccaacagaggagaggttctatgtgacctttgaacctggcggcagcgcaaaagatg

SEQ ID NO: 11503 - DNA, 103 bp, Artificial Sequence
  Synthetic Polynucleotide
taatacgactcactataggggggccactgagagagtgcaaaggtcattcaaacagaggagatgaatgatgtttgcactcaacctggcggcagcgcaaaagatg

SEQ ID NO: 11504 - DNA, 103 bp, Artificial Sequence
  Synthetic Polynucleotide
taatacgactcactatagggcgtctgggccactgagagagtgcaaaggtcaacagaggagagaccttatgactctctcaaacctggcggcagcgcaaaagatg

SEQ ID NO: 11505 - DNA, 103 bp, Artificial Sequence
  Synthetic Polynucleotide
taatacgactcactatagggtggaccgtctgggccactgagagagtgcaaaacagaggagattgcacatgctcagtggcaacctggcggcagcgcaaaagatg

SEQ ID NO: 11506 - DNA, 103 bp, Artificial Sequence
  Synthetic Polynucleotide
taatacgactcactatagggatccctggaccgtctgggccactgagagagaacagaggagactctctatgtggcccagaaacctggcggcagcgcaaaagatg

SEQ ID NO: 11507 - DNA, 103 bp, Artificial Sequence
  Synthetic Polynucleotide
taatacgactcactatagggcttccatccctggaccgtctgggccactgaaacagaggagatcagtgatgcagacggtcaacctggcggcagcgcaaaagatg

SEQ ID NO: 11508 - DNA, 103 bp, Artificial Sequence
  Synthetic Polynucleotide
taatacgactcactataggggtaaccttccatccctggaccgtctgggccaacagaggagaggcccaatgggtccagggaacctggcggcagcgcaaaagatg

SEQ ID NO: 11509 - DNA, 103 bp, Artificial Sequence
  Synthetic Polynucleotide
taatacgactcactatagggcccaggtaaccttccatccctggaccgtctaacagaggagaagacggatgagggatggaaacctggcggcagcgcaaaagatg

SEQ ID NO: 11510 - DNA, 103 bp, Artificial Sequence
  Synthetic Polynucleotide
taatacgactcactatagggcccagcccaggtaaccttccatccctggacaacagaggagagtccagatgtggaaggttaacctggcggcagcgcaaaagatg

SEQ ID NO: 11511 - DNA, 103 bp, Artificial Sequence
  Synthetic Polynucleotide
taatacgactcactataggggtctgaaaatgaccatcatgtgtccaactgaacagaggagacagttgatgacatgatggaacctggcggcagcgcaaaagatg

SEQ ID NO: 11512 - DNA, 103 bp, Artificial Sequence
  Synthetic Polynucleotide
taatacgactcactatagggtcaatcccagcccaggtaaccttccatcccaacagaggagagggatgatgggttacctgaacctggcggcagcgcaaaagatg

SEQ ID NO: 11513 - DNA, 103 bp, Artificial Sequence
  Synthetic Polynucleotide
taatacgactcactatagggcaaattcaatcccagcccaggtaaccttccaacagaggagaggaaggatgcctgggctgaacctggcggcagcgcaaaagatg

SEQ ID NO: 11514 - DNA, 103 bp, Artificial Sequence
  Synthetic Polynucleotide
taatacgactcactatagggaacatcaaattcaatcccagcccaggtaacaacagaggagagttaccatggctgggattaacctggcggcagcgcaaaagatg

SEQ ID NO: 11515 - DNA, 103 bp, Artificial Sequence
  Synthetic Polynucleotide
taatacgactcactatagggtgtgtaacatcaaattcaatcccagcccagaacagaggagactgggcatggattgaattaacctggcggcagcgcaaaagatg

SEQ ID NO: 11516 - DNA, 103 bp, Artificial Sequence
  Synthetic Polynucleotide
taatacgactcactatagggctttctgtgtaacatcaaattcaatcccagaacagaggagactgggaatgaatttgatgaacctggcggcagcgcaaaagatg

SEQ ID NO: 11517 - DNA, 103 bp, Artificial Sequence
  Synthetic Polynucleotide
taatacgactcactatagggcatccctttctgtgtaacatcaaattcaataacagaggagaattgaaatggatgttacaaacctggcggcagcgcaaaagatg

SEQ ID NO: 11518 - DNA, 103 bp, Artificial Sequence
  Synthetic Polynucleotide
taatacgactcactatagggaaggccatccctttctgtgtaacatcaaataacagaggagaatttgaatgtacacagaaaacctggcggcagcgcaaaagatg

SEQ ID NO: 11519 - DNA, 103 bp, Artificial Sequence
  Synthetic Polynucleotide
taatacgactcactataggggcaataaggccatccctttctgtgtaacataacagaggagaatgttaatgagaaagggaaacctggcggcagcgcaaaagatg

SEQ ID NO: 11520 - DNA, 103 bp, Artificial Sequence
  Synthetic Polynucleotide
taatacgactcactatagggcctgtgcaataaggccatccctttctgtgtaacagaggagaacacagatggggatggccaacctggcggcagcgcaaaagatg

SEQ ID NO: 11521 - DNA, 103 bp, Artificial Sequence
  Synthetic Polynucleotide
taatacgactcactatagggttgagcctgtgcaataaggccatccctttcaacagaggagagaaaggatgggccttattaacctggcggcagcgcaaaagatg

SEQ ID NO: 11522 - DNA, 103 bp, Artificial Sequence
  Synthetic Polynucleotide
taatacgactcactatagggagagtaagtaacagatcaatgagaatcttaaacagaggagataagatatgcattgatctaacctggcggcagcgcaaaagatg

SEQ ID NO: 11523 - DNA, 103 bp, Artificial Sequence
  Synthetic Polynucleotide
taatacgactcactatagggcatcagtctgaaaatgaccatcatgtgtccaacagaggagaggacacatgatggtcattaacctggcggcagcgcaaaagatg

SEQ ID NO: 11524 - DNA, 103 bp, Artificial Sequence
  Synthetic Polynucleotide
taatacgactcactatagggtggtcttgagcctgtgcaataaggccatccaacagaggagaggatggatgtattgcacaaacctggcggcagcgcaaaagatg

SEQ ID NO: 11525 - DNA, 103 bp, Artificial Sequence
  Synthetic Polynucleotide
taatacgactcactatagggatcactggtcttgagcctgtgcaataaggcaacagaggagagccttaatgcacaggctcaacctggcggcagcgcaaaagatg

SEQ ID NO: 11526 - DNA, 103 bp, Artificial Sequence
  Synthetic Polynucleotide
taatacgactcactataggggcaaaatcactggtcttgagcctgtgcaataacagaggagaattgcaatggctcaagacaacctggcggcagcgcaaaagatg

SEQ ID NO: 11527 - DNA, 103 bp, Artificial Sequence
  Synthetic Polynucleotide
taatacgactcactatagggctggagcaaaatcactggtcttgagcctgtaacagaggagaacaggcatgagaccagtgaacctggcggcagcgcaaaagatg

SEQ ID NO: 11528 - DNA, 103 bp, Artificial Sequence
  Synthetic Polynucleotide
taatacgactcactatagggccaggctggagcaaaatcactggtcttgagaacagaggagactcaagatgagtgattttaacctggcggcagcgcaaaagatg

SEQ ID NO: 11529 - DNA, 103 bp, Artificial Sequence
  Synthetic Polynucleotide
taatacgactcactatagggattgaccaggctggagcaaaatcactggtcaacagaggagagaccagatgttttgctccaacctggcggcagcgcaaaagatg

SEQ ID NO: 11530 - DNA, 103 bp, Artificial Sequence
  Synthetic Polynucleotide
taatacgactcactatagggtggtcattgaccaggctggagcaaaatcacaacagaggagagtgattatgctccagcctaacctggcggcagcgcaaaagatg

SEQ ID NO: 11531 - DNA, 103 bp, Artificial Sequence
  Synthetic Polynucleotide
taatacgactcactataggggttcctggtcattgaccaggctggagcaaaaacagaggagatttgctatggcctggtcaaacctggcggcagcgcaaaagatg

SEQ ID NO: 11532 - DNA, 103 bp, Artificial Sequence
  Synthetic Polynucleotide
taatacgactcactatagggaataagttcctggtcattgaccaggctggaaacagaggagatccagcatggtcaatgacaacctggcggcagcgcaaaagatg

SEQ ID NO: 11533 - DNA, 103 bp, Artificial Sequence
  Synthetic Polynucleotide
taatacgactcactataggggtggaaataagttcctggtcattgaccaggaacagaggagacctggtatgtgaccaggaaacctggcggcagcgcaaaagatg

SEQ ID NO: 11534 - DNA, 103 bp, Artificial Sequence
  Synthetic Polynucleotide
taatacgactcactataggggttctcatcagtctgaaaatgaccatcatgaacagaggagacatgatatgcattttcagaacctggcggcagcgcaaaagatg

SEQ ID NO: 11535 - DNA, 103 bp, Artificial Sequence
  Synthetic Polynucleotide
taatacgactcactataggggagatgtggaaataagttcctggtcattgaaacagaggagatcaatgatgaggaacttaaacctggcggcagcgcaaaagatg

SEQ ID NO: 11536 - DNA, 103 bp, Artificial Sequence
  Synthetic Polynucleotide
taatacgactcactatagggtgaaagagatgtggaaataagttcctggtcaacagaggagagaccagatgcttatttccaacctggcggcagcgcaaaagatg

SEQ ID NO: 11537 - DNA, 103 bp, Artificial Sequence
  Synthetic Polynucleotide
taatacgactcactatagggggttttgaaagagatgtggaaataagttccaacagaggagaggaactatgttccacatcaacctggcggcagcgcaaaagatg

SEQ ID NO: 11538 - DNA, 103 bp, Artificial Sequence
  Synthetic Polynucleotide
taatacgactcactataggggttcgggttttgaaagagatgtggaaataaaacagaggagattatttatgcatctctttaacctggcggcagcgcaaaagatg

SEQ ID NO: 11539 - DNA, 103 bp, Artificial Sequence
  Synthetic Polynucleotide
taatacgactcactataggggtagagttcgggttttgaaagagatgtggaaacagaggagatccacaatgctttcaaaaaacctggcggcagcgcaaaagatg

SEQ ID NO: 11540 - DNA, 103 bp, Artificial Sequence
  Synthetic Polynucleotide
taatacgactcactatagggcaattgtagagttcgggttttgaaagagataacagaggagaatctctatgaaaacccgaaacctggcggcagcgcaaaagatg

SEQ ID NO: 11541 - DNA, 103 bp, Artificial Sequence
  Synthetic Polynucleotide
taatacgactcactatagggcgactcaattgtagagttcgggttttgaaaaacagaggagatttcaaatgccgaactctaacctggcggcagcgcaaaagatg

SEQ ID NO: 11542 - DNA, 103 bp, Artificial Sequence
  Synthetic Polynucleotide
taatacgactcactatagggagtggcgactcaattgtagagttcgggtttaacagaggagaaaacccatgctctacaataacctggcggcagcgcaaaagatg

SEQ ID NO: 11543 - DNA, 103 bp, Artificial Sequence
  Synthetic Polynucleotide
taatacgactcactatagggcccaaagtggcgactcaattgtagagttcgaacagaggagacgaactatgcaattgagtaacctggcggcagcgcaaaagatg

SEQ ID NO: 11544 - DNA, 103 bp, Artificial Sequence
  Synthetic Polynucleotide
taatacgactcactatagggcagtgcccaaagtggcgactcaattgtagaaacagaggagatctacaatggagtcgccaaacctggcggcagcgcaaaagatg

SEQ ID NO: 11545 - DNA, 103 bp, Artificial Sequence
  Synthetic Polynucleotide
taatacgactcactatagggaatttgttctcatcagtctgaaaatgaccaaacagaggagatggtcaatgtcagactgaaacctggcggcagcgcaaaagatg

SEQ ID NO: 11546 - DNA, 103 bp, Artificial Sequence
  Synthetic Polynucleotide
taatacgactcactatagggacccgcagtgcccaaagtggcgactcaattaacagaggagaaattgaatggccactttgaacctggcggcagcgcaaaagatg

SEQ ID NO: 11547 - DNA, 103 bp, Artificial Sequence
  Synthetic Polynucleotide
taatacgactcactataggggtatgacccgcagtgcccaaagtggcgactaacagaggagaagtcgcatgtttgggcacaacctggcggcagcgcaaaagatg

SEQ ID NO: 11548 - DNA, 103 bp, Artificial Sequence
  Synthetic Polynucleotide
taatacgactcactatagggtgctagtatgacccgcagtgcccaaagtggaacagaggagaccacttatggcactgcggaacctggcggcagcgcaaaagatg

SEQ ID NO: 11549 - DNA, 103 bp, Artificial Sequence
  Synthetic Polynucleotide
taatacgactcactatagggcctgctgctagtatgacccgcagtgcccaaaacagaggagattgggcatggcgggtcataacctggcggcagcgcaaaagatg

SEQ ID NO: 11550 - DNA, 103 bp, Artificial Sequence
  Synthetic Polynucleotide
taatacgactcactataggggaatacctgctgctagtatgacccgcagtgaacagaggagacactgcatgtcatactagaacctggcggcagcgcaaaagatg

SEQ ID NO: 11551 - DNA, 103 bp, Artificial Sequence
  Synthetic Polynucleotide
taatacgactcactatagggatcttgaatacctgctgctagtatgacccgaacagaggagacgggtcatgctagcagcaaacctggcggcagcgcaaaagatg

SEQ ID NO: 11552 - DNA, 103 bp, Artificial Sequence
  Synthetic Polynucleotide
taatacgactcactatagggagctgatcttgaatacctgctgctagtatgaacagaggagacatactatgagcaggtataacctggcggcagcgcaaaagatg

SEQ ID NO: 11553 - DNA, 103 bp, Artificial Sequence
  Synthetic Polynucleotide
taatacgactcactatagggcaattagctgatcttgaatacctgctgctaaacagaggagatagcagatggtattcaagaacctggcggcagcgcaaaagatg

SEQ ID NO: 11554 - DNA, 103 bp, Artificial Sequence
  Synthetic Polynucleotide
taatacgactcactatagggttgatcaattagctgatcttgaatacctgcaacagaggagagcaggtatgcaagatcagaacctggcggcagcgcaaaagatg

SEQ ID NO: 11555 - DNA, 103 bp, Artificial Sequence
  Synthetic Polynucleotide
taatacgactcactatagggaacgattgatcaattagctgatcttgaataaacagaggagatattcaatgtcagctaataacctggcggcagcgcaaaagatg

SEQ ID NO: 11556 - DNA, 103 bp, Artificial Sequence
  Synthetic Polynucleotide
taatacgactcactatagggtagaaaatttgttctcatcagtctgaaaataacagaggagaattttcatgctgatgagaaacctggcggcagcgcaaaagatg

SEQ ID NO: 11557 - DNA, 103 bp, Artificial Sequence
  Synthetic Polynucleotide
taatacgactcactatagggcgatcaacgattgatcaattagctgatcttaacagaggagaaagatcatgtaattgatcaacctggcggcagcgcaaaagatg

SEQ ID NO: 11558 - DNA, 103 bp, Artificial Sequence
  Synthetic Polynucleotide
taatacgactcactataggggggttcgatcaacgattgatcaattagctgaacagaggagacagctaatggatcaatcgaacctggcggcagcgcaaaagatg

SEQ ID NO: 11559 - DNA, 103 bp, Artificial Sequence
  Synthetic Polynucleotide
taatacgactcactataggggccaagggttcgatcaacgattgatcaattaacagaggagaaattgaatgatcgttgataacctggcggcagcgcaaaagatg

SEQ ID NO: 11560 - DNA, 103 bp, Artificial Sequence
  Synthetic Polynucleotide
taatacgactcactatagggctcctgccaagggttcgatcaacgattgataacagaggagaatcaatatgtgatcgaacaacctggcggcagcgcaaaagatg

SEQ ID NO: 11561 - DNA, 103 bp, Artificial Sequence
  Synthetic Polynucleotide
taatacgactcactatagggtagcgctcctgccaagggttcgatcaacgaaacagaggagatcgttgatggaacccttgaacctggcggcagcgcaaaagatg

SEQ ID NO: 11562 - DNA, 103 bp, Artificial Sequence
  Synthetic Polynucleotide
taatacgactcactatagggaagcctagcgctcctgccaagggttcgatcaacagaggagagatcgaatgcttggcaggaacctggcggcagcgcaaaagatg

SEQ ID NO: 11563 - DNA, 103 bp, Artificial Sequence
  Synthetic Polynucleotide
taatacgactcactatagggcaattaagcctagcgctcctgccaagggttaacagaggagaaaccctatgcaggagcgcaacctggcggcagcgcaaaagatg

SEQ ID NO: 11564 - DNA, 103 bp, Artificial Sequence
  Synthetic Polynucleotide
taatacgactcactatagggatcagcaattaagcctagcgctcctgccaaaacagaggagattggcaatggcgctaggcaacctggcggcagcgcaaaagatg

SEQ ID NO: 11565 - DNA, 103 bp, Artificial Sequence
  Synthetic Polynucleotide
taatacgactcactatagggagccaatcagcaattaagcctagcgctcctaacagaggagaaggagcatgaggcttaataacctggcggcagcgcaaaagatg

SEQ ID NO: 11566 - DNA, 103 bp, Artificial Sequence
  Synthetic Polynucleotide
taatacgactcactatagggtaagaagccaatcagcaattaagcctagcgaacagaggagacgctagatgtaattgctgaacctggcggcagcgcaaaagatg

SEQ ID NO: 11567 - DNA, 103 bp, Artificial Sequence
  Synthetic Polynucleotide
taatacgactcactatagggttaattagaaaatttgttctcatcagtctgaacagaggagacagactatggagaacaaaaacctggcggcagcgcaaaagatg

SEQ ID NO: 11568 - DNA, 103 bp, Artificial Sequence
  Synthetic Polynucleotide
taatacgactcactatagggagtagtaagaagccaatcagcaattaagccaacagaggagaggcttaatggctgattggaacctggcggcagcgcaaaagatg

SEQ ID NO: 11569 - DNA, 103 bp, Artificial Sequence
  Synthetic Polynucleotide
taatacgactcactataggggttccagtagtaagaagccaatcagcaattaacagaggagaaattgcatgttggcttctaacctggcggcagcgcaaaagatg

SEQ ID NO: 11570 - DNA, 103 bp, Artificial Sequence
  Synthetic Polynucleotide
taatacgactcactatagggggtttgttccagtagtaagaagccaatcagaacagaggagactgattatgttcttactaaacctggcggcagcgcaaaagatg

SEQ ID NO: 11571 - DNA, 103 bp, Artificial Sequence
  Synthetic Polynucleotide
taatacgactcactatagggaaagtggtttgttccagtagtaagaagccaaacagaggagatggcttatgactactggaaacctggcggcagcgcaaaagatg

SEQ ID NO: 11572 - DNA, 103 bp, Artificial Sequence
  Synthetic Polynucleotide
taatacgactcactatagggatttgaaagtggtttgttccagtagtaagaaacagaggagatcttacatgtggaacaaaaacctggcggcagcgcaaaagatg

SEQ ID NO: 11573 - DNA, 103 bp, Artificial Sequence
  Synthetic Polynucleotide
taatacgactcactatagggtgcgcatttgaaagtggtttgttccagtagaacagaggagactactgatgcaaaccactaacctggcggcagcgcaaaagatg

SEQ ID NO: 11574 - DNA, 103 bp, Artificial Sequence
  Synthetic Polynucleotide
taatacgactcactatagggttgtgtgcgcatttgaaagtggtttgttccaacagaggagaggaacaatgcactttcaaaacctggcggcagcgcaaaagatg

SEQ ID NO: 11575 - DNA, 103 bp, Artificial Sequence
  Synthetic Polynucleotide
taatacgactcactataggggcctgttgtgtgcgcatttgaaagtggtttaacagaggagaaaaccaatgtcaaatgcgaacctggcggcagcgcaaaagatg

SEQ ID NO: 11576 - DNA, 103 bp, Artificial Sequence
  Synthetic Polynucleotide
taatacgactcactatagggccttagcctgttgtgtgcgcatttgaaagtaacagaggagaactttcatgtgcgcacacaacctggcggcagcgcaaaagatg

SEQ ID NO: 11577 - DNA, 103 bp, Artificial Sequence
  Synthetic Polynucleotide
taatacgactcactatagggttgctccttagcctgttgtgtgcgcatttgaacagaggagacaaatgatgacacaacagaacctggcggcagcgcaaaagatg

SEQ ID NO: 11578 - DNA, 103 bp, Artificial Sequence
  Synthetic Polynucleotide
taatacgactcactatagggggaacttaattagaaaatttgttctcatcaaacagaggagatgatgaatgcaaattttcaacctggcggcagcgcaaaagatg

SEQ ID NO: 11579 - DNA, 103 bp, Artificial Sequence
  Synthetic Polynucleotide
taatacgactcactatagggcttagttgctccttagcctgttgtgtgcgcaacagaggagagcgcacatgacaggctaaaacctggcggcagcgcaaaagatg

SEQ ID NO: 11580 - DNA, 103 bp, Artificial Sequence
  Synthetic Polynucleotide
taatacgactcactatagggttagacttagttgctccttagcctgttgtgaacagaggagacacaacatgctaaggagcaacctggcggcagcgcaaaagatg

SEQ ID NO: 11581 - DNA, 103 bp, Artificial Sequence
  Synthetic Polynucleotide
taatacgactcactatagggcatttttagacttagttgctccttagcctgaacagaggagacaggctatggagcaactaaacctggcggcagcgcaaaagatg

SEQ ID NO: 11582 - DNA, 103 bp, Artificial Sequence
  Synthetic Polynucleotide
taatacgactcactataggggacaacatttttagacttagttgctccttaaacagaggagataaggaatgactaagtctaacctggcggcagcgcaaaagatg

SEQ ID NO: 11583 - DNA, 103 bp, Artificial Sequence
  Synthetic Polynucleotide
taatacgactcactatagggccagggacaacatttttagacttagttgctaacagaggagaagcaacatggtctaaaaaaacctggcggcagcgcaaaagatg

SEQ ID NO: 11584 - DNA, 103 bp, Artificial Sequence
  Synthetic Polynucleotide
taatacgactcactatagggtcgcaccagggacaacatttttagacttagaacagaggagactaagtatgaaaatgttgaacctggcggcagcgcaaaagatg

SEQ ID NO: 11585 - DNA, 103 bp, Artificial Sequence
  Synthetic Polynucleotide
taatacgactcactatagggtttgatcgcaccagggacaacatttttagaaacagaggagatctaaaatggttgtccctaacctggcggcagcgcaaaagatg

SEQ ID NO: 11586 - DNA, 103 bp, Artificial Sequence
  Synthetic Polynucleotide
taatacgactcactatagggggatgtttgatcgcaccagggacaacatttaacagaggagaaaatgtatgccctggtgcaacctggcggcagcgcaaaagatg

SEQ ID NO: 11587 - DNA, 103 bp, Artificial Sequence
  Synthetic Polynucleotide
taatacgactcactatagggctttaggatgtttgatcgcaccagggacaaaacagaggagattgtccatggtgcgatcaaacctggcggcagcgcaaaagatg

SEQ ID NO: 11588 - DNA, 103 bp, Artificial Sequence
  Synthetic Polynucleotide
taatacgactcactatagggatgaactttaggatgtttgatcgcaccaggaacagaggagacctggtatgatcaaacataacctggcggcagcgcaaaagatg

SEQ ID NO: 11589 - DNA, 103 bp, Artificial Sequence
  Synthetic Polynucleotide
taatacgactcactatagggaaggaggaacttaattagaaaatttgttctaacagaggagaagaacaatgtttctaattaacctggcggcagcgcaaaagatg

SEQ ID NO: 11590 - DNA, 103 bp, Artificial Sequence
  Synthetic Polynucleotide
taatacgactcactatagggggttgatgaactttaggatgtttgatcgcaaacagaggagatgcgatatgacatcctaaaacctggcggcagcgcaaaagatg

SEQ ID NO: 11591 - DNA, 103 bp, Artificial Sequence
  Synthetic Polynucleotide
taatacgactcactatagggtagttggttgatgaactttaggatgtttgaaacagaggagatcaaacatgctaaagttcaacctggcggcagcgcaaaagatg

SEQ ID NO: 11592 - DNA, 103 bp, Artificial Sequence
  Synthetic Polynucleotide
taatacgactcactataggggcatctagttggttgatgaactttaggatgaacagaggagacatcctatggttcatcaaaacctggcggcagcgcaaaagatg

SEQ ID NO: 11593 - DNA, 103 bp, Artificial Sequence
  Synthetic Polynucleotide
taatacgactcactataggggtagtgcatctagttggttgatgaactttaaacagaggagataaagtatgtcaaccaacaacctggcggcagcgcaaaagatg

SEQ ID NO: 11594 - DNA, 103 bp, Artificial Sequence
  Synthetic Polynucleotide
taatacgactcactatagggaacatgtagtgcatctagttggttgatgaaaacagaggagattcatcatgcaactagataacctggcggcagcgcaaaagatg

SEQ ID NO: 11595 - DNA, 103 bp, Artificial Sequence
  Synthetic Polynucleotide
taatacgactcactatagggttcacaacatgtagtgcatctagttggttgaacagaggagacaaccaatgagatgcactaacctggcggcagcgcaaaagatg

SEQ ID NO: 11596 - DNA, 103 bp, Artificial Sequence
  Synthetic Polynucleotide
taatacgactcactatagggtgtaattcacaacatgtagtgcatctagttaacagaggagaaactagatgcactacatgaacctggcggcagcgcaaaagatg

SEQ ID NO: 11597 - DNA, 103 bp, Artificial Sequence
  Synthetic Polynucleotide
taatacgactcactatagggtccattgtaattcacaacatgtagtgcatcaacagaggagagatgcaatgcatgttgtgaacctggcggcagcgcaaaagatg

SEQ ID NO: 11598 - DNA, 103 bp, Artificial Sequence
  Synthetic Polynucleotide
taatacgactcactatagggagaagtccattgtaattcacaacatgtagtaacagaggagaactacaatgtgtgaattaaacctggcggcagcgcaaaagatg

SEQ ID NO: 11599 - DNA, 103 bp, Artificial Sequence
  Synthetic Polynucleotide
taatacgactcactatagggtactgagaagtccattgtaattcacaacataacagaggagaatgttgatgattacaatgaacctggcggcagcgcaaaagatg

SEQ ID NO: 11600 - DNA, 103 bp, Artificial Sequence
  Synthetic Polynucleotide
taatacgactcactatagggtgtataaggaggaacttaattagaaaatttaacagaggagaaaatttatgaattaagttaacctggcggcagcgcaaaagatg

SEQ ID NO: 11601 - DNA, 103 bp, Artificial Sequence
  Synthetic Polynucleotide
taatacgactcactatagggaatgctactgagaagtccattgtaattcacaacagaggagagtgaatatgaatggacttaacctggcggcagcgcaaaagatg

SEQ ID NO: 11602 - DNA, 103 bp, Artificial Sequence
  Synthetic Polynucleotide
taatacgactcactatagggatttcaatgctactgagaagtccattgtaaaacagaggagattacaaatgacttctcagaacctggcggcagcgcaaaagatg

SEQ ID NO: 11603 - DNA, 103 bp, Artificial Sequence
  Synthetic Polynucleotide
taatacgactcactatagggtgccaatttcaatgctactgagaagtccataacagaggagaatggacatgtcagtagcaaacctggcggcagcgcaaaagatg

SEQ ID NO: 11604 - DNA, 103 bp, Artificial Sequence
  Synthetic Polynucleotide
taatacgactcactatagggtttggtgccaatttcaatgctactgagaagaacagaggagacttctcatgagcattgaaaacctggcggcagcgcaaaagatg

SEQ ID NO: 11605 - DNA, 103 bp, Artificial Sequence
  Synthetic Polynucleotide
taatacgactcactatagggtggcttttggtgccaatttcaatgctactgaacagaggagacagtagatgtgaaattggaacctggcggcagcgcaaaagatg

SEQ ID NO: 11606 - DNA, 103 bp, Artificial Sequence
  Synthetic Polynucleotide
taatacgactcactatagggttgtatggcttttggtgccaatttcaatgcaacagaggagagcattgatgttggcaccaaacctggcggcagcgcaaaagatg

SEQ ID NO: 11607 - DNA, 103 bp, Artificial Sequence
  Synthetic Polynucleotide
taatacgactcactatagggtataattgtatggcttttggtgccaatttcaacagaggagagaaattatgaccaaaagcaacctggcggcagcgcaaaagatg

SEQ ID NO: 11608 - DNA, 103 bp, Artificial Sequence
  Synthetic Polynucleotide
taatacgactcactataggggtaattataattgtatggcttttggtgccaaacagaggagatggcacatgaagccatacaacctggcggcagcgcaaaagatg

SEQ ID NO: 11609 - DNA, 103 bp, Artificial Sequence
  Synthetic Polynucleotide
taatacgactcactatagggtccgggtaattataattgtatggcttttggaacagaggagaccaaaaatgatacaattaaacctggcggcagcgcaaaagatg

SEQ ID NO: 11610 - DNA, 103 bp, Artificial Sequence
  Synthetic Polynucleotide
taatacgactcactatagggatttgtccgggtaattataattgtatggctaacagaggagaagccatatgattataattaacctggcggcagcgcaaaagatg

SEQ ID NO: 11611 - DNA, 103 bp, Artificial Sequence
  Synthetic Polynucleotide
taatacgactcactatagggcttgatgtataaggaggaacttaattagaaaacagaggagattctaaatgagttcctccaacctggcggcagcgcaaaagatg

SEQ ID NO: 11612 - DNA, 103 bp, Artificial Sequence
  Synthetic Polynucleotide
taatacgactcactatagggcccatatttgtccgggtaattataattgtaaacagaggagatacaatatgaattacccgaacctggcggcagcgcaaaagatg

SEQ ID NO: 11613 - DNA, 103 bp, Artificial Sequence
  Synthetic Polynucleotide
taatacgactcactatagggaaaaacccatatttgtccgggtaattataaaacagaggagattataaatgcccggacaaaacctggcggcagcgcaaaagatg

SEQ ID NO: 11614 - DNA, 103 bp, Artificial Sequence
  Synthetic Polynucleotide
taatacgactcactatagggtaccaaaaaacccatatttgtccgggtaataacagaggagaattaccatgacaaatatgaacctggcggcagcgcaaaagatg

SEQ ID NO: 11615 - DNA, 103 bp, Artificial Sequence
  Synthetic Polynucleotide
taatacgactcactatagggaactctaccaaaaaacccatatttgtccggaacagaggagaccggacatgtatgggtttaacctggcggcagcgcaaaagatg

SEQ ID NO: 11616 - DNA, 103 bp, Artificial Sequence
  Synthetic Polynucleotide
taatacgactcactatagggcttgcaactctaccaaaaaacccatatttgaacagaggagacaaataatggttttttggaacctggcggcagcgcaaaagatg

SEQ ID NO: 11617 - DNA, 103 bp, Artificial Sequence
  Synthetic Polynucleotide
taatacgactcactatagggaggctcttgcaactctaccaaaaaacccataacagaggagaatgggtatgttggtagagaacctggcggcagcgcaaaagatg

SEQ ID NO: 11618 - DNA, 103 bp, Artificial Sequence
  Synthetic Polynucleotide
taatacgactcactatagggttgtcaggctcttgcaactctaccaaaaaaaacagaggagattttttatgagagttgcaaacctggcggcagcgcaaaagatg

SEQ ID NO: 11619 - DNA, 103 bp, Artificial Sequence
  Synthetic Polynucleotide
taatacgactcactatagggctgatttgtcaggctcttgcaactctaccaaacagaggagatggtagatgtgcaagagcaacctggcggcagcgcaaaagatg

SEQ ID NO: 11620 - DNA, 103 bp, Artificial Sequence
  Synthetic Polynucleotide
taatacgactcactatagggcatggctgatttgtcaggctcttgcaactcaacagaggagagagttgatggagcctgacaacctggcggcagcgcaaaagatg

SEQ ID NO: 11621 - DNA, 103 bp, Artificial Sequence
  Synthetic Polynucleotide
taatacgactcactataggggtgttcatggctgatttgtcaggctcttgcaacagaggagagcaagaatgtgacaaatcaacctggcggcagcgcaaaagatg

SEQ ID NO: 11622 - DNA, 103 bp, Artificial Sequence
  Synthetic Polynucleotide
taatacgactcactatagggcatcccttgatgtataaggaggaacttaataacagaggagaattaagatgctccttataaacctggcggcagcgcaaaagatg

SEQ ID NO: 11623 - DNA, 103 bp, Artificial Sequence
  Synthetic Polynucleotide
taatacgactcactatagggttctggtgttcatggctgatttgtcaggctaacagaggagaagcctgatgaatcagccaaacctggcggcagcgcaaaagatg

SEQ ID NO: 11624 - DNA, 103 bp, Artificial Sequence
  Synthetic Polynucleotide
taatacgactcactatagggtggttttctggtgttcatggctgatttgtcaacagaggagagacaaaatggccatgaacaacctggcggcagcgcaaaagatg

SEQ ID NO: 11625 - DNA, 103 bp, Artificial Sequence
  Synthetic Polynucleotide
taatacgactcactatagggggtcctggttttctggtgttcatggctgataacagaggagaatcagcatggaacaccagaacctggcggcagcgcaaaagatg

SEQ ID NO: 11626 - DNA, 103 bp, Artificial Sequence
  Synthetic Polynucleotide
taatacgactcactatagggtgactggtcctggttttctggtgttcatggaacagaggagaccatgaatgccagaaaacaacctggcggcagcgcaaaagatg

SEQ ID NO: 11627 - DNA, 103 bp, Artificial Sequence
  Synthetic Polynucleotide
taatacgactcactataggggaatttgactggtcctggttttctggtgttaacagaggagaaacaccatgaaaccaggaaacctggcggcagcgcaaaagatg

SEQ ID NO: 11628 - DNA, 103 bp, Artificial Sequence
  Synthetic Polynucleotide
taatacgactcactatagggagggagaatttgactggtcctggttttctgaacagaggagacagaaaatgaggaccagtaacctggcggcagcgcaaaagatg

SEQ ID NO: 11629 - DNA, 103 bp, Artificial Sequence
  Synthetic Polynucleotide
taatacgactcactatagggggaggagggagaatttgactggtcctggttaacagaggagaaaccagatgcagtcaaataacctggcggcagcgcaaaagatg

SEQ ID NO: 11630 - DNA, 103 bp, Artificial Sequence
  Synthetic Polynucleotide
taatacgactcactatagggttcatggaggagggagaatttgactggtccaacagaggagaggaccaatgaaattctccaacctggcggcagcgcaaaagatg

SEQ ID NO: 11631 - DNA, 103 bp, Artificial Sequence
  Synthetic Polynucleotide
taatacgactcactataggggttgattcatggaggagggagaatttgactaacagaggagaagtcaaatgctccctcctaacctggcggcagcgcaaaagatg

SEQ ID NO: 11632 - DNA, 103 bp, Artificial Sequence
  Synthetic Polynucleotide
taatacgactcactatagggtcaaggttgattcatggaggagggagaattaacagaggagaaattctatgtcctccatgaacctggcggcagcgcaaaagatg

SEQ ID NO: 11633 - DNA, 103 bp, Artificial Sequence
  Synthetic Polynucleotide
taatacgactcactatagggtcctcagagtaagtaacagatcaatgagaaaacagaggagattctcaatgatctgttacaacctggcggcagcgcaaaagatg

SEQ ID NO: 11634 - DNA, 103 bp, Artificial Sequence
  Synthetic Polynucleotide
taatacgactcactatagggatatgcatcccttgatgtataaggaggaacaacagaggagagttcctatgtatacatcaaacctggcggcagcgcaaaagatg

SEQ ID NO: 11635 - DNA, 103 bp, Artificial Sequence
  Synthetic Polynucleotide
taatacgactcactatagggtgtcttcaaggttgattcatggaggagggaaacagaggagatccctcatgcatgaatcaaacctggcggcagcgcaaaagatg

SEQ ID NO: 11636 - DNA, 103 bp, Artificial Sequence
  Synthetic Polynucleotide
taatacgactcactataggggcaagtgtcttcaaggttgattcatggaggaacagaggagacctccaatgatcaaccttaacctggcggcagcgcaaaagatg

SEQ ID NO: 11637 - DNA, 103 bp, Artificial Sequence
  Synthetic Polynucleotide
taatacgactcactatagggttttagcaagtgtcttcaaggttgattcataacagaggagaatgaatatgccttgaagaaacctggcggcagcgcaaaagatg

SEQ ID NO: 11638 - DNA, 103 bp, Artificial Sequence
  Synthetic Polynucleotide
taatacgactcactatagggaggttttttagcaagtgtcttcaaggttgaaacagaggagatcaaccatgaagacacttaacctggcggcagcgcaaaagatg

SEQ ID NO: 11639 - DNA, 103 bp, Artificial Sequence
  Synthetic Polynucleotide
taatacgactcactataggggtcgcaggttttttagcaagtgtcttcaagaacagaggagacttgaaatgacttgctaaaacctggcggcagcgcaaaagatg

SEQ ID NO: 11640 - DNA, 103 bp, Artificial Sequence
  Synthetic Polynucleotide
taatacgactcactatagggtctgggtcgcaggttttttagcaagtgtctaacagaggagaagacacatgctaaaaaacaacctggcggcagcgcaaaagatg

SEQ ID NO: 11641 - DNA, 103 bp, Artificial Sequence
  Synthetic Polynucleotide
taatacgactcactatagggttgcatctgggtcgcaggttttttagcaagaacagaggagacttgctatgaaacctgcgaacctggcggcagcgcaaaagatg

SEQ ID NO: 11642 - DNA, 103 bp, Artificial Sequence
  Synthetic Polynucleotide
taatacgactcactatagggagtgcttgcatctgggtcgcaggttttttaaacagaggagataaaaaatgtgcgacccaaacctggcggcagcgcaaaagatg

SEQ ID NO: 11643 - DNA, 103 bp, Artificial Sequence
  Synthetic Polynucleotide
taatacgactcactatagggagattagtgcttgcatctgggtcgcaggttaacagaggagaaacctgatgcccagatgcaacctggcggcagcgcaaaagatg

SEQ ID NO: 11644 - DNA, 103 bp, Artificial Sequence
  Synthetic Polynucleotide
taatacgactcactatagggttctaagattagtgcttgcatctgggtcgcaacagaggagagcgaccatgatgcaagcaaacctggcggcagcgcaaaagatg

SEQ ID NO: 11645 - DNA, 103 bp, Artificial Sequence
  Synthetic Polynucleotide
taatacgactcactatagggctaccatatgcatcccttgatgtataaggaaacagaggagatccttaatgatcaagggaaacctggcggcagcgcaaaagatg

SEQ ID NO: 11646 - DNA, 103 bp, Artificial Sequence
  Synthetic Polynucleotide
taatacgactcactatagggttgaattctaagattagtgcttgcatctggaacagaggagaccagatatgagcactaataacctggcggcagcgcaaaagatg

SEQ ID NO: 11647 - DNA, 103 bp, Artificial Sequence
  Synthetic Polynucleotide
taatacgactcactatagggaactattgaattctaagattagtgcttgcaaacagaggagatgcaagatgtaatcttagaacctggcggcagcgcaaaagatg

SEQ ID NO: 11648 - DNA, 103 bp, Artificial Sequence
  Synthetic Polynucleotide
taatacgactcactataggggagagaactattgaattctaagattagtgcaacagaggagagcactaatgttagaattcaacctggcggcagcgcaaaagatg

SEQ ID NO: 11649 - DNA, 103 bp, Artificial Sequence
  Synthetic Polynucleotide
taatacgactcactatagggatagcgagagaactattgaattctaagattaacagaggagaaatcttatgattcaatagaacctggcggcagcgcaaaagatg

SEQ ID NO: 11650 - DNA, 103 bp, Artificial Sequence
  Synthetic Polynucleotide
taatacgactcactataggggttaaatagcgagagaactattgaattctaaacagaggagatagaatatgatagttctcaacctggcggcagcgcaaaagatg

SEQ ID NO: 11651 - DNA, 103 bp, Artificial Sequence
  Synthetic Polynucleotide
taatacgactcactataggggttgagttaaatagcgagagaactattgaaaacagaggagattcaatatgtctctcgctaacctggcggcagcgcaaaagatg

SEQ ID NO: 11652 - DNA, 103 bp, Artificial Sequence
  Synthetic Polynucleotide
taatacgactcactataggggatgagttgagttaaatagcgagagaactaaacagaggagatagttcatgcgctatttaaacctggcggcagcgcaaaagatg

SEQ ID NO: 11653 - DNA, 103 bp, Artificial Sequence
  Synthetic Polynucleotide
taatacgactcactatagggattttgatgagttgagttaaatagcgagagaacagaggagactctcgatgtttaactcaaacctggcggcagcgcaaaagatg

SEQ ID NO: 11654 - DNA, 103 bp, Artificial Sequence
  Synthetic Polynucleotide
taatacgactcactatagggttagcattttgatgagttgagttaaatagcaacagaggagagctattatgctcaactcaaacctggcggcagcgcaaaagatg

SEQ ID NO: 11655 - DNA, 103 bp, Artificial Sequence
  Synthetic Polynucleotide
taatacgactcactatagggacaagttagcattttgatgagttgagttaaaacagaggagattaactatgctcatcaaaaacctggcggcagcgcaaaagatg

SEQ ID NO: 11656 - DNA, 103 bp, Artificial Sequence
  Synthetic Polynucleotide
taatacgactcactatagggtcctgctaccatatgcatcccttgatgtataacagaggagaatacatatggggatgcataacctggcggcagcgcaaaagatg

SEQ ID NO: 11657 - DNA, 103 bp, Artificial Sequence
  Synthetic Polynucleotide
taatacgactcactatagggggatcacaagttagcattttgatgagttgaaacagaggagatcaactatgcaaaatgctaacctggcggcagcgcaaaagatg

SEQ ID NO: 11658 - DNA, 103 bp, Artificial Sequence
  Synthetic Polynucleotide
taatacgactcactatagggcttaaggatcacaagttagcattttgatgaaacagaggagatcatcaatgtgctaacttaacctggcggcagcgcaaaagatg

SEQ ID NO: 11659 - DNA, 103 bp, Artificial Sequence
  Synthetic Polynucleotide
taatacgactcactatagggtgcagcttaaggatcacaagttagcattttaacagaggagaaaaatgatgacttgtgataacctggcggcagcgcaaaagatg

SEQ ID NO: 11660 - DNA, 103 bp, Artificial Sequence
  Synthetic Polynucleotide
taatacgactcactatagggtaaggtgcagcttaaggatcacaagttagcaacagaggagagctaacatgtgatccttaaacctggcggcagcgcaaaagatg

SEQ ID NO: 11661 - DNA, 103 bp, Artificial Sequence
  Synthetic Polynucleotide
taatacgactcactatagggaagtctaaggtgcagcttaaggatcacaagaacagaggagacttgtgatgcttaagctgaacctggcggcagcgcaaaagatg

SEQ ID NO: 11662 - DNA, 103 bp, Artificial Sequence
  Synthetic Polynucleotide
taatacgactcactatagggatcaaaagtctaaggtgcagcttaaggatcaacagaggagagatcctatggctgcacctaacctggcggcagcgcaaaagatg

SEQ ID NO: 11663 - DNA, 103 bp, Artificial Sequence
  Synthetic Polynucleotide
taatacgactcactatagggttcttatcaaaagtctaaggtgcagcttaaaacagaggagattaagcatgaccttagacaacctggcggcagcgcaaaagatg

SEQ ID NO: 11664 - DNA, 103 bp, Artificial Sequence
  Synthetic Polynucleotide
taatacgactcactatagggtagtattcttatcaaaagtctaaggtgcagaacagaggagactgcacatgagacttttgaacctggcggcagcgcaaaagatg

SEQ ID NO: 11665 - DNA, 103 bp, Artificial Sequence
  Synthetic Polynucleotide
taatacgactcactatagggatagttagtattcttatcaaaagtctaaggaacagaggagaccttagatgtttgataagaacctggcggcagcgcaaaagatg

SEQ ID NO: 11666 - DNA, 103 bp, Artificial Sequence
  Synthetic Polynucleotide
taatacgactcactatagggcatcaatagttagtattcttatcaaaagtcaacagaggagagactttatgtaagaatacaacctggcggcagcgcaaaagatg

SEQ ID NO: 11667 - DNA, 103 bp, Artificial Sequence
  Synthetic Polynucleotide
taatacgactcactatagggtcgtgtcctgctaccatatgcatcccttgaaacagaggagatcaaggatggcatatggtaacctggcggcagcgcaaaagatg

SEQ ID NO: 11668 - DNA, 103 bp, Artificial Sequence
  Synthetic Polynucleotide
taatacgactcactatagggacaatcatcaatagttagtattcttatcaaaacagaggagattgataatgatactaactaacctggcggcagcgcaaaagatg

SEQ ID NO: 11669 - DNA, 103 bp, Artificial Sequence
  Synthetic Polynucleotide
taatacgactcactatagggcaaagacaatcatcaatagttagtattcttaacagaggagaaagaatatgaactattgaaacctggcggcagcgcaaaagatg

SEQ ID NO: 11670 - DNA, 103 bp, Artificial Sequence
  Synthetic Polynucleotide
taatacgactcactatagggcatgtcaaagacaatcatcaatagttagtaaacagaggagatactaaatgttgatgattaacctggcggcagcgcaaaagatg

SEQ ID NO: 11671 - DNA, 103 bp, Artificial Sequence
  Synthetic Polynucleotide
taatacgactcactatagggatcctcatgtcaaagacaatcatcaatagtaacagaggagaactattatggattgtcttaacctggcggcagcgcaaaagatg

SEQ ID NO: 11672 - DNA, 103 bp, Artificial Sequence
  Synthetic Polynucleotide
taatacgactcactatagggttcttatcctcatgtcaaagacaatcatcaaacagaggagatgatgaatgtctttgacaaacctggcggcagcgcaaaagatg

SEQ ID NO: 11673 - DNA, 103 bp, Artificial Sequence
  Synthetic Polynucleotide
taatacgactcactatagggcagtgttcttatcctcatgtcaaagacaataacagaggagaattgtcatggacatgaggaacctggcggcagcgcaaaagatg

SEQ ID NO: 11674 - DNA, 103 bp, Artificial Sequence
  Synthetic Polynucleotide
taatacgactcactatagggatgggcagtgttcttatcctcatgtcaaagaacagaggagactttgaatggaggataagaacctggcggcagcgcaaaagatg

SEQ ID NO: 11675 - DNA, 103 bp, Artificial Sequence
  Synthetic Polynucleotide
taatacgactcactatagggatctaatgggcagtgttcttatcctcatgtaacagaggagaacatgaatgtaagaacacaacctggcggcagcgcaaaagatg

SEQ ID NO: 11676 - DNA, 103 bp, Artificial Sequence
  Synthetic Polynucleotide
taatacgactcactatagggcatctatctaatgggcagtgttcttatcctaacagaggagaaggataatgacactgcccaacctggcggcagcgcaaaagatg

SEQ ID NO: 11677 - DNA, 103 bp, Artificial Sequence
  Synthetic Polynucleotide
taatacgactcactatagggaaccccatctatctaatgggcagtgttcttaacagaggagaaagaacatggcccattagaacctggcggcagcgcaaaagatg

SEQ ID NO: 11678 - DNA, 103 bp, Artificial Sequence
  Synthetic Polynucleotide
taatacgactcactatagggtagcatcgtgtcctgctaccatatgcatccaacagaggagaggatgcatgtggtagcagaacctggcggcagcgcaaaagatg

SEQ ID NO: 11679 - DNA, 103 bp, Artificial Sequence
  Synthetic Polynucleotide
taatacgactcactatagggtggtgaaccccatctatctaatgggcagtgaacagaggagacactgcatgttagatagaaacctggcggcagcgcaaaagatg

SEQ ID NO: 11680 - DNA, 103 bp, Artificial Sequence
  Synthetic Polynucleotide
taatacgactcactatagggattaatggtgaaccccatctatctaatgggaacagaggagacccattatgtagatggggaacctggcggcagcgcaaaagatg

SEQ ID NO: 11681 - DNA, 103 bp, Artificial Sequence
  Synthetic Polynucleotide
taatacgactcactatagggtgtgtattaatggtgaaccccatctatctaaacagaggagatagataatgggggttcacaacctggcggcagcgcaaaagatg

SEQ ID NO: 11682 - DNA, 103 bp, Artificial Sequence
  Synthetic Polynucleotide
taatacgactcactataggggtaattgtgtattaatggtgaaccccatctaacagaggagaagatggatgtcaccattaaacctggcggcagcgcaaaagatg

SEQ ID NO: 11683 - DNA, 103 bp, Artificial Sequence
  Synthetic Polynucleotide
taatacgactcactatagggattgggtaattgtgtattaatggtgaacccaacagaggagagggttcatgattaatacaaacctggcggcagcgcaaaagatg

SEQ ID NO: 11684 - DNA, 103 bp, Artificial Sequence
  Synthetic Polynucleotide
taatacgactcactatagggacatgattgggtaattgtgtattaatggtgaacagaggagacaccatatgtacacaattaacctggcggcagcgcaaaagatg

SEQ ID NO: 11685 - DNA, 103 bp, Artificial Sequence
  Synthetic Polynucleotide
taatacgactcactatagggtgttaacatgattgggtaattgtgtattaaaacagaggagattaataatgaattacccaaacctggcggcagcgcaaaagatg

SEQ ID NO: 11686 - DNA, 103 bp, Artificial Sequence
  Synthetic Polynucleotide
taatacgactcactatagggactgctgttaacatgattgggtaattgtgtaacagaggagaacacaaatgcccaatcataacctggcggcagcgcaaaagatg

SEQ ID NO: 11687 - DNA, 103 bp, Artificial Sequence
  Synthetic Polynucleotide
taatacgactcactatagggatctaactgctgttaacatgattgggtaataacagaggagaattaccatgtcatgttaaaacctggcggcagcgcaaaagatg

SEQ ID NO: 11688 - DNA, 103 bp, Artificial Sequence
  Synthetic Polynucleotide
taatacgactcactataggggagggatctaactgctgttaacatgattggaacagaggagaccaatcatgttaacagcaaacctggcggcagcgcaaaagatg

SEQ ID NO: 11689 - DNA, 103 bp, Artificial Sequence
  Synthetic Polynucleotide
taatacgactcactatagggatcgttagcatcgtgtcctgctaccatatgaacagaggagacatatgatggcaggacacaacctggcggcagcgcaaaagatg

SEQ ID NO: 11690 - DNA, 103 bp, Artificial Sequence
  Synthetic Polynucleotide
taatacgactcactatagggtacttgagggatctaactgctgttaacatgaacagaggagacatgttatgagcagttagaacctggcggcagcgcaaaagatg

SEQ ID NO: 11691 - DNA, 103 bp, Artificial Sequence
  Synthetic Polynucleotide
taatacgactcactatagggtgatatacttgagggatctaactgctgttaaacagaggagataacagatgttagatcccaacctggcggcagcgcaaaagatg

SEQ ID NO: 11692 - DNA, 103 bp, Artificial Sequence
  Synthetic Polynucleotide
taatacgactcactataggggaacttgatatacttgagggatctaactgcaacagaggagagcagttatgtccctcaagaacctggcggcagcgcaaaagatg

SEQ ID NO: 11693 - DNA, 103 bp, Artificial Sequence
  Synthetic Polynucleotide
taatacgactcactatagggagaatgaacttgatatacttgagggatctaaacagaggagatagatcatgcaagtatataacctggcggcagcgcaaaagatg

SEQ ID NO: 11694 - DNA, 103 bp, Artificial Sequence
  Synthetic Polynucleotide
taatacgactcactatagggagggtagaatgaacttgatatacttgagggaacagaggagaccctcaatgatatcaagtaacctggcggcagcgcaaaagatg

SEQ ID NO: 11695 - DNA, 103 bp, Artificial Sequence
  Synthetic Polynucleotide
taatacgactcactatagggtgcaaagggtagaatgaacttgatatacttaacagaggagaaagtatatgaagttcattaacctggcggcagcgcaaaagatg

SEQ ID NO: 11696 - DNA, 103 bp, Artificial Sequence
  Synthetic Polynucleotide
taatacgactcactataggggacaatgcaaagggtagaatgaacttgataaacagaggagatatcaaatgcattctaccaacctggcggcagcgcaaaagatg

SEQ ID NO: 11697 - DNA, 103 bp, Artificial Sequence
  Synthetic Polynucleotide
taatacgactcactatagggagagtgacaatgcaaagggtagaatgaactaacagaggagaagttcaatgtaccctttgaacctggcggcagcgcaaaagatg

SEQ ID NO: 11698 - DNA, 103 bp, Artificial Sequence
  Synthetic Polynucleotide
taatacgactcactatagggtaattagagtgacaatgcaaagggtagaataacagaggagaattctaatgtttgcattgaacctggcggcagcgcaaaagatg

SEQ ID NO: 11699 - DNA, 103 bp, Artificial Sequence
  Synthetic Polynucleotide
taatacgactcactatagggtgatttaattagagtgacaatgcaaagggtaacagaggagaacccttatgattgtcactaacctggcggcagcgcaaaagatg

SEQ ID NO: 11700 - DNA, 103 bp, Artificial Sequence
  Synthetic Polynucleotide
taatacgactcactatagggacagcatcgttagcatcgtgtcctgctaccaacagaggagaggtagcatgacacgatgcaacctggcggcagcgcaaaagatg

SEQ ID NO: 11701 - DNA, 103 bp, Artificial Sequence
  Synthetic Polynucleotide
taatacgactcactatagggtcaggtgatttaattagagtgacaatgcaaaacagaggagattgcatatgcactctaataacctggcggcagcgcaaaagatg

SEQ ID NO: 11702 - DNA, 103 bp, Artificial Sequence
  Synthetic Polynucleotide
taatacgactcactatagggttgtatcaggtgatttaattagagtgacaaaacagaggagattgtcaatgtaattaaataacctggcggcagcgcaaaagatg

SEQ ID NO: 11703 - DNA, 103 bp, Artificial Sequence
  Synthetic Polynucleotide
taatacgactcactatagggcataattgtatcaggtgatttaattagagtaacagaggagaactctaatgaaatcacctaacctggcggcagcgcaaaagatg

SEQ ID NO: 11704 - DNA, 103 bp, Artificial Sequence
  Synthetic Polynucleotide
taatacgactcactatagggattaacataattgtatcaggtgatttaattaacagaggagaaattaaatgacctgatacaacctggcggcagcgcaaaagatg

SEQ ID NO: 11705 - DNA, 103 bp, Artificial Sequence
  Synthetic Polynucleotide
taatacgactcactatagggagctaattaacataattgtatcaggtgattaacagaggagaaatcacatgatacaattaaacctggcggcagcgcaaaagatg

SEQ ID NO: 11706 - DNA, 103 bp, Artificial Sequence
  Synthetic Polynucleotide
taatacgactcactatagggaatctagctaattaacataattgtatcaggaacagaggagacctgatatgattatgttaaacctggcggcagcgcaaaagatg

SEQ ID NO: 11707 - DNA, 103 bp, Artificial Sequence
  Synthetic Polynucleotide
taatacgactcactataggggagagaatctagctaattaacataattgtaaacagaggagatacaatatggttaattagaacctggcggcagcgcaaaagatg

SEQ ID NO: 11708 - DNA, 103 bp, Artificial Sequence
  Synthetic Polynucleotide
taatacgactcactatagggaaaatgagagaatctagctaattaacataaaacagaggagattatgtatgttagctagaaacctggcggcagcgcaaaagatg

SEQ ID NO: 11709 - DNA, 103 bp, Artificial Sequence
  Synthetic Polynucleotide
taatacgactcactataggggtctaaaaatgagagaatctagctaattaaaacagaggagattaattatgtagattctcaacctggcggcagcgcaaaagatg

SEQ ID NO: 11710 - DNA, 103 bp, Artificial Sequence
  Synthetic Polynucleotide
taatacgactcactatagggaacaagtctaaaaatgagagaatctagctaaacagaggagatagctaatgtctctcattaacctggcggcagcgcaaaagatg

SEQ ID NO: 11711 - DNA, 103 bp, Artificial Sequence
  Synthetic Polynucleotide
taatacgactcactatagggcgatgacagcatcgttagcatcgtgtcctgaacagaggagacaggacatgatgctaacgaacctggcggcagcgcaaaagatg

SEQ ID NO: 11712 - DNA, 103 bp, Artificial Sequence
  Synthetic Polynucleotide
taatacgactcactatagggtagcaaacaagtctaaaaatgagagaatctaacagaggagaagattcatgcatttttagaacctggcggcagcgcaaaagatg

SEQ ID NO: 11713 - DNA, 103 bp, Artificial Sequence
  Synthetic Polynucleotide
taatacgactcactatagggtattctagcaaacaagtctaaaaatgagagaacagaggagactctcaatgttagacttgaacctggcggcagcgcaaaagatg

SEQ ID NO: 11714 - DNA, 103 bp, Artificial Sequence
  Synthetic Polynucleotide
taatacgactcactatagggtcaattattctagcaaacaagtctaaaaataacagaggagaatttttatgcttgtttgcaacctggcggcagcgcaaaagatg

SEQ ID NO: 11715 - DNA, 103 bp, Artificial Sequence
  Synthetic Polynucleotide
taatacgactcactataggggatgatcaattattctagcaaacaagtctaaacagaggagatagactatgttgctagaaaacctggcggcagcgcaaaagatg

SEQ ID NO: 11716 - DNA, 103 bp, Artificial Sequence
  Synthetic Polynucleotide
taatacgactcactatagggaagtggatgatcaattattctagcaaacaaaacagaggagattgtttatgagaataattaacctggcggcagcgcaaaagatg

SEQ ID NO: 11717 - DNA, 103 bp, Artificial Sequence
  Synthetic Polynucleotide
taatacgactcactatagggtaatcaagtggatgatcaattattctagcaaacagaggagatgctagatgaattgatcaaacctggcggcagcgcaaaagatg

SEQ ID NO: 11718 - DNA, 103 bp, Artificial Sequence
  Synthetic Polynucleotide
taatacgactcactatagggatgtgtaatcaagtggatgatcaattattcaacagaggagagaataaatgatcatccacaacctggcggcagcgcaaaagatg

SEQ ID NO: 11719 - DNA, 103 bp, Artificial Sequence
  Synthetic Polynucleotide
taatacgactcactataggggttggatgtgtaatcaagtggatgatcaataacagaggagaattgatatgccacttgataacctggcggcagcgcaaaagatg

SEQ ID NO: 11720 - DNA, 103 bp, Artificial Sequence
  Synthetic Polynucleotide
taatacgactcactatagggccctagttggatgtgtaatcaagtggatgaaacagaggagatcatccatgtgattacacaacctggcggcagcgcaaaagatg

SEQ ID NO: 11721 - DNA, 103 bp, Artificial Sequence
  Synthetic Polynucleotide
taatacgactcactatagggctagaccctagttggatgtgtaatcaagtgaacagaggagacacttgatgacacatccaaacctggcggcagcgcaaaagatg

SEQ ID NO: 11722 - DNA, 103 bp, Artificial Sequence
  Synthetic Polynucleotide
taatacgactcactataggggtttgcgatgacagcatcgttagcatcgtgaacagaggagacacgatatgaacgatgctaacctggcggcagcgcaaaagatg

SEQ ID NO: 11723 - DNA, 103 bp, Artificial Sequence
  Synthetic Polynucleotide
taatacgactcactatagggatgaactagaccctagttggatgtgtaatcaacagaggagagattacatgtccaactagaacctggcggcagcgcaaaagatg

SEQ ID NO: 11724 - DNA, 103 bp, Artificial Sequence
  Synthetic Polynucleotide
taatacgactcactatagggaatctatgaactagaccctagttggatgtgaacagaggagacacatcatgctagggtctaacctggcggcagcgcaaaagatg

SEQ ID NO: 11725 - DNA, 103 bp, Artificial Sequence
  Synthetic Polynucleotide
taatacgactcactatagggttagcaatctatgaactagaccctagttggaacagaggagaccaactatggtctagttcaacctggcggcagcgcaaaagatg

SEQ ID NO: 11726 - DNA, 103 bp, Artificial Sequence
  Synthetic Polynucleotide
taatacgactcactataggggattattagcaatctatgaactagaccctaaacagaggagatagggtatggttcatagaaacctggcggcagcgcaaaagatg

SEQ ID NO: 11727 - DNA, 103 bp, Artificial Sequence
  Synthetic Polynucleotide
taatacgactcactatagggctaaagattattagcaatctatgaactagaaacagaggagatctagtatgtagattgctaacctggcggcagcgcaaaagatg

SEQ ID NO: 11728 - DNA, 103 bp, Artificial Sequence
  Synthetic Polynucleotide
taatacgactcactatagggttgaactaaagattattagcaatctatgaaaacagaggagattcataatgtgctaataaaacctggcggcagcgcaaaagatg

SEQ ID NO: 11729 - DNA, 103 bp, Artificial Sequence
  Synthetic Polynucleotide
taatacgactcactatagggtagtattgaactaaagattattagcaatctaacagaggagaagattgatgataatctttaacctggcggcagcgcaaaagatg

SEQ ID NO: 11730 - DNA, 103 bp, Artificial Sequence
  Synthetic Polynucleotide
taatacgactcactataggggtcattagtattgaactaaagattattagcaacagaggagagctaatatgctttagttcaacctggcggcagcgcaaaagatg

SEQ ID NO: 11731 - DNA, 103 bp, Artificial Sequence
  Synthetic Polynucleotide
taatacgactcactatagggtctttgtcattagtattgaactaaagattaaacagaggagataatctatggttcaatacaacctggcggcagcgcaaaagatg

SEQ ID NO: 11732 - DNA, 103 bp, Artificial Sequence
  Synthetic Polynucleotide
taatacgactcactatagggtaatctctttgtcattagtattgaactaaaaacagaggagatttagtatgatactaatgaacctggcggcagcgcaaaagatg

SEQ ID NO: 11733 - DNA, 103 bp, Artificial Sequence
  Synthetic Polynucleotide
taatacgactcactatagggacagagtttgcgatgacagcatcgttagcaaacagaggagatgctaaatgtgctgtcataacctggcggcagcgcaaaagatg

SEQ ID NO: 11734 - DNA, 103 bp, Artificial Sequence
  Synthetic Polynucleotide
taatacgactcactatagggtaatctaatctctttgtcattagtattgaaaacagaggagattcaatatgaatgacaaaaacctggcggcagcgcaaaagatg

SEQ ID NO: 11735 - DNA, 103 bp, Artificial Sequence
  Synthetic Polynucleotide
taatacgactcactatagggatagctaatctaatctctttgtcattagtaaacagaggagatactaaatgcaaagagataacctggcggcagcgcaaaagatg

SEQ ID NO: 11736 - DNA, 103 bp, Artificial Sequence
  Synthetic Polynucleotide
taatacgactcactatagggaagctatagctaatctaatctctttgtcataacagaggagaatgacaatgagattagataacctggcggcagcgcaaaagatg

SEQ ID NO: 11737 - DNA, 103 bp, Artificial Sequence
  Synthetic Polynucleotide
taatacgactcactatagggtcctcaagctatagctaatctaatctctttaacagaggagaaaagagatgagattagctaacctggcggcagcgcaaaagatg

SEQ ID NO: 11738 - DNA, 103 bp, Artificial Sequence
  Synthetic Polynucleotide
taatacgactcactatagggaatcttcctcaagctatagctaatctaatcaacagaggagagattagatgagctatagcaacctggcggcagcgcaaaagatg

SEQ ID NO: 11739 - DNA, 103 bp, Artificial Sequence
  Synthetic Polynucleotide
taatacgactcactatagggttcttaatcttcctcaagctatagctaatcaacagaggagagattagatgtagcttgagaacctggcggcagcgcaaaagatg

SEQ ID NO: 11740 - DNA, 103 bp, Artificial Sequence
  Synthetic Polynucleotide
taatacgactcactatagggactttttcttaatcttcctcaagctatagcaacagaggagagctataatgtgaggaagaaacctggcggcagcgcaaaagatg

SEQ ID NO: 11741 - DNA, 103 bp, Artificial Sequence
  Synthetic Polynucleotide
taatacgactcactatagggcagacactttttcttaatcttcctcaagctaacagaggagaagcttgatgaagattaagaacctggcggcagcgcaaaagatg

SEQ ID NO: 11742 - DNA, 103 bp, Artificial Sequence
  Synthetic Polynucleotide
taatacgactcactatagggccccacagacactttttcttaatcttcctcaacagaggagagaggaaatgtaagaaaaaaacctggcggcagcgcaaaagatg

SEQ ID NO: 11743 - DNA, 103 bp, Artificial Sequence
  Synthetic Polynucleotide
taatacgactcactatagggaaagaccccacagacactttttcttaatctaacagaggagaagattaatgaaaagtgtcaacctggcggcagcgcaaaagatg

SEQ ID NO: 11744 - DNA, 103 bp, Artificial Sequence
  Synthetic Polynucleotide
taatacgactcactatagggtattatcctcagagtaagtaacagatcaataacagaggagaattgatatgttacttactaacctggcggcagcgcaaaagatg

SEQ ID NO: 11745 - DNA, 103 bp, Artificial Sequence
  Synthetic Polynucleotide
taatacgactcactataggggagctacagagtttgcgatgacagcatcgtaacagaggagaacgatgatgtcatcgcaaaacctggcggcagcgcaaaagatg

SEQ ID NO: 11746 - DNA, 103 bp, Artificial Sequence
  Synthetic Polynucleotide
taatacgactcactatagggcacggaaagaccccacagacactttttcttaacagaggagaaagaaaatgtgtctgtggaacctggcggcagcgcaaaagatg

SEQ ID NO: 11747 - DNA, 103 bp, Artificial Sequence
  Synthetic Polynucleotide
taatacgactcactatagggttctacacggaaagaccccacagacactttaacagaggagaaaagtgatggtggggtctaacctggcggcagcgcaaaagatg

SEQ ID NO: 11748 - DNA, 103 bp, Artificial Sequence
  Synthetic Polynucleotide
taatacgactcactatagggtgcccttctacacggaaagaccccacagacaacagaggagagtctgtatggtctttccgaacctggcggcagcgcaaaagatg

SEQ ID NO: 11749 - DNA, 103 bp, Artificial Sequence
  Synthetic Polynucleotide
taatacgactcactatagggctgtgtgcccttctacacggaaagaccccaaacagaggagatggggtatgtccgtgtagaacctggcggcagcgcaaaagatg

SEQ ID NO: 11750 - DNA, 103 bp, Artificial Sequence
  Synthetic Polynucleotide
taatacgactcactatagggtatggctgtgtgcccttctacacggaaagaaacagaggagatctttcatggtagaagggaacctggcggcagcgcaaaagatg

SEQ ID NO: 11751 - DNA, 103 bp, Artificial Sequence
  Synthetic Polynucleotide
taatacgactcactatagggagaattatggctgtgtgcccttctacacggaacagaggagaccgtgtatgagggcacacaacctggcggcagcgcaaaagatg

SEQ ID NO: 11752 - DNA, 103 bp, Artificial Sequence
  Synthetic Polynucleotide
taatacgactcactataggggaggaagaattatggctgtgtgcccttctaaacagaggagatagaagatgacacagccaaacctggcggcagcgcaaaagatg

SEQ ID NO: 11753 - DNA, 103 bp, Artificial Sequence
  Synthetic Polynucleotide
taatacgactcactatagggataaagaggaagaattatggctgtgtgcccaacagaggagagggcacatggccataattaacctggcggcagcgcaaaagatg

SEQ ID NO: 11754 - DNA, 103 bp, Artificial Sequence
  Synthetic Polynucleotide
taatacgactcactataggggttgtataaagaggaagaattatggctgtgaacagaggagacacagcatgaattcttccaacctggcggcagcgcaaaagatg

SEQ ID NO: 11755 - DNA, 103 bp, Artificial Sequence
  Synthetic Polynucleotide
taatacgactcactataggggccatgttgtataaagaggaagaattatggaacagaggagaccataaatgttcctctttaacctggcggcagcgcaaaagatg

SEQ ID NO: 11756 - DNA, 103 bp, Artificial Sequence
  Synthetic Polynucleotide
taatacgactcactatagggtgcttgagctacagagtttgcgatgacagcaacagaggagagctgtcatggcaaactctaacctggcggcagcgcaaaagatg

SEQ ID NO: 11757 - DNA, 103 bp, Artificial Sequence
  Synthetic Polynucleotide
taatacgactcactataggggtgtagccatgttgtataaagaggaagaataacagaggagaattcttatgctttatacaaacctggcggcagcgcaaaagatg

SEQ ID NO: 11758 - DNA, 103 bp, Artificial Sequence
  Synthetic Polynucleotide
taatacgactcactatagggatgttgtgtagccatgttgtataaagaggaaacagaggagatcctctatgtacaacatgaacctggcggcagcgcaaaagatg

SEQ ID NO: 11759 - DNA, 103 bp, Artificial Sequence
  Synthetic Polynucleotide
taatacgactcactatagggtgcgtatgttgtgtagccatgttgtataaaaacagaggagatttataatgcatggctacaacctggcggcagcgcaaaagatg

SEQ ID NO: 11760 - DNA, 103 bp, Artificial Sequence
  Synthetic Polynucleotide
taatacgactcactataggggatattgcgtatgttgtgtagccatgttgtaacagaggagaacaacaatgctacacaacaacctggcggcagcgcaaaagatg

SEQ ID NO: 11761 - DNA, 103 bp, Artificial Sequence
  Synthetic Polynucleotide
taatacgactcactataggggtctggatattgcgtatgttgtgtagccataacagaggagaatggctatgcaacatacgaacctggcggcagcgcaaaagatg

SEQ ID NO: 11762 - DNA, 103 bp, Artificial Sequence
  Synthetic Polynucleotide
taatacgactcactatagggcttgcgtctggatattgcgtatgttgtgtaaacagaggagatacacaatgtacgcaataaacctggcggcagcgcaaaagatg

SEQ ID NO: 11763 - DNA, 103 bp, Artificial Sequence
  Synthetic Polynucleotide
taatacgactcactatagggataaccttgcgtctggatattgcgtatgttaacagaggagaaacataatgaatatccagaacctggcggcagcgcaaaagatg

SEQ ID NO: 11764 - DNA, 103 bp, Artificial Sequence
  Synthetic Polynucleotide
taatacgactcactatagggtgatgataaccttgcgtctggatattgcgtaacagaggagaacgcaaatgccagacgcaaacctggcggcagcgcaaaagatg

SEQ ID NO: 11765 - DNA, 103 bp, Artificial Sequence
  Synthetic Polynucleotide
taatacgactcactatagggataggtgatgataaccttgcgtctggatataacagaggagaatatccatgcgcaaggttaacctggcggcagcgcaaaagatg

SEQ ID NO: 11766 - DNA, 103 bp, Artificial Sequence
  Synthetic Polynucleotide
taatacgactcactatagggaaactataggtgatgataaccttgcgtctgaacagaggagacagacgatgggttatcataacctggcggcagcgcaaaagatg

SEQ ID NO: 11767 - DNA, 103 bp, Artificial Sequence
  Synthetic Polynucleotide
taatacgactcactatagggaaacgtgcttgagctacagagtttgcgatgaacagaggagacatcgcatgctctgtagcaacctggcggcagcgcaaaagatg

SEQ ID NO: 11768 - DNA, 103 bp, Artificial Sequence
  Synthetic Polynucleotide
taatacgactcactatagggatctaaaactataggtgatgataaccttgcaacagaggagagcaaggatgtcatcacctaacctggcggcagcgcaaaagatg

SEQ ID NO: 11769 - DNA, 103 bp, Artificial Sequence
  Synthetic Polynucleotide
taatacgactcactatagggcactgatctaaaactataggtgatgataacaacagaggagagttatcatgacctatagtaacctggcggcagcgcaaaagatg

SEQ ID NO: 11770 - DNA, 103 bp, Artificial Sequence
  Synthetic Polynucleotide
taatacgactcactataggggatcacactgatctaaaactataggtgatgaacagaggagacatcacatgtagttttagaacctggcggcagcgcaaaagatg

SEQ ID NO: 11771 - DNA, 103 bp, Artificial Sequence
  Synthetic Polynucleotide
taatacgactcactataggggacaagatcacactgatctaaaactataggaacagaggagacctataatgttagatcagaacctggcggcagcgcaaaagatg

SEQ ID NO: 11772 - DNA, 103 bp, Artificial Sequence
  Synthetic Polynucleotide
taatacgactcactatagggcgagtgacaagatcacactgatctaaaactaacagaggagaagttttatgtcagtgtgaaacctggcggcagcgcaaaagatg

SEQ ID NO: 11773 - DNA, 103 bp, Artificial Sequence
  Synthetic Polynucleotide
taatacgactcactatagggaagcacgagtgacaagatcacactgatctaaacagaggagatagatcatggtgatcttgaacctggcggcagcgcaaaagatg

SEQ ID NO: 11774 - DNA, 103 bp, Artificial Sequence
  Synthetic Polynucleotide
taatacgactcactatagggtccacaagcacgagtgacaagatcacactgaacagaggagacagtgtatgcttgtcactaacctggcggcagcgcaaaagatg

SEQ ID NO: 11775 - DNA, 103 bp, Artificial Sequence
  Synthetic Polynucleotide
taatacgactcactatagggtacaatccacaagcacgagtgacaagatcaaacagaggagatgatctatgcactcgtgcaacctggcggcagcgcaaaagatg

SEQ ID NO: 11776 - DNA, 103 bp, Artificial Sequence
  Synthetic Polynucleotide
taatacgactcactatagggcggaatacaatccacaagcacgagtgacaaaacagaggagattgtcaatggtgcttgtgaacctggcggcagcgcaaaagatg

SEQ ID NO: 11777 - DNA, 103 bp, Artificial Sequence
  Synthetic Polynucleotide
taatacgactcactataggggtatgcggaatacaatccacaagcacgagtaacagaggagaactcgtatgtgtggattgaacctggcggcagcgcaaaagatg

SEQ ID NO: 11778 - DNA, 103 bp, Artificial Sequence
  Synthetic Polynucleotide
taatacgactcactatagggctgaaaaacgtgcttgagctacagagtttgaacagaggagacaaactatgtagctcaagaacctggcggcagcgcaaaagatg

SEQ ID NO: 11779 - DNA, 103 bp, Artificial Sequence
  Synthetic Polynucleotide
taatacgactcactatagggaaggagtatgcggaatacaatccacaagcaaacagaggagatgcttgatgattgtattcaacctggcggcagcgcaaaagatg

SEQ ID NO: 11780 - DNA, 103 bp, Artificial Sequence
  Synthetic Polynucleotide
taatacgactcactataggggatttaaggagtatgcggaatacaatccacaacagaggagagtggatatgattccgcataacctggcggcagcgcaaaagatg

SEQ ID NO: 11781 - DNA, 103 bp, Artificial Sequence
  Synthetic Polynucleotide
taatacgactcactatagggttggggatttaaggagtatgcggaatacaaaacagaggagattgtatatggcatactccaacctggcggcagcgcaaaagatg

SEQ ID NO: 11782 - DNA, 103 bp, Artificial Sequence
  Synthetic Polynucleotide
taatacgactcactatagggtttagttggggatttaaggagtatgcggaaaacagaggagattccgcatgctccttaaaaacctggcggcagcgcaaaagatg

SEQ ID NO: 11783 - DNA, 103 bp, Artificial Sequence
  Synthetic Polynucleotide
taatacgactcactatagggagttctttagttggggatttaaggagtatgaacagaggagacatactatgtaaatccccaacctggcggcagcgcaaaagatg

SEQ ID NO: 11784 - DNA, 103 bp, Artificial Sequence
  Synthetic Polynucleotide
taatacgactcactatagggtctacagttctttagttggggatttaaggaaacagaggagatccttaatgccccaactaaacctggcggcagcgcaaaagatg

SEQ ID NO: 11785 - DNA, 103 bp, Artificial Sequence
  Synthetic Polynucleotide
taatacgactcactatagggggtagtctacagttctttagttggggatttaacagaggagaaaatccatgactaaagaaaacctggcggcagcgcaaaagatg

SEQ ID NO: 11786 - DNA, 103 bp, Artificial Sequence
  Synthetic Polynucleotide
taatacgactcactataggggtttcggtagtctacagttctttagttgggaacagaggagacccaacatgagaactgtaaacctggcggcagcgcaaaagatg

SEQ ID NO: 11787 - DNA, 103 bp, Artificial Sequence
  Synthetic Polynucleotide
taatacgactcactatagggtatatgtttcggtagtctacagttctttagaacagaggagactaaagatgtgtagactaaacctggcggcagcgcaaaagatg

SEQ ID NO: 11788 - DNA, 103 bp, Artificial Sequence
  Synthetic Polynucleotide
taatacgactcactatagggcggtatatatgtttcggtagtctacagttcaacagaggagagaactgatgactaccgaaaacctggcggcagcgcaaaagatg

SEQ ID NO: 11789 - DNA, 103 bp, Artificial Sequence
  Synthetic Polynucleotide
taatacgactcactatagggtaatcctgaaaaacgtgcttgagctacagaaacagaggagatctgtaatgcaagcacgtaacctggcggcagcgcaaaagatg

SEQ ID NO: 11790 - DNA, 103 bp, Artificial Sequence
  Synthetic Polynucleotide
taatacgactcactatagggttagtcggtatatatgtttcggtagtctacaacagaggagagtagacatgcgaaacataaacctggcggcagcgcaaaagatg

SEQ ID NO: 11791 - DNA, 103 bp, Artificial Sequence
  Synthetic Polynucleotide
taatacgactcactatagggatattttagtcggtatatatgtttcggtagaacagaggagactaccgatgcatatatacaacctggcggcagcgcaaaagatg

SEQ ID NO: 11792 - DNA, 103 bp, Artificial Sequence
  Synthetic Polynucleotide
taatacgactcactataggggtgtcatattttagtcggtatatatgtttcaacagaggagagaaacaatgataccgactaacctggcggcagcgcaaaagatg

SEQ ID NO: 11793 - DNA, 103 bp, Artificial Sequence
  Synthetic Polynucleotide
taatacgactcactatagggcagtggtgtcatattttagtcggtatatataacagaggagaatatatatggactaaaataacctggcggcagcgcaaaagatg

SEQ ID NO: 11794 - DNA, 103 bp, Artificial Sequence
  Synthetic Polynucleotide
taatacgactcactatagggtgtaacagtggtgtcatattttagtcggtaaacagaggagataccgaatgaaatatgacaacctggcggcagcgcaaaagatg

SEQ ID NO: 11795 - DNA, 103 bp, Artificial Sequence
  Synthetic Polynucleotide
taatacgactcactatagggaactctgtaacagtggtgtcatattttagtaacagaggagaactaaaatgtgacaccacaacctggcggcagcgcaaaagatg

SEQ ID NO: 11796 - DNA, 103 bp, Artificial Sequence
  Synthetic Polynucleotide
taatacgactcactatagggtcaaaaactctgtaacagtggtgtcatattaacagaggagaaatatgatgccactgttaaacctggcggcagcgcaaaagatg

SEQ ID NO: 11797 - DNA, 103 bp, Artificial Sequence
  Synthetic Polynucleotide
taatacgactcactatagggatcactcaaaaactctgtaacagtggtgtcaacagaggagagacaccatggttacagagaacctggcggcagcgcaaaagatg

SEQ ID NO: 11798 - DNA, 103 bp, Artificial Sequence
  Synthetic Polynucleotide
taatacgactcactatagggggcacatcactcaaaaactctgtaacagtgaacagaggagacactgtatgagagtttttaacctggcggcagcgcaaaagatg

SEQ ID NO: 11799 - DNA, 103 bp, Artificial Sequence
  Synthetic Polynucleotide
taatacgactcactatagggctaccggcacatcactcaaaaactctgtaaaacagaggagattacagatgttttgagtgaacctggcggcagcgcaaaagatg

SEQ ID NO: 11800 - DNA, 103 bp, Artificial Sequence
  Synthetic Polynucleotide
taatacgactcactatagggatcaataatcctgaaaaacgtgcttgagctaacagaggagaagctcaatgacgtttttcaacctggcggcagcgcaaaagatg

SEQ ID NO: 11801 - DNA, 103 bp, Artificial Sequence
  Synthetic Polynucleotide
taatacgactcactatagggtgttgctaccggcacatcactcaaaaactcaacagaggagagagtttatgagtgatgtgaacctggcggcagcgcaaaagatg

SEQ ID NO: 11802 - DNA, 103 bp, Artificial Sequence
  Synthetic Polynucleotide
taatacgactcactatagggggcaatgttgctaccggcacatcactcaaaaacagaggagatttgagatgtgtgccggtaacctggcggcagcgcaaaagatg

SEQ ID NO: 11803 - DNA, 103 bp, Artificial Sequence
  Synthetic Polynucleotide
taatacgactcactatagggccgctggcaatgttgctaccggcacatcacaacagaggagagtgatgatgcggtagcaaaacctggcggcagcgcaaaagatg

SEQ ID NO: 11804 - DNA, 103 bp, Artificial Sequence
  Synthetic Polynucleotide
taatacgactcactatagggaaaatccgctggcaatgttgctaccggcacaacagaggagagtgccgatggcaacattgaacctggcggcagcgcaaaagatg

SEQ ID NO: 11805 - DNA, 103 bp, Artificial Sequence
  Synthetic Polynucleotide
taatacgactcactatagggactaaaaaatccgctggcaatgttgctaccaacagaggagaggtagcatgattgccagcaacctggcggcagcgcaaaagatg

SEQ ID NO: 11806 - DNA, 103 bp, Artificial Sequence
  Synthetic Polynucleotide
taatacgactcactatagggtaggtactaaaaaatccgctggcaatgttgaacagaggagacaacatatgcagcggattaacctggcggcagcgcaaaagatg

SEQ ID NO: 11807 - DNA, 103 bp, Artificial Sequence
  Synthetic Polynucleotide
taatacgactcactatagggaaatgtaggtactaaaaaatccgctggcaaaacagaggagattgccaatggattttttaaacctggcggcagcgcaaaagatg

SEQ ID NO: 11808 - DNA, 103 bp, Artificial Sequence
  Synthetic Polynucleotide
taatacgactcactatagggctaagaaatgtaggtactaaaaaatccgctaacagaggagaagcggaatgtttagtaccaacctggcggcagcgcaaaagatg

SEQ ID NO: 11809 - DNA, 103 bp, Artificial Sequence
  Synthetic Polynucleotide
taatacgactcactataggggagtcctaagaaatgtaggtactaaaaaataacagaggagaatttttatgtacctacataacctggcggcagcgcaaaagatg

SEQ ID NO: 11810 - DNA, 103 bp, Artificial Sequence
  Synthetic Polynucleotide
taatacgactcactatagggtgatagagtcctaagaaatgtaggtactaaaacagaggagattagtaatgacatttcttaacctggcggcagcgcaaaagatg

SEQ ID NO: 11811 - DNA, 103 bp, Artificial Sequence
  Synthetic Polynucleotide
taatacgactcactatagggtaacgatcaataatcctgaaaaacgtgcttaacagaggagaaagcacatgtttcaggataacctggcggcagcgcaaaagatg

SEQ ID NO: 11812 - DNA, 103 bp, Artificial Sequence
  Synthetic Polynucleotide
taatacgactcactatagggtttcctgatagagtcctaagaaatgtaggtaacagaggagaacctacatgtcttaggacaacctggcggcagcgcaaaagatg

SEQ ID NO: 11813 - DNA, 103 bp, Artificial Sequence
  Synthetic Polynucleotide
taatacgactcactatagggaaccatttcctgatagagtcctaagaaatgaacagaggagacatttcatgggactctataacctggcggcagcgcaaaagatg

SEQ ID NO: 11814 - DNA, 103 bp, Artificial Sequence
  Synthetic Polynucleotide
taatacgactcactatagggacaagaaccatttcctgatagagtcctaagaacagaggagacttaggatgctatcaggaaacctggcggcagcgcaaaagatg

SEQ ID NO: 11815 - DNA, 103 bp, Artificial Sequence
  Synthetic Polynucleotide
taatacgactcactatagggattggacaagaaccatttcctgatagagtcaacagaggagagactctatgaggaaatggaacctggcggcagcgcaaaagatg

SEQ ID NO: 11816 - DNA, 103 bp, Artificial Sequence
  Synthetic Polynucleotide
taatacgactcactataggggatcaattggacaagaaccatttcctgataaacagaggagatatcagatgatggttcttaacctggcggcagcgcaaaagatg

SEQ ID NO: 11817 - DNA, 103 bp, Artificial Sequence
  Synthetic Polynucleotide
taatacgactcactatagggttttggatcaattggacaagaaccatttccaacagaggagaggaaatatgtcttgtccaaacctggcggcagcgcaaaagatg

SEQ ID NO: 11818 - DNA, 103 bp, Artificial Sequence
  Synthetic Polynucleotide
taatacgactcactatagggctgcattttggatcaattggacaagaaccaaacagaggagatggttcatgtccaattgaaacctggcggcagcgcaaaagatg

SEQ ID NO: 11819 - DNA, 103 bp, Artificial Sequence
  Synthetic Polynucleotide
taatacgactcactatagggattgactgcattttggatcaattggacaagaacagaggagacttgtcatgttgatccaaaacctggcggcagcgcaaaagatg

SEQ ID NO: 11820 - DNA, 103 bp, Artificial Sequence
  Synthetic Polynucleotide
taatacgactcactatagggtaaaaattgactgcattttggatcaattggaacagaggagaccaattatgccaaaatgcaacctggcggcagcgcaaaagatg

SEQ ID NO: 11821 - DNA, 103 bp, Artificial Sequence
  Synthetic Polynucleotide
taatacgactcactatagggtcttctaaaaattgactgcattttggatcaaacagaggagatgatccatgatgcagtcaaacctggcggcagcgcaaaagatg

SEQ ID NO: 11822 - DNA, 103 bp, Artificial Sequence
  Synthetic Polynucleotide
taatacgactcactatagggtgttttaacgatcaataatcctgaaaaacgaacagaggagacgttttatgggattattgaacctggcggcagcgcaaaagatg

SEQ ID NO: 11823 - DNA, 103 bp, Artificial Sequence
  Synthetic Polynucleotide
taatacgactcactatagggcaatttcttctaaaaattgactgcattttgaacagaggagacaaaatatggtcaattttaacctggcggcagcgcaaaagatg

SEQ ID NO: 11824 - DNA, 103 bp, Artificial Sequence
  Synthetic Polynucleotide
taatacgactcactatagggattgacaatttcttctaaaaattgactgcaaacagaggagatgcagtatgtttttagaaaacctggcggcagcgcaaaagatg

SEQ ID NO: 11825 - DNA, 103 bp, Artificial Sequence
  Synthetic Polynucleotide
taatacgactcactataggggtataattgacaatttcttctaaaaattgaaacagaggagatcaattatgagaagaaataacctggcggcagcgcaaaagatg

SEQ ID NO: 11826 - DNA, 103 bp, Artificial Sequence
  Synthetic Polynucleotide
taatacgactcactataggggtagagtataattgacaatttcttctaaaaaacagaggagattttagatgaaattgtcaaacctggcggcagcgcaaaagatg

SEQ ID NO: 11827 - DNA, 103 bp, Artificial Sequence
  Synthetic Polynucleotide
taatacgactcactatagggatcttgtagagtataattgacaatttcttcaacagaggagagaagaaatggtcaattataacctggcggcagcgcaaaagatg

SEQ ID NO: 11828 - DNA, 103 bp, Artificial Sequence
  Synthetic Polynucleotide
taatacgactcactatagggcgaatatcttgtagagtataattgacaattaacagaggagaaattgtatgttatactctaacctggcggcagcgcaaaagatg

SEQ ID NO: 11829 - DNA, 103 bp, Artificial Sequence
  Synthetic Polynucleotide
taatacgactcactatagggggaagcgaatatcttgtagagtataattgaaacagaggagatcaattatgctctacaagaacctggcggcagcgcaaaagatg

SEQ ID NO: 11830 - DNA, 103 bp, Artificial Sequence
  Synthetic Polynucleotide
taatacgactcactataggggtttaggaagcgaatatcttgtagagtataaacagaggagatatactatgcaagatattaacctggcggcagcgcaaaagatg

SEQ ID NO: 11831 - DNA, 103 bp, Artificial Sequence
  Synthetic Polynucleotide
taatacgactcactatagggtaatagtttaggaagcgaatatcttgtagaaacagaggagatctacaatgtattcgcttaacctggcggcagcgcaaaagatg

SEQ ID NO: 11832 - DNA, 103 bp, Artificial Sequence
  Synthetic Polynucleotide
taatacgactcactatagggtgaggtaatagtttaggaagcgaatatcttaacagaggagaaagataatggcttcctaaaacctggcggcagcgcaaaagatg

SEQ ID NO: 11833 - DNA, 103 bp, Artificial Sequence
  Synthetic Polynucleotide
taatacgactcactatagggagcactgttttaacgatcaataatcctgaaaacagaggagattcaggatgattgatcgtaacctggcggcagcgcaaaagatg

SEQ ID NO: 11834 - DNA, 103 bp, Artificial Sequence
  Synthetic Polynucleotide
taatacgactcactatagggtcgattgaggtaatagtttaggaagcgaataacagaggagaattcgcatgctaaactataacctggcggcagcgcaaaagatg

SEQ ID NO: 11835 - DNA, 103 bp, Artificial Sequence
  Synthetic Polynucleotide
taatacgactcactatagggccggctcgattgaggtaatagtttaggaagaacagaggagacttcctatgctattacctaacctggcggcagcgcaaaagatg

SEQ ID NO: 11836 - DNA, 103 bp, Artificial Sequence
  Synthetic Polynucleotide
taatacgactcactataggggcactccggctcgattgaggtaatagtttaaacagaggagataaactatgacctcaatcaacctggcggcagcgcaaaagatg

SEQ ID NO: 11837 - DNA, 103 bp, Artificial Sequence
  Synthetic Polynucleotide
taatacgactcactataggggttatgcactccggctcgattgaggtaataaacagaggagatattacatgaatcgagccaacctggcggcagcgcaaaagatg

SEQ ID NO: 11838 - DNA, 103 bp, Artificial Sequence
  Synthetic Polynucleotide
taatacgactcactatagggtgatcgttatgcactccggctcgattgaggaacagaggagacctcaaatgagccggagtaacctggcggcagcgcaaaagatg

SEQ ID NO: 11839 - DNA, 103 bp, Artificial Sequence
  Synthetic Polynucleotide
taatacgactcactatagggccacatgatcgttatgcactccggctcgataacagaggagaatcgagatggagtgcataaacctggcggcagcgcaaaagatg

SEQ ID NO: 11840 - DNA, 103 bp, Artificial Sequence
  Synthetic Polynucleotide
taatacgactcactatagggcctatccacatgatcgttatgcactccggcaacagaggagagccggaatgcataacgataacctggcggcagcgcaaaagatg

SEQ ID NO: 11841 - DNA, 103 bp, Artificial Sequence
  Synthetic Polynucleotide
taatacgactcactatagggaaatccctatccacatgatcgttatgcactaacagaggagaagtgcaatgcgatcatgtaacctggcggcagcgcaaaagatg

SEQ ID NO: 11842 - DNA, 103 bp, Artificial Sequence
  Synthetic Polynucleotide
taatacgactcactataggggtccaaaatccctatccacatgatcgttataacagaggagaataacgatgatgtggataaacctggcggcagcgcaaaagatg

SEQ ID NO: 11843 - DNA, 103 bp, Artificial Sequence
  Synthetic Polynucleotide
taatacgactcactatagggtttttgtccaaaatccctatccacatgatcaacagaggagagatcatatggatagggataacctggcggcagcgcaaaagatg

SEQ ID NO: 11844 - DNA, 103 bp, Artificial Sequence
  Synthetic Polynucleotide
taatacgactcactataggggatctagcactgttttaacgatcaataatcaacagaggagagattatatgtcgttaaaaaacctggcggcagcgcaaaagatg

SEQ ID NO: 11845 - DNA, 103 bp, Artificial Sequence
  Synthetic Polynucleotide
taatacgactcactatagggcgaattttttgtccaaaatccctatccacaaacagaggagatgtggaatgggattttggaacctggcggcagcgcaaaagatg

SEQ ID NO: 11846 - DNA, 103 bp, Artificial Sequence
  Synthetic Polynucleotide
taatacgactcactataggggattgcgaattttttgtccaaaatccctataacagaggagaatagggatgttggacaaaaacctggcggcagcgcaaaagatg

SEQ ID NO: 11847 - DNA, 103 bp, Artificial Sequence
  Synthetic Polynucleotide
taatacgactcactatagggaattagattgcgaattttttgtccaaaatcaacagaggagagattttatgcaaaaaattaacctggcggcagcgcaaaagatg

SEQ ID NO: 11848 - DNA, 103 bp, Artificial Sequence
  Synthetic Polynucleotide
taatacgactcactatagggtcgcaaattagattgcgaattttttgtccaaacagaggagatggacaatgaattcgcaaaacctggcggcagcgcaaaagatg

SEQ ID NO: 11849 - DNA, 103 bp, Artificial Sequence
  Synthetic Polynucleotide
taatacgactcactatagggcattgtcgcaaattagattgcgaattttttaacagaggagaaaaaaaatggcaatctaaaacctggcggcagcgcaaaagatg

SEQ ID NO: 11850 - DNA, 103 bp, Artificial Sequence
  Synthetic Polynucleotide
taatacgactcactatagggaacctcattgtcgcaaattagattgcgaataacagaggagaattcgcatgctaatttgcaacctggcggcagcgcaaaagatg

SEQ ID NO: 11851 - DNA, 103 bp, Artificial Sequence
  Synthetic Polynucleotide
taatacgactcactatagggtgtaaaacctcattgtcgcaaattagattgaacagaggagacaatctatgttgcgacaaaacctggcggcagcgcaaaagatg

SEQ ID NO: 11852 - DNA, 103 bp, Artificial Sequence
  Synthetic Polynucleotide
taatacgactcactatagggtttgatgtaaaacctcattgtcgcaaattaaacagaggagataatttatgacaatgaggaacctggcggcagcgcaaaagatg

SEQ ID NO: 11853 - DNA, 103 bp, Artificial Sequence
  Synthetic Polynucleotide
taatacgactcactatagggaaacatttgatgtaaaacctcattgtcgcaaacagaggagatgcgacatggaggttttaaacctggcggcagcgcaaaagatg

SEQ ID NO: 11854 - DNA, 103 bp, Artificial Sequence
  Synthetic Polynucleotide
taatacgactcactatagggcagtgaaacatttgatgtaaaacctcattgaacagaggagacaatgaatgtttacatcaaacctggcggcagcgcaaaagatg

SEQ ID NO: 11855 - DNA, 103 bp, Artificial Sequence
  Synthetic Polynucleotide
taatacgactcactatagggccaattattatcctcagagtaagtaacagaaacagaggagatctgttatgtactctgagaacctggcggcagcgcaaaagatg

SEQ ID NO: 11856 - DNA, 103 bp, Artificial Sequence
  Synthetic Polynucleotide
taatacgactcactataggggatgtgatctagcactgttttaacgatcaaaacagaggagattgatcatgaaaacagtgaacctggcggcagcgcaaaagatg

SEQ ID NO: 11857 - DNA, 103 bp, Artificial Sequence
  Synthetic Polynucleotide
taatacgactcactatagggcataccagtgaaacatttgatgtaaaacctaacagaggagaaggtttatgatcaaatgtaacctggcggcagcgcaaaagatg

SEQ ID NO: 11858 - DNA, 103 bp, Artificial Sequence
  Synthetic Polynucleotide
taatacgactcactatagggaagatcataccagtgaaacatttgatgtaaaacagaggagattacatatgatgtttcacaacctggcggcagcgcaaaagatg

SEQ ID NO: 11859 - DNA, 103 bp, Artificial Sequence
  Synthetic Polynucleotide
taatacgactcactatagggattgcaagatcataccagtgaaacatttgaaacagaggagatcaaatatgtcactggtaaacctggcggcagcgcaaaagatg

SEQ ID NO: 11860 - DNA, 103 bp, Artificial Sequence
  Synthetic Polynucleotide
taatacgactcactatagggctagaattgcaagatcataccagtgaaacaaacagaggagatgtttcatgggtatgatcaacctggcggcagcgcaaaagatg

SEQ ID NO: 11861 - DNA, 103 bp, Artificial Sequence
  Synthetic Polynucleotide
taatacgactcactatagggacgtgctagaattgcaagatcataccagtgaacagaggagacactggatggatcttgcaaacctggcggcagcgcaaaagatg

SEQ ID NO: 11862 - DNA, 103 bp, Artificial Sequence
  Synthetic Polynucleotide
taatacgactcactatagggcctctacgtgctagaattgcaagatcatacaacagaggagagtatgaatgtgcaattctaacctggcggcagcgcaaaagatg

SEQ ID NO: 11863 - DNA, 103 bp, Artificial Sequence
  Synthetic Polynucleotide
taatacgactcactataggggtcgccctctacgtgctagaattgcaagataacagaggagaatcttgatgttctagcacaacctggcggcagcgcaaaagatg

SEQ ID NO: 11864 - DNA, 103 bp, Artificial Sequence
  Synthetic Polynucleotide
taatacgactcactatagggatttagtcgccctctacgtgctagaattgcaacagaggagagcaattatggcacgtagaaacctggcggcagcgcaaaagatg

SEQ ID NO: 11865 - DNA, 103 bp, Artificial Sequence
  Synthetic Polynucleotide
taatacgactcactatagggcctctatttagtcgccctctacgtgctagaaacagaggagatctagcatgtagagggcgaacctggcggcagcgcaaaagatg

SEQ ID NO: 11866 - DNA, 103 bp, Artificial Sequence
  Synthetic Polynucleotide
taatacgactcactatagggtattccctctatttagtcgccctctacgtgaacagaggagacacgtaatgggcgactaaaacctggcggcagcgcaaaagatg

SEQ ID NO: 11867 - DNA, 103 bp, Artificial Sequence
  Synthetic Polynucleotide
taatacgactcactatagggtgaaggatgtgatctagcactgttttaacgaacagaggagacgttaaatgagtgctagaaacctggcggcagcgcaaaagatg

SEQ ID NO: 11868 - DNA, 103 bp, Artificial Sequence
  Synthetic Polynucleotide
taatacgactcactataggggcgattattccctctatttagtcgccctctaacagaggagaagagggatgctaaatagaaacctggcggcagcgcaaaagatg

SEQ ID NO: 11869 - DNA, 103 bp, Artificial Sequence
  Synthetic Polynucleotide
taatacgactcactataggggttgagcgattattccctctatttagtcgcaacagaggagagcgactatgtagagggaaaacctggcggcagcgcaaaagatg

SEQ ID NO: 11870 - DNA, 103 bp, Artificial Sequence
  Synthetic Polynucleotide
taatacgactcactatagggaccatgttgagcgattattccctctatttaaacagaggagataaataatgggaataatcaacctggcggcagcgcaaaagatg

SEQ ID NO: 11871 - DNA, 103 bp, Artificial Sequence
  Synthetic Polynucleotide
taatacgactcactatagggtgcaaaccatgttgagcgattattccctctaacagaggagaagagggatgaatcgctcaaacctggcggcagcgcaaaagatg

SEQ ID NO: 11872 - DNA, 103 bp, Artificial Sequence
  Synthetic Polynucleotide
taatacgactcactatagggtcacttgcaaaccatgttgagcgattattcaacagaggagagaataaatgctcaacatgaacctggcggcagcgcaaaagatg

SEQ ID NO: 11873 - DNA, 103 bp, Artificial Sequence
  Synthetic Polynucleotide
taatacgactcactatagggaattatcacttgcaaaccatgttgagcgataacagaggagaatcgctatgcatggtttgaacctggcggcagcgcaaaagatg

SEQ ID NO: 11874 - DNA, 103 bp, Artificial Sequence
  Synthetic Polynucleotide
taatacgactcactatagggtaccaaattatcacttgcaaaccatgttgaaacagaggagatcaacaatgtttgcaagtaacctggcggcagcgcaaaagatg

SEQ ID NO: 11875 - DNA, 103 bp, Artificial Sequence
  Synthetic Polynucleotide
taatacgactcactatagggatatctaccaaattatcacttgcaaaccataacagaggagaatggttatgaagtgataaaacctggcggcagcgcaaaagatg

SEQ ID NO: 11876 - DNA, 103 bp, Artificial Sequence
  Synthetic Polynucleotide
taatacgactcactatagggctaggatatctaccaaattatcacttgcaaaacagaggagattgcaaatgataatttggaacctggcggcagcgcaaaagatg

SEQ ID NO: 11877 - DNA, 103 bp, Artificial Sequence
  Synthetic Polynucleotide
taatacgactcactatagggataacctaggatatctaccaaattatcactaacagaggagaagtgatatgttggtagataacctggcggcagcgcaaaagatg

SEQ ID NO: 11878 - DNA, 103 bp, Artificial Sequence
  Synthetic Polynucleotide
taatacgactcactatagggttttctgaaggatgtgatctagcactgtttaacagaggagaaaacagatgtagatcacaaacctggcggcagcgcaaaagatg

SEQ ID NO: 11879 - DNA, 103 bp, Artificial Sequence
  Synthetic Polynucleotide
taatacgactcactatagggtctccataacctaggatatctaccaaattaaacagaggagataatttatgagatatcctaacctggcggcagcgcaaaagatg

SEQ ID NO: 11880 - DNA, 103 bp, Artificial Sequence
  Synthetic Polynucleotide
taatacgactcactatagggtataatctccataacctaggatatctaccaaacagaggagatggtagatgtcctaggttaacctggcggcagcgcaaaagatg

SEQ ID NO: 11881 - DNA, 103 bp, Artificial Sequence
  Synthetic Polynucleotide
taatacgactcactatagggaaaaatataatctccataacctaggatatcaacagaggagagatatcatgggttatggaaacctggcggcagcgcaaaagatg

SEQ ID NO: 11882 - DNA, 103 bp, Artificial Sequence
  Synthetic Polynucleotide
taatacgactcactatagggttccaaaaaatataatctccataacctaggaacagaggagacctaggatgtggagattaaacctggcggcagcgcaaaagatg

SEQ ID NO: 11883 - DNA, 103 bp, Artificial Sequence
  Synthetic Polynucleotide
taatacgactcactataggggtattttccaaaaaatataatctccataacaacagaggagagttatgatgattatatttaacctggcggcagcgcaaaagatg

SEQ ID NO: 11884 - DNA, 103 bp, Artificial Sequence
  Synthetic Polynucleotide
taatacgactcactatagggtaatggtattttccaaaaaatataatctccaacagaggagaggagatatgattttttggaacctggcggcagcgcaaaagatg

SEQ ID NO: 11885 - DNA, 103 bp, Artificial Sequence
  Synthetic Polynucleotide
taatacgactcactatagggagtgataatggtattttccaaaaaatataaaacagaggagattatatatgttggaaaataacctggcggcagcgcaaaagatg

SEQ ID NO: 11886 - DNA, 103 bp, Artificial Sequence
  Synthetic Polynucleotide
taatacgactcactataggggtagtagtgataatggtattttccaaaaaaaacagaggagattttttatgaaataccataacctggcggcagcgcaaaagatg

SEQ ID NO: 11887 - DNA, 103 bp, Artificial Sequence
  Synthetic Polynucleotide
taatacgactcactatagggcactggtagtagtgataatggtattttccaaacagaggagatggaaaatgccattatcaaacctggcggcagcgcaaaagatg

SEQ ID NO: 11888 - DNA, 103 bp, Artificial Sequence
  Synthetic Polynucleotide
taatacgactcactataggggtatccactggtagtagtgataatggtattaacagaggagaaataccatgatcactactaacctggcggcagcgcaaaagatg

SEQ ID NO: 11889 - DNA, 103 bp, Artificial Sequence
  Synthetic Polynucleotide
taatacgactcactatagggctctgttttctgaaggatgtgatctagcacaacagaggagagtgctaatgcacatccttaacctggcggcagcgcaaaagatg

SEQ ID NO: 11890 - DNA, 103 bp, Artificial Sequence
  Synthetic Polynucleotide
taatacgactcactatagggcttgtgtatccactggtagtagtgataatgaacagaggagacattatatgtactaccagaacctggcggcagcgcaaaagatg

SEQ ID NO: 11891 - DNA, 103 bp, Artificial Sequence
  Synthetic Polynucleotide
taatacgactcactataggggaggccttgtgtatccactggtagtagtgaaacagaggagatcactaatgccagtggataacctggcggcagcgcaaaagatg

SEQ ID NO: 11892 - DNA, 103 bp, Artificial Sequence
  Synthetic Polynucleotide
taatacgactcactatagggtgtgggaggccttgtgtatccactggtagtaacagaggagaactaccatgggatacacaaacctggcggcagcgcaaaagatg

SEQ ID NO: 11893 - DNA, 103 bp, Artificial Sequence
  Synthetic Polynucleotide
taatacgactcactatagggctgcatgtgggaggccttgtgtatccactgaacagaggagacagtggatgcacaaggccaacctggcggcagcgcaaaagatg

SEQ ID NO: 11894 - DNA, 103 bp, Artificial Sequence
  Synthetic Polynucleotide
taatacgactcactatagggcttggctgcatgtgggaggccttgtgtatcaacagaggagagatacaatgggcctcccaaacctggcggcagcgcaaaagatg

SEQ ID NO: 11895 - DNA, 103 bp, Artificial Sequence
  Synthetic Polynucleotide
taatacgactcactatagggcagtccttggctgcatgtgggaggccttgtaacagaggagaacaaggatgcccacatgcaacctggcggcagcgcaaaagatg

SEQ ID NO: 11896 - DNA, 103 bp, Artificial Sequence
  Synthetic Polynucleotide
taatacgactcactataggggataccagtccttggctgcatgtgggaggcaacagaggagagcctccatgatgcagccaaacctggcggcagcgcaaaagatg

SEQ ID NO: 11897 - DNA, 103 bp, Artificial Sequence
  Synthetic Polynucleotide
taatacgactcactatagggttcatgataccagtccttggctgcatgtggaacagaggagaccacatatggccaaggacaacctggcggcagcgcaaaagatg

SEQ ID NO: 11898 - DNA, 103 bp, Artificial Sequence
  Synthetic Polynucleotide
taatacgactcactatagggaccgattcatgataccagtccttggctgcaaacagaggagatgcagcatgggactggtaaacctggcggcagcgcaaaagatg

SEQ ID NO: 11899 - DNA, 103 bp, Artificial Sequence
  Synthetic Polynucleotide
taatacgactcactatagggtgaaaaccgattcatgataccagtccttggaacagaggagaccaaggatgggtatcatgaacctggcggcagcgcaaaagatg

SEQ ID NO: 11900 - DNA, 103 bp, Artificial Sequence
  Synthetic Polynucleotide
taatacgactcactatagggccgtgctctgttttctgaaggatgtgatctaacagaggagaagatcaatgccttcagaaaacctggcggcagcgcaaaagatg

SEQ ID NO: 11901 - DNA, 103 bp, Artificial Sequence
  Synthetic Polynucleotide
taatacgactcactatagggctccttgaaaaccgattcatgataccagtcaacagaggagagactggatgcatgaatcgaacctggcggcagcgcaaaagatg

SEQ ID NO: 11902 - DNA, 103 bp, Artificial Sequence
  Synthetic Polynucleotide
taatacgactcactatagggatagcctccttgaaaaccgattcatgatacaacagaggagagtatcaatgatcggttttaacctggcggcagcgcaaaagatg

SEQ ID NO: 11903 - DNA, 103 bp, Artificial Sequence
  Synthetic Polynucleotide
taatacgactcactatagggcttgaatagcctccttgaaaaccgattcataacagaggagaatgaatatgttttcaaggaacctggcggcagcgcaaaagatg

SEQ ID NO: 11904 - DNA, 103 bp, Artificial Sequence
  Synthetic Polynucleotide
taatacgactcactatagggatggccttgaatagcctccttgaaaaccgaaacagaggagatcggttatgaaggaggctaacctggcggcagcgcaaaagatg

SEQ ID NO: 11905 - DNA, 103 bp, Artificial Sequence
  Synthetic Polynucleotide
taatacgactcactatagggtgtgtatggccttgaatagcctccttgaaaaacagaggagatttcaaatgggctattcaaacctggcggcagcgcaaaagatg

SEQ ID NO: 11906 - DNA, 103 bp, Artificial Sequence
  Synthetic Polynucleotide
taatacgactcactatagggcgatgtgtgtatggccttgaatagcctcctaacagaggagaaggaggatgttcaaggccaacctggcggcagcgcaaaagatg

SEQ ID NO: 11907 - DNA, 103 bp, Artificial Sequence
  Synthetic Polynucleotide
taatacgactcactatagggggacacgatgtgtgtatggccttgaatagcaacagaggagagctattatgggccatacaaacctggcggcagcgcaaaagatg

SEQ ID NO: 11908 - DNA, 103 bp, Artificial Sequence
  Synthetic Polynucleotide
taatacgactcactataggggagatggacacgatgtgtgtatggccttgaaacagaggagatcaaggatgtacacacataacctggcggcagcgcaaaagatg

SEQ ID NO: 11909 - DNA, 103 bp, Artificial Sequence
  Synthetic Polynucleotide
taatacgactcactatagggctgtagagatggacacgatgtgtgtatggcaacagaggagagccataatgacatcgtgtaacctggcggcagcgcaaaagatg

SEQ ID NO: 11910 - DNA, 103 bp, Artificial Sequence
  Synthetic Polynucleotide
taatacgactcactatagggatctgctgtagagatggacacgatgtgtgtaacagaggagaacacacatggtgtccatcaacctggcggcagcgcaaaagatg

SEQ ID NO: 11911 - DNA, 103 bp, Artificial Sequence
  Synthetic Polynucleotide
taatacgactcactataggggcactccgtgctctgttttctgaaggatgtaacagaggagaacatccatgagaaaacagaacctggcggcagcgcaaaagatg

SEQ ID NO: 11912 - DNA, 103 bp, Artificial Sequence
  Synthetic Polynucleotide
taatacgactcactatagggaagacatctgctgtagagatggacacgatgaacagaggagacatcgtatgcatctctacaacctggcggcagcgcaaaagatg

SEQ ID NO: 11913 - DNA, 103 bp, Artificial Sequence
  Synthetic Polynucleotide
taatacgactcactatagggtgattaagacatctgctgtagagatggacaaacagaggagatgtccaatgctacagcagaacctggcggcagcgcaaaagatg

SEQ ID NO: 11914 - DNA, 103 bp, Artificial Sequence
  Synthetic Polynucleotide
taatacgactcactatagggacacatgattaagacatctgctgtagagataacagaggagaatctctatggcagatgtcaacctggcggcagcgcaaaagatg

SEQ ID NO: 11915 - DNA, 103 bp, Artificial Sequence
  Synthetic Polynucleotide
taatacgactcactatagggtccttacacatgattaagacatctgctgtaaacagaggagatacagcatgtgtcttaataacctggcggcagcgcaaaagatg

SEQ ID NO: 11916 - DNA, 103 bp, Artificial Sequence
  Synthetic Polynucleotide
taatacgactcactatagggttatgtccttacacatgattaagacatctgaacagaggagacagatgatgtaatcatgtaacctggcggcagcgcaaaagatg

SEQ ID NO: 11917 - DNA, 103 bp, Artificial Sequence
  Synthetic Polynucleotide
taatacgactcactatagggggtgattatgtccttacacatgattaagacaacagaggagagtcttaatgatgtgtaagaacctggcggcagcgcaaaagatg

SEQ ID NO: 11918 - DNA, 103 bp, Artificial Sequence
  Synthetic Polynucleotide
taatacgactcactatagggcgacaggtgattatgtccttacacatgattaacagaggagaaatcatatgtaaggacataacctggcggcagcgcaaaagatg

SEQ ID NO: 11919 - DNA, 103 bp, Artificial Sequence
  Synthetic Polynucleotide
taatacgactcactatagggtaaatcgacaggtgattatgtccttacacaaacagaggagatgtgtaatgacataatcaaacctggcggcagcgcaaaagatg

SEQ ID NO: 11920 - DNA, 103 bp, Artificial Sequence
  Synthetic Polynucleotide
taatacgactcactatagggagtattaaatcgacaggtgattatgtccttaacagaggagaaaggacatgatcacctgtaacctggcggcagcgcaaaagatg

SEQ ID NO: 11921 - DNA, 103 bp, Artificial Sequence
  Synthetic Polynucleotide
taatacgactcactatagggagtaaagtattaaatcgacaggtgattatgaacagaggagacataatatgctgtcgattaacctggcggcagcgcaaaagatg

SEQ ID NO: 11922 - DNA, 103 bp, Artificial Sequence
  Synthetic Polynucleotide
taatacgactcactatagggaagacgcactccgtgctctgttttctgaagaacagaggagacttcagatgacagagcacaacctggcggcagcgcaaaagatg

SEQ ID NO: 11923 - DNA, 103 bp, Artificial Sequence
  Synthetic Polynucleotide
taatacgactcactatagggcaatcagtaaagtattaaatcgacaggtgaaacagaggagatcacctatggatttaataaacctggcggcagcgcaaaagatg

SEQ ID NO: 11924 - DNA, 103 bp, Artificial Sequence
  Synthetic Polynucleotide
taatacgactcactatagggagcagcaatcagtaaagtattaaatcgacaaacagaggagatgtcgaatgaatactttaaacctggcggcagcgcaaaagatg

SEQ ID NO: 11925 - DNA, 103 bp, Artificial Sequence
  Synthetic Polynucleotide
taatacgactcactataggggccacagcagcaatcagtaaagtattaaataacagaggagaatttaaatgtttactgataacctggcggcagcgcaaaagatg

SEQ ID NO: 11926 - DNA, 103 bp, Artificial Sequence
  Synthetic Polynucleotide
taatacgactcactataggggatttgccacagcagcaatcagtaaagtataacagaggagaatacttatgtgattgctgaacctggcggcagcgcaaaagatg

SEQ ID NO: 11927 - DNA, 103 bp, Artificial Sequence
  Synthetic Polynucleotide
taatacgactcactatagggctctagatttgccacagcagcaatcagtaaaacagaggagattactgatggctgctgtgaacctggcggcagcgcaaaagatg

SEQ ID NO: 11928 - DNA, 103 bp, Artificial Sequence
  Synthetic Polynucleotide
taatacgactcactataggggaatcctctagatttgccacagcagcaatcaacagaggagagattgcatgtgtggcaaaaacctggcggcagcgcaaaagatg

SEQ ID NO: 11929 - DNA, 103 bp, Artificial Sequence
  Synthetic Polynucleotide
taatacgactcactataggggaactgaatcctctagatttgccacagcagaacagaggagactgctgatgcaaatctagaacctggcggcagcgcaaaagatg

SEQ ID NO: 11930 - DNA, 103 bp, Artificial Sequence
  Synthetic Polynucleotide
taatacgactcactatagggtgaatgaactgaatcctctagatttgccacaacagaggagagtggcaatgctagaggataacctggcggcagcgcaaaagatg

SEQ ID NO: 11931 - DNA, 103 bp, Artificial Sequence
  Synthetic Polynucleotide
taatacgactcactatagggtaatctgaatgaactgaatcctctagatttaacagaggagaaaatctatgggattcagtaacctggcggcagcgcaaaagatg

SEQ ID NO: 11932 - DNA, 103 bp, Artificial Sequence
  Synthetic Polynucleotide
taatacgactcactatagggaagggtaatctgaatgaactgaatcctctaaacagaggagatagaggatgcagttcattaacctggcggcagcgcaaaagatg

SEQ ID NO: 11933 - DNA, 103 bp, Artificial Sequence
  Synthetic Polynucleotide
taatacgactcactatagggggatgaagacgcactccgtgctctgttttcaacagaggagagaaaacatggcacggagtaacctggcggcagcgcaaaagatg

SEQ ID NO: 11934 - DNA, 103 bp, Artificial Sequence
  Synthetic Polynucleotide
taatacgactcactatagggtggtaaagggtaatctgaatgaactgaatcaacagaggagagattcaatgcattcagataacctggcggcagcgcaaaagatg

SEQ ID NO: 11935 - DNA, 103 bp, Artificial Sequence
  Synthetic Polynucleotide
taatacgactcactataggggtttctggtaaagggtaatctgaatgaactaacagaggagaagttcaatgagattacccaacctggcggcagcgcaaaagatg

SEQ ID NO: 11936 - DNA, 103 bp, Artificial Sequence
  Synthetic Polynucleotide
taatacgactcactatagggacactgtttctggtaaagggtaatctgaataacagaggagaattcagatgaccctttacaacctggcggcagcgcaaaagatg

SEQ ID NO: 11937 - DNA, 103 bp, Artificial Sequence
  Synthetic Polynucleotide
taatacgactcactataggggtcagacactgtttctggtaaagggtaatcaacagaggagagattacatgttaccagaaaacctggcggcagcgcaaaagatg

SEQ ID NO: 11938 - DNA, 103 bp, Artificial Sequence
  Synthetic Polynucleotide
taatacgactcactatagggtataggtcagacactgtttctggtaaagggaacagaggagaccctttatgagaaacagtaacctggcggcagcgcaaaagatg

SEQ ID NO: 11939 - DNA, 103 bp, Artificial Sequence
  Synthetic Polynucleotide
taatacgactcactatagggctttgtataggtcagacactgtttctggtaaacagaggagataccagatgcagtgtctgaacctggcggcagcgcaaaagatg

SEQ ID NO: 11940 - DNA, 103 bp, Artificial Sequence
  Synthetic Polynucleotide
taatacgactcactatagggtcctgctttgtataggtcagacactgtttcaacagaggagagaaacaatgtctgacctaaacctggcggcagcgcaaaagatg

SEQ ID NO: 11941 - DNA, 103 bp, Artificial Sequence
  Synthetic Polynucleotide
taatacgactcactatagggtaatctcctgctttgtataggtcagacactaacagaggagaagtgtcatgcctatacaaaacctggcggcagcgcaaaagatg

SEQ ID NO: 11942 - DNA, 103 bp, Artificial Sequence
  Synthetic Polynucleotide
taatacgactcactatagggttaaataatctcctgctttgtataggtcagaacagaggagactgaccatgacaaagcagaacctggcggcagcgcaaaagatg

SEQ ID NO: 11943 - DNA, 103 bp, Artificial Sequence
  Synthetic Polynucleotide
taatacgactcactatagggtgagattaaataatctcctgctttgtatagaacagaggagactatacatggcaggagataacctggcggcagcgcaaaagatg

SEQ ID NO: 11944 - DNA, 103 bp, Artificial Sequence
  Synthetic Polynucleotide
taatacgactcactatagggccaaaggatgaagacgcactccgtgctctgaacagaggagacagagcatggagtgcgtcaacctggcggcagcgcaaaagatg

SEQ ID NO: 11945 - DNA, 103 bp, Artificial Sequence
  Synthetic Polynucleotide
taatacgactcactatagggagcaatgagattaaataatctcctgctttgaacagaggagacaaagcatgagattatttaacctggcggcagcgcaaaagatg

SEQ ID NO: 11946 - DNA, 103 bp, Artificial Sequence
  Synthetic Polynucleotide
taatacgactcactatagggatcctagcaatgagattaaataatctcctgaacagaggagacaggagatgatttaatctaacctggcggcagcgcaaaagatg

SEQ ID NO: 11947 - DNA, 103 bp, Artificial Sequence
  Synthetic Polynucleotide
taatacgactcactatagggttctgatcctagcaatgagattaaataatcaacagaggagagattatatgatctcattgaacctggcggcagcgcaaaagatg

SEQ ID NO: 11948 - DNA, 103 bp, Artificial Sequence
  Synthetic Polynucleotide
taatacgactcactatagggtaaccttctgatcctagcaatgagattaaaaacagaggagatttaatatgattgctaggaacctggcggcagcgcaaaagatg

SEQ ID NO: 11949 - DNA, 103 bp, Artificial Sequence
  Synthetic Polynucleotide
taatacgactcactatagggctttgtaaccttctgatcctagcaatgagaaacagaggagatctcatatgtaggatcagaacctggcggcagcgcaaaagatg

SEQ ID NO: 11950 - DNA, 103 bp, Artificial Sequence
  Synthetic Polynucleotide
taatacgactcactatagggtatgactttgtaaccttctgatcctagcaaaacagaggagattgctaatgtcagaaggtaacctggcggcagcgcaaaagatg

SEQ ID NO: 11951 - DNA, 103 bp, Artificial Sequence
  Synthetic Polynucleotide
taatacgactcactatagggaattttatgactttgtaaccttctgatcctaacagaggagaaggatcatgaggttacaaaacctggcggcagcgcaaaagatg

SEQ ID NO: 11952 - DNA, 103 bp, Artificial Sequence
  Synthetic Polynucleotide
taatacgactcactatagggcaaggaattttatgactttgtaaccttctgaacagaggagacagaagatgacaaagtcaaacctggcggcagcgcaaaagatg

SEQ ID NO: 11953 - DNA, 103 bp, Artificial Sequence
  Synthetic Polynucleotide
taatacgactcactatagggcggctcaaggaattttatgactttgtaaccaacagaggagaggttacatggtcataaaaaacctggcggcagcgcaaaagatg

SEQ ID NO: 11954 - DNA, 103 bp, Artificial Sequence
  Synthetic Polynucleotide
taatacgactcactatagggcataacggctcaaggaattttatgactttgaacagaggagacaaagtatgaaaattcctaacctggcggcagcgcaaaagatg

SEQ ID NO: 11955 - DNA, 103 bp, Artificial Sequence
  Synthetic Polynucleotide
taatacgactcactatagggtcttgccaaaggatgaagacgcactccgtgaacagaggagacacggaatgcgtcttcataacctggcggcagcgcaaaagatg

SEQ ID NO: 11956 - DNA, 103 bp, Artificial Sequence
  Synthetic Polynucleotide
taatacgactcactatagggctaagcataacggctcaaggaattttatgaaacagaggagatcataaatgtccttgagcaacctggcggcagcgcaaaagatg

SEQ ID NO: 11957 - DNA, 103 bp, Artificial Sequence
  Synthetic Polynucleotide
taatacgactcactatagggctttgctaagcataacggctcaaggaatttaacagaggagaaaattcatggagccgttaaacctggcggcagcgcaaaagatg

SEQ ID NO: 11958 - DNA, 103 bp, Artificial Sequence
  Synthetic Polynucleotide
taatacgactcactatagggtggatctttgctaagcataacggctcaaggaacagaggagaccttgaatggttatgcttaacctggcggcagcgcaaaagatg

SEQ ID NO: 11959 - DNA, 103 bp, Artificial Sequence
  Synthetic Polynucleotide
taatacgactcactatagggagagttggatctttgctaagcataacggctaacagaggagaagccgtatggcttagcaaaacctggcggcagcgcaaaagatg

SEQ ID NO: 11960 - DNA, 103 bp, Artificial Sequence
  Synthetic Polynucleotide
taatacgactcactatagggtgagcagagttggatctttgctaagcataaaacagaggagattatgcatggcaaagatcaacctggcggcagcgcaaaagatg

SEQ ID NO: 11961 - DNA, 103 bp, Artificial Sequence
  Synthetic Polynucleotide
taatacgactcactatagggtaatttgagcagagttggatctttgctaagaacagaggagacttagcatggatccaactaacctggcggcagcgcaaaagatg

SEQ ID NO: 11962 - DNA, 103 bp, Artificial Sequence
  Synthetic Polynucleotide
taatacgactcactatagggcagtgtaatttgagcagagttggatctttgaacagaggagacaaagaatgaactctgctaacctggcggcagcgcaaaagatg

SEQ ID NO: 11963 - DNA, 103 bp, Artificial Sequence
  Synthetic Polynucleotide
taatacgactcactatagggcctctcagtgtaatttgagcagagttggataacagaggagaatccaaatgtgctcaaataacctggcggcagcgcaaaagatg

SEQ ID NO: 11964 - DNA, 103 bp, Artificial Sequence
  Synthetic Polynucleotide
taatacgactcactatagggcctttcctctcagtgtaatttgagcagagtaacagaggagaactctgatgaaattacacaacctggcggcagcgcaaaagatg

SEQ ID NO: 11965 - DNA, 103 bp, Artificial Sequence
  Synthetic Polynucleotide
taatacgactcactatagggatcttcctttcctctcagtgtaatttgagcaacagaggagagctcaaatgacactgagaaacctggcggcagcgcaaaagatg

SEQ ID NO: 11966 - DNA, 103 bp, Artificial Sequence
  Synthetic Polynucleotide
taatacgactcactataggggaacaccaattattatcctcagagtaagtaaacagaggagatacttaatgtgaggataaaacctggcggcagcgcaaaagatg

SEQ ID NO: 11967 - DNA, 103 bp, Artificial Sequence
  Synthetic Polynucleotide
taatacgactcactataggggcagttcttgccaaaggatgaagacgcactaacagaggagaagtgcgatgtcatcctttaacctggcggcagcgcaaaagatg

SEQ ID NO: 11968 - DNA, 103 bp, Artificial Sequence
  Synthetic Polynucleotide
taatacgactcactataggggaggaatcttcctttcctctcagtgtaattaacagaggagaaattacatggagaggaaaaacctggcggcagcgcaaaagatg

SEQ ID NO: 11969 - DNA, 103 bp, Artificial Sequence
  Synthetic Polynucleotide
taatacgactcactatagggtgagtgaggaatcttcctttcctctcagtgaacagaggagacactgaatggaaaggaagaacctggcggcagcgcaaaagatg

SEQ ID NO: 11970 - DNA, 103 bp, Artificial Sequence
  Synthetic Polynucleotide
taatacgactcactataggggcatttgagtgaggaatcttcctttcctctaacagaggagaagaggaatggaagattccaacctggcggcagcgcaaaagatg

SEQ ID NO: 11971 - DNA, 103 bp, Artificial Sequence
  Synthetic Polynucleotide
taatacgactcactatagggtaaatgcatttgagtgaggaatcttcctttaacagaggagaaaaggaatgttcctcactaacctggcggcagcgcaaaagatg

SEQ ID NO: 11972 - DNA, 103 bp, Artificial Sequence
  Synthetic Polynucleotide
taatacgactcactatagggacagctaaatgcatttgagtgaggaatcttaacagaggagaaagattatgcactcaaataacctggcggcagcgcaaaagatg

SEQ ID NO: 11973 - DNA, 103 bp, Artificial Sequence
  Synthetic Polynucleotide
taatacgactcactataggggatttacagctaaatgcatttgagtgaggaaacagaggagatcctcaatgaaatgcattaacctggcggcagcgcaaaagatg

SEQ ID NO: 11974 - DNA, 103 bp, Artificial Sequence
  Synthetic Polynucleotide
taatacgactcactatagggtgtatgatttacagctaaatgcatttgagtaacagaggagaactcaaatgcatttagctaacctggcggcagcgcaaaagatg

SEQ ID NO: 11975 - DNA, 103 bp, Artificial Sequence
  Synthetic Polynucleotide
taatacgactcactatagggtcaagtgtatgatttacagctaaatgcattaacagaggagaaatgcaatgagctgtaaaaacctggcggcagcgcaaaagatg

SEQ ID NO: 11976 - DNA, 103 bp, Artificial Sequence
  Synthetic Polynucleotide
taatacgactcactataggggttcctcaagtgtatgatttacagctaaataacagaggagaatttagatgtaaatcataaacctggcggcagcgcaaaagatg

SEQ ID NO: 11977 - DNA, 103 bp, Artificial Sequence
  Synthetic Polynucleotide
taatacgactcactatagggtgtaagttcctcaagtgtatgatttacagcaacagaggagagctgtaatgcatacacttaacctggcggcagcgcaaaagatg

SEQ ID NO: 11978 - DNA, 103 bp, Artificial Sequence
  Synthetic Polynucleotide
taatacgactcactatagggccttagcagttcttgccaaaggatgaagacaacagaggagagtcttcatgctttggcaaaacctggcggcagcgcaaaagatg

SEQ ID NO: 11979 - DNA, 103 bp, Artificial Sequence
  Synthetic Polynucleotide
taatacgactcactataggggaccctgtaagttcctcaagtgtatgatttaacagaggagaaaatcaatgacttgaggaaacctggcggcagcgcaaaagatg

SEQ ID NO: 11980 - DNA, 103 bp, Artificial Sequence
  Synthetic Polynucleotide
taatacgactcactatagggctcgggaccctgtaagttcctcaagtgtataacagaggagaatacacatgaggaacttaaacctggcggcagcgcaaaagatg

SEQ ID NO: 11981 - DNA, 103 bp, Artificial Sequence
  Synthetic Polynucleotide
taatacgactcactatagggtaattctcgggaccctgtaagttcctcaagaacagaggagacttgagatgcttacagggaacctggcggcagcgcaaaagatg

SEQ ID NO: 11982 - DNA, 103 bp, Artificial Sequence
  Synthetic Polynucleotide
taatacgactcactatagggggccttaattctcgggaccctgtaagttccaacagaggagaggaactatgagggtcccgaacctggcggcagcgcaaaagatg

SEQ ID NO: 11983 - DNA, 103 bp, Artificial Sequence
  Synthetic Polynucleotide
taatacgactcactataggggttgtggccttaattctcgggaccctgtaaaacagaggagattacagatgcccgagaataacctggcggcagcgcaaaagatg

SEQ ID NO: 11984 - DNA, 103 bp, Artificial Sequence
  Synthetic Polynucleotide
taatacgactcactatagggaatctgttgtggccttaattctcgggacccaacagaggagagggtccatggaattaaggaacctggcggcagcgcaaaagatg

SEQ ID NO: 11985 - DNA, 103 bp, Artificial Sequence
  Synthetic Polynucleotide
taatacgactcactatagggttccgaatctgttgtggccttaattctcggaacagaggagaccgagaatgaaggccacaaacctggcggcagcgcaaaagatg

SEQ ID NO: 11986 - DNA, 103 bp, Artificial Sequence
  Synthetic Polynucleotide
taatacgactcactatagggttaccttccgaatctgttgtggccttaattaacagaggagaaattaaatgcacaacagaaacctggcggcagcgcaaaagatg

SEQ ID NO: 11987 - DNA, 103 bp, Artificial Sequence
  Synthetic Polynucleotide
taatacgactcactatagggttcccttaccttccgaatctgttgtggcctaacagaggagaaggccaatgcagattcggaacctggcggcagcgcaaaagatg

SEQ ID NO: 11988 - DNA, 103 bp, Artificial Sequence
  Synthetic Polynucleotide
taatacgactcactatagggtggaattcccttaccttccgaatctgttgtaacagaggagaacaacaatgtcggaaggtaacctggcggcagcgcaaaagatg

SEQ ID NO: 11989 - DNA, 103 bp, Artificial Sequence
  Synthetic Polynucleotide
taatacgactcactatagggcttgaccttagcagttcttgccaaaggatgaacagaggagacatcctatggcaagaactaacctggcggcagcgcaaaagatg

SEQ ID NO: 11990 - DNA, 103 bp, Artificial Sequence
  Synthetic Polynucleotide
taatacgactcactatagggtttgatggaattcccttaccttccgaatctaacagaggagaagattcatgaggtaagggaacctggcggcagcgcaaaagatg

SEQ ID NO: 11991 - DNA, 103 bp, Artificial Sequence
  Synthetic Polynucleotide
taatacgactcactatagggcagcatttgatggaattcccttaccttccgaacagaggagacggaagatgagggaattcaacctggcggcagcgcaaaagatg

SEQ ID NO: 11992 - DNA, 103 bp, Artificial Sequence
  Synthetic Polynucleotide
taatacgactcactatagggtttatcagcatttgatggaattcccttaccaacagaggagaggtaagatgattccatcaaacctggcggcagcgcaaaagatg

SEQ ID NO: 11993 - DNA, 103 bp, Artificial Sequence
  Synthetic Polynucleotide
taatacgactcactatagggtaaggtttatcagcatttgatggaattcccaacagaggagagggaatatgatcaaatgcaacctggcggcagcgcaaaagatg

SEQ ID NO: 11994 - DNA, 103 bp, Artificial Sequence
  Synthetic Polynucleotide
taatacgactcactatagggtgccttaaggtttatcagcatttgatggaaaacagaggagattccatatgatgctgataaacctggcggcagcgcaaaagatg

SEQ ID NO: 11995 - DNA, 103 bp, Artificial Sequence
  Synthetic Polynucleotide
taatacgactcactatagggggagttgccttaaggtttatcagcatttgaaacagaggagatcaaatatggataaacctaacctggcggcagcgcaaaagatg

SEQ ID NO: 11996 - DNA, 103 bp, Artificial Sequence
  Synthetic Polynucleotide
taatacgactcactataggggttgaggagttgccttaaggtttatcagcaaacagaggagatgctgaatgaccttaaggaacctggcggcagcgcaaaagatg

SEQ ID NO: 11997 - DNA, 103 bp, Artificial Sequence
  Synthetic Polynucleotide
taatacgactcactataggggagttgttgaggagttgccttaaggtttataacagaggagaataaacatgaaggcaactaacctggcggcagcgcaaaagatg

SEQ ID NO: 11998 - DNA, 103 bp, Artificial Sequence
  Synthetic Polynucleotide
taatacgactcactatagggtcacagagttgttgaggagttgccttaaggaacagaggagaccttaaatgaactcctcaaacctggcggcagcgcaaaagatg

SEQ ID NO: 11999 - DNA, 103 bp, Artificial Sequence
  Synthetic Polynucleotide
taatacgactcactatagggacaactcacagagttgttgaggagttgcctaacagaggagaaggcaaatgctcaacaacaacctggcggcagcgcaaaagatg

SEQ ID NO: 12000 - DNA, 103 bp, Artificial Sequence
  Synthetic Polynucleotide
taatacgactcactatagggtcgttcttgaccttagcagttcttgccaaaaacagaggagatttggcatgaactgctaaaacctggcggcagcgcaaaagatg

SEQ ID NO: 12001 - DNA, 103 bp, Artificial Sequence
  Synthetic Polynucleotide
taatacgactcactatagggtgaaaacaactcacagagttgttgaggagtaacagaggagaactcctatgcaactctgtaacctggcggcagcgcaaaagatg

SEQ ID NO: 12002 - DNA, 103 bp, Artificial Sequence
  Synthetic Polynucleotide
taatacgactcactatagggtgcactgaaaacaactcacagagttgttgaaacagaggagatcaacaatgctgtgagttaacctggcggcagcgcaaaagatg

SEQ ID NO: 12003 - DNA, 103 bp, Artificial Sequence
  Synthetic Polynucleotide
taatacgactcactataggggcttttgcactgaaaacaactcacagagttaacagaggagaaactctatgagttgttttaacctggcggcagcgcaaaagatg

SEQ ID NO: 12004 - DNA, 103 bp, Artificial Sequence
  Synthetic Polynucleotide
taatacgactcactatagggccaatgcttttgcactgaaaacaactcacaaacagaggagatgtgagatgttttcagtgaacctggcggcagcgcaaaagatg

SEQ ID NO: 12005 - DNA, 103 bp, Artificial Sequence
  Synthetic Polynucleotide
taatacgactcactatagggtgcccccaatgcttttgcactgaaaacaacaacagaggagagttgttatgagtgcaaaaaacctggcggcagcgcaaaagatg

SEQ ID NO: 12006 - DNA, 103 bp, Artificial Sequence
  Synthetic Polynucleotide
taatacgactcactatagggcagggtgcccccaatgcttttgcactgaaaaacagaggagatttcagatgaaaagcattaacctggcggcagcgcaaaagatg

SEQ ID NO: 12007 - DNA, 103 bp, Artificial Sequence
  Synthetic Polynucleotide
taatacgactcactatagggcaagacagggtgcccccaatgcttttgcacaacagaggagagtgcaaatgcattgggggaacctggcggcagcgcaaaagatg

SEQ ID NO: 12008 - DNA, 103 bp, Artificial Sequence
  Synthetic Polynucleotide
taatacgactcactatagggctatgcaagacagggtgcccccaatgctttaacagaggagaaaagcaatgggggcacccaacctggcggcagcgcaaaagatg

SEQ ID NO: 12009 - DNA, 103 bp, Artificial Sequence
  Synthetic Polynucleotide
taatacgactcactatagggtttcgctatgcaagacagggtgcccccaataacagaggagaattgggatgaccctgtctaacctggcggcagcgcaaaagatg

SEQ ID NO: 12010 - DNA, 103 bp, Artificial Sequence
  Synthetic Polynucleotide
taatacgactcactatagggagccttttcgctatgcaagacagggtgcccaacagaggagagggcacatggtcttgcataacctggcggcagcgcaaaagatg

SEQ ID NO: 12011 - DNA, 103 bp, Artificial Sequence
  Synthetic Polynucleotide
taatacgactcactatagggttacttcgttcttgaccttagcagttcttgaacagaggagacaagaaatgctaaggtcaaacctggcggcagcgcaaaagatg

SEQ ID NO: 12012 - DNA, 103 bp, Artificial Sequence
  Synthetic Polynucleotide
taatacgactcactatagggtggatagccttttcgctatgcaagacagggaacagaggagaccctgtatggcatagcgaaacctggcggcagcgcaaaagatg

SEQ ID NO: 12013 - DNA, 103 bp, Artificial Sequence
  Synthetic Polynucleotide
taatacgactcactatagggctttttggatagccttttcgctatgcaagaaacagaggagatcttgcatggcgaaaaggaacctggcggcagcgcaaaagatg

SEQ ID NO: 12014 - DNA, 103 bp, Artificial Sequence
  Synthetic Polynucleotide
taatacgactcactatagggctttactttttggatagccttttcgctatgaacagaggagacatagcatgaaggctatcaacctggcggcagcgcaaaagatg

SEQ ID NO: 12015 - DNA, 103 bp, Artificial Sequence
  Synthetic Polynucleotide
taatacgactcactatagggtgcttctttactttttggatagccttttcgaacagaggagacgaaaaatgtatccaaaaaacctggcggcagcgcaaaagatg

SEQ ID NO: 12016 - DNA, 103 bp, Artificial Sequence
  Synthetic Polynucleotide
taatacgactcactatagggttgcatgcttctttactttttggatagcctaacagaggagaaggctaatgaaaaagtaaaacctggcggcagcgcaaaagatg

SEQ ID NO: 12017 - DNA, 103 bp, Artificial Sequence
  Synthetic Polynucleotide
taatacgactcactatagggcactgttgcatgcttctttactttttggataacagaggagaatccaaatggtaaagaagaacctggcggcagcgcaaaagatg

SEQ ID NO: 12018 - DNA, 103 bp, Artificial Sequence
  Synthetic Polynucleotide
taatacgactcactatagggtttatcactgttgcatgcttctttacttttaacagaggagaaaaagtatggaagcatgcaacctggcggcagcgcaaaagatg

SEQ ID NO: 12019 - DNA, 103 bp, Artificial Sequence
  Synthetic Polynucleotide
taatacgactcactatagggatgcttttatcactgttgcatgcttctttaaacagaggagataaagaatgatgcaacagaacctggcggcagcgcaaaagatg

SEQ ID NO: 12020 - DNA, 103 bp, Artificial Sequence
  Synthetic Polynucleotide
taatacgactcactataggggcgcaatgcttttatcactgttgcatgcttaacagaggagaaagcatatgacagtgataaacctggcggcagcgcaaaagatg

SEQ ID NO: 12021 - DNA, 103 bp, Artificial Sequence
  Synthetic Polynucleotide
taatacgactcactatagggattgggcgcaatgcttttatcactgttgcaaacagaggagatgcaacatggataaaagcaacctggcggcagcgcaaaagatg

SEQ ID NO: 12022 - DNA, 103 bp, Artificial Sequence
  Synthetic Polynucleotide
taatacgactcactatagggggaatttacttcgttcttgaccttagcagtaacagaggagaactgctatggtcaagaacaacctggcggcagcgcaaaagatg

SEQ ID NO: 12023 - DNA, 103 bp, Artificial Sequence
  Synthetic Polynucleotide
taatacgactcactatagggttattattgggcgcaatgcttttatcactgaacagaggagacagtgaatgaagcattgcaacctggcggcagcgcaaaagatg

SEQ ID NO: 12024 - DNA, 103 bp, Artificial Sequence
  Synthetic Polynucleotide
taatacgactcactatagggaaagattattattgggcgcaatgcttttataacagaggagaataaaaatgttgcgcccaaacctggcggcagcgcaaaagatg

SEQ ID NO: 12025 - DNA, 103 bp, Artificial Sequence
  Synthetic Polynucleotide
taatacgactcactataggggtttcaaagattattattgggcgcaatgctaacagaggagaagcattatgcccaataataacctggcggcagcgcaaaagatg

SEQ ID NO: 12026 - DNA, 103 bp, Artificial Sequence
  Synthetic Polynucleotide
taatacgactcactatagggaatatgtttcaaagattattattgggcgcaaacagaggagatgcgccatgtaataatctaacctggcggcagcgcaaaagatg

SEQ ID NO: 12027 - DNA, 103 bp, Artificial Sequence
  Synthetic Polynucleotide
taatacgactcactatagggcacacaatatgtttcaaagattattattggaacagaggagaccaataatgatctttgaaaacctggcggcagcgcaaaagatg

SEQ ID NO: 12028 - DNA, 103 bp, Artificial Sequence
  Synthetic Polynucleotide
taatacgactcactatagggttaaacacacaatatgtttcaaagattattaacagaggagaaataatatgtgaaacataaacctggcggcagcgcaaaagatg

SEQ ID NO: 12029 - DNA, 103 bp, Artificial Sequence
  Synthetic Polynucleotide
taatacgactcactatagggtgtatttaaacacacaatatgtttcaaagaaacagaggagatctttgatgcatattgtgaacctggcggcagcgcaaaagatg

SEQ ID NO: 12030 - DNA, 103 bp, Artificial Sequence
  Synthetic Polynucleotide
taatacgactcactatagggaatgctgtatttaaacacacaatatgtttcaacagaggagagaaacaatgtgtgtgtttaacctggcggcagcgcaaaagatg

SEQ ID NO: 12031 - DNA, 103 bp, Artificial Sequence
  Synthetic Polynucleotide
taatacgactcactatagggtttgcaatgctgtatttaaacacacaatataacagaggagaatattgatggtttaaataaacctggcggcagcgcaaaagatg

SEQ ID NO: 12032 - DNA, 103 bp, Artificial Sequence
  Synthetic Polynucleotide
taatacgactcactatagggaatgttttgcaatgctgtatttaaacacacaacagaggagagtgtgtatgaatacagcaaacctggcggcagcgcaaaagatg

SEQ ID NO: 12033 - DNA, 103 bp, Artificial Sequence
  Synthetic Polynucleotide
taatacgactcactatagggttaaaggaatttacttcgttcttgaccttaaacagaggagataaggtatggaacgaagtaacctggcggcagcgcaaaagatg

SEQ ID NO: 12034 - DNA, 103 bp, Artificial Sequence
  Synthetic Polynucleotide
taatacgactcactatagggaaaataatgttttgcaatgctgtatttaaaaacagaggagatttaaaatgagcattgcaaacctggcggcagcgcaaaagatg

SEQ ID NO: 12035 - DNA, 103 bp, Artificial Sequence
  Synthetic Polynucleotide
taatacgactcactatagggctatcaaaataatgttttgcaatgctgtataacagaggagaatacagatgtgcaaaacaaacctggcggcagcgcaaaagatg

SEQ ID NO: 12036 - DNA, 103 bp, Artificial Sequence
  Synthetic Polynucleotide
taatacgactcactatagggcctgactatcaaaataatgttttgcaatgcaacagaggagagcattgatgaacattattaacctggcggcagcgcaaaagatg

SEQ ID NO: 12037 - DNA, 103 bp, Artificial Sequence
  Synthetic Polynucleotide
taatacgactcactatagggcgtaccctgactatcaaaataatgttttgcaacagaggagagcaaaaatgtattttgataacctggcggcagcgcaaaagatg

SEQ ID NO: 12038 - DNA, 103 bp, Artificial Sequence
  Synthetic Polynucleotide
taatacgactcactatagggtaccacgtaccctgactatcaaaataatgtaacagaggagaacattaatgtgatagtcaaacctggcggcagcgcaaaagatg

SEQ ID NO: 12039 - DNA, 103 bp, Artificial Sequence
  Synthetic Polynucleotide
taatacgactcactatagggcactgtaccacgtaccctgactatcaaaataacagaggagaattttgatggtcagggtaaacctggcggcagcgcaaaagatg

SEQ ID NO: 12040 - DNA, 103 bp, Artificial Sequence
  Synthetic Polynucleotide
taatacgactcactatagggagtcacactgtaccacgtaccctgactatcaacagaggagagatagtatgggtacgtggaacctggcggcagcgcaaaagatg

SEQ ID NO: 12041 - DNA, 103 bp, Artificial Sequence
  Synthetic Polynucleotide
taatacgactcactatagggtcagaagtcacactgtaccacgtaccctgaaacagaggagatcagggatggtggtacagaacctggcggcagcgcaaaagatg

SEQ ID NO: 12042 - DNA, 103 bp, Artificial Sequence
  Synthetic Polynucleotide
taatacgactcactatagggatctgtcagaagtcacactgtaccacgtacaacagaggagagtacgtatgacagtgtgaaacctggcggcagcgcaaaagatg

SEQ ID NO: 12043 - DNA, 103 bp, Artificial Sequence
  Synthetic Polynucleotide
taatacgactcactatagggtaagcatctgtcagaagtcacactgtaccaaacagaggagatggtacatggtgacttctaacctggcggcagcgcaaaagatg

SEQ ID NO: 12044 - DNA, 103 bp, Artificial Sequence
  Synthetic Polynucleotide
taatacgactcactatagggcagccttaaaggaatttacttcgttcttgaaacagaggagatcaagaatgaagtaaattaacctggcggcagcgcaaaagatg

SEQ ID NO: 12045 - DNA, 103 bp, Artificial Sequence
  Synthetic Polynucleotide
taatacgactcactatagggggtgttaagcatctgtcagaagtcacactgaacagaggagacagtgtatgttctgacagaacctggcggcagcgcaaaagatg

SEQ ID NO: 12046 - DNA, 103 bp, Artificial Sequence
  Synthetic Polynucleotide
taatacgactcactatagggggcctggtgttaagcatctgtcagaagtcaaacagaggagatgacttatgacagatgctaacctggcggcagcgcaaaagatg

SEQ ID NO: 12047 - DNA, 103 bp, Artificial Sequence
  Synthetic Polynucleotide
taatacgactcactatagggggaaaggcctggtgttaagcatctgtcagaaacagaggagatctgacatgtgcttaacaaacctggcggcagcgcaaaagatg

SEQ ID NO: 12048 - DNA, 103 bp, Artificial Sequence
  Synthetic Polynucleotide
taatacgactcactatagggtaagaggaaaggcctggtgttaagcatctgaacagaggagacagatgatgaacaccaggaacctggcggcagcgcaaaagatg

SEQ ID NO: 12049 - DNA, 103 bp, Artificial Sequence
  Synthetic Polynucleotide
taatacgactcactatagggtgatgtaagaggaaaggcctggtgttaagcaacagaggagagcttaaatgcaggcctttaacctggcggcagcgcaaaagatg

SEQ ID NO: 12050 - DNA, 103 bp, Artificial Sequence
  Synthetic Polynucleotide
taatacgactcactatagggtcttttgatgtaagaggaaaggcctggtgtaacagaggagaacaccaatgctttcctctaacctggcggcagcgcaaaagatg

SEQ ID NO: 12051 - DNA, 103 bp, Artificial Sequence
  Synthetic Polynucleotide
taatacgactcactatagggtggtttcttttgatgtaagaggaaaggcctaacagaggagaaggcctatgctcttacataacctggcggcagcgcaaaagatg

SEQ ID NO: 12052 - DNA, 103 bp, Artificial Sequence
  Synthetic Polynucleotide
taatacgactcactataggggaaattggtttcttttgatgtaagaggaaaaacagaggagatttcctatgacatcaaaaaacctggcggcagcgcaaaagatg

SEQ ID NO: 12053 - DNA, 103 bp, Artificial Sequence
  Synthetic Polynucleotide
taatacgactcactatagggtggaggaaattggtttcttttgatgtaagaaacagaggagatcttacatgaaaagaaacaacctggcggcagcgcaaaagatg

SEQ ID NO: 12054 - DNA, 103 bp, Artificial Sequence
  Synthetic Polynucleotide
taatacgactcactatagggggtagtggaggaaattggtttcttttgatgaacagaggagacatcaaatgaaaccaattaacctggcggcagcgcaaaagatg

SEQ ID NO: 12055 - DNA, 103 bp, Artificial Sequence
  Synthetic Polynucleotide
taatacgactcactatagggaagggcagccttaaaggaatttacttcgttaacagaggagaaacgaaatgaattcctttaacctggcggcagcgcaaaagatg

SEQ ID NO: 12056 - DNA, 103 bp, Artificial Sequence
  Synthetic Polynucleotide
taatacgactcactatagggtcataggtagtggaggaaattggtttctttaacagaggagaaaagaaatgaatttcctcaacctggcggcagcgcaaaagatg

SEQ ID NO: 12057 - DNA, 103 bp, Artificial Sequence
  Synthetic Polynucleotide
taatacgactcactatagggtttgatcataggtagtggaggaaattggttaacagaggagaaaccaaatgcctccactaaacctggcggcagcgcaaaagatg

SEQ ID NO: 12058 - DNA, 103 bp, Artificial Sequence
  Synthetic Polynucleotide
taatacgactcactatagggagttctttgatcataggtagtggaggaaataacagaggagaatttccatgactacctataacctggcggcagcgcaaaagatg

SEQ ID NO: 12059 - DNA, 103 bp, Artificial Sequence
  Synthetic Polynucleotide
taatacgactcactatagggacaaaagttctttgatcataggtagtggagaacagaggagactccacatgctatgatcaaacctggcggcagcgcaaaagatg

SEQ ID NO: 12060 - DNA, 103 bp, Artificial Sequence
  Synthetic Polynucleotide
taatacgactcactatagggttcccacaaaagttctttgatcataggtagaacagaggagactacctatgatcaaagaaaacctggcggcagcgcaaaagatg

SEQ ID NO: 12061 - DNA, 103 bp, Artificial Sequence
  Synthetic Polynucleotide
taatacgactcactatagggtaaaattcccacaaaagttctttgatcataaacagaggagatatgatatgagaacttttaacctggcggcagcgcaaaagatg

SEQ ID NO: 12062 - DNA, 103 bp, Artificial Sequence
  Synthetic Polynucleotide
taatacgactcactatagggagtgataaaattcccacaaaagttctttgaaacagaggagatcaaagatgttttgtgggaacctggcggcagcgcaaaagatg

SEQ ID NO: 12063 - DNA, 103 bp, Artificial Sequence
  Synthetic Polynucleotide
taatacgactcactatagggatctaagtgataaaattcccacaaaagttcaacagaggagagaacttatgtgggaatttaacctggcggcagcgcaaaagatg

SEQ ID NO: 12064 - DNA, 103 bp, Artificial Sequence
  Synthetic Polynucleotide
taatacgactcactatagggggatgatctaagtgataaaattcccacaaaaacagaggagatttgtgatgattttatcaaacctggcggcagcgcaaaagatg

SEQ ID NO: 12065 - DNA, 103 bp, Artificial Sequence
  Synthetic Polynucleotide
taatacgactcactatagggacggaggatgatctaagtgataaaattcccaacagaggagagggaatatgatcacttagaacctggcggcagcgcaaaagatg

SEQ ID NO: 12066 - DNA, 103 bp, Artificial Sequence
  Synthetic Polynucleotide
taatacgactcactataggggagctaagggcagccttaaaggaatttactaacagaggagaagtaaaatgctttaaggcaacctggcggcagcgcaaaagatg

SEQ ID NO: 12067 - DNA, 103 bp, Artificial Sequence
  Synthetic Polynucleotide
taatacgactcactataggggaataacggaggatgatctaagtgataaaaaacagaggagattttatatgttagatcataacctggcggcagcgcaaaagatg

SEQ ID NO: 12068 - DNA, 103 bp, Artificial Sequence
  Synthetic Polynucleotide
taatacgactcactataggggtggagaataacggaggatgatctaagtgaaacagaggagatcacttatgtcatcctccaacctggcggcagcgcaaaagatg

SEQ ID NO: 12069 - DNA, 103 bp, Artificial Sequence
  Synthetic Polynucleotide
taatacgactcactatagggctttggtggagaataacggaggatgatctaaacagaggagatagatcatgctccgttataacctggcggcagcgcaaaagatg

SEQ ID NO: 12070 - DNA, 103 bp, Artificial Sequence
  Synthetic Polynucleotide
taatacgactcactatagggaatcactttggtggagaataacggaggatgaacagaggagacatcctatgttattctccaacctggcggcagcgcaaaagatg

SEQ ID NO: 12071 - DNA, 103 bp, Artificial Sequence
  Synthetic Polynucleotide
taatacgactcactatagggtcactaatcactttggtggagaataacggaaacagaggagatccgttatgctccaccaaaacctggcggcagcgcaaaagatg

SEQ ID NO: 12072 - DNA, 103 bp, Artificial Sequence
  Synthetic Polynucleotide
taatacgactcactatagggtcaaatcactaatcactttggtggagaataaacagaggagatattctatgccaaagtgaaacctggcggcagcgcaaaagatg

SEQ ID NO: 12073 - DNA, 103 bp, Artificial Sequence
  Synthetic Polynucleotide
taatacgactcactataggggatactcaaatcactaatcactttggtggaaacagaggagatccaccatggtgattagtaacctggcggcagcgcaaaagatg

SEQ ID NO: 12074 - DNA, 103 bp, Artificial Sequence
  Synthetic Polynucleotide
taatacgactcactatagggataaagatactcaaatcactaatcactttgaacagaggagacaaagtatgtagtgatttaacctggcggcagcgcaaaagatg

SEQ ID NO: 12075 - DNA, 103 bp, Artificial Sequence
  Synthetic Polynucleotide
taatacgactcactatagggctttaataaagatactcaaatcactaatcaaacagaggagatgattaatgatttgagtaaacctggcggcagcgcaaaagatg

SEQ ID NO: 12076 - DNA, 103 bp, Artificial Sequence
  Synthetic Polynucleotide
taatacgactcactatagggacgatctttaataaagatactcaaatcactaacagaggagaagtgatatgagtatctttaacctggcggcagcgcaaaagatg

SEQ ID NO: 12077 - DNA, 103 bp, Artificial Sequence
  Synthetic Polynucleotide
taatacgactcactatagggcttctgaacaccaattattatcctcagagtaacagaggagaactctgatgataataattaacctggcggcagcgcaaaagatg

SEQ ID NO: 12078 - DNA, 103 bp, Artificial Sequence
  Synthetic Polynucleotide
taatacgactcactatagggctagcgagctaagggcagccttaaaggaataacagaggagaattcctatgaggctgcccaacctggcggcagcgcaaaagatg

SEQ ID NO: 12079 - DNA, 103 bp, Artificial Sequence
  Synthetic Polynucleotide
taatacgactcactataggggtagcacgatctttaataaagatactcaaaaacagaggagatttgagatgctttattaaaacctggcggcagcgcaaaagatg

SEQ ID NO: 12080 - DNA, 103 bp, Artificial Sequence
  Synthetic Polynucleotide
taatacgactcactatagggctgcagtagcacgatctttaataaagatacaacagaggagagtatctatgttaaagatcaacctggcggcagcgcaaaagatg

SEQ ID NO: 12081 - DNA, 103 bp, Artificial Sequence
  Synthetic Polynucleotide
taatacgactcactatagggctcgactgcagtagcacgatctttaataaaaacagaggagatttattatggatcgtgctaacctggcggcagcgcaaaagatg

SEQ ID NO: 12082 - DNA, 103 bp, Artificial Sequence
  Synthetic Polynucleotide
taatacgactcactataggggttttctcgactgcagtagcacgatctttaaacagaggagataaagaatgtgctactgcaacctggcggcagcgcaaaagatg

SEQ ID NO: 12083 - DNA, 103 bp, Artificial Sequence
  Synthetic Polynucleotide
taatacgactcactatagggagcatgttttctcgactgcagtagcacgataacagaggagaatcgtgatgctgcagtcgaacctggcggcagcgcaaaagatg

SEQ ID NO: 12084 - DNA, 103 bp, Artificial Sequence
  Synthetic Polynucleotide
taatacgactcactataggggtcccagcatgttttctcgactgcagtagcaacagaggagagctactatggtcgagaaaaacctggcggcagcgcaaaagatg

SEQ ID NO: 12085 - DNA, 103 bp, Artificial Sequence
  Synthetic Polynucleotide
taatacgactcactatagggactgcgtcccagcatgttttctcgactgcaaacagaggagatgcagtatggaaaacatgaacctggcggcagcgcaaaagatg

SEQ ID NO: 12086 - DNA, 103 bp, Artificial Sequence
  Synthetic Polynucleotide
taatacgactcactatagggcaaaaactgcgtcccagcatgttttctcgaaacagaggagatcgagaatgcatgctgggaacctggcggcagcgcaaaagatg

SEQ ID NO: 12087 - DNA, 103 bp, Artificial Sequence
  Synthetic Polynucleotide
taatacgactcactataggggggttcaaaaactgcgtcccagcatgttttaacagaggagaaaaacaatgtgggacgcaaacctggcggcagcgcaaaagatg

SEQ ID NO: 12088 - DNA, 103 bp, Artificial Sequence
  Synthetic Polynucleotide
taatacgactcactatagggacattgggttcaaaaactgcgtcccagcataacagaggagaatgctgatgcgcagttttaacctggcggcagcgcaaaagatg

SEQ ID NO: 12089 - DNA, 103 bp, Artificial Sequence
  Synthetic Polynucleotide
taatacgactcactatagggttgtgctagcgagctaagggcagccttaaaaacagaggagatttaagatggcccttagcaacctggcggcagcgcaaaagatg

SEQ ID NO: 12090 - DNA, 103 bp, Artificial Sequence
  Synthetic Polynucleotide
taatacgactcactatagggcaagaacattgggttcaaaaactgcgtcccaacagaggagagggacgatgtttttgaacaacctggcggcagcgcaaaagatg

SEQ ID NO: 12091 - DNA, 103 bp, Artificial Sequence
  Synthetic Polynucleotide
taatacgactcactatagggataaccaagaacattgggttcaaaaactgcaacagaggagagcagttatggaacccaataacctggcggcagcgcaaaagatg

SEQ ID NO: 12092 - DNA, 103 bp, Artificial Sequence
  Synthetic Polynucleotide
taatacgactcactataggggggttataaccaagaacattgggttcaaaaaacagaggagattttgaatgcaatgttctaacctggcggcagcgcaaaagatg

SEQ ID NO: 12093 - DNA, 103 bp, Artificial Sequence
  Synthetic Polynucleotide
taatacgactcactatagggtcggtgggttataaccaagaacattgggttaacagaggagaaacccaatgttcttggttaacctggcggcagcgcaaaagatg

SEQ ID NO: 12094 - DNA, 103 bp, Artificial Sequence
  Synthetic Polynucleotide
taatacgactcactatagggtttattcggtgggttataaccaagaacattaacagaggagaaatgttatgggttataacaacctggcggcagcgcaaaagatg

SEQ ID NO: 12095 - DNA, 103 bp, Artificial Sequence
  Synthetic Polynucleotide
taatacgactcactataggggcaaatttattcggtgggttataaccaagaaacagaggagatcttggatgtaacccaccaacctggcggcagcgcaaaagatg

SEQ ID NO: 12096 - DNA, 103 bp, Artificial Sequence
  Synthetic Polynucleotide
taatacgactcactatagggttgtagcaaatttattcggtgggttataacaacagaggagagttataatgcaccgaataaacctggcggcagcgcaaaagatg

SEQ ID NO: 12097 - DNA, 103 bp, Artificial Sequence
  Synthetic Polynucleotide
taatacgactcactatagggcctttttgtagcaaatttattcggtgggttaacagaggagaaacccaatgaataaatttaacctggcggcagcgcaaaagatg

SEQ ID NO: 12098 - DNA, 103 bp, Artificial Sequence
  Synthetic Polynucleotide
taatacgactcactatagggggtaccctttttgtagcaaatttattcggtaacagaggagaaccgaaatgatttgctacaacctggcggcagcgcaaaagatg

SEQ ID NO: 12099 - DNA, 103 bp, Artificial Sequence
  Synthetic Polynucleotide
taatacgactcactataggggctcaggtaccctttttgtagcaaatttataacagaggagaataaatatgctacaaaaaaacctggcggcagcgcaaaagatg

SEQ ID NO: 12100 - DNA, 103 bp, Artificial Sequence
  Synthetic Polynucleotide
taatacgactcactatagggccatgttgtgctagcgagctaagggcagccaacagaggagaggctgcatgtagctcgctaacctggcggcagcgcaaaagatg

SEQ ID NO: 12101 - DNA, 103 bp, Artificial Sequence
  Synthetic Polynucleotide
taatacgactcactataggggaattgctcaggtaccctttttgtagcaaaaacagaggagatttgctatgaaaagggtaaacctggcggcagcgcaaaagatg

SEQ ID NO: 12102 - DNA, 103 bp, Artificial Sequence
  Synthetic Polynucleotide
taatacgactcactatagggtcaaggaattgctcaggtaccctttttgtaaacagaggagatacaaaatgggtacctgaaacctggcggcagcgcaaaagatg

SEQ ID NO: 12103 - DNA, 103 bp, Artificial Sequence
  Synthetic Polynucleotide
taatacgactcactatagggcctgttcaaggaattgctcaggtaccctttaacagaggagaaaagggatgctgagcaataacctggcggcagcgcaaaagatg

SEQ ID NO: 12104 - DNA, 103 bp, Artificial Sequence
  Synthetic Polynucleotide
taatacgactcactatagggattctcctgttcaaggaattgctcaggtacaacagaggagagtacctatgcaattccttaacctggcggcagcgcaaaagatg

SEQ ID NO: 12105 - DNA, 103 bp, Artificial Sequence
  Synthetic Polynucleotide
taatacgactcactataggggagaaattctcctgttcaaggaattgctcaaacagaggagatgagcaatgccttgaacaaacctggcggcagcgcaaaagatg

SEQ ID NO: 12106 - DNA, 103 bp, Artificial Sequence
  Synthetic Polynucleotide
taatacgactcactatagggctattgagaaattctcctgttcaaggaattaacagaggagaaattccatgaacaggagaaacctggcggcagcgcaaaagatg

SEQ ID NO: 12107 - DNA, 103 bp, Artificial Sequence
  Synthetic Polynucleotide
taatacgactcactatagggactctctattgagaaattctcctgttcaagaacagaggagacttgaaatggagaatttcaacctggcggcagcgcaaaagatg

SEQ ID NO: 12108 - DNA, 103 bp, Artificial Sequence
  Synthetic Polynucleotide
taatacgactcactatagggaggacactctctattgagaaattctcctgtaacagaggagaacaggaatgtttctcaataacctggcggcagcgcaaaagatg

SEQ ID NO: 12109 - DNA, 103 bp, Artificial Sequence
  Synthetic Polynucleotide
taatacgactcactatagggaatgtaggacactctctattgagaaattctaacagaggagaagaattatgcaatagagaaacctggcggcagcgcaaaagatg

SEQ ID NO: 12110 - DNA, 103 bp, Artificial Sequence
  Synthetic Polynucleotide
taatacgactcactatagggagcataatgtaggacactctctattgagaaaacagaggagattctcaatggagagtgtcaacctggcggcagcgcaaaagatg

SEQ ID NO: 12111 - DNA, 103 bp, Artificial Sequence
  Synthetic Polynucleotide
taatacgactcactatagggactctccatgttgtgctagcgagctaagggaacagaggagacccttaatgcgctagcacaacctggcggcagcgcaaaagatg

SEQ ID NO: 12112 - DNA, 103 bp, Artificial Sequence
  Synthetic Polynucleotide
taatacgactcactatagggcgttgagcataatgtaggacactctctattaacagaggagaaatagaatgtgtcctacaaacctggcggcagcgcaaaagatg

SEQ ID NO: 12113 - DNA, 103 bp, Artificial Sequence
  Synthetic Polynucleotide
taatacgactcactatagggccagacgttgagcataatgtaggacactctaacagaggagaagagtgatgtacattatgaacctggcggcagcgcaaaagatg

SEQ ID NO: 12114 - DNA, 103 bp, Artificial Sequence
  Synthetic Polynucleotide
taatacgactcactatagggatattccagacgttgagcataatgtaggacaacagaggagagtcctaatgtatgctcaaaacctggcggcagcgcaaaagatg

SEQ ID NO: 12115 - DNA, 103 bp, Artificial Sequence
  Synthetic Polynucleotide
taatacgactcactatagggagaagatattccagacgttgagcataatgtaacagaggagaacattaatgtcaacgtctaacctggcggcagcgcaaaagatg

SEQ ID NO: 12116 - DNA, 103 bp, Artificial Sequence
  Synthetic Polynucleotide
taatacgactcactatagggccgggagaagatattccagacgttgagcataacagaggagaatgctcatggtctggaataacctggcggcagcgcaaaagatg

SEQ ID NO: 12117 - DNA, 103 bp, Artificial Sequence
  Synthetic Polynucleotide
taatacgactcactataggggtactccgggagaagatattccagacgttgaacagaggagacaacgtatggaatatcttaacctggcggcagcgcaaaagatg

SEQ ID NO: 12118 - DNA, 103 bp, Artificial Sequence
  Synthetic Polynucleotide
taatacgactcactatagggttccggtactccgggagaagatattccagaaacagaggagatctggaatgtcttctcccaacctggcggcagcgcaaaagatg

SEQ ID NO: 12119 - DNA, 103 bp, Artificial Sequence
  Synthetic Polynucleotide
taatacgactcactatagggagaagttccggtactccgggagaagatattaacagaggagaaatatcatgtcccggagtaacctggcggcagcgcaaaagatg

SEQ ID NO: 12120 - DNA, 103 bp, Artificial Sequence
  Synthetic Polynucleotide
taatacgactcactatagggaaaagagaagttccggtactccgggagaagaacagaggagacttctcatggagtaccggaacctggcggcagcgcaaaagatg

SEQ ID NO: 12121 - DNA, 103 bp, Artificial Sequence
  Synthetic Polynucleotide
taatacgactcactatagggagtgaaaaagagaagttccggtactccgggaacagaggagacccggaatgccggaacttaacctggcggcagcgcaaaagatg

SEQ ID NO: 12122 - DNA, 103 bp, Artificial Sequence
  Synthetic Polynucleotide
taatacgactcactatagggagcatactctccatgttgtgctagcgagctaacagaggagaagctcgatggcacaacataacctggcggcagcgcaaaagatg

SEQ ID NO: 12123 - DNA, 103 bp, Artificial Sequence
  Synthetic Polynucleotide
taatacgactcactatagggccttgagtgaaaaagagaagttccggtactaacagaggagaagtaccatgacttctcttaacctggcggcagcgcaaaagatg

SEQ ID NO: 12124 - DNA, 103 bp, Artificial Sequence
  Synthetic Polynucleotide
taatacgactcactatagggcttctccttgagtgaaaaagagaagttccgaacagaggagacggaacatgtctttttcaaacctggcggcagcgcaaaagatg

SEQ ID NO: 12125 - DNA, 103 bp, Artificial Sequence
  Synthetic Polynucleotide
taatacgactcactatagggaactccttctccttgagtgaaaaagagaagaacagaggagacttctcatgttcactcaaaacctggcggcagcgcaaaagatg

SEQ ID NO: 12126 - DNA, 103 bp, Artificial Sequence
  Synthetic Polynucleotide
taatacgactcactatagggtgtttaactccttctccttgagtgaaaaagaacagaggagactttttatgtcaaggagaaacctggcggcagcgcaaaagatg

SEQ ID NO: 12127 - DNA, 103 bp, Artificial Sequence
  Synthetic Polynucleotide
taatacgactcactatagggtccaatgtttaactccttctccttgagtgaaacagaggagatcactcatggagaaggagaacctggcggcagcgcaaaagatg

SEQ ID NO: 12128 - DNA, 103 bp, Artificial Sequence
  Synthetic Polynucleotide
taatacgactcactataggggctcgtccaatgtttaactccttctccttgaacagaggagacaaggaatgggagttaaaaacctggcggcagcgcaaaagatg

SEQ ID NO: 12129 - DNA, 103 bp, Artificial Sequence
  Synthetic Polynucleotide
taatacgactcactatagggcaaaagctcgtccaatgtttaactccttctaacagaggagaagaaggatgtaaacattgaacctggcggcagcgcaaaagatg

SEQ ID NO: 12130 - DNA, 103 bp, Artificial Sequence
  Synthetic Polynucleotide
taatacgactcactatagggtttcccaaaagctcgtccaatgtttaactcaacagaggagagagttaatgattggacgaaacctggcggcagcgcaaaagatg

SEQ ID NO: 12131 - DNA, 103 bp, Artificial Sequence
  Synthetic Polynucleotide
taatacgactcactatagggggcaatttcccaaaagctcgtccaatgtttaacagaggagaaaacatatgacgagctttaacctggcggcagcgcaaaagatg

SEQ ID NO: 12132 - DNA, 103 bp, Artificial Sequence
  Synthetic Polynucleotide
taatacgactcactataggggatatggcaatttcccaaaagctcgtccaaaacagaggagattggacatgcttttgggaaacctggcggcagcgcaaaagatg

SEQ ID NO: 12133 - DNA, 103 bp, Artificial Sequence
  Synthetic Polynucleotide
taatacgactcactatagggaaaggagcatactctccatgttgtgctagcaacagaggagagctagcatgacatggagaaacctggcggcagcgcaaaagatg

SEQ ID NO: 12134 - DNA, 103 bp, Artificial Sequence
  Synthetic Polynucleotide
taatacgactcactatagggtgttggatatggcaatttcccaaaagctcgaacagaggagacgagctatggggaaattgaacctggcggcagcgcaaaagatg

SEQ ID NO: 12135 - DNA, 103 bp, Artificial Sequence
  Synthetic Polynucleotide
taatacgactcactatagggttgcgtgttggatatggcaatttcccaaaaaacagaggagattttggatgattgccataaacctggcggcagcgcaaaagatg

SEQ ID NO: 12136 - DNA, 103 bp, Artificial Sequence
  Synthetic Polynucleotide
taatacgactcactataggggaacattgcgtgttggatatggcaatttccaacagaggagaggaaatatgcatatccaaaacctggcggcagcgcaaaagatg

SEQ ID NO: 12137 - DNA, 103 bp, Artificial Sequence
  Synthetic Polynucleotide
taatacgactcactatagggagtttgaacattgcgtgttggatatggcaaaacagaggagattgccaatgccaacacgcaacctggcggcagcgcaaaagatg

SEQ ID NO: 12138 - DNA, 103 bp, Artificial Sequence
  Synthetic Polynucleotide
taatacgactcactatagggcacagagtttgaacattgcgtgttggatataacagaggagaatatccatgacgcaatgtaacctggcggcagcgcaaaagatg

SEQ ID NO: 12139 - DNA, 103 bp, Artificial Sequence
  Synthetic Polynucleotide
taatacgactcactatagggcttcgcacagagtttgaacattgcgtgttgaacagaggagacaacacatgatgttcaaaaacctggcggcagcgcaaaagatg

SEQ ID NO: 12140 - DNA, 103 bp, Artificial Sequence
  Synthetic Polynucleotide
taatacgactcactatagggcaaagcttcgcacagagtttgaacattgcgaacagaggagacgcaatatgcaaactctgaacctggcggcagcgcaaaagatg

SEQ ID NO: 12141 - DNA, 103 bp, Artificial Sequence
  Synthetic Polynucleotide
taatacgactcactataggggctaacaaagcttcgcacagagtttgaacaaacagaggagatgttcaatgtctgtgcgaaacctggcggcagcgcaaaagatg

SEQ ID NO: 12142 - DNA, 103 bp, Artificial Sequence
  Synthetic Polynucleotide
taatacgactcactatagggcatctgctaacaaagcttcgcacagagtttaacagaggagaaaactcatggcgaagcttaacctggcggcagcgcaaaagatg

SEQ ID NO: 12143 - DNA, 103 bp, Artificial Sequence
  Synthetic Polynucleotide
taatacgactcactatagggcaaaccatctgctaacaaagcttcgcacagaacagaggagactgtgcatggctttgttaaacctggcggcagcgcaaaagatg

SEQ ID NO: 12144 - DNA, 103 bp, Artificial Sequence
  Synthetic Polynucleotide
taatacgactcactataggggagcaaaaggagcatactctccatgttgtgaacagaggagacacaacatggagagtatgaacctggcggcagcgcaaaagatg

SEQ ID NO: 12145 - DNA, 103 bp, Artificial Sequence
  Synthetic Polynucleotide
taatacgactcactatagggttcgccaaaccatctgctaacaaagcttcgaacagaggagacgaagcatggttagcagaaacctggcggcagcgcaaaagatg

SEQ ID NO: 12146 - DNA, 103 bp, Artificial Sequence
  Synthetic Polynucleotide
taatacgactcactatagggatgctttcgccaaaccatctgctaacaaagaacagaggagactttgtatgcagatggttaacctggcggcagcgcaaaagatg

SEQ ID NO: 12147 - DNA, 103 bp, Artificial Sequence
  Synthetic Polynucleotide
taatacgactcactatagggtgggaatgctttcgccaaaccatctgctaaaacagaggagattagcaatgggtttggcgaacctggcggcagcgcaaaagatg

SEQ ID NO: 12148 - DNA, 103 bp, Artificial Sequence
  Synthetic Polynucleotide
taatacgactcactatagggttgcttgggaatgctttcgccaaaccatctaacagaggagaagatggatgggcgaaagcaacctggcggcagcgcaaaagatg

SEQ ID NO: 12149 - DNA, 103 bp, Artificial Sequence
  Synthetic Polynucleotide
taatacgactcactatagggtcatattgcttgggaatgctttcgccaaacaacagaggagagtttggatgaagcattccaacctggcggcagcgcaaaagatg

SEQ ID NO: 12150 - DNA, 103 bp, Artificial Sequence
  Synthetic Polynucleotide
taatacgactcactatagggaaccatcatattgcttgggaatgctttcgcaacagaggagagcgaaaatgttcccaagcaacctggcggcagcgcaaaagatg

SEQ ID NO: 12151 - DNA, 103 bp, Artificial Sequence
  Synthetic Polynucleotide
taatacgactcactataggggtcacaaccatcatattgcttgggaatgctaacagaggagaagcattatgaagcaatataacctggcggcagcgcaaaagatg

SEQ ID NO: 12152 - DNA, 103 bp, Artificial Sequence
  Synthetic Polynucleotide
taatacgactcactataggggctctgtcacaaccatcatattgcttgggaaacagaggagatcccaaatgatatgatggaacctggcggcagcgcaaaagatg

SEQ ID NO: 12153 - DNA, 103 bp, Artificial Sequence
  Synthetic Polynucleotide
taatacgactcactatagggctcgcgctctgtcacaaccatcatattgctaacagaggagaagcaatatgatggttgtgaacctggcggcagcgcaaaagatg

SEQ ID NO: 12154 - DNA, 103 bp, Artificial Sequence
  Synthetic Polynucleotide
taatacgactcactatagggttttgctcgcgctctgtcacaaccatcataaacagaggagatatgatatgtgtgacagaaacctggcggcagcgcaaaagatg

SEQ ID NO: 12155 - DNA, 103 bp, Artificial Sequence
  Synthetic Polynucleotide
taatacgactcactatagggcaagcgagcaaaaggagcatactctccatgaacagaggagacatggaatgtatgctcctaacctggcggcagcgcaaaagatg

SEQ ID NO: 12156 - DNA, 103 bp, Artificial Sequence
  Synthetic Polynucleotide
taatacgactcactatagggtttctttttgctcgcgctctgtcacaaccaaacagaggagatggttgatgcagagcgcgaacctggcggcagcgcaaaagatg

SEQ ID NO: 12157 - DNA, 103 bp, Artificial Sequence
  Synthetic Polynucleotide
taatacgactcactatagggaaggctttctttttgctcgcgctctgtcacaacagaggagagtgacaatgcgcgagcaaaacctggcggcagcgcaaaagatg

SEQ ID NO: 12158 - DNA, 103 bp, Artificial Sequence
  Synthetic Polynucleotide
taatacgactcactatagggtgcaaaaggctttctttttgctcgcgctctaacagaggagaagagcgatggcaaaaagaaacctggcggcagcgcaaaagatg

SEQ ID NO: 12159 - DNA, 103 bp, Artificial Sequence
  Synthetic Polynucleotide
taatacgactcactatagggcttgatgcaaaaggctttctttttgctcgcaacagaggagagcgagcatgaagaaagccaacctggcggcagcgcaaaagatg

SEQ ID NO: 12160 - DNA, 103 bp, Artificial Sequence
  Synthetic Polynucleotide
taatacgactcactatagggagacgcttgatgcaaaaggctttctttttgaacagaggagacaaaaaatgagccttttgaacctggcggcagcgcaaaagatg

SEQ ID NO: 12161 - DNA, 103 bp, Artificial Sequence
  Synthetic Polynucleotide
taatacgactcactatagggtgccaagacgcttgatgcaaaaggctttctaacagaggagaagaaagatgtttgcatcaaacctggcggcagcgcaaaagatg

SEQ ID NO: 12162 - DNA, 103 bp, Artificial Sequence
  Synthetic Polynucleotide
taatacgactcactatagggtgtgatgccaagacgcttgatgcaaaaggcaacagaggagagcctttatgatcaagcgtaacctggcggcagcgcaaaagatg

SEQ ID NO: 12163 - DNA, 103 bp, Artificial Sequence
  Synthetic Polynucleotide
taatacgactcactatagggacttgtgtgatgccaagacgcttgatgcaaaacagaggagattgcatatggcgtcttggaacctggcggcagcgcaaaagatg

SEQ ID NO: 12164 - DNA, 103 bp, Artificial Sequence
  Synthetic Polynucleotide
taatacgactcactatagggtcatcacttgtgtgatgccaagacgcttgaaacagaggagatcaagcatgttggcatcaaacctggcggcagcgcaaaagatg

SEQ ID NO: 12165 - DNA, 103 bp, Artificial Sequence
  Synthetic Polynucleotide
taatacgactcactatagggcaaaatcatcacttgtgtgatgccaagacgaacagaggagacgtcttatgatcacacaaaacctggcggcagcgcaaaagatg

SEQ ID NO: 12166 - DNA, 103 bp, Artificial Sequence
  Synthetic Polynucleotide
taatacgactcactatagggttcagcaagcgagcaaaaggagcatactctaacagaggagaagagtaatgtccttttgcaacctggcggcagcgcaaaagatg

SEQ ID NO: 12167 - DNA, 103 bp, Artificial Sequence
  Synthetic Polynucleotide
taatacgactcactatagggctcaccaaaatcatcacttgtgtgatgccaaacagaggagatggcatatgacaagtgataacctggcggcagcgcaaaagatg

SEQ ID NO: 12168 - DNA, 103 bp, Artificial Sequence
  Synthetic Polynucleotide
taatacgactcactataggggcattctcaccaaaatcatcacttgtgtgaaacagaggagatcacacatgtgatgatttaacctggcggcagcgcaaaagatg

SEQ ID NO: 12169 - DNA, 103 bp, Artificial Sequence
  Synthetic Polynucleotide
taatacgactcactatagggcagtagcattctcaccaaaatcatcacttgaacagaggagacaagtgatgattttggtgaacctggcggcagcgcaaaagatg

SEQ ID NO: 12170 - DNA, 103 bp, Artificial Sequence
  Synthetic Polynucleotide
taatacgactcactatagggtctaacagtagcattctcaccaaaatcatcaacagaggagagatgatatgggtgagaataacctggcggcagcgcaaaagatg

SEQ ID NO: 12171 - DNA, 103 bp, Artificial Sequence
  Synthetic Polynucleotide
taatacgactcactatagggctgcctctaacagtagcattctcaccaaaaaacagaggagattttggatggaatgctacaacctggcggcagcgcaaaagatg

SEQ ID NO: 12172 - DNA, 103 bp, Artificial Sequence
  Synthetic Polynucleotide
taatacgactcactatagggaactactgcctctaacagtagcattctcacaacagaggagagtgagaatgctactgttaaacctggcggcagcgcaaaagatg

SEQ ID NO: 12173 - DNA, 103 bp, Artificial Sequence
  Synthetic Polynucleotide
taatacgactcactatagggtacaaaactactgcctctaacagtagcattaacagaggagaaatgctatggttagaggcaacctggcggcagcgcaaaagatg

SEQ ID NO: 12174 - DNA, 103 bp, Artificial Sequence
  Synthetic Polynucleotide
taatacgactcactatagggtctgttacaaaactactgcctctaacagtaaacagaggagatactgtatgaggcagtagaacctggcggcagcgcaaaagatg

SEQ ID NO: 12175 - DNA, 103 bp, Artificial Sequence
  Synthetic Polynucleotide
taatacgactcactatagggccaagtctgttacaaaactactgcctctaaaacagaggagattagagatggtagttttgaacctggcggcagcgcaaaagatg

SEQ ID NO: 12176 - DNA, 103 bp, Artificial Sequence
  Synthetic Polynucleotide
taatacgactcactatagggtttttccaagtctgttacaaaactactgccaacagaggagaggcagtatgtttgtaacaaacctggcggcagcgcaaaagatg

SEQ ID NO: 12177 - DNA, 103 bp, Artificial Sequence
  Synthetic Polynucleotide
taatacgactcactatagggaaagattcagcaagcgagcaaaaggagcataacagaggagaatgctcatgttgctcgctaacctggcggcagcgcaaaagatg

SEQ ID NO: 12178 - DNA, 103 bp, Artificial Sequence
  Synthetic Polynucleotide
taatacgactcactatagggttgtatttttccaagtctgttacaaaactaaacagaggagatagtttatgaacagacttaacctggcggcagcgcaaaagatg

SEQ ID NO: 12179 - DNA, 103 bp, Artificial Sequence
  Synthetic Polynucleotide
taatacgactcactatagggctaaattgtatttttccaagtctgttacaaaacagaggagattgtaaatgacttggaaaaacctggcggcagcgcaaaagatg

SEQ ID NO: 12180 - DNA, 103 bp, Artificial Sequence
  Synthetic Polynucleotide
taatacgactcactataggggaatgctaaattgtatttttccaagtctgtaacagaggagaacagacatggaaaaatacaacctggcggcagcgcaaaagatg

SEQ ID NO: 12181 - DNA, 103 bp, Artificial Sequence
  Synthetic Polynucleotide
taatacgactcactatagggtatcggaatgctaaattgtatttttccaagaacagaggagacttggaatgatacaatttaacctggcggcagcgcaaaagatg

SEQ ID NO: 12182 - DNA, 103 bp, Artificial Sequence
  Synthetic Polynucleotide
taatacgactcactatagggactcatatcggaatgctaaattgtatttttaacagaggagaaaaaatatgatttagcataacctggcggcagcgcaaaagatg

SEQ ID NO: 12183 - DNA, 103 bp, Artificial Sequence
  Synthetic Polynucleotide
taatacgactcactatagggtgtaaactcatatcggaatgctaaattgtaaacagaggagatacaatatggcattccgaaacctggcggcagcgcaaaagatg

SEQ ID NO: 12184 - DNA, 103 bp, Artificial Sequence
  Synthetic Polynucleotide
taatacgactcactatagggggagctgtaaactcatatcggaatgctaaaaacagaggagatttagcatgccgatatgaaacctggcggcagcgcaaaagatg

SEQ ID NO: 12185 - DNA, 103 bp, Artificial Sequence
  Synthetic Polynucleotide
taatacgactcactatagggtaaaaggagctgtaaactcatatcggaatgaacagaggagacattccatgatgagtttaaacctggcggcagcgcaaaagatg

SEQ ID NO: 12186 - DNA, 103 bp, Artificial Sequence
  Synthetic Polynucleotide
taatacgactcactatagggttcaataaaaggagctgtaaactcatatcgaacagaggagacgatatatgtttacagctaacctggcggcagcgcaaaagatg

SEQ ID NO: 12187 - DNA, 103 bp, Artificial Sequence
  Synthetic Polynucleotide
taatacgactcactatagggcagtattcaataaaaggagctgtaaactcaaacagaggagatgagttatgagctcctttaacctggcggcagcgcaaaagatg

SEQ ID NO: 12188 - DNA, 103 bp, Artificial Sequence
  Synthetic Polynucleotide
taatacgactcactataggggggtacttctgaacaccaattattatcctcaacagaggagagaggatatgaattggtgtaacctggcggcagcgcaaaagatg

SEQ ID NO: 12189 - DNA, 103 bp, Artificial Sequence
  Synthetic Polynucleotide
taatacgactcactatagggtccagaaagattcagcaagcgagcaaaaggaacagaggagaccttttatgcgcttgctgaacctggcggcagcgcaaaagatg

SEQ ID NO: 12190 - DNA, 103 bp, Artificial Sequence
  Synthetic Polynucleotide
taatacgactcactataggggattacagtattcaataaaaggagctgtaaaacagaggagattacagatgcttttattgaacctggcggcagcgcaaaagatg

SEQ ID NO: 12191 - DNA, 103 bp, Artificial Sequence
  Synthetic Polynucleotide
taatacgactcactatagggacaacgattacagtattcaataaaaggagcaacagaggagagctcctatgattgaatacaacctggcggcagcgcaaaagatg

SEQ ID NO: 12192 - DNA, 103 bp, Artificial Sequence
  Synthetic Polynucleotide
taatacgactcactatagggccgtaacaacgattacagtattcaataaaaaacagaggagattttatatgatactgtaaaacctggcggcagcgcaaaagatg

SEQ ID NO: 12193 - DNA, 103 bp, Artificial Sequence
  Synthetic Polynucleotide
taatacgactcactatagggttacaccgtaacaacgattacagtattcaaaacagaggagattgaatatggtaatcgttaacctggcggcagcgcaaaagatg

SEQ ID NO: 12194 - DNA, 103 bp, Artificial Sequence
  Synthetic Polynucleotide
taatacgactcactatagggatttcttacaccgtaacaacgattacagtaaacagaggagatactgtatgcgttgttacaacctggcggcagcgcaaaagatg

SEQ ID NO: 12195 - DNA, 103 bp, Artificial Sequence
  Synthetic Polynucleotide
taatacgactcactatagggaacaaatttcttacaccgtaacaacgattaaacagaggagataatcgatgttacggtgtaacctggcggcagcgcaaaagatg

SEQ ID NO: 12196 - DNA, 103 bp, Artificial Sequence
  Synthetic Polynucleotide
taatacgactcactatagggaattaaacaaatttcttacaccgtaacaacaacagaggagagttgttatggtgtaagaaaacctggcggcagcgcaaaagatg

SEQ ID NO: 12197 - DNA, 103 bp, Artificial Sequence
  Synthetic Polynucleotide
taatacgactcactatagggcatccaattaaacaaatttcttacaccgtaaacagaggagatacggtatgagaaatttgaacctggcggcagcgcaaaagatg

SEQ ID NO: 12198 - DNA, 103 bp, Artificial Sequence
  Synthetic Polynucleotide
taatacgactcactatagggtagtgcatccaattaaacaaatttcttacaaacagaggagatgtaagatgtttgtttaaaacctggcggcagcgcaaaagatg

SEQ ID NO: 12199 - DNA, 103 bp, Artificial Sequence
  Synthetic Polynucleotide
taatacgactcactatagggtagtgtagtgcatccaattaaacaaatttcaacagaggagagaaattatgttaattggaaacctggcggcagcgcaaaagatg

SEQ ID NO: 12200 - DNA, 103 bp, Artificial Sequence
  Synthetic Polynucleotide
taatacgactcactatagggttgactccagaaagattcagcaagcgagcaaacagaggagatgctcgatggctgaatctaacctggcggcagcgcaaaagatg

SEQ ID NO: 12201 - DNA, 103 bp, Artificial Sequence
  Synthetic Polynucleotide
taatacgactcactatagggtggtatagtgtagtgcatccaattaaacaaaacagaggagattgtttatgtggatgcacaacctggcggcagcgcaaaagatg

SEQ ID NO: 12202 - DNA, 103 bp, Artificial Sequence
  Synthetic Polynucleotide
taatacgactcactatagggcactgtggtatagtgtagtgcatccaattaaacagaggagataattgatggcactacacaacctggcggcagcgcaaaagatg

SEQ ID NO: 12203 - DNA, 103 bp, Artificial Sequence
  Synthetic Polynucleotide
taatacgactcactatagggtataacactgtggtatagtgtagtgcatccaacagaggagaggatgcatgacactatacaacctggcggcagcgcaaaagatg

SEQ ID NO: 12204 - DNA, 103 bp, Artificial Sequence
  Synthetic Polynucleotide
taatacgactcactatagggatgtatataacactgtggtatagtgtagtgaacagaggagacactacatgataccacagaacctggcggcagcgcaaaagatg

SEQ ID NO: 12205 - DNA, 103 bp, Artificial Sequence
  Synthetic Polynucleotide
taatacgactcactatagggctcacatgtatataacactgtggtatagtgaacagaggagacactatatgacagtgttaaacctggcggcagcgcaaaagatg

SEQ ID NO: 12206 - DNA, 103 bp, Artificial Sequence
  Synthetic Polynucleotide
taatacgactcactatagggaatcactcacatgtatataacactgtggtaaacagaggagataccacatggttatatacaacctggcggcagcgcaaaagatg

SEQ ID NO: 12207 - DNA, 103 bp, Artificial Sequence
  Synthetic Polynucleotide
taatacgactcactatagggataataatcactcacatgtatataacactgaacagaggagacagtgtatgatacatgtgaacctggcggcagcgcaaaagatg

SEQ ID NO: 12208 - DNA, 103 bp, Artificial Sequence
  Synthetic Polynucleotide
taatacgactcactataggggggttataataatcactcacatgtatataaaacagaggagattatatatgtgtgagtgaaacctggcggcagcgcaaaagatg

SEQ ID NO: 12209 - DNA, 103 bp, Artificial Sequence
  Synthetic Polynucleotide
taatacgactcactataggggtggggggttataataatcactcacatgtaaacagaggagatacatgatggtgattattaacctggcggcagcgcaaaagatg

SEQ ID NO: 12210 - DNA, 103 bp, Artificial Sequence
  Synthetic Polynucleotide
taatacgactcactatagggtccatgtggggggttataataatcactcacaacagaggagagtgagtatgtattataacaacctggcggcagcgcaaaagatg

SEQ ID NO: 12211 - DNA, 103 bp, Artificial Sequence
  Synthetic Polynucleotide
taatacgactcactataggggattgttgactccagaaagattcagcaagcaacagaggagagcttgcatgatctttctgaacctggcggcagcgcaaaagatg

SEQ ID NO: 12212 - DNA, 103 bp, Artificial Sequence
  Synthetic Polynucleotide
taatacgactcactataggggagactccatgtggggggttataataatcaaacagaggagatgattaatgtaaccccccaacctggcggcagcgcaaaagatg

SEQ ID NO: 12213 - DNA, 103 bp, Artificial Sequence
  Synthetic Polynucleotide
taatacgactcactatagggcgagagagactccatgtggggggttataataacagaggagaattataatgccccacatgaacctggcggcagcgcaaaagatg

SEQ ID NO: 12214 - DNA, 103 bp, Artificial Sequence
  Synthetic Polynucleotide
taatacgactcactataggggttttcgagagagactccatgtggggggttaacagaggagaaaccccatgcatggagtcaacctggcggcagcgcaaaagatg

SEQ ID NO: 12215 - DNA, 103 bp, Artificial Sequence
  Synthetic Polynucleotide
taatacgactcactatagggtctcggttttcgagagagactccatgtgggaacagaggagacccacaatgagtctctctaacctggcggcagcgcaaaagatg

SEQ ID NO: 12216 - DNA, 103 bp, Artificial Sequence
  Synthetic Polynucleotide
taatacgactcactataggggattttctcggttttcgagagagactccataacagaggagaatggagatgctctcgaaaaacctggcggcagcgcaaaagatg

SEQ ID NO: 12217 - DNA, 103 bp, Artificial Sequence
  Synthetic Polynucleotide
taatacgactcactatagggtggtggattttctcggttttcgagagagacaacagaggagagtctctatggaaaaccgaaacctggcggcagcgcaaaagatg

SEQ ID NO: 12218 - DNA, 103 bp, Artificial Sequence
  Synthetic Polynucleotide
taatacgactcactatagggccttctggtggattttctcggttttcgagaaacagaggagatctcgaatgccgagaaaaaacctggcggcagcgcaaaagatg

SEQ ID NO: 12219 - DNA, 103 bp, Artificial Sequence
  Synthetic Polynucleotide
taatacgactcactatagggttggaccttctggtggattttctcggttttaacagaggagaaaaaccatgaaaatccacaacctggcggcagcgcaaaagatg

SEQ ID NO: 12220 - DNA, 103 bp, Artificial Sequence
  Synthetic Polynucleotide
taatacgactcactatagggagagcttggaccttctggtggattttctcgaacagaggagacgagaaatgccaccagaaaacctggcggcagcgcaaaagatg

SEQ ID NO: 12221 - DNA, 103 bp, Artificial Sequence
  Synthetic Polynucleotide
taatacgactcactatagggcggtaagagcttggaccttctggtggatttaacagaggagaaaatccatgagaaggtccaacctggcggcagcgcaaaagatg

SEQ ID NO: 12222 - DNA, 103 bp, Artificial Sequence
  Synthetic Polynucleotide
taatacgactcactatagggctcgagattgttgactccagaaagattcagaacagaggagactgaatatgtctggagtcaacctggcggcagcgcaaaagatg

SEQ ID NO: 12223 - DNA, 103 bp, Artificial Sequence
  Synthetic Polynucleotide
taatacgactcactataggggaccacggtaagagcttggaccttctggtgaacagaggagacaccagatggtccaagctaacctggcggcagcgcaaaagatg

SEQ ID NO: 12224 - DNA, 103 bp, Artificial Sequence
  Synthetic Polynucleotide
taatacgactcactatagggtagatgaccacggtaagagcttggaccttcaacagaggagagaaggtatgagctcttacaacctggcggcagcgcaaaagatg

SEQ ID NO: 12225 - DNA, 103 bp, Artificial Sequence
  Synthetic Polynucleotide
taatacgactcactatagggccgcctagatgaccacggtaagagcttggaaacagaggagatccaagatgttaccgtggaacctggcggcagcgcaaaagatg

SEQ ID NO: 12226 - DNA, 103 bp, Artificial Sequence
  Synthetic Polynucleotide
taatacgactcactatagggcaatcccgcctagatgaccacggtaagagcaacagaggagagctcttatggtggtcatcaacctggcggcagcgcaaaagatg

SEQ ID NO: 12227 - DNA, 103 bp, Artificial Sequence
  Synthetic Polynucleotide
taatacgactcactatagggtccctcaatcccgcctagatgaccacggtaaacagaggagataccgtatgcatctaggcaacctggcggcagcgcaaaagatg

SEQ ID NO: 12228 - DNA, 103 bp, Artificial Sequence
  Synthetic Polynucleotide
taatacgactcactatagggtgaagtccctcaatcccgcctagatgaccaaacagaggagatggtcaatgaggcgggataacctggcggcagcgcaaaagatg

SEQ ID NO: 12229 - DNA, 103 bp, Artificial Sequence
  Synthetic Polynucleotide
taatacgactcactatagggtttgttgaagtccctcaatcccgcctagataacagaggagaatctagatgggattgaggaacctggcggcagcgcaaaagatg

SEQ ID NO: 12230 - DNA, 103 bp, Artificial Sequence
  Synthetic Polynucleotide
taatacgactcactataggggagtttttgttgaagtccctcaatcccgccaacagaggagaggcgggatggagggacttaacctggcggcagcgcaaaagatg

SEQ ID NO: 12231 - DNA, 103 bp, Artificial Sequence
  Synthetic Polynucleotide
taatacgactcactataggggtccagagtttttgttgaagtccctcaatcaacagaggagagattgaatgacttcaacaaacctggcggcagcgcaaaagatg

SEQ ID NO: 12232 - DNA, 103 bp, Artificial Sequence
  Synthetic Polynucleotide
taatacgactcactatagggtgcttgtccagagtttttgttgaagtccctaacagaggagaagggacatgaacaaaaacaacctggcggcagcgcaaaagatg

SEQ ID NO: 12233 - DNA, 103 bp, Artificial Sequence
  Synthetic Polynucleotide
taatacgactcactatagggccgtgctcgagattgttgactccagaaagaaacagaggagatctttcatgagtcaacaaaacctggcggcagcgcaaaagatg

SEQ ID NO: 12234 - DNA, 103 bp, Artificial Sequence
  Synthetic Polynucleotide
taatacgactcactatagggtgagatgcttgtccagagtttttgttgaagaacagaggagacttcaaatgaaactctggaacctggcggcagcgcaaaagatg

SEQ ID NO: 12235 - DNA, 103 bp, Artificial Sequence
  Synthetic Polynucleotide
taatacgactcactataggggcacatgagatgcttgtccagagtttttgtaacagaggagaacaaaaatgctggacaagaacctggcggcagcgcaaaagatg

SEQ ID NO: 12236 - DNA, 103 bp, Artificial Sequence
  Synthetic Polynucleotide
taatacgactcactatagggtctgtgcacatgagatgcttgtccagagttaacagaggagaaactctatgcaagcatctaacctggcggcagcgcaaaagatg

SEQ ID NO: 12237 - DNA, 103 bp, Artificial Sequence
  Synthetic Polynucleotide
taatacgactcactatagggtgaaatctgtgcacatgagatgcttgtccaaacagaggagatggacaatgatctcatgtaacctggcggcagcgcaaaagatg

SEQ ID NO: 12238 - DNA, 103 bp, Artificial Sequence
  Synthetic Polynucleotide
taatacgactcactatagggactaatgaaatctgtgcacatgagatgcttaacagaggagaaagcatatgatgtgcacaaacctggcggcagcgcaaaagatg

SEQ ID NO: 12239 - DNA, 103 bp, Artificial Sequence
  Synthetic Polynucleotide
taatacgactcactatagggtttcaactaatgaaatctgtgcacatgagaaacagaggagatctcatatgcacagatttaacctggcggcagcgcaaaagatg

SEQ ID NO: 12240 - DNA, 103 bp, Artificial Sequence
  Synthetic Polynucleotide
taatacgactcactatagggtttgatttcaactaatgaaatctgtgcacaaacagaggagatgtgcaatgatttcattaaacctggcggcagcgcaaaagatg

SEQ ID NO: 12241 - DNA, 103 bp, Artificial Sequence
  Synthetic Polynucleotide
taatacgactcactatagggccggttttgatttcaactaatgaaatctgtaacagaggagaacagatatgattagttgaaacctggcggcagcgcaaaagatg

SEQ ID NO: 12242 - DNA, 103 bp, Artificial Sequence
  Synthetic Polynucleotide
taatacgactcactatagggtaaaaccggttttgatttcaactaatgaaaaacagaggagatttcatatgttgaaatcaaacctggcggcagcgcaaaagatg

SEQ ID NO: 12243 - DNA, 103 bp, Artificial Sequence
  Synthetic Polynucleotide
taatacgactcactatagggcagtttaaaaccggttttgatttcaactaaaacagaggagattagttatgatcaaaaccaacctggcggcagcgcaaaagatg

SEQ ID NO: 12244 - DNA, 103 bp, Artificial Sequence
  Synthetic Polynucleotide
taatacgactcactatagggacagtccgtgctcgagattgttgactccagaacagaggagactggagatgacaatctcgaacctggcggcagcgcaaaagatg

SEQ ID NO: 12245 - DNA, 103 bp, Artificial Sequence
  Synthetic Polynucleotide
taatacgactcactataggggatcgcagtttaaaaccggttttgatttcaaacagaggagatgaaatatgaaccggtttaacctggcggcagcgcaaaagatg

SEQ ID NO: 12246 - DNA, 103 bp, Artificial Sequence
  Synthetic Polynucleotide
taatacgactcactatagggccgcagatcgcagtttaaaaccggttttgaaacagaggagatcaaaaatggttttaaacaacctggcggcagcgcaaaagatg

SEQ ID NO: 12247 - DNA, 103 bp, Artificial Sequence
  Synthetic Polynucleotide
taatacgactcactatagggcattaccgcagatcgcagtttaaaaccggtaacagaggagaaccggtatgaaactgcgaaacctggcggcagcgcaaaagatg

SEQ ID NO: 12248 - DNA, 103 bp, Artificial Sequence
  Synthetic Polynucleotide
taatacgactcactatagggtcacccattaccgcagatcgcagtttaaaaaacagaggagattttaaatggcgatctgcaacctggcggcagcgcaaaagatg

SEQ ID NO: 12249 - DNA, 103 bp, Artificial Sequence
  Synthetic Polynucleotide
taatacgactcactataggggattgtcacccattaccgcagatcgcagttaacagaggagaaactgcatgctgcggtaaaacctggcggcagcgcaaaagatg

SEQ ID NO: 12250 - DNA, 103 bp, Artificial Sequence
  Synthetic Polynucleotide
taatacgactcactatagggacattgattgtcacccattaccgcagatcgaacagaggagacgatctatggtaatgggtaacctggcggcagcgcaaaagatg

SEQ ID NO: 12251 - DNA, 103 bp, Artificial Sequence
  Synthetic Polynucleotide
taatacgactcactataggggttatacattgattgtcacccattaccgcaaacagaggagatgcggtatggggtgacaaaacctggcggcagcgcaaaagatg

SEQ ID NO: 12252 - DNA, 103 bp, Artificial Sequence
  Synthetic Polynucleotide
taatacgactcactataggggtacagttatacattgattgtcacccattaaacagaggagataatggatgacaatcaataacctggcggcagcgcaaaagatg

SEQ ID NO: 12253 - DNA, 103 bp, Artificial Sequence
  Synthetic Polynucleotide
taatacgactcactatagggagagagtacagttatacattgattgtcaccaacagaggagaggtgacatgcaatgtataaacctggcggcagcgcaaaagatg

SEQ ID NO: 12254 - DNA, 103 bp, Artificial Sequence
  Synthetic Polynucleotide
taatacgactcactatagggaatacagagagtacagttatacattgattgaacagaggagacaatcaatgtataactgtaacctggcggcagcgcaaaagatg

SEQ ID NO: 12255 - DNA, 103 bp, Artificial Sequence
  Synthetic Polynucleotide
taatacgactcactatagggaggaaacagtccgtgctcgagattgttgacaacagaggagagtcaacatgctcgagcacaacctggcggcagcgcaaaagatg

SEQ ID NO: 12256 - DNA, 103 bp, Artificial Sequence
  Synthetic Polynucleotide
taatacgactcactatagggggggaaatacagagagtacagttatacattaacagaggagaaatgtaatgctgtactctaacctggcggcagcgcaaaagatg

SEQ ID NO: 12257 - DNA, 103 bp, Artificial Sequence
  Synthetic Polynucleotide
taatacgactcactatagggttcgaggggaaatacagagagtacagttataacagaggagaataactatgctctctgtaaacctggcggcagcgcaaaagatg

SEQ ID NO: 12258 - DNA, 103 bp, Artificial Sequence
  Synthetic Polynucleotide
taatacgactcactatagggtcagtttcgaggggaaatacagagagtacaaacagaggagatgtactatgtgtatttccaacctggcggcagcgcaaaagatg

SEQ ID NO: 12259 - DNA, 103 bp, Artificial Sequence
  Synthetic Polynucleotide
taatacgactcactatagggtagactcagtttcgaggggaaatacagagaaacagaggagatctctgatgttcccctcgaacctggcggcagcgcaaaagatg

SEQ ID NO: 12260 - DNA, 103 bp, Artificial Sequence
  Synthetic Polynucleotide
taatacgactcactatagggctcactagactcagtttcgaggggaaatacaacagaggagagtatttatgctcgaaactaacctggcggcagcgcaaaagatg

SEQ ID NO: 12261 - DNA, 103 bp, Artificial Sequence
  Synthetic Polynucleotide
taatacgactcactatagggtcttgctcactagactcagtttcgaggggaaacagaggagatcccctatgaactgagtcaacctggcggcagcgcaaaagatg

SEQ ID NO: 12262 - DNA, 103 bp, Artificial Sequence
  Synthetic Polynucleotide
taatacgactcactatagggttaattcttgctcactagactcagtttcgaaacagaggagatcgaaaatgagtctagtgaacctggcggcagcgcaaaagatg

SEQ ID NO: 12263 - DNA, 103 bp, Artificial Sequence
  Synthetic Polynucleotide
taatacgactcactatagggagaacttaattcttgctcactagactcagtaacagaggagaactgagatgagtgagcaaaacctggcggcagcgcaaaagatg

SEQ ID NO: 12264 - DNA, 103 bp, Artificial Sequence
  Synthetic Polynucleotide
taatacgactcactatagggtcttcagaacttaattcttgctcactagacaacagaggagagtctagatggcaagaattaacctggcggcagcgcaaaagatg

SEQ ID NO: 12265 - DNA, 103 bp, Artificial Sequence
  Synthetic Polynucleotide
taatacgactcactatagggcattatcttcagaacttaattcttgctcacaacagaggagagtgagcatgaattaagttaacctggcggcagcgcaaaagatg

SEQ ID NO: 12266 - DNA, 103 bp, Artificial Sequence
  Synthetic Polynucleotide
taatacgactcactatagggagctgaggaaacagtccgtgctcgagattgaacagaggagacaatctatggcacggactaacctggcggcagcgcaaaagatg

SEQ ID NO: 12267 - DNA, 103 bp, Artificial Sequence
  Synthetic Polynucleotide
taatacgactcactatagggagcggcattatcttcagaacttaattcttgaacagaggagacaagaaatgagttctgaaaacctggcggcagcgcaaaagatg

SEQ ID NO: 12268 - DNA, 103 bp, Artificial Sequence
  Synthetic Polynucleotide
taatacgactcactatagggactctagcggcattatcttcagaacttaataacagaggagaattaagatgtgaagataaaacctggcggcagcgcaaaagatg

SEQ ID NO: 12269 - DNA, 103 bp, Artificial Sequence
  Synthetic Polynucleotide
taatacgactcactatagggcagctactctagcggcattatcttcagaacaacagaggagagttctgatgataatgccgaacctggcggcagcgcaaaagatg

SEQ ID NO: 12270 - DNA, 103 bp, Artificial Sequence
  Synthetic Polynucleotide
taatacgactcactataggggctagcagctactctagcggcattatcttcaacagaggagagaagatatggccgctagaaacctggcggcagcgcaaaagatg

SEQ ID NO: 12271 - DNA, 103 bp, Artificial Sequence
  Synthetic Polynucleotide
taatacgactcactataggggctaagctagcagctactctagcggcattaaacagaggagataatgcatgtagagtagcaacctggcggcagcgcaaaagatg

SEQ ID NO: 12272 - DNA, 103 bp, Artificial Sequence
  Synthetic Polynucleotide
taatacgactcactatagggcttttgctaagctagcagctactctagcggaacagaggagaccgctaatgtagctgctaaacctggcggcagcgcaaaagatg

SEQ ID NO: 12273 - DNA, 103 bp, Artificial Sequence
  Synthetic Polynucleotide
taatacgactcactatagggtgtgacttttgctaagctagcagctactctaacagaggagaagagtaatggctagcttaaacctggcggcagcgcaaaagatg

SEQ ID NO: 12274 - DNA, 103 bp, Artificial Sequence
  Synthetic Polynucleotide
taatacgactcactataggggcacttgtgacttttgctaagctagcagctaacagaggagaagctgcatgcttagcaaaaacctggcggcagcgcaaaagatg

SEQ ID NO: 12275 - DNA, 103 bp, Artificial Sequence
  Synthetic Polynucleotide
taatacgactcactatagggcgcaggcacttgtgacttttgctaagctagaacagaggagactagctatgcaaaagtcaaacctggcggcagcgcaaaagatg

SEQ ID NO: 12276 - DNA, 103 bp, Artificial Sequence
  Synthetic Polynucleotide
taatacgactcactataggggatgccgcaggcacttgtgacttttgctaaaacagaggagattagcaatggtcacaagtaacctggcggcagcgcaaaagatg

SEQ ID NO: 12277 - DNA, 103 bp, Artificial Sequence
  Synthetic Polynucleotide
taatacgactcactatagggcagaaagctgaggaaacagtccgtgctcgaaacagaggagatcgagcatggactgtttcaacctggcggcagcgcaaaagatg

SEQ ID NO: 12278 - DNA, 103 bp, Artificial Sequence
  Synthetic Polynucleotide
taatacgactcactatagggaaaaagatgccgcaggcacttgtgacttttaacagaggagaaaaagtatgaagtgcctgaacctggcggcagcgcaaaagatg

SEQ ID NO: 12279 - DNA, 103 bp, Artificial Sequence
  Synthetic Polynucleotide
taatacgactcactataggggttttaaaaagatgccgcaggcacttgtgaaacagaggagatcacaaatgcctgcggcaaacctggcggcagcgcaaaagatg

SEQ ID NO: 12280 - DNA, 103 bp, Artificial Sequence
  Synthetic Polynucleotide
taatacgactcactatagggatcaggttttaaaaagatgccgcaggcactaacagaggagaagtgccatgggcatctttaacctggcggcagcgcaaaagatg

SEQ ID NO: 12281 - DNA, 103 bp, Artificial Sequence
  Synthetic Polynucleotide
taatacgactcactataggggtttcatcaggttttaaaaagatgccgcagaacagaggagactgcggatgctttttaaaaacctggcggcagcgcaaaagatg

SEQ ID NO: 12282 - DNA, 103 bp, Artificial Sequence
  Synthetic Polynucleotide
taatacgactcactatagggcaaaagtttcatcaggttttaaaaagatgcaacagaggagagcatctatgtaaaacctgaacctggcggcagcgcaaaagatg

SEQ ID NO: 12283 - DNA, 103 bp, Artificial Sequence
  Synthetic Polynucleotide
taatacgactcactataggggtgaacaaaagtttcatcaggttttaaaaaaacagaggagatttttaatgcctgatgaaaacctggcggcagcgcaaaagatg

SEQ ID NO: 12284 - DNA, 103 bp, Artificial Sequence
  Synthetic Polynucleotide
taatacgactcactatagggcctgagtgaacaaaagtttcatcaggttttaacagaggagaaaaaccatgtgaaactttaacctggcggcagcgcaaaagatg

SEQ ID NO: 12285 - DNA, 103 bp, Artificial Sequence
  Synthetic Polynucleotide
taatacgactcactatagggtgaaacctgagtgaacaaaagtttcatcagaacagaggagactgatgatgcttttgttcaacctggcggcagcgcaaaagatg

SEQ ID NO: 12286 - DNA, 103 bp, Artificial Sequence
  Synthetic Polynucleotide
taatacgactcactatagggataaatgaaacctgagtgaacaaaagtttcaacagaggagagaaactatggttcactcaaacctggcggcagcgcaaaagatg

SEQ ID NO: 12287 - DNA, 103 bp, Artificial Sequence
  Synthetic Polynucleotide
taatacgactcactatagggccaaaataaatgaaacctgagtgaacaaaaaacagaggagattttgtatgctcaggtttaacctggcggcagcgcaaaagatg

SEQ ID NO: 12288 - DNA, 103 bp, Artificial Sequence
  Synthetic Polynucleotide
taatacgactcactatagggaattgcagaaagctgaggaaacagtccgtgaacagaggagacacggaatgtttcctcagaacctggcggcagcgcaaaagatg

SEQ ID NO: 12289 - DNA, 103 bp, Artificial Sequence
  Synthetic Polynucleotide
taatacgactcactatagggttttgccaaaataaatgaaacctgagtgaaaacagaggagattcactatggtttcatttaacctggcggcagcgcaaaagatg

SEQ ID NO: 12290 - DNA, 103 bp, Artificial Sequence
  Synthetic Polynucleotide
taatacgactcactatagggttgttttttgccaaaataaatgaaacctgaaacagaggagatcaggtatgatttattttaacctggcggcagcgcaaaagatg

SEQ ID NO: 12291 - DNA, 103 bp, Artificial Sequence
  Synthetic Polynucleotide
taatacgactcactatagggaaatattgttttttgccaaaataaatgaaaaacagaggagatttcatatgttttggcaaaacctggcggcagcgcaaaagatg

SEQ ID NO: 12292 - DNA, 103 bp, Artificial Sequence
  Synthetic Polynucleotide
taatacgactcactatagggcattcaaatattgttttttgccaaaataaaaacagaggagatttattatggcaaaaaacaacctggcggcagcgcaaaagatg

SEQ ID NO: 12293 - DNA, 103 bp, Artificial Sequence
  Synthetic Polynucleotide
taatacgactcactatagggtactccattcaaatattgttttttgccaaaaacagaggagatttggcatgaaacaatataacctggcggcagcgcaaaagatg

SEQ ID NO: 12294 - DNA, 103 bp, Artificial Sequence
  Synthetic Polynucleotide
taatacgactcactatagggaattgtactccattcaaatattgttttttgaacagaggagacaaaaaatgatatttgaaaacctggcggcagcgcaaaagatg

SEQ ID NO: 12295 - DNA, 103 bp, Artificial Sequence
  Synthetic Polynucleotide
taatacgactcactataggggaggtaattgtactccattcaaatattgttaacagaggagaaacaatatgtgaatggagaacctggcggcagcgcaaaagatg

SEQ ID NO: 12296 - DNA, 103 bp, Artificial Sequence
  Synthetic Polynucleotide
taatacgactcactatagggtgattgaggtaattgtactccattcaaataaacagaggagatatttgatgggagtacaaaacctggcggcagcgcaaaagatg

SEQ ID NO: 12297 - DNA, 103 bp, Artificial Sequence
  Synthetic Polynucleotide
taatacgactcactatagggttcagtgattgaggtaattgtactccattcaacagaggagagaatggatgacaattaccaacctggcggcagcgcaaaagatg

SEQ ID NO: 12298 - DNA, 103 bp, Artificial Sequence
  Synthetic Polynucleotide
taatacgactcactatagggcagttttcagtgattgaggtaattgtactcaacagaggagagagtacatgtacctcaataacctggcggcagcgcaaaagatg

SEQ ID NO: 12299 - DNA, 103 bp, Artificial Sequence
  Synthetic Polynucleotide
taatacgactcactataggggaatggggtacttctgaacaccaattattaaacagaggagataataaatggtgttcagaaacctggcggcagcgcaaaagatg

SEQ ID NO: 12300 - DNA, 103 bp, Artificial Sequence
  Synthetic Polynucleotide
taatacgactcactatagggagggcaattgcagaaagctgaggaaacagtaacagaggagaactgttatgtcagctttcaacctggcggcagcgcaaaagatg

SEQ ID NO: 12301 - DNA, 103 bp, Artificial Sequence
  Synthetic Polynucleotide
taatacgactcactatagggagtagcagttttcagtgattgaggtaattgaacagaggagacaattaatgcaatcactgaacctggcggcagcgcaaaagatg

SEQ ID NO: 12302 - DNA, 103 bp, Artificial Sequence
  Synthetic Polynucleotide
taatacgactcactatagggattctagtagcagttttcagtgattgaggtaacagaggagaacctcaatgactgaaaacaacctggcggcagcgcaaaagatg

SEQ ID NO: 12303 - DNA, 103 bp, Artificial Sequence
  Synthetic Polynucleotide
taatacgactcactataggggtgcaattctagtagcagttttcagtgattaacagaggagaaatcacatgaaactgctaaacctggcggcagcgcaaaagatg

SEQ ID NO: 12304 - DNA, 103 bp, Artificial Sequence
  Synthetic Polynucleotide
taatacgactcactatagggcaagggtgcaattctagtagcagttttcagaacagaggagactgaaaatggctactagaaacctggcggcagcgcaaaagatg

SEQ ID NO: 12305 - DNA, 103 bp, Artificial Sequence
  Synthetic Polynucleotide
taatacgactcactatagggtctgacaagggtgcaattctagtagcagttaacagaggagaaactgcatgtagaattgcaacctggcggcagcgcaaaagatg

SEQ ID NO: 12306 - DNA, 103 bp, Artificial Sequence
  Synthetic Polynucleotide
taatacgactcactatagggtagcatctgacaagggtgcaattctagtagaacagaggagactactaatgttgcaccctaacctggcggcagcgcaaaagatg

SEQ ID NO: 12307 - DNA, 103 bp, Artificial Sequence
  Synthetic Polynucleotide
taatacgactcactatagggaaagatagcatctgacaagggtgcaattctaacagaggagaagaattatgcccttgtcaaacctggcggcagcgcaaaagatg

SEQ ID NO: 12308 - DNA, 103 bp, Artificial Sequence
  Synthetic Polynucleotide
taatacgactcactatagggtcatcaaagatagcatctgacaagggtgcaaacagaggagatgcaccatggtcagatgcaacctggcggcagcgcaaaagatg

SEQ ID NO: 12309 - DNA, 103 bp, Artificial Sequence
  Synthetic Polynucleotide
taatacgactcactataggggaagatcatcaaagatagcatctgacaaggaacagaggagaccttgtatgatgctatctaacctggcggcagcgcaaaagatg

SEQ ID NO: 12310 - DNA, 103 bp, Artificial Sequence
  Synthetic Polynucleotide
taatacgactcactatagggcccttgaagatcatcaaagatagcatctgaaacagaggagatcagatatgatctttgataacctggcggcagcgcaaaagatg

SEQ ID NO: 12311 - DNA, 103 bp, Artificial Sequence
  Synthetic Polynucleotide
taatacgactcactatagggcacctagggcaattgcagaaagctgaggaaaacagaggagattcctcatgtttctgcaaaacctggcggcagcgcaaaagatg

SEQ ID NO: 12312 - DNA, 103 bp, Artificial Sequence
  Synthetic Polynucleotide
taatacgactcactatagggagtgtcccttgaagatcatcaaagatagcaaacagaggagatgctatatgtgatgatctaacctggcggcagcgcaaaagatg

SEQ ID NO: 12313 - DNA, 103 bp, Artificial Sequence
  Synthetic Polynucleotide
taatacgactcactatagggtagctagtgtcccttgaagatcatcaaagaaacagaggagatctttgatgatcttcaagaacctggcggcagcgcaaaagatg

SEQ ID NO: 12314 - DNA, 103 bp, Artificial Sequence
  Synthetic Polynucleotide
taatacgactcactatagggtatgctagctagtgtcccttgaagatcatcaacagaggagagatgatatgcaagggacaaacctggcggcagcgcaaaagatg

SEQ ID NO: 12315 - DNA, 103 bp, Artificial Sequence
  Synthetic Polynucleotide
taatacgactcactataggggtgcctatgctagctagtgtcccttgaagaaacagaggagatcttcaatggacactagcaacctggcggcagcgcaaaagatg

SEQ ID NO: 12316 - DNA, 103 bp, Artificial Sequence
  Synthetic Polynucleotide
taatacgactcactatagggaagccgtgcctatgctagctagtgtcccttaacagaggagaaagggaatgtagctagcaaacctggcggcagcgcaaaagatg

SEQ ID NO: 12317 - DNA, 103 bp, Artificial Sequence
  Synthetic Polynucleotide
taatacgactcactatagggttcaaaagccgtgcctatgctagctagtgtaacagaggagaacactaatgagcataggcaacctggcggcagcgcaaaagatg

SEQ ID NO: 12318 - DNA, 103 bp, Artificial Sequence
  Synthetic Polynucleotide
taatacgactcactataggggatctttcaaaagccgtgcctatgctagctaacagaggagaagctagatgaggcacggcaacctggcggcagcgcaaaagatg

SEQ ID NO: 12319 - DNA, 103 bp, Artificial Sequence
  Synthetic Polynucleotide
taatacgactcactatagggagatagatctttcaaaagccgtgcctatgcaacagaggagagcatagatgcggcttttgaacctggcggcagcgcaaaagatg

SEQ ID NO: 12320 - DNA, 103 bp, Artificial Sequence
  Synthetic Polynucleotide
taatacgactcactatagggttcggagatagatctttcaaaagccgtgccaacagaggagaggcacgatgtttgaaagaaacctggcggcagcgcaaaagatg

SEQ ID NO: 12321 - DNA, 103 bp, Artificial Sequence
  Synthetic Polynucleotide
taatacgactcactatagggctagtttcggagatagatctttcaaaagccaacagaggagaggctttatgaagatctataacctggcggcagcgcaaaagatg

SEQ ID NO: 12322 - DNA, 103 bp, Artificial Sequence
  Synthetic Polynucleotide
taatacgactcactatagggtgcgacacctagggcaattgcagaaagctgaacagaggagacagcttatggcaattgccaacctggcggcagcgcaaaagatg

SEQ ID NO: 12323 - DNA, 103 bp, Artificial Sequence
  Synthetic Polynucleotide
taatacgactcactatagggcgtgcctagtttcggagatagatctttcaaaacagaggagattgaaaatgctatctccgaacctggcggcagcgcaaaagatg

SEQ ID NO: 12324 - DNA, 103 bp, Artificial Sequence
  Synthetic Polynucleotide
taatacgactcactataggggactacgtgcctagtttcggagatagatctaacagaggagaagatctatgtccgaaactaacctggcggcagcgcaaaagatg

SEQ ID NO: 12325 - DNA, 103 bp, Artificial Sequence
  Synthetic Polynucleotide
taatacgactcactatagggcaagggactacgtgcctagtttcggagataaacagaggagatatctcatgaactaggcaaacctggcggcagcgcaaaagatg

SEQ ID NO: 12326 - DNA, 103 bp, Artificial Sequence
  Synthetic Polynucleotide
taatacgactcactatagggctctacaagggactacgtgcctagtttcggaacagaggagaccgaaaatgggcacgtagaacctggcggcagcgcaaaagatg

SEQ ID NO: 12327 - DNA, 103 bp, Artificial Sequence
  Synthetic Polynucleotide
taatacgactcactatagggtgctactctacaagggactacgtgcctagtaacagaggagaactaggatggtagtccctaacctggcggcagcgcaaaagatg

SEQ ID NO: 12328 - DNA, 103 bp, Artificial Sequence
  Synthetic Polynucleotide
taatacgactcactataggggcagctgctactctacaagggactacgtgcaacagaggagagcacgtatgcccttgtagaacctggcggcagcgcaaaagatg

SEQ ID NO: 12329 - DNA, 103 bp, Artificial Sequence
  Synthetic Polynucleotide
taatacgactcactatagggggaatgcagctgctactctacaagggactaaacagaggagatagtccatggtagagtagaacctggcggcagcgcaaaagatg

SEQ ID NO: 12330 - DNA, 103 bp, Artificial Sequence
  Synthetic Polynucleotide
taatacgactcactatagggggtatggaatgcagctgctactctacaaggaacagaggagaccttgtatggtagcagctaacctggcggcagcgcaaaagatg

SEQ ID NO: 12331 - DNA, 103 bp, Artificial Sequence
  Synthetic Polynucleotide
taatacgactcactatagggaaaaaggtatggaatgcagctgctactctaaacagaggagatagagtatgagctgcattaacctggcggcagcgcaaaagatg

SEQ ID NO: 12332 - DNA, 103 bp, Artificial Sequence
  Synthetic Polynucleotide
taatacgactcactatagggcggaaaaaaaggtatggaatgcagctgctaaacagaggagatagcagatgcattccataaacctggcggcagcgcaaaagatg

SEQ ID NO: 12333 - DNA, 103 bp, Artificial Sequence
  Synthetic Polynucleotide
taatacgactcactataggggccgttgcgacacctagggcaattgcagaaaacagaggagattctgcatgtgccctaggaacctggcggcagcgcaaaagatg

SEQ ID NO: 12334 - DNA, 103 bp, Artificial Sequence
  Synthetic Polynucleotide
taatacgactcactatagggtcttacggaaaaaaaggtatggaatgcagcaacagaggagagctgcaatgcatacctttaacctggcggcagcgcaaaagatg

SEQ ID NO: 12335 - DNA, 103 bp, Artificial Sequence
  Synthetic Polynucleotide
taatacgactcactatagggaagattcttacggaaaaaaaggtatggaataacagaggagaattccaatgctttttttcaacctggcggcagcgcaaaagatg

SEQ ID NO: 12336 - DNA, 103 bp, Artificial Sequence
  Synthetic Polynucleotide
taatacgactcactatagggattgtaagattcttacggaaaaaaaggtataacagaggagaatacctatgtttccgtaaaacctggcggcagcgcaaaagatg

SEQ ID NO: 12337 - DNA, 103 bp, Artificial Sequence
  Synthetic Polynucleotide
taatacgactcactatagggatgatattgtaagattcttacggaaaaaaaaacagaggagattttttatggtaagaatcaacctggcggcagcgcaaaagatg

SEQ ID NO: 12338 - DNA, 103 bp, Artificial Sequence
  Synthetic Polynucleotide
taatacgactcactatagggagatgatgatattgtaagattcttacggaaaacagaggagattccgtatgaatcttacaaacctggcggcagcgcaaaagatg

SEQ ID NO: 12339 - DNA, 103 bp, Artificial Sequence
  Synthetic Polynucleotide
taatacgactcactatagggagccaagatgatgatattgtaagattcttaaacagaggagataagaaatgtacaatatcaacctggcggcagcgcaaaagatg

SEQ ID NO: 12340 - DNA, 103 bp, Artificial Sequence
  Synthetic Polynucleotide
taatacgactcactataggggttgaagccaagatgatgatattgtaagataacagaggagaatcttaatgtatcatcataacctggcggcagcgcaaaagatg

SEQ ID NO: 12341 - DNA, 103 bp, Artificial Sequence
  Synthetic Polynucleotide
taatacgactcactatagggcccttgttgaagccaagatgatgatattgtaacagaggagaacaataatgtcatcttggaacctggcggcagcgcaaaagatg

SEQ ID NO: 12342 - DNA, 103 bp, Artificial Sequence
  Synthetic Polynucleotide
taatacgactcactatagggctgttcccttgttgaagccaagatgatgataacagaggagaatcatcatgttggcttcaaacctggcggcagcgcaaaagatg

SEQ ID NO: 12343 - DNA, 103 bp, Artificial Sequence
  Synthetic Polynucleotide
taatacgactcactatagggcaggtctgttcccttgttgaagccaagatgaacagaggagacatcttatgttcaacaagaacctggcggcagcgcaaaagatg

SEQ ID NO: 12344 - DNA, 103 bp, Artificial Sequence
  Synthetic Polynucleotide
taatacgactcactatagggcgtgtgccgttgcgacacctagggcaattgaacagaggagacaattgatgtaggtgtcgaacctggcggcagcgcaaaagatg

SEQ ID NO: 12345 - DNA, 103 bp, Artificial Sequence
  Synthetic Polynucleotide
taatacgactcactatagggtgacccaggtctgttcccttgttgaagccaaacagaggagatggcttatgcaagggaacaacctggcggcagcgcaaaagatg

SEQ ID NO: 12346 - DNA, 103 bp, Artificial Sequence
  Synthetic Polynucleotide
taatacgactcactatagggacaattgacccaggtctgttcccttgttgaaacagaggagatcaacaatggaacagaccaacctggcggcagcgcaaaagatg

SEQ ID NO: 12347 - DNA, 103 bp, Artificial Sequence
  Synthetic Polynucleotide
taatacgactcactatagggtaatgacaattgacccaggtctgttcccttaacagaggagaaagggaatggacctgggtaacctggcggcagcgcaaaagatg

SEQ ID NO: 12348 - DNA, 103 bp, Artificial Sequence
  Synthetic Polynucleotide
taatacgactcactatagggttgcttaatgacaattgacccaggtctgttaacagaggagaaacagaatggggtcaattaacctggcggcagcgcaaaagatg

SEQ ID NO: 12349 - DNA, 103 bp, Artificial Sequence
  Synthetic Polynucleotide
taatacgactcactatagggatggcttgcttaatgacaattgacccaggtaacagaggagaacctggatgaattgtcataacctggcggcagcgcaaaagatg

SEQ ID NO: 12350 - DNA, 103 bp, Artificial Sequence
  Synthetic Polynucleotide
taatacgactcactatagggatctaatggcttgcttaatgacaattgaccaacagaggagaggtcaaatgtcattaagcaacctggcggcagcgcaaaagatg

SEQ ID NO: 12351 - DNA, 103 bp, Artificial Sequence
  Synthetic Polynucleotide
taatacgactcactatagggccaaaatctaatggcttgcttaatgacaataacagaggagaattgtcatgaagcaagccaacctggcggcagcgcaaaagatg

SEQ ID NO: 12352 - DNA, 103 bp, Artificial Sequence
  Synthetic Polynucleotide
taatacgactcactatagggtagttccaaaatctaatggcttgcttaatgaacagaggagacattaaatgagccattagaacctggcggcagcgcaaaagatg

SEQ ID NO: 12353 - DNA, 103 bp, Artificial Sequence
  Synthetic Polynucleotide
taatacgactcactatagggagttatagttccaaaatctaatggcttgctaacagaggagaagcaagatgttagattttaacctggcggcagcgcaaaagatg

SEQ ID NO: 12354 - DNA, 103 bp, Artificial Sequence
  Synthetic Polynucleotide
taatacgactcactataggggccaaagttatagttccaaaatctaatggcaacagaggagagccattatgttttggaacaacctggcggcagcgcaaaagatg

SEQ ID NO: 12355 - DNA, 103 bp, Artificial Sequence
  Synthetic Polynucleotide
taatacgactcactatagggactgccgtgtgccgttgcgacacctagggcaacagaggagagccctaatggtcgcaacgaacctggcggcagcgcaaaagatg

SEQ ID NO: 12356 - DNA, 103 bp, Artificial Sequence
  Synthetic Polynucleotide
taatacgactcactatagggccaaggccaaagttatagttccaaaatctaaacagaggagatagattatggaactataaaacctggcggcagcgcaaaagatg

SEQ ID NO: 12357 - DNA, 103 bp, Artificial Sequence
  Synthetic Polynucleotide
taatacgactcactatagggtactgccaaggccaaagttatagttccaaaaacagaggagatttggaatgataactttgaacctggcggcagcgcaaaagatg

SEQ ID NO: 12358 - DNA, 103 bp, Artificial Sequence
  Synthetic Polynucleotide
taatacgactcactatagggtgtggtactgccaaggccaaagttatagttaacagaggagaaactatatgtttggccttaacctggcggcagcgcaaaagatg

SEQ ID NO: 12359 - DNA, 103 bp, Artificial Sequence
  Synthetic Polynucleotide
taatacgactcactatagggagacttgtggtactgccaaggccaaagttaaacagaggagataacttatgccttggcagaacctggcggcagcgcaaaagatg

SEQ ID NO: 12360 - DNA, 103 bp, Artificial Sequence
  Synthetic Polynucleotide
taatacgactcactatagggacccaagacttgtggtactgccaaggccaaaacagaggagattggccatggcagtaccaaacctggcggcagcgcaaaagatg

SEQ ID NO: 12361 - DNA, 103 bp, Artificial Sequence
  Synthetic Polynucleotide
taatacgactcactatagggaagccacccaagacttgtggtactgccaagaacagaggagacttggcatgaccacaagtaacctggcggcagcgcaaaagatg

SEQ ID NO: 12362 - DNA, 103 bp, Artificial Sequence
  Synthetic Polynucleotide
taatacgactcactatagggatgataagccacccaagacttgtggtactgaacagaggagacagtacatgaagtcttggaacctggcggcagcgcaaaagatg

SEQ ID NO: 12363 - DNA, 103 bp, Artificial Sequence
  Synthetic Polynucleotide
taatacgactcactatagggtaggaatgataagccacccaagacttgtggaacagaggagaccacaaatgttgggtggcaacctggcggcagcgcaaaagatg

SEQ ID NO: 12364 - DNA, 103 bp, Artificial Sequence
  Synthetic Polynucleotide
taatacgactcactatagggggatttaggaatgataagccacccaagactaacagaggagaagtcttatgtggcttatcaacctggcggcagcgcaaaagatg

SEQ ID NO: 12365 - DNA, 103 bp, Artificial Sequence
  Synthetic Polynucleotide
taatacgactcactatagggtttctggatttaggaatgataagccacccaaacagaggagatgggtgatgtatcattccaacctggcggcagcgcaaaagatg

SEQ ID NO: 12366 - DNA, 103 bp, Artificial Sequence
  Synthetic Polynucleotide
taatacgactcactatagggagggtactgccgtgtgccgttgcgacacctaacagaggagaaggtgtatgaacggcacaaacctggcggcagcgcaaaagatg

SEQ ID NO: 12367 - DNA, 103 bp, Artificial Sequence
  Synthetic Polynucleotide
taatacgactcactatagggacatttttctggatttaggaatgataagccaacagaggagaggcttaatgttcctaaataacctggcggcagcgcaaaagatg

SEQ ID NO: 12368 - DNA, 103 bp, Artificial Sequence
  Synthetic Polynucleotide
taatacgactcactatagggtaaaaacatttttctggatttaggaatgataacagaggagaatcattatgaaatccagaaacctggcggcagcgcaaaagatg

SEQ ID NO: 12369 - DNA, 103 bp, Artificial Sequence
  Synthetic Polynucleotide
taatacgactcactatagggttctataaaaacatttttctggatttaggaaacagaggagatcctaaatgcagaaaaataacctggcggcagcgcaaaagatg

SEQ ID NO: 12370 - DNA, 103 bp, Artificial Sequence
  Synthetic Polynucleotide
taatacgactcactatagggcagatttctataaaaacatttttctggattaacagaggagaaatccaatgaaatgttttaacctggcggcagcgcaaaagatg

SEQ ID NO: 12371 - DNA, 103 bp, Artificial Sequence
  Synthetic Polynucleotide
taatacgactcactatagggtcacccagatttctataaaaacatttttctaacagaggagaagaaaaatgtttttatagaacctggcggcagcgcaaaagatg

SEQ ID NO: 12372 - DNA, 103 bp, Artificial Sequence
  Synthetic Polynucleotide
taatacgactcactatagggcaggatcacccagatttctataaaaacattaacagaggagaaatgttatgatagaaatcaacctggcggcagcgcaaaagatg

SEQ ID NO: 12373 - DNA, 103 bp, Artificial Sequence
  Synthetic Polynucleotide
taatacgactcactatagggagtaacaggatcacccagatttctataaaaaacagaggagattttatatgaatctgggtaacctggcggcagcgcaaaagatg

SEQ ID NO: 12374 - DNA, 103 bp, Artificial Sequence
  Synthetic Polynucleotide
taatacgactcactatagggcctgaagtaacaggatcacccagatttctaaacagaggagatagaaaatggggtgatccaacctggcggcagcgcaaaagatg

SEQ ID NO: 12375 - DNA, 103 bp, Artificial Sequence
  Synthetic Polynucleotide
taatacgactcactatagggacagccctgaagtaacaggatcacccagataacagaggagaatctggatgatcctgttaaacctggcggcagcgcaaaagatg

SEQ ID NO: 12376 - DNA, 103 bp, Artificial Sequence
  Synthetic Polynucleotide
taatacgactcactatagggctgaaacagccctgaagtaacaggatcaccaacagaggagaggtgatatggttacttcaaacctggcggcagcgcaaaagatg

SEQ ID NO: 12377 - DNA, 103 bp, Artificial Sequence
  Synthetic Polynucleotide
taatacgactcactatagggctgccagggtactgccgtgtgccgttgcgaaacagaggagatcgcaaatgcacacggcaaacctggcggcagcgcaaaagatg

SEQ ID NO: 12378 - DNA, 103 bp, Artificial Sequence
  Synthetic Polynucleotide
taatacgactcactatagggttgagctgaaacagccctgaagtaacaggaaacagaggagatcctgtatgttcagggctaacctggcggcagcgcaaaagatg

SEQ ID NO: 12379 - DNA, 103 bp, Artificial Sequence
  Synthetic Polynucleotide
taatacgactcactatagggatgtcttgagctgaaacagccctgaagtaaaacagaggagattacttatgggctgtttcaacctggcggcagcgcaaaagatg

SEQ ID NO: 12380 - DNA, 103 bp, Artificial Sequence
  Synthetic Polynucleotide
taatacgactcactatagggaagatatgtcttgagctgaaacagccctgaaacagaggagatcagggatgtttcagctcaacctggcggcagcgcaaaagatg

SEQ ID NO: 12381 - DNA, 103 bp, Artificial Sequence
  Synthetic Polynucleotide
taatacgactcactatagggatttgaagatatgtcttgagctgaaacagcaacagaggagagctgttatggctcaagacaacctggcggcagcgcaaaagatg

SEQ ID NO: 12382 - DNA, 103 bp, Artificial Sequence
  Synthetic Polynucleotide
taatacgactcactatagggggatcatttgaagatatgtcttgagctgaaaacagaggagattcagcatgagacatatcaacctggcggcagcgcaaaagatg

SEQ ID NO: 12383 - DNA, 103 bp, Artificial Sequence
  Synthetic Polynucleotide
taatacgactcactatagggcatgtggatcatttgaagatatgtcttgagaacagaggagactcaagatgtatcttcaaaacctggcggcagcgcaaaagatg

SEQ ID NO: 12384 - DNA, 103 bp, Artificial Sequence
  Synthetic Polynucleotide
taatacgactcactatagggtcatccatgtggatcatttgaagatatgtcaacagaggagagacataatgtcaaatgataacctggcggcagcgcaaaagatg

SEQ ID NO: 12385 - DNA, 103 bp, Artificial Sequence
  Synthetic Polynucleotide
taatacgactcactatagggacaaatcatccatgtggatcatttgaagataacagaggagaatcttcatgtgatccacaaacctggcggcagcgcaaaagatg

SEQ ID NO: 12386 - DNA, 103 bp, Artificial Sequence
  Synthetic Polynucleotide
taatacgactcactatagggtaaaaacaaatcatccatgtggatcatttgaacagaggagacaaatgatgcacatggataacctggcggcagcgcaaaagatg

SEQ ID NO: 12387 - DNA, 103 bp, Artificial Sequence
  Synthetic Polynucleotide
taatacgactcactatagggaaaggtaaaaacaaatcatccatgtggatcaacagaggagagatccaatgggatgatttaacctggcggcagcgcaaaagatg

SEQ ID NO: 12388 - DNA, 103 bp, Artificial Sequence
  Synthetic Polynucleotide
taatacgactcactatagggtactcctgccagggtactgccgtgtgccgtaacagaggagaacggcaatgggcagtaccaacctggcggcagcgcaaaagatg

SEQ ID NO: 12389 - DNA, 103 bp, Artificial Sequence
  Synthetic Polynucleotide
taatacgactcactatagggcgatcaaaggtaaaaacaaatcatccatgtaacagaggagaacatggatgatttgttttaacctggcggcagcgcaaaagatg

SEQ ID NO: 12390 - DNA, 103 bp, Artificial Sequence
  Synthetic Polynucleotide
taatacgactcactatagggctttgcgatcaaaggtaaaaacaaatcatcaacagaggagagatgatatgtttttacctaacctggcggcagcgcaaaagatg

SEQ ID NO: 12391 - DNA, 103 bp, Artificial Sequence
  Synthetic Polynucleotide
taatacgactcactataggggggttctttgcgatcaaaggtaaaaacaaaaacagaggagatttgttatgacctttgataacctggcggcagcgcaaaagatg

SEQ ID NO: 12392 - DNA, 103 bp, Artificial Sequence
  Synthetic Polynucleotide
taatacgactcactatagggtccctgggttctttgcgatcaaaggtaaaaaacagaggagattttacatgtgatcgcaaaacctggcggcagcgcaaaagatg

SEQ ID NO: 12393 - DNA, 103 bp, Artificial Sequence
  Synthetic Polynucleotide
taatacgactcactatagggacagttccctgggttctttgcgatcaaaggaacagaggagacctttgatggcaaagaacaacctggcggcagcgcaaaagatg

SEQ ID NO: 12394 - DNA, 103 bp, Artificial Sequence
  Synthetic Polynucleotide
taatacgactcactataggggcgctacagttccctgggttctttgcgatcaacagaggagagatcgcatggaacccaggaacctggcggcagcgcaaaagatg

SEQ ID NO: 12395 - DNA, 103 bp, Artificial Sequence
  Synthetic Polynucleotide
taatacgactcactatagggcaattgcgctacagttccctgggttctttgaacagaggagacaaagaatgcagggaactaacctggcggcagcgcaaaagatg

SEQ ID NO: 12396 - DNA, 103 bp, Artificial Sequence
  Synthetic Polynucleotide
taatacgactcactatagggaaagtcaattgcgctacagttccctgggttaacagaggagaaacccaatgaactgtagcaacctggcggcagcgcaaaagatg

SEQ ID NO: 12397 - DNA, 103 bp, Artificial Sequence
  Synthetic Polynucleotide
taatacgactcactatagggaacacaaagtcaattgcgctacagttccctaacagaggagaagggaaatgtagcgcaataacctggcggcagcgcaaaagatg

SEQ ID NO: 12398 - DNA, 103 bp, Artificial Sequence
  Synthetic Polynucleotide
taatacgactcactatagggggtttaacacaaagtcaattgcgctacagtaacagaggagaactgtaatgcaattgactaacctggcggcagcgcaaaagatg

SEQ ID NO: 12399 - DNA, 103 bp, Artificial Sequence
  Synthetic Polynucleotide
taatacgactcactatagggacatttactcctgccagggtactgccgtgtaacagaggagaacacggatgtaccctggcaacctggcggcagcgcaaaagatg

SEQ ID NO: 12400 - DNA, 103 bp, Artificial Sequence
  Synthetic Polynucleotide
taatacgactcactatagggactagggtttaacacaaagtcaattgcgctaacagaggagaagcgcaatggactttgtgaacctggcggcagcgcaaaagatg

SEQ ID NO: 12401 - DNA, 103 bp, Artificial Sequence
  Synthetic Polynucleotide
taatacgactcactatagggaacccactagggtttaacacaaagtcaattaacagaggagaaattgaatgtgtgttaaaaacctggcggcagcgcaaaagatg

SEQ ID NO: 12402 - DNA, 103 bp, Artificial Sequence
  Synthetic Polynucleotide
taatacgactcactatagggcgtttaacccactagggtttaacacaaagtaacagaggagaactttgatgtaaaccctaaacctggcggcagcgcaaaagatg

SEQ ID NO: 12403 - DNA, 103 bp, Artificial Sequence
  Synthetic Polynucleotide
taatacgactcactatagggcggtacgtttaacccactagggtttaacacaacagaggagagtgttaatgcctagtgggaacctggcggcagcgcaaaagatg

SEQ ID NO: 12404 - DNA, 103 bp, Artificial Sequence
  Synthetic Polynucleotide
taatacgactcactataggggaccccggtacgtttaacccactagggtttaacagaggagaaaacccatgtgggttaaaaacctggcggcagcgcaaaagatg

SEQ ID NO: 12405 - DNA, 103 bp, Artificial Sequence
  Synthetic Polynucleotide
taatacgactcactatagggcctgtgaccccggtacgtttaacccactagaacagaggagactagtgatgtaaacgtacaacctggcggcagcgcaaaagatg

SEQ ID NO: 12406 - DNA, 103 bp, Artificial Sequence
  Synthetic Polynucleotide
taatacgactcactatagggcaaatcctgtgaccccggtacgtttaacccaacagaggagagggttaatggtaccggggaacctggcggcagcgcaaaagatg

SEQ ID NO: 12407 - DNA, 103 bp, Artificial Sequence
  Synthetic Polynucleotide
taatacgactcactataggggatgtcaaatcctgtgaccccggtacgtttaacagaggagaaaacgtatgggggtcacaaacctggcggcagcgcaaaagatg

SEQ ID NO: 12408 - DNA, 103 bp, Artificial Sequence
  Synthetic Polynucleotide
taatacgactcactatagggggaaggatgtcaaatcctgtgaccccggtaaacagaggagataccggatgcacaggattaacctggcggcagcgcaaaagatg

SEQ ID NO: 12409 - DNA, 103 bp, Artificial Sequence
  Synthetic Polynucleotide
taatacgactcactatagggacgtaggaaggatgtcaaatcctgtgacccaacagaggagagggtcaatggatttgacaaacctggcggcagcgcaaaagatg

SEQ ID NO: 12410 - DNA, 103 bp, Artificial Sequence
  Synthetic Polynucleotide
taatacgactcactatagggctggggaatggggtacttctgaacaccaataacagaggagaattggtatgcagaagtacaacctggcggcagcgcaaaagatg

SEQ ID NO: 12411 - DNA, 103 bp, Artificial Sequence
  Synthetic Polynucleotide
taatacgactcactatagggcccccacatttactcctgccagggtactgcaacagaggagagcagtaatgtggcaggagaacctggcggcagcgcaaaagatg

SEQ ID NO: 12412 - DNA, 103 bp, Artificial Sequence
  Synthetic Polynucleotide
taatacgactcactatagggatctgacgtaggaaggatgtcaaatcctgtaacagaggagaacaggaatggacatccttaacctggcggcagcgcaaaagatg

SEQ ID NO: 12413 - DNA, 103 bp, Artificial Sequence
  Synthetic Polynucleotide
taatacgactcactataggggcactatctgacgtaggaaggatgtcaaataacagaggagaatttgaatgccttcctacaacctggcggcagcgcaaaagatg

SEQ ID NO: 12414 - DNA, 103 bp, Artificial Sequence
  Synthetic Polynucleotide
taatacgactcactatagggtcggcgcactatctgacgtaggaaggatgtaacagaggagaacatccatgctacgtcagaacctggcggcagcgcaaaagatg

SEQ ID NO: 12415 - DNA, 103 bp, Artificial Sequence
  Synthetic Polynucleotide
taatacgactcactatagggattgttcggcgcactatctgacgtaggaagaacagaggagacttcctatgtcagatagtaacctggcggcagcgcaaaagatg

SEQ ID NO: 12416 - DNA, 103 bp, Artificial Sequence
  Synthetic Polynucleotide
taatacgactcactataggggagtaattgttcggcgcactatctgacgtaaacagaggagatacgtcatgtagtgcgccaacctggcggcagcgcaaaagatg

SEQ ID NO: 12417 - DNA, 103 bp, Artificial Sequence
  Synthetic Polynucleotide
taatacgactcactatagggacttagagtaattgttcggcgcactatctgaacagaggagacagataatgcgccgaacaaacctggcggcagcgcaaaagatg

SEQ ID NO: 12418 - DNA, 103 bp, Artificial Sequence
  Synthetic Polynucleotide
taatacgactcactatagggttagcacttagagtaattgttcggcgcactaacagaggagaagtgcgatgaacaattacaacctggcggcagcgcaaaagatg

SEQ ID NO: 12419 - DNA, 103 bp, Artificial Sequence
  Synthetic Polynucleotide
taatacgactcactatagggtatttttagcacttagagtaattgttcggcaacagaggagagccgaaatgttactctaaaacctggcggcagcgcaaaagatg

SEQ ID NO: 12420 - DNA, 103 bp, Artificial Sequence
  Synthetic Polynucleotide
taatacgactcactatagggtaatttatttttagcacttagagtaattgtaacagaggagaacaattatgctaagtgctaacctggcggcagcgcaaaagatg

SEQ ID NO: 12421 - DNA, 103 bp, Artificial Sequence
  Synthetic Polynucleotide
taatacgactcactatagggtttattaatttatttttagcacttagagtaaacagaggagatactctatgtgctaaaaaaacctggcggcagcgcaaaagatg

SEQ ID NO: 12422 - DNA, 103 bp, Artificial Sequence
  Synthetic Polynucleotide
taatacgactcactatagggctgttcccccacatttactcctgccagggtaacagaggagaaccctgatgggagtaaataacctggcggcagcgcaaaagatg

SEQ ID NO: 12423 - DNA, 103 bp, Artificial Sequence
  Synthetic Polynucleotide
taatacgactcactatagggaagtgtttattaatttatttttagcacttaaacagaggagataagtgatgaaaataaataacctggcggcagcgcaaaagatg

SEQ ID NO: 12424 - DNA, 103 bp, Artificial Sequence
  Synthetic Polynucleotide
taatacgactcactataggggaacaaagtgtttattaatttatttttagcaacagaggagagctaaaatgaaattaataaacctggcggcagcgcaaaagatg

SEQ ID NO: 12425 - DNA, 103 bp, Artificial Sequence
  Synthetic Polynucleotide
taatacgactcactataggggaatggaacaaagtgtttattaatttatttaacagaggagaaaataaatgaataaacacaacctggcggcagcgcaaaagatg

SEQ ID NO: 12426 - DNA, 103 bp, Artificial Sequence
  Synthetic Polynucleotide
taatacgactcactatagggcagaagaatggaacaaagtgtttattaattaacagaggagaaattaaatgacactttgtaacctggcggcagcgcaaaagatg

SEQ ID NO: 12427 - DNA, 103 bp, Artificial Sequence
  Synthetic Polynucleotide
taatacgactcactatagggatcagcagaagaatggaacaaagtgtttataacagaggagaataaacatgttgttccataacctggcggcagcgcaaaagatg

SEQ ID NO: 12428 - DNA, 103 bp, Artificial Sequence
  Synthetic Polynucleotide
taatacgactcactatagggtctaaatcagcagaagaatggaacaaagtgaacagaggagacactttatgccattcttcaacctggcggcagcgcaaaagatg

SEQ ID NO: 12429 - DNA, 103 bp, Artificial Sequence
  Synthetic Polynucleotide
taatacgactcactatagggcatcttctaaatcagcagaagaatggaacaaacagaggagatgttccatgcttctgctgaacctggcggcagcgcaaaagatg

SEQ ID NO: 12430 - DNA, 103 bp, Artificial Sequence
  Synthetic Polynucleotide
taatacgactcactatagggcatttcatcttctaaatcagcagaagaatgaacagaggagacattctatggctgatttaaacctggcggcagcgcaaaagatg

SEQ ID NO: 12431 - DNA, 103 bp, Artificial Sequence
  Synthetic Polynucleotide
taatacgactcactatagggcaaaccatttcatcttctaaatcagcagaaaacagaggagattctgcatgtttagaagaaacctggcggcagcgcaaaagatg

SEQ ID NO: 12432 - DNA, 103 bp, Artificial Sequence
  Synthetic Polynucleotide
taatacgactcactatagggatttgcaaaccatttcatcttctaaatcagaacagaggagactgattatgaagatgaaaaacctggcggcagcgcaaaagatg

SEQ ID NO: 12433 - DNA, 103 bp, Artificial Sequence
  Synthetic Polynucleotide
taatacgactcactatagggtgatactgttcccccacatttactcctgccaacagaggagaggcaggatgaaatgtgggaacctggcggcagcgcaaaagatg

SEQ ID NO: 12434 - DNA, 103 bp, Artificial Sequence
  Synthetic Polynucleotide
taatacgactcactatagggcaaccatttgcaaaccatttcatcttctaaaacagaggagattagaaatggaaatggttaacctggcggcagcgcaaaagatg

SEQ ID NO: 12435 - DNA, 103 bp, Artificial Sequence
  Synthetic Polynucleotide
taatacgactcactataggggaaagcaaccatttgcaaaccatttcatctaacagaggagaagatgaatgggtttgcaaaacctggcggcagcgcaaaagatg

SEQ ID NO: 12436 - DNA, 103 bp, Artificial Sequence
  Synthetic Polynucleotide
taatacgactcactatagggtagaagaaagcaaccatttgcaaaccatttaacagaggagaaaatggatggcaaatggtaacctggcggcagcgcaaaagatg

SEQ ID NO: 12437 - DNA, 103 bp, Artificial Sequence
  Synthetic Polynucleotide
taatacgactcactatagggtggtgtagaagaaagcaaccatttgcaaacaacagaggagagtttgcatgtggttgcttaacctggcggcagcgcaaaagatg

SEQ ID NO: 12438 - DNA, 103 bp, Artificial Sequence
  Synthetic Polynucleotide
taatacgactcactatagggatgactggtgtagaagaaagcaaccatttgaacagaggagacaaatgatggctttcttcaacctggcggcagcgcaaaagatg

SEQ ID NO: 12439 - DNA, 103 bp, Artificial Sequence
  Synthetic Polynucleotide
taatacgactcactatagggtactcatgactggtgtagaagaaagcaaccaacagaggagaggttgcatgcttctacacaacctggcggcagcgcaaaagatg

SEQ ID NO: 12440 - DNA, 103 bp, Artificial Sequence
  Synthetic Polynucleotide
taatacgactcactatagggaaacctactcatgactggtgtagaagaaagaacagaggagactttctatgacaccagtcaacctggcggcagcgcaaaagatg

SEQ ID NO: 12441 - DNA, 103 bp, Artificial Sequence
  Synthetic Polynucleotide
taatacgactcactataggggcggcaaacctactcatgactggtgtagaaaacagaggagattctacatgagtcatgagaacctggcggcagcgcaaaagatg

SEQ ID NO: 12442 - DNA, 103 bp, Artificial Sequence
  Synthetic Polynucleotide
taatacgactcactatagggtatcggcggcaaacctactcatgactggtgaacagaggagacaccagatgtgagtaggtaacctggcggcagcgcaaaagatg

SEQ ID NO: 12443 - DNA, 103 bp, Artificial Sequence
  Synthetic Polynucleotide
taatacgactcactatagggaaatatatcggcggcaaacctactcatgacaacagaggagagtcatgatgaggtttgccaacctggcggcagcgcaaaagatg

SEQ ID NO: 12444 - DNA, 103 bp, Artificial Sequence
  Synthetic Polynucleotide
taatacgactcactataggggttgctgatactgttcccccacatttactcaacagaggagagagtaaatgtgggggaacaacctggcggcagcgcaaaagatg

SEQ ID NO: 12445 - DNA, 103 bp, Artificial Sequence
  Synthetic Polynucleotide
taatacgactcactatagggcgagaaaatatatcggcggcaaacctactcaacagaggagagagtagatgtgccgccgaaacctggcggcagcgcaaaagatg

SEQ ID NO: 12446 - DNA, 103 bp, Artificial Sequence
  Synthetic Polynucleotide
taatacgactcactataggggagtgcgagaaaatatatcggcggcaaaccaacagaggagaggtttgatgccgatatataacctggcggcagcgcaaaagatg

SEQ ID NO: 12447 - DNA, 103 bp, Artificial Sequence
  Synthetic Polynucleotide
taatacgactcactatagggactgggagtgcgagaaaatatatcggcggcaacagaggagagccgccatgatattttctaacctggcggcagcgcaaaagatg

SEQ ID NO: 12448 - DNA, 103 bp, Artificial Sequence
  Synthetic Polynucleotide
taatacgactcactatagggttcccactgggagtgcgagaaaatatatcgaacagaggagacgatatatgttctcgcacaacctggcggcagcgcaaaagatg

SEQ ID NO: 12449 - DNA, 103 bp, Artificial Sequence
  Synthetic Polynucleotide
taatacgactcactatagggaacgtttcccactgggagtgcgagaaaataaacagaggagatattttatggcactcccaaacctggcggcagcgcaaaagatg

SEQ ID NO: 12450 - DNA, 103 bp, Artificial Sequence
  Synthetic Polynucleotide
taatacgactcactatagggctgtaaacgtttcccactgggagtgcgagaaacagaggagatctcgcatgcccagtgggaacctggcggcagcgcaaaagatg

SEQ ID NO: 12451 - DNA, 103 bp, Artificial Sequence
  Synthetic Polynucleotide
taatacgactcactatagggaagatctgtaaacgtttcccactgggagtgaacagaggagacactccatgtgggaaacgaacctggcggcagcgcaaaagatg

SEQ ID NO: 12452 - DNA, 103 bp, Artificial Sequence
  Synthetic Polynucleotide
taatacgactcactatagggaacctaagatctgtaaacgtttcccactggaacagaggagaccagtgatgaacgtttacaacctggcggcagcgcaaaagatg

SEQ ID NO: 12453 - DNA, 103 bp, Artificial Sequence
  Synthetic Polynucleotide
taatacgactcactatagggaaggtaacctaagatctgtaaacgtttcccaacagaggagagggaaaatgttacagatcaacctggcggcagcgcaaaagatg

SEQ ID NO: 12454 - DNA, 103 bp, Artificial Sequence
  Synthetic Polynucleotide
taatacgactcactatagggccttcaaggtaacctaagatctgtaaacgtaacagaggagaacgtttatggatcttaggaacctggcggcagcgcaaaagatg

SEQ ID NO: 12455 - DNA, 103 bp, Artificial Sequence
  Synthetic Polynucleotide
taatacgactcactatagggtcgtagttgctgatactgttcccccacattaacagaggagaaatgtgatggaacagtataacctggcggcagcgcaaaagatg

SEQ ID NO: 12456 - DNA, 103 bp, Artificial Sequence
  Synthetic Polynucleotide
taatacgactcactatagggtagtcccttcaaggtaacctaagatctgtaaacagaggagatacagaatgtaggttaccaacctggcggcagcgcaaaagatg

SEQ ID NO: 12457 - DNA, 103 bp, Artificial Sequence
  Synthetic Polynucleotide
taatacgactcactatagggtgttctagtcccttcaaggtaacctaagataacagaggagaatcttaatgtaccttgaaaacctggcggcagcgcaaaagatg

SEQ ID NO: 12458 - DNA, 103 bp, Artificial Sequence
  Synthetic Polynucleotide
taatacgactcactatagggaacaatgttctagtcccttcaaggtaacctaacagaggagaaggttaatgtgaagggacaacctggcggcagcgcaaaagatg

SEQ ID NO: 12459 - DNA, 103 bp, Artificial Sequence
  Synthetic Polynucleotide
taatacgactcactatagggaggctaacaatgttctagtcccttcaaggtaacagaggagaaccttgatgggactagaaaacctggcggcagcgcaaaagatg

SEQ ID NO: 12460 - DNA, 103 bp, Artificial Sequence
  Synthetic Polynucleotide
taatacgactcactatagggtttagaggctaacaatgttctagtcccttcaacagaggagagaagggatgagaacattgaacctggcggcagcgcaaaagatg

SEQ ID NO: 12461 - DNA, 103 bp, Artificial Sequence
  Synthetic Polynucleotide
taatacgactcactatagggataattttagaggctaacaatgttctagtcaacagaggagagactagatgattgttagcaacctggcggcagcgcaaaagatg

SEQ ID NO: 12462 - DNA, 103 bp, Artificial Sequence
  Synthetic Polynucleotide
taatacgactcactataggggatttataattttagaggctaacaatgttcaacagaggagagaacatatgtagcctctaaacctggcggcagcgcaaaagatg

SEQ ID NO: 12463 - DNA, 103 bp, Artificial Sequence
  Synthetic Polynucleotide
taatacgactcactatagggattatgatttataattttagaggctaacaaaacagaggagattgttaatgtctaaaattaacctggcggcagcgcaaaagatg

SEQ ID NO: 12464 - DNA, 103 bp, Artificial Sequence
  Synthetic Polynucleotide
taatacgactcactatagggtcagtattatgatttataattttagaggctaacagaggagaagcctcatgaattataaaaacctggcggcagcgcaaaagatg

SEQ ID NO: 12465 - DNA, 103 bp, Artificial Sequence
  Synthetic Polynucleotide
taatacgactcactataggggtgtctcagtattatgatttataattttagaacagaggagactaaaaatgtaaatcataaacctggcggcagcgcaaaagatg

SEQ ID NO: 12466 - DNA, 103 bp, Artificial Sequence
  Synthetic Polynucleotide
taatacgactcactataggggcttctcgtagttgctgatactgttcccccaacagaggagagggggaatggtatcagcaaacctggcggcagcgcaaaagatg

SEQ ID NO: 12467 - DNA, 103 bp, Artificial Sequence
  Synthetic Polynucleotide
taatacgactcactataggggataggtgtctcagtattatgatttataataacagaggagaattataatgcataatactaacctggcggcagcgcaaaagatg

SEQ ID NO: 12468 - DNA, 103 bp, Artificial Sequence
  Synthetic Polynucleotide
taatacgactcactatagggtctaggataggtgtctcagtattatgatttaacagaggagaaaatcaatgtactgagacaacctggcggcagcgcaaaagatg

SEQ ID NO: 12469 - DNA, 103 bp, Artificial Sequence
  Synthetic Polynucleotide
taatacgactcactatagggatcgatctaggataggtgtctcagtattataacagaggagaataataatgagacacctaaacctggcggcagcgcaaaagatg

SEQ ID NO: 12470 - DNA, 103 bp, Artificial Sequence
  Synthetic Polynucleotide
taatacgactcactatagggcctcaatcgatctaggataggtgtctcagtaacagaggagaactgagatgcctatcctaaacctggcggcagcgcaaaagatg

SEQ ID NO: 12471 - DNA, 103 bp, Artificial Sequence
  Synthetic Polynucleotide
taatacgactcactatagggattttcctcaatcgatctaggataggtgtcaacagaggagagacaccatgcctagatcgaacctggcggcagcgcaaaagatg

SEQ ID NO: 12472 - DNA, 103 bp, Artificial Sequence
  Synthetic Polynucleotide
taatacgactcactataggggcgtaattttcctcaatcgatctaggatagaacagaggagactatccatgatcgattgaaacctggcggcagcgcaaaagatg

SEQ ID NO: 12473 - DNA, 103 bp, Artificial Sequence
  Synthetic Polynucleotide
taatacgactcactatagggttgcagcgtaattttcctcaatcgatctagaacagaggagactagatatgttgaggaaaaacctggcggcagcgcaaaagatg

SEQ ID NO: 12474 - DNA, 103 bp, Artificial Sequence
  Synthetic Polynucleotide
taatacgactcactatagggcacctttgcagcgtaattttcctcaatcgaaacagaggagatcgattatggaaaattacaacctggcggcagcgcaaaagatg

SEQ ID NO: 12475 - DNA, 103 bp, Artificial Sequence
  Synthetic Polynucleotide
taatacgactcactatagggggctccacctttgcagcgtaattttcctcaaacagaggagatgaggaatgttacgctgcaacctggcggcagcgcaaaagatg

SEQ ID NO: 12476 - DNA, 103 bp, Artificial Sequence
  Synthetic Polynucleotide
taatacgactcactatagggccacaggctccacctttgcagcgtaattttaacagaggagaaaaattatgctgcaaaggaacctggcggcagcgcaaaagatg

SEQ ID NO: 12477 - DNA, 103 bp, Artificial Sequence
  Synthetic Polynucleotide
taatacgactcactatagggtggctgcttctcgtagttgctgatactgttaacagaggagaaacagtatgagcaactacaacctggcggcagcgcaaaagatg

SEQ ID NO: 12478 - DNA, 103 bp, Artificial Sequence
  Synthetic Polynucleotide
taatacgactcactatagggctaaaccacaggctccacctttgcagcgtaaacagaggagatacgctatgaaggtggagaacctggcggcagcgcaaaagatg

SEQ ID NO: 12479 - DNA, 103 bp, Artificial Sequence
  Synthetic Polynucleotide
taatacgactcactataggggataactaaaccacaggctccacctttgcaaacagaggagatgcaaaatgggagcctgtaacctggcggcagcgcaaaagatg

SEQ ID NO: 12480 - DNA, 103 bp, Artificial Sequence
  Synthetic Polynucleotide
taatacgactcactataggggtcgagataactaaaccacaggctccacctaacagaggagaaggtggatgctgtggtttaacctggcggcagcgcaaaagatg

SEQ ID NO: 12481 - DNA, 103 bp, Artificial Sequence
  Synthetic Polynucleotide
taatacgactcactatagggcagtggtcgagataactaaaccacaggctcaacagaggagagagcctatggtttagttaaacctggcggcagcgcaaaagatg

SEQ ID NO: 12482 - DNA, 103 bp, Artificial Sequence
  Synthetic Polynucleotide
taatacgactcactataggggatcacagtggtcgagataactaaaccacaaacagaggagatgtggtatggttatctcgaacctggcggcagcgcaaaagatg

SEQ ID NO: 12483 - DNA, 103 bp, Artificial Sequence
  Synthetic Polynucleotide
taatacgactcactatagggaacttgatcacagtggtcgagataactaaaaacagaggagatttagtatgctcgaccacaacctggcggcagcgcaaaagatg

SEQ ID NO: 12484 - DNA, 103 bp, Artificial Sequence
  Synthetic Polynucleotide
taatacgactcactataggggccagaacttgatcacagtggtcgagataaaacagaggagattatctatgccactgtgaaacctggcggcagcgcaaaagatg

SEQ ID NO: 12485 - DNA, 103 bp, Artificial Sequence
  Synthetic Polynucleotide
taatacgactcactatagggcatcagccagaacttgatcacagtggtcgaaacagaggagatcgaccatggtgatcaagaacctggcggcagcgcaaaagatg

SEQ ID NO: 12486 - DNA, 103 bp, Artificial Sequence
  Synthetic Polynucleotide
taatacgactcactatagggtagggcatcagccagaacttgatcacagtgaacagaggagacactgtatgcaagttctgaacctggcggcagcgcaaaagatg

SEQ ID NO: 12487 - DNA, 103 bp, Artificial Sequence
  Synthetic Polynucleotide
taatacgactcactatagggtgagttagggcatcagccagaacttgatcaaacagaggagatgatcaatgtctggctgaaacctggcggcagcgcaaaagatg

SEQ ID NO: 12488 - DNA, 103 bp, Artificial Sequence
  Synthetic Polynucleotide
taatacgactcactatagggctcagtggctgcttctcgtagttgctgataaacagaggagatatcagatgctacgagaaaacctggcggcagcgcaaaagatg

SEQ ID NO: 12489 - DNA, 103 bp, Artificial Sequence
  Synthetic Polynucleotide
taatacgactcactatagggttatctgagttagggcatcagccagaacttaacagaggagaaagttcatgctgatgcccaacctggcggcagcgcaaaagatg

SEQ ID NO: 12490 - DNA, 103 bp, Artificial Sequence
  Synthetic Polynucleotide
taatacgactcactataggggcaggttatctgagttagggcatcagccagaacagaggagactggctatggccctaactaacctggcggcagcgcaaaagatg

SEQ ID NO: 12491 - DNA, 103 bp, Artificial Sequence
  Synthetic Polynucleotide
taatacgactcactatagggacagtgcaggttatctgagttagggcatcaaacagaggagatgatgcatgaactcagataacctggcggcagcgcaaaagatg

SEQ ID NO: 12492 - DNA, 103 bp, Artificial Sequence
  Synthetic Polynucleotide
taatacgactcactatagggagtccacagtgcaggttatctgagttagggaacagaggagaccctaaatgagataacctaacctggcggcagcgcaaaagatg

SEQ ID NO: 12493 - DNA, 103 bp, Artificial Sequence
  Synthetic Polynucleotide
taatacgactcactatagggtgctaagtccacagtgcaggttatctgagtaacagaggagaactcagatgacctgcactaacctggcggcagcgcaaaagatg

SEQ ID NO: 12494 - DNA, 103 bp, Artificial Sequence
  Synthetic Polynucleotide
taatacgactcactatagggatctgtgctaagtccacagtgcaggttatcaacagaggagagataacatgcactgtggaaacctggcggcagcgcaaaagatg

SEQ ID NO: 12495 - DNA, 103 bp, Artificial Sequence
  Synthetic Polynucleotide
taatacgactcactataggggaagaatctgtgctaagtccacagtgcaggaacagaggagacctgcaatgtggacttagaacctggcggcagcgcaaaagatg

SEQ ID NO: 12496 - DNA, 103 bp, Artificial Sequence
  Synthetic Polynucleotide
taatacgactcactatagggctcgcgaagaatctgtgctaagtccacagtaacagaggagaactgtgatgttagcacagaacctggcggcagcgcaaaagatg

SEQ ID NO: 12497 - DNA, 103 bp, Artificial Sequence
  Synthetic Polynucleotide
taatacgactcactataggggtgtactcgcgaagaatctgtgctaagtccaacagaggagaggacttatgacagattctaacctggcggcagcgcaaaagatg

SEQ ID NO: 12498 - DNA, 103 bp, Artificial Sequence
  Synthetic Polynucleotide
taatacgactcactatagggcccaggtgtactcgcgaagaatctgtgctaaacagaggagatagcacatgttcttcgcgaacctggcggcagcgcaaaagatg

SEQ ID NO: 12499 - DNA, 103 bp, Artificial Sequence
  Synthetic Polynucleotide
taatacgactcactatagggtctgcctcagtggctgcttctcgtagttgcaacagaggagagcaactatgagaagcagcaacctggcggcagcgcaaaagatg

SEQ ID NO: 12500 - DNA, 103 bp, Artificial Sequence
  Synthetic Polynucleotide
taatacgactcactataggggtgtgcccaggtgtactcgcgaagaatctgaacagaggagacagattatgcgcgagtacaacctggcggcagcgcaaaagatg

SEQ ID NO: 12501 - DNA, 103 bp, Artificial Sequence
  Synthetic Polynucleotide
taatacgactcactatagggagtatgtgtgcccaggtgtactcgcgaagaaacagaggagatcttcgatggtacacctgaacctggcggcagcgcaaaagatg

SEQ ID NO: 12502 - DNA, 103 bp, Artificial Sequence
  Synthetic Polynucleotide
taatacgactcactatagggcctctagtatgtgtgcccaggtgtactcgcaacagaggagagcgagtatgcctgggcacaacctggcggcagcgcaaaagatg

SEQ ID NO: 12503 - DNA, 103 bp, Artificial Sequence
  Synthetic Polynucleotide
taatacgactcactatagggccttccctctagtatgtgtgcccaggtgtaaacagaggagatacaccatggcacacataaacctggcggcagcgcaaaagatg

SEQ ID NO: 12504 - DNA, 103 bp, Artificial Sequence
  Synthetic Polynucleotide
taatacgactcactatagggagctgccttccctctagtatgtgtgcccagaacagaggagactgggcatgcatactagaaacctggcggcagcgcaaaagatg

SEQ ID NO: 12505 - DNA, 103 bp, Artificial Sequence
  Synthetic Polynucleotide
taatacgactcactatagggcaatgagctgccttccctctagtatgtgtgaacagaggagacacacaatgtagagggaaaacctggcggcagcgcaaaagatg

SEQ ID NO: 12506 - DNA, 103 bp, Artificial Sequence
  Synthetic Polynucleotide
taatacgactcactatagggtgctccaatgagctgccttccctctagtataacagaggagaatactaatgggaaggcagaacctggcggcagcgcaaaagatg

SEQ ID NO: 12507 - DNA, 103 bp, Artificial Sequence
  Synthetic Polynucleotide
taatacgactcactatagggagtgttgctccaatgagctgccttccctctaacagaggagaagagggatggcagctcataacctggcggcagcgcaaaagatg

SEQ ID NO: 12508 - DNA, 103 bp, Artificial Sequence
  Synthetic Polynucleotide
taatacgactcactatagggaaggaagtgttgctccaatgagctgccttcaacagaggagagaaggcatgtcattggagaacctggcggcagcgcaaaagatg

SEQ ID NO: 12509 - DNA, 103 bp, Artificial Sequence
  Synthetic Polynucleotide
taatacgactcactatagggtatacaaggaagtgttgctccaatgagctgaacagaggagacagctcatgggagcaacaaacctggcggcagcgcaaaagatg

SEQ ID NO: 12510 - DNA, 103 bp, Artificial Sequence
  Synthetic Polynucleotide
taatacgactcactataggggtttttctgcctcagtggctgcttctcgtaaacagaggagatacgagatgcagccactgaacctggcggcagcgcaaaagatg

SEQ ID NO: 12511 - DNA, 103 bp, Artificial Sequence
  Synthetic Polynucleotide
taatacgactcactatagggtctagtatacaaggaagtgttgctccaatgaacagaggagacattggatgaacacttccaacctggcggcagcgcaaaagatg

SEQ ID NO: 12512 - DNA, 103 bp, Artificial Sequence
  Synthetic Polynucleotide
taatacgactcactataggggttgttctagtatacaaggaagtgttgctcaacagaggagagagcaaatgttccttgtaaacctggcggcagcgcaaaagatg

SEQ ID NO: 12513 - DNA, 103 bp, Artificial Sequence
  Synthetic Polynucleotide
taatacgactcactatagggatttagttgttctagtatacaaggaagtgtaacagaggagaacacttatgtgtatactaaacctggcggcagcgcaaaagatg

SEQ ID NO: 12514 - DNA, 103 bp, Artificial Sequence
  Synthetic Polynucleotide
taatacgactcactatagggatgacatttagttgttctagtatacaaggaaacagaggagatccttgatgactagaacaaacctggcggcagcgcaaaagatg

SEQ ID NO: 12515 - DNA, 103 bp, Artificial Sequence
  Synthetic Polynucleotide
taatacgactcactataggggccagatgacatttagttgttctagtatacaacagaggagagtatacatgaacaactaaaacctggcggcagcgcaaaagatg

SEQ ID NO: 12516 - DNA, 103 bp, Artificial Sequence
  Synthetic Polynucleotide
taatacgactcactatagggtttgagccagatgacatttagttgttctagaacagaggagactagaaatgctaaatgtcaacctggcggcagcgcaaaagatg

SEQ ID NO: 12517 - DNA, 103 bp, Artificial Sequence
  Synthetic Polynucleotide
taatacgactcactatagggtatggtttgagccagatgacatttagttgtaacagaggagaacaactatgtgtcatctgaacctggcggcagcgcaaaagatg

SEQ ID NO: 12518 - DNA, 103 bp, Artificial Sequence
  Synthetic Polynucleotide
taatacgactcactataggggctcatatggtttgagccagatgacatttaaacagaggagataaatgatgtctggctcaaacctggcggcagcgcaaaagatg

SEQ ID NO: 12519 - DNA, 103 bp, Artificial Sequence
  Synthetic Polynucleotide
taatacgactcactataggggcaatgctcatatggtttgagccagatgacaacagaggagagtcatcatgctcaaaccaaacctggcggcagcgcaaaagatg

SEQ ID NO: 12520 - DNA, 103 bp, Artificial Sequence
  Synthetic Polynucleotide
taatacgactcactatagggttagggcaatgctcatatggtttgagccagaacagaggagactggctatgaccatatgaaacctggcggcagcgcaaaagatg

SEQ ID NO: 12521 - DNA, 103 bp, Artificial Sequence
  Synthetic Polynucleotide
taatacgactcactatagggcaataaagatcaaaaaaccttctttcttttaacagaggagaaaaagaatgaaggtttttaacctggcggcagcgcaaaagatg

SEQ ID NO: 12522 - DNA, 103 bp, Artificial Sequence
  Synthetic Polynucleotide
taatacgactcactatagggccccactggggaatggggtacttctgaacaaacagaggagatgttcaatggtaccccataacctggcggcagcgcaaaagatg

SEQ ID NO: 12523 - DNA, 103 bp, Artificial Sequence
  Synthetic Polynucleotide
taatacgactcactatagggcaattgtttttctgcctcagtggctgcttcaacagaggagagaagcaatgactgaggcaaacctggcggcagcgcaaaagatg

SEQ ID NO: 12524 - DNA, 103 bp, Artificial Sequence
  Synthetic Polynucleotide
taatacgactcactatagggcacatttagggcaatgctcatatggtttgaaacagaggagatcaaacatgatgagcattaacctggcggcagcgcaaaagatg

SEQ ID NO: 12525 - DNA, 103 bp, Artificial Sequence
  Synthetic Polynucleotide
taatacgactcactatagggctttgcacatttagggcaatgctcatatggaacagaggagaccatatatgcattgccctaacctggcggcagcgcaaaagatg

SEQ ID NO: 12526 - DNA, 103 bp, Artificial Sequence
  Synthetic Polynucleotide
taatacgactcactataggggctgactttgcacatttagggcaatgctcaaacagaggagatgagcaatgccctaaatgaacctggcggcagcgcaaaagatg

SEQ ID NO: 12527 - DNA, 103 bp, Artificial Sequence
  Synthetic Polynucleotide
taatacgactcactatagggggtttgctgactttgcacatttagggcaataacagaggagaattgccatgaatgtgcaaaacctggcggcagcgcaaaagatg

SEQ ID NO: 12528 - DNA, 103 bp, Artificial Sequence
  Synthetic Polynucleotide
taatacgactcactatagggtttagggtttgctgactttgcacatttaggaacagaggagacctaaaatggcaaagtcaaacctggcggcagcgcaaaagatg

SEQ ID NO: 12529 - DNA, 103 bp, Artificial Sequence
  Synthetic Polynucleotide
taatacgactcactatagggtcccctttagggtttgctgactttgcacataacagaggagaatgtgcatggtcagcaaaaacctggcggcagcgcaaaagatg

SEQ ID NO: 12530 - DNA, 103 bp, Artificial Sequence
  Synthetic Polynucleotide
taatacgactcactatagggaaggttcccctttagggtttgctgactttgaacagaggagacaaagtatgcaaaccctaaacctggcggcagcgcaaaagatg

SEQ ID NO: 12531 - DNA, 103 bp, Artificial Sequence
  Synthetic Polynucleotide
taatacgactcactatagggaacaaaaggttcccctttagggtttgctgaaacagaggagatcagcaatgcctaaagggaacctggcggcagcgcaaaagatg

SEQ ID NO: 12532 - DNA, 103 bp, Artificial Sequence
  Synthetic Polynucleotide
taatacgactcactatagggatagaaacaaaaggttcccctttagggtttaacagaggagaaaacccatgaggggaaccaacctggcggcagcgcaaaagatg

SEQ ID NO: 12533 - DNA, 103 bp, Artificial Sequence
  Synthetic Polynucleotide
taatacgactcactatagggttgcaatagaaacaaaaggttcccctttagaacagaggagactaaagatgaaccttttgaacctggcggcagcgcaaaagatg

SEQ ID NO: 12534 - DNA, 103 bp, Artificial Sequence
  Synthetic Polynucleotide
taatacgactcactatagggttctgcaattgtttttctgcctcagtggctaacagaggagaagccacatgggcagaaaaaacctggcggcagcgcaaaagatg

SEQ ID NO: 12535 - DNA, 103 bp, Artificial Sequence
  Synthetic Polynucleotide
taatacgactcactatagggtttaattgcaatagaaacaaaaggttccccaacagaggagaggggaaatgtttgtttctaacctggcggcagcgcaaaagatg

SEQ ID NO: 12536 - DNA, 103 bp, Artificial Sequence
  Synthetic Polynucleotide
taatacgactcactatagggtgttttttaattgcaatagaaacaaaaggtaacagaggagaacctttatgttctattgcaacctggcggcagcgcaaaagatg

SEQ ID NO: 12537 - DNA, 103 bp, Artificial Sequence
  Synthetic Polynucleotide
taatacgactcactatagggctacatgttttttaattgcaatagaaacaaaacagaggagattgtttatgttgcaattaaacctggcggcagcgcaaaagatg

SEQ ID NO: 12538 - DNA, 103 bp, Artificial Sequence
  Synthetic Polynucleotide
taatacgactcactatagggacttactacatgttttttaattgcaatagaaacagaggagatctattatgattaaaaaaaacctggcggcagcgcaaaagatg

SEQ ID NO: 12539 - DNA, 103 bp, Artificial Sequence
  Synthetic Polynucleotide
taatacgactcactatagggcaagcacttactacatgttttttaattgcaaacagaggagatgcaatatgaaaacatgtaacctggcggcagcgcaaaagatg

SEQ ID NO: 12540 - DNA, 103 bp, Artificial Sequence
  Synthetic Polynucleotide
taatacgactcactatagggcaggccaagcacttactacatgttttttaaaacagaggagattaaaaatgatgtagtaaaacctggcggcagcgcaaaagatg

SEQ ID NO: 12541 - DNA, 103 bp, Artificial Sequence
  Synthetic Polynucleotide
taatacgactcactatagggttgatcaggccaagcacttactacatgtttaacagaggagaaaacatatggtaagtgctaacctggcggcagcgcaaaagatg

SEQ ID NO: 12542 - DNA, 103 bp, Artificial Sequence
  Synthetic Polynucleotide
taatacgactcactatagggcgtgattgatcaggccaagcacttactacaaacagaggagatgtagtatgtgcttggccaacctggcggcagcgcaaaagatg

SEQ ID NO: 12543 - DNA, 103 bp, Artificial Sequence
  Synthetic Polynucleotide
taatacgactcactatagggtaagtcgtgattgatcaggccaagcacttaaacagaggagataagtgatgggcctgatcaacctggcggcagcgcaaaagatg

SEQ ID NO: 12544 - DNA, 103 bp, Artificial Sequence
  Synthetic Polynucleotide
taatacgactcactatagggccaactaagtcgtgattgatcaggccaagcaacagaggagagcttggatggatcaatcaaacctggcggcagcgcaaaagatg

SEQ ID NO: 12545 - DNA, 103 bp, Artificial Sequence
  Synthetic Polynucleotide
taatacgactcactatagggcgtatttctgcaattgtttttctgcctcagaacagaggagactgaggatgaaaaacaataacctggcggcagcgcaaaagatg

SEQ ID NO: 12546 - DNA, 103 bp, Artificial Sequence
  Synthetic Polynucleotide
taatacgactcactatagggattgtccaactaagtcgtgattgatcaggcaacagaggagagcctgaatgatcacgactaacctggcggcagcgcaaaagatg

SEQ ID NO: 12547 - DNA, 103 bp, Artificial Sequence
  Synthetic Polynucleotide
taatacgactcactatagggctccaattgtccaactaagtcgtgattgataacagaggagaatcaatatggacttagttaacctggcggcagcgcaaaagatg

SEQ ID NO: 12548 - DNA, 103 bp, Artificial Sequence
  Synthetic Polynucleotide
taatacgactcactataggggccatctccaattgtccaactaagtcgtgaaacagaggagatcacgaatgagttggacaaacctggcggcagcgcaaaagatg

SEQ ID NO: 12549 - DNA, 103 bp, Artificial Sequence
  Synthetic Polynucleotide
taatacgactcactataggggggatgccatctccaattgtccaactaagtaacagaggagaacttagatggacaattggaacctggcggcagcgcaaaagatg

SEQ ID NO: 12550 - DNA, 103 bp, Artificial Sequence
  Synthetic Polynucleotide
taatacgactcactatagggtataagggatgccatctccaattgtccaacaacagaggagagttggaatgttggagatgaacctggcggcagcgcaaaagatg

SEQ ID NO: 12551 - DNA, 103 bp, Artificial Sequence
  Synthetic Polynucleotide
taatacgactcactatagggtccgatataagggatgccatctccaattgtaacagaggagaacaattatggatggcatcaacctggcggcagcgcaaaagatg

SEQ ID NO: 12552 - DNA, 103 bp, Artificial Sequence
  Synthetic Polynucleotide
taatacgactcactatagggcgagatccgatataagggatgccatctccaaacagaggagatggagaatgcatcccttaaacctggcggcagcgcaaaagatg

SEQ ID NO: 12553 - DNA, 103 bp, Artificial Sequence
  Synthetic Polynucleotide
taatacgactcactatagggctgttcgagatccgatataagggatgccataacagaggagaatggcaatgcttatatcgaacctggcggcagcgcaaaagatg

SEQ ID NO: 12554 - DNA, 103 bp, Artificial Sequence
  Synthetic Polynucleotide
taatacgactcactatagggatcctctgttcgagatccgatataagggataacagaggagaatccctatgatcggatctaacctggcggcagcgcaaaagatg

SEQ ID NO: 12555 - DNA, 103 bp, Artificial Sequence
  Synthetic Polynucleotide
taatacgactcactatagggatcttatcctctgttcgagatccgatataaaacagaggagattatatatgatctcgaacaacctggcggcagcgcaaaagatg

SEQ ID NO: 12556 - DNA, 103 bp, Artificial Sequence
  Synthetic Polynucleotide
taatacgactcactatagggttcagcgtatttctgcaattgtttttctgcaacagaggagagcagaaatgcaattgcagaacctggcggcagcgcaaaagatg

SEQ ID NO: 12557 - DNA, 103 bp, Artificial Sequence
  Synthetic Polynucleotide
taatacgactcactataggggcccaatcttatcctctgttcgagatccgaaacagaggagatcggatatggaacagaggaacctggcggcagcgcaaaagatg

SEQ ID NO: 12558 - DNA, 103 bp, Artificial Sequence
  Synthetic Polynucleotide
taatacgactcactatagggtggctgcccaatcttatcctctgttcgagaaacagaggagatctcgaatggaggataagaacctggcggcagcgcaaaagatg

SEQ ID NO: 12559 - DNA, 103 bp, Artificial Sequence
  Synthetic Polynucleotide
taatacgactcactatagggatggctggctgcccaatcttatcctctgttaacagaggagaaacagaatgtaagattggaacctggcggcagcgcaaaagatg

SEQ ID NO: 12560 - DNA, 103 bp, Artificial Sequence
  Synthetic Polynucleotide
taatacgactcactataggggtttgatggctggctgcccaatcttatcctaacagaggagaaggataatgttgggcagcaacctggcggcagcgcaaaagatg

SEQ ID NO: 12561 - DNA, 103 bp, Artificial Sequence
  Synthetic Polynucleotide
taatacgactcactatagggttttggtttgatggctggctgcccaatcttaacagaggagaaagattatgcagccagccaacctggcggcagcgcaaaagatg

SEQ ID NO: 12562 - DNA, 103 bp, Artificial Sequence
  Synthetic Polynucleotide
taatacgactcactataggggggcattttggtttgatggctggctgcccaaacagaggagatgggcaatgagccatcaaaacctggcggcagcgcaaaagatg

SEQ ID NO: 12563 - DNA, 103 bp, Artificial Sequence
  Synthetic Polynucleotide
taatacgactcactatagggctgaagggcattttggtttgatggctggctaacagaggagaagccagatgtcaaaccaaaacctggcggcagcgcaaaagatg

SEQ ID NO: 12564 - DNA, 103 bp, Artificial Sequence
  Synthetic Polynucleotide
taatacgactcactatagggggctgctgaagggcattttggtttgatggcaacagaggagagccatcatgccaaaatgcaacctggcggcagcgcaaaagatg

SEQ ID NO: 12565 - DNA, 103 bp, Artificial Sequence
  Synthetic Polynucleotide
taatacgactcactatagggcgtaaggctgctgaagggcattttggtttgaacagaggagacaaaccatgatgcccttcaacctggcggcagcgcaaaagatg

SEQ ID NO: 12566 - DNA, 103 bp, Artificial Sequence
  Synthetic Polynucleotide
taatacgactcactatagggcttcacgtaaggctgctgaagggcattttgaacagaggagacaaaatatgcttcagcagaacctggcggcagcgcaaaagatg

SEQ ID NO: 12567 - DNA, 103 bp, Artificial Sequence
  Synthetic Polynucleotide
taatacgactcactatagggcgagattcagcgtatttctgcaattgttttaacagaggagaaaaacaatggcagaaataaacctggcggcagcgcaaaagatg

SEQ ID NO: 12568 - DNA, 103 bp, Artificial Sequence
  Synthetic Polynucleotide
taatacgactcactatagggaattgcttcacgtaaggctgctgaagggcaaacagaggagatgccctatggcagccttaaacctggcggcagcgcaaaagatg

SEQ ID NO: 12569 - DNA, 103 bp, Artificial Sequence
  Synthetic Polynucleotide
taatacgactcactatagggaactcaattgcttcacgtaaggctgctgaaaacagaggagattcagcatgcttacgtgaaacctggcggcagcgcaaaagatg

SEQ ID NO: 12570 - DNA, 103 bp, Artificial Sequence
  Synthetic Polynucleotide
taatacgactcactatagggatgtcaactcaattgcttcacgtaaggctgaacagaggagacagcctatggtgaagcaaaacctggcggcagcgcaaaagatg

SEQ ID NO: 12571 - DNA, 103 bp, Artificial Sequence
  Synthetic Polynucleotide
taatacgactcactatagggtcttgatgtcaactcaattgcttcacgtaaaacagaggagattacgtatggcaattgagaacctggcggcagcgcaaaagatg

SEQ ID NO: 12572 - DNA, 103 bp, Artificial Sequence
  Synthetic Polynucleotide
taatacgactcactataggggtcaatcttgatgtcaactcaattgcttcaaacagaggagatgaagcatgtgagttgacaacctggcggcagcgcaaaagatg

SEQ ID NO: 12573 - DNA, 103 bp, Artificial Sequence
  Synthetic Polynucleotide
taatacgactcactatagggcccaagtcaatcttgatgtcaactcaattgaacagaggagacaattgatgtgacatcaaaacctggcggcagcgcaaaagatg

SEQ ID NO: 12574 - DNA, 103 bp, Artificial Sequence
  Synthetic Polynucleotide
taatacgactcactatagggagtaacccaagtcaatcttgatgtcaactcaacagaggagagagttgatgtcaagattgaacctggcggcagcgcaaaagatg

SEQ ID NO: 12575 - DNA, 103 bp, Artificial Sequence
  Synthetic Polynucleotide
taatacgactcactatagggccttgagtaacccaagtcaatcttgatgtcaacagaggagagacatcatgattgacttgaacctggcggcagcgcaaaagatg

SEQ ID NO: 12576 - DNA, 103 bp, Artificial Sequence
  Synthetic Polynucleotide
taatacgactcactatagggctccaccttgagtaacccaagtcaatcttgaacagaggagacaagatatgcttgggttaaacctggcggcagcgcaaaagatg

SEQ ID NO: 12577 - DNA, 103 bp, Artificial Sequence
  Synthetic Polynucleotide
taatacgactcactataggggtttgctccaccttgagtaacccaagtcaaaacagaggagattgactatggttactcaaaacctggcggcagcgcaaaagatg

SEQ ID NO: 12578 - DNA, 103 bp, Artificial Sequence
  Synthetic Polynucleotide
taatacgactcactataggggctcgcgagattcagcgtatttctgcaattaacagaggagaaattgcatgaatacgctgaacctggcggcagcgcaaaagatg

SEQ ID NO: 12579 - DNA, 103 bp, Artificial Sequence
  Synthetic Polynucleotide
taatacgactcactatagggtcgctgtttgctccaccttgagtaacccaaaacagaggagattgggtatgtcaaggtggaacctggcggcagcgcaaaagatg

SEQ ID NO: 12580 - DNA, 103 bp, Artificial Sequence
  Synthetic Polynucleotide
taatacgactcactataggggtaagtcgctgtttgctccaccttgagtaaaacagaggagattactcatggtggagcaaaacctggcggcagcgcaaaagatg

SEQ ID NO: 12581 - DNA, 103 bp, Artificial Sequence
  Synthetic Polynucleotide
taatacgactcactatagggaactagtaagtcgctgtttgctccaccttgaacagaggagacaaggtatggcaaacagcaacctggcggcagcgcaaaagatg

SEQ ID NO: 12582 - DNA, 103 bp, Artificial Sequence
  Synthetic Polynucleotide
taatacgactcactatagggggtttaactagtaagtcgctgtttgctccaaacagaggagatggagcatgcagcgacttaacctggcggcagcgcaaaagatg

SEQ ID NO: 12583 - DNA, 103 bp, Artificial Sequence
  Synthetic Polynucleotide
taatacgactcactatagggtgaagggtttaactagtaagtcgctgtttgaacagaggagacaaacaatgacttactagaacctggcggcagcgcaaaagatg

SEQ ID NO: 12584 - DNA, 103 bp, Artificial Sequence
  Synthetic Polynucleotide
taatacgactcactatagggttctatgaagggtttaactagtaagtcgctaacagaggagaagcgacatgctagttaaaaacctggcggcagcgcaaaagatg

SEQ ID NO: 12585 - DNA, 103 bp, Artificial Sequence
  Synthetic Polynucleotide
taatacgactcactatagggcgtgcttctatgaagggtttaactagtaagaacagaggagacttactatgtaaacccttaacctggcggcagcgcaaaagatg

SEQ ID NO: 12586 - DNA, 103 bp, Artificial Sequence
  Synthetic Polynucleotide
taatacgactcactatagggttactcgtgcttctatgaagggtttaactaaacagaggagatagttaatgccttcatagaacctggcggcagcgcaaaagatg

SEQ ID NO: 12587 - DNA, 103 bp, Artificial Sequence
  Synthetic Polynucleotide
taatacgactcactatagggtaaatttactcgtgcttctatgaagggtttaacagaggagaaaacccatgatagaagcaaacctggcggcagcgcaaaagatg

SEQ ID NO: 12588 - DNA, 103 bp, Artificial Sequence
  Synthetic Polynucleotide
taatacgactcactatagggacgcttaaatttactcgtgcttctatgaagaacagaggagacttcatatgagcacgagtaacctggcggcagcgcaaaagatg

SEQ ID NO: 12589 - DNA, 103 bp, Artificial Sequence
  Synthetic Polynucleotide
taatacgactcactataggggtcaagctcgcgagattcagcgtatttctgaacagaggagacagaaaatggctgaatctaacctggcggcagcgcaaaagatg

SEQ ID NO: 12590 - DNA, 103 bp, Artificial Sequence
  Synthetic Polynucleotide
taatacgactcactatagggcctgtacgcttaaatttactcgtgcttctaaacagaggagatagaagatggagtaaattaacctggcggcagcgcaaaagatg

SEQ ID NO: 12591 - DNA, 103 bp, Artificial Sequence
  Synthetic Polynucleotide
taatacgactcactatagggaatttcctgtacgcttaaatttactcgtgcaacagaggagagcacgaatgaatttaagcaacctggcggcagcgcaaaagatg

SEQ ID NO: 12592 - DNA, 103 bp, Artificial Sequence
  Synthetic Polynucleotide
taatacgactcactatagggtggagaatttcctgtacgcttaaatttactaacagaggagaagtaaaatgaagcgtacaaacctggcggcagcgcaaaagatg

SEQ ID NO: 12593 - DNA, 103 bp, Artificial Sequence
  Synthetic Polynucleotide
taatacgactcactatagggtcatttggagaatttcctgtacgcttaaataacagaggagaatttaaatgtacaggaaaaacctggcggcagcgcaaaagatg

SEQ ID NO: 12594 - DNA, 103 bp, Artificial Sequence
  Synthetic Polynucleotide
taatacgactcactatagggaggtgtcatttggagaatttcctgtacgctaacagaggagaagcgtaatggaaattctcaacctggcggcagcgcaaaagatg

SEQ ID NO: 12595 - DNA, 103 bp, Artificial Sequence
  Synthetic Polynucleotide
taatacgactcactatagggtgagaaggtgtcatttggagaatttcctgtaacagaggagaacaggaatgtctccaaataacctggcggcagcgcaaaagatg

SEQ ID NO: 12596 - DNA, 103 bp, Artificial Sequence
  Synthetic Polynucleotide
taatacgactcactatagggagtaatgagaaggtgtcatttggagaatttaacagaggagaaaattcatgaaatgacacaacctggcggcagcgcaaaagatg

SEQ ID NO: 12597 - DNA, 103 bp, Artificial Sequence
  Synthetic Polynucleotide
taatacgactcactataggggccggagtaatgagaaggtgtcatttggagaacagaggagactccaaatgacaccttctaacctggcggcagcgcaaaagatg

SEQ ID NO: 12598 - DNA, 103 bp, Artificial Sequence
  Synthetic Polynucleotide
taatacgactcactatagggatgttgccggagtaatgagaaggtgtcattaacagaggagaaatgacatgttctcattaaacctggcggcagcgcaaaagatg

SEQ ID NO: 12599 - DNA, 103 bp, Artificial Sequence
  Synthetic Polynucleotide
taatacgactcactataggggcacaatgttgccggagtaatgagaaggtgaacagaggagacaccttatgattactccgaacctggcggcagcgcaaaagatg

SEQ ID NO: 12600 - DNA, 103 bp, Artificial Sequence
  Synthetic Polynucleotide
taatacgactcactatagggagatggtcaagctcgcgagattcagcgtataacagaggagaatacgcatgatctcgcgaaacctggcggcagcgcaaaagatg

SEQ ID NO: 12601 - DNA, 103 bp, Artificial Sequence
  Synthetic Polynucleotide
taatacgactcactatagggtcgatgcacaatgttgccggagtaatgagaaacagaggagatctcatatgtccggcaacaacctggcggcagcgcaaaagatg

SEQ ID NO: 12602 - DNA, 103 bp, Artificial Sequence
  Synthetic Polynucleotide
taatacgactcactatagggttatatcgatgcacaatgttgccggagtaaaacagaggagattactcatgcaacattgtaacctggcggcagcgcaaaagatg

SEQ ID NO: 12603 - DNA, 103 bp, Artificial Sequence
  Synthetic Polynucleotide
taatacgactcactataggggatcattatatcgatgcacaatgttgccggaacagaggagaccggcaatgttgtgcatcaacctggcggcagcgcaaaagatg

SEQ ID NO: 12604 - DNA, 103 bp, Artificial Sequence
  Synthetic Polynucleotide
taatacgactcactatagggatattgatcattatatcgatgcacaatgttaacagaggagaaacattatgcatcgatataacctggcggcagcgcaaaagatg

SEQ ID NO: 12605 - DNA, 103 bp, Artificial Sequence
  Synthetic Polynucleotide
taatacgactcactatagggggactatattgatcattatatcgatgcacaaacagaggagatgtgcaatgatataatgaaacctggcggcagcgcaaaagatg

SEQ ID NO: 12606 - DNA, 103 bp, Artificial Sequence
  Synthetic Polynucleotide
taatacgactcactatagggagtgtggactatattgatcattatatcgataacagaggagaatcgatatgatgatcaataacctggcggcagcgcaaaagatg

SEQ ID NO: 12607 - DNA, 103 bp, Artificial Sequence
  Synthetic Polynucleotide
taatacgactcactatagggaaatgagtgtggactatattgatcattataaacagaggagatataatatgcaatatagtaacctggcggcagcgcaaaagatg

SEQ ID NO: 12608 - DNA, 103 bp, Artificial Sequence
  Synthetic Polynucleotide
taatacgactcactataggggccataaatgagtgtggactatattgatcaaacagaggagatgatcaatgtagtccacaaacctggcggcagcgcaaaagatg

SEQ ID NO: 12609 - DNA, 103 bp, Artificial Sequence
  Synthetic Polynucleotide
taatacgactcactatagggtatttgccataaatgagtgtggactatattaacagaggagaaatataatgcacactcataacctggcggcagcgcaaaagatg

SEQ ID NO: 12610 - DNA, 103 bp, Artificial Sequence
  Synthetic Polynucleotide
taatacgactcactatagggcatcctatttgccataaatgagtgtggactaacagaggagaagtccaatgtcatttatgaacctggcggcagcgcaaaagatg

SEQ ID NO: 12611 - DNA, 103 bp, Artificial Sequence
  Synthetic Polynucleotide
taatacgactcactataggggacctagatggtcaagctcgcgagattcagaacagaggagactgaatatggcgagcttgaacctggcggcagcgcaaaagatg

SEQ ID NO: 12612 - DNA, 103 bp, Artificial Sequence
  Synthetic Polynucleotide
taatacgactcactatagggttactcatcctatttgccataaatgagtgtaacagaggagaacactcatgtatggcaaaaacctggcggcagcgcaaaagatg

SEQ ID NO: 12613 - DNA, 103 bp, Artificial Sequence
  Synthetic Polynucleotide
taatacgactcactatagggcagaattactcatcctatttgccataaatgaacagaggagacatttaatgcaaataggaaacctggcggcagcgcaaaagatg

SEQ ID NO: 12614 - DNA, 103 bp, Artificial Sequence
  Synthetic Polynucleotide
taatacgactcactatagggagtagcagaattactcatcctatttgccataacagaggagaatggcaatgaggatgagtaacctggcggcagcgcaaaagatg

SEQ ID NO: 12615 - DNA, 103 bp, Artificial Sequence
  Synthetic Polynucleotide
taatacgactcactatagggaacctagtagcagaattactcatcctatttaacagaggagaaaatagatggagtaattcaacctggcggcagcgcaaaagatg

SEQ ID NO: 12616 - DNA, 103 bp, Artificial Sequence
  Synthetic Polynucleotide
taatacgactcactatagggcaactaacctagtagcagaattactcatccaacagaggagaggatgaatgattctgctaaacctggcggcagcgcaaaagatg

SEQ ID NO: 12617 - DNA, 103 bp, Artificial Sequence
  Synthetic Polynucleotide
taatacgactcactatagggcgaaacaactaacctagtagcagaattactaacagaggagaagtaatatggctactaggaacctggcggcagcgcaaaagatg

SEQ ID NO: 12618 - DNA, 103 bp, Artificial Sequence
  Synthetic Polynucleotide
taatacgactcactatagggtttgtcgaaacaactaacctagtagcagaaaacagaggagattctgcatgtaggttagtaacctggcggcagcgcaaaagatg

SEQ ID NO: 12619 - DNA, 103 bp, Artificial Sequence
  Synthetic Polynucleotide
taatacgactcactataggggagtgtttgtcgaaacaactaacctagtagaacagaggagactactaatgtagttgtttaacctggcggcagcgcaaaagatg

SEQ ID NO: 12620 - DNA, 103 bp, Artificial Sequence
  Synthetic Polynucleotide
taatacgactcactatagggtccaagagtgtttgtcgaaacaactaacctaacagaggagaaggttaatggtttcgacaaacctggcggcagcgcaaaagatg

SEQ ID NO: 12621 - DNA, 103 bp, Artificial Sequence
  Synthetic Polynucleotide
taatacgactcactatagggaattctccaagagtgtttgtcgaaacaactaacagaggagaagttgtatggacaaacacaacctggcggcagcgcaaaagatg

SEQ ID NO: 12622 - DNA, 103 bp, Artificial Sequence
  Synthetic Polynucleotide
taatacgactcactatagggatcgagacctagatggtcaagctcgcgagaaacagaggagatctcgcatgcttgaccataacctggcggcagcgcaaaagatg

SEQ ID NO: 12623 - DNA, 103 bp, Artificial Sequence
  Synthetic Polynucleotide
taatacgactcactatagggctgaaaattctccaagagtgtttgtcgaaaaacagaggagatttcgaatgacactcttgaacctggcggcagcgcaaaagatg

SEQ ID NO: 12624 - DNA, 103 bp, Artificial Sequence
  Synthetic Polynucleotide
taatacgactcactatagggtcctcctgaaaattctccaagagtgtttgtaacagaggagaacaaacatgcttggagaaaacctggcggcagcgcaaaagatg

SEQ ID NO: 12625 - DNA, 103 bp, Artificial Sequence
  Synthetic Polynucleotide
taatacgactcactatagggtgacctcctcctgaaaattctccaagagtgaacagaggagacactctatgagaattttcaacctggcggcagcgcaaaagatg

SEQ ID NO: 12626 - DNA, 103 bp, Artificial Sequence
  Synthetic Polynucleotide
taatacgactcactatagggctgactgacctcctcctgaaaattctccaaaacagaggagattggagatgtttcaggagaacctggcggcagcgcaaaagatg

SEQ ID NO: 12627 - DNA, 103 bp, Artificial Sequence
  Synthetic Polynucleotide
taatacgactcactatagggtcttgctgactgacctcctcctgaaaattcaacagaggagagaatttatgggaggaggtaacctggcggcagcgcaaaagatg

SEQ ID NO: 12628 - DNA, 103 bp, Artificial Sequence
  Synthetic Polynucleotide
taatacgactcactatagggctatctcttgctgactgacctcctcctgaaaacagaggagattcaggatgaggtcagtcaacctggcggcagcgcaaaagatg

SEQ ID NO: 12629 - DNA, 103 bp, Artificial Sequence
  Synthetic Polynucleotide
taatacgactcactatagggtattactatctcttgctgactgacctcctcaacagaggagagaggagatgagtcagcaaaacctggcggcagcgcaaaagatg

SEQ ID NO: 12630 - DNA, 103 bp, Artificial Sequence
  Synthetic Polynucleotide
taatacgactcactataggggataatattactatctcttgctgactgaccaacagaggagaggtcagatggcaagagataacctggcggcagcgcaaaagatg

SEQ ID NO: 12631 - DNA, 103 bp, Artificial Sequence
  Synthetic Polynucleotide
taatacgactcactatagggtggaagataatattactatctcttgctgacaacagaggagagtcagcatgagatagtaaaacctggcggcagcgcaaaagatg

SEQ ID NO: 12632 - DNA, 103 bp, Artificial Sequence
  Synthetic Polynucleotide
taatacgactcactatagggcattctggaagataatattactatctcttgaacagaggagacaagagatggtaatattaaacctggcggcagcgcaaaagatg

SEQ ID NO: 12633 - DNA, 103 bp, Artificial Sequence
  Synthetic Polynucleotide
taatacgactcactatagggtttgcccccactggggaatggggtacttctaacagaggagaagaagtatgccattccccaacctggcggcagcgcaaaagatg

SEQ ID NO: 12634 - DNA, 103 bp, Artificial Sequence
  Synthetic Polynucleotide
taatacgactcactatagggtgatcatcgagacctagatggtcaagctcgaacagaggagacgagctatgccatctaggaacctggcggcagcgcaaaagatg

SEQ ID NO: 12635 - DNA, 103 bp, Artificial Sequence
  Synthetic Polynucleotide
taatacgactcactatagggaatgacattctggaagataatattactatcaacagaggagagatagtatgattatcttcaacctggcggcagcgcaaaagatg

SEQ ID NO: 12636 - DNA, 103 bp, Artificial Sequence
  Synthetic Polynucleotide
taatacgactcactatagggaaattaatgacattctggaagataatattaaacagaggagataatatatgcttccagaaaacctggcggcagcgcaaaagatg

SEQ ID NO: 12637 - DNA, 103 bp, Artificial Sequence
  Synthetic Polynucleotide
taatacgactcactatagggcagcaaaattaatgacattctggaagataaaacagaggagattatctatgagaatgtcaaacctggcggcagcgcaaaagatg

SEQ ID NO: 12638 - DNA, 103 bp, Artificial Sequence
  Synthetic Polynucleotide
taatacgactcactatagggtgcaacagcaaaattaatgacattctggaaaacagaggagattccagatggtcattaataacctggcggcagcgcaaaagatg

SEQ ID NO: 12639 - DNA, 103 bp, Artificial Sequence
  Synthetic Polynucleotide
taatacgactcactatagggaaaagtgcaacagcaaaattaatgacattcaacagaggagagaatgtatgtaattttgcaacctggcggcagcgcaaaagatg

SEQ ID NO: 12640 - DNA, 103 bp, Artificial Sequence
  Synthetic Polynucleotide
taatacgactcactataggggatcaaaaagtgcaacagcaaaattaatgaaacagaggagatcattaatgttgctgttgaacctggcggcagcgcaaaagatg

SEQ ID NO: 12641 - DNA, 103 bp, Artificial Sequence
  Synthetic Polynucleotide
taatacgactcactatagggtcgtagatcaaaaagtgcaacagcaaaattaacagaggagaaattttatggttgcacttaacctggcggcagcgcaaaagatg

SEQ ID NO: 12642 - DNA, 103 bp, Artificial Sequence
  Synthetic Polynucleotide
taatacgactcactatagggctaaatcgtagatcaaaaagtgcaacagcaaacagaggagatgctgtatgactttttgaaacctggcggcagcgcaaaagatg

SEQ ID NO: 12643 - DNA, 103 bp, Artificial Sequence
  Synthetic Polynucleotide
taatacgactcactatagggcgttcctaaatcgtagatcaaaaagtgcaaaacagaggagattgcacatgttgatctacaacctggcggcagcgcaaaagatg

SEQ ID NO: 12644 - DNA, 103 bp, Artificial Sequence
  Synthetic Polynucleotide
taatacgactcactatagggagccacgttcctaaatcgtagatcaaaaagaacagaggagactttttatgctacgatttaacctggcggcagcgcaaaagatg

SEQ ID NO: 12645 - DNA, 103 bp, Artificial Sequence
  Synthetic Polynucleotide
taatacgactcactatagggtctcttgatcatcgagacctagatggtcaaaacagaggagattgaccatgtaggtctcgaacctggcggcagcgcaaaagatg

SEQ ID NO: 12646 - DNA, 103 bp, Artificial Sequence
  Synthetic Polynucleotide
taatacgactcactataggggaagtagccacgttcctaaatcgtagatcaaacagaggagatgatctatgatttaggaaaacctggcggcagcgcaaaagatg

SEQ ID NO: 12647 - DNA, 103 bp, Artificial Sequence
  Synthetic Polynucleotide
taatacgactcactatagggtagaagaagtagccacgttcctaaatcgtaaacagaggagatacgatatgggaacgtggaacctggcggcagcgcaaaagatg

SEQ ID NO: 12648 - DNA, 103 bp, Artificial Sequence
  Synthetic Polynucleotide
taatacgactcactatagggttgtatagaagaagtagccacgttcctaaaaacagaggagatttaggatggtggctactaacctggcggcagcgcaaaagatg

SEQ ID NO: 12649 - DNA, 103 bp, Artificial Sequence
  Synthetic Polynucleotide
taatacgactcactatagggtgatgttgtatagaagaagtagccacgttcaacagaggagagaacgtatgtacttcttcaacctggcggcagcgcaaaagatg

SEQ ID NO: 12650 - DNA, 103 bp, Artificial Sequence
  Synthetic Polynucleotide
taatacgactcactatagggcccgatgatgttgtatagaagaagtagccaaacagaggagatggctaatgcttctatacaacctggcggcagcgcaaaagatg

SEQ ID NO: 12651 - DNA, 103 bp, Artificial Sequence
  Synthetic Polynucleotide
taatacgactcactatagggatgagcccgatgatgttgtatagaagaagtaacagaggagaacttctatgatacaacataacctggcggcagcgcaaaagatg

SEQ ID NO: 12652 - DNA, 103 bp, Artificial Sequence
  Synthetic Polynucleotide
taatacgactcactatagggtgaagatgagcccgatgatgttgtatagaaaacagaggagattctatatgacatcatcgaacctggcggcagcgcaaaagatg

SEQ ID NO: 12653 - DNA, 103 bp, Artificial Sequence
  Synthetic Polynucleotide
taatacgactcactatagggacaaatgaagatgagcccgatgatgttgtaaacagaggagatacaacatgatcgggctcaacctggcggcagcgcaaaagatg

SEQ ID NO: 12654 - DNA, 103 bp, Artificial Sequence
  Synthetic Polynucleotide
taatacgactcactatagggctttgacaaatgaagatgagcccgatgatgaacagaggagacatcatatggctcatcttaacctggcggcagcgcaaaagatg

SEQ ID NO: 12655 - DNA, 103 bp, Artificial Sequence
  Synthetic Polynucleotide
taatacgactcactatagggcaacactttgacaaatgaagatgagcccgaaacagaggagatcgggcatgtcttcatttaacctggcggcagcgcaaaagatg

SEQ ID NO: 12656 - DNA, 103 bp, Artificial Sequence
  Synthetic Polynucleotide
taatacgactcactatagggcttcttctcttgatcatcgagacctagatgaacagaggagacatctaatgctcgatgataacctggcggcagcgcaaaagatg

SEQ ID NO: 12657 - DNA, 103 bp, Artificial Sequence
  Synthetic Polynucleotide
taatacgactcactataggggcgtgcaacactttgacaaatgaagatgagaacagaggagactcatcatgatttgtcaaaacctggcggcagcgcaaaagatg

SEQ ID NO: 12658 - DNA, 103 bp, Artificial Sequence
  Synthetic Polynucleotide
taatacgactcactatagggctctcgcgtgcaacactttgacaaatgaagaacagaggagacttcatatgtcaaagtgtaacctggcggcagcgcaaaagatg

SEQ ID NO: 12659 - DNA, 103 bp, Artificial Sequence
  Synthetic Polynucleotide
taatacgactcactatagggggaacctctcgcgtgcaacactttgacaaaaacagaggagatttgtcatggtgttgcacaacctggcggcagcgcaaaagatg

SEQ ID NO: 12660 - DNA, 103 bp, Artificial Sequence
  Synthetic Polynucleotide
taatacgactcactataggggggctggaacctctcgcgtgcaacactttgaacagaggagacaaagtatggcacgcgagaacctggcggcagcgcaaaagatg

SEQ ID NO: 12661 - DNA, 103 bp, Artificial Sequence
  Synthetic Polynucleotide
taatacgactcactatagggatattgggctggaacctctcgcgtgcaacaaacagaggagatgttgcatgcgagaggttaacctggcggcagcgcaaaagatg

SEQ ID NO: 12662 - DNA, 103 bp, Artificial Sequence
  Synthetic Polynucleotide
taatacgactcactatagggactaaatattgggctggaacctctcgcgtgaacagaggagacacgcgatgggttccagcaacctggcggcagcgcaaaagatg

SEQ ID NO: 12663 - DNA, 103 bp, Artificial Sequence
  Synthetic Polynucleotide
taatacgactcactatagggtataaactaaatattgggctggaacctctcaacagaggagagagaggatgcagcccaataacctggcggcagcgcaaaagatg

SEQ ID NO: 12664 - DNA, 103 bp, Artificial Sequence
  Synthetic Polynucleotide
taatacgactcactatagggtgatgtataaactaaatattgggctggaacaacagaggagagttccaatgcaatatttaaacctggcggcagcgcaaaagatg

SEQ ID NO: 12665 - DNA, 103 bp, Artificial Sequence
  Synthetic Polynucleotide
taatacgactcactatagggaatgttgatgtataaactaaatattgggctaacagaggagaagcccaatgtttagtttaaacctggcggcagcgcaaaagatg

SEQ ID NO: 12666 - DNA, 103 bp, Artificial Sequence
  Synthetic Polynucleotide
taatacgactcactatagggatggcaatgttgatgtataaactaaatattaacagaggagaaatattatgtttatacataacctggcggcagcgcaaaagatg

SEQ ID NO: 12667 - DNA, 103 bp, Artificial Sequence
  Synthetic Polynucleotide
taatacgactcactatagggaagatcttcttctcttgatcatcgagacctaacagaggagaaggtctatgtgatcaagaaacctggcggcagcgcaaaagatg

SEQ ID NO: 12668 - DNA, 103 bp, Artificial Sequence
  Synthetic Polynucleotide
taatacgactcactataggggtccaatggcaatgttgatgtataaactaaaacagaggagattagttatgacatcaacaaacctggcggcagcgcaaaagatg

SEQ ID NO: 12669 - DNA, 103 bp, Artificial Sequence
  Synthetic Polynucleotide
taatacgactcactataggggtaaggtccaatggcaatgttgatgtataaaacagaggagattatacatgaacattgccaacctggcggcagcgcaaaagatg

SEQ ID NO: 12670 - DNA, 103 bp, Artificial Sequence
  Synthetic Polynucleotide
taatacgactcactatagggaccgtgtaaggtccaatggcaatgttgatgaacagaggagacatcaaatgtgccattggaacctggcggcagcgcaaaagatg

SEQ ID NO: 12671 - DNA, 103 bp, Artificial Sequence
  Synthetic Polynucleotide
taatacgactcactatagggccgataccgtgtaaggtccaatggcaatgtaacagaggagaacattgatgttggaccttaacctggcggcagcgcaaaagatg

SEQ ID NO: 12672 - DNA, 103 bp, Artificial Sequence
  Synthetic Polynucleotide
taatacgactcactatagggttatcccgataccgtgtaaggtccaatggcaacagaggagagccattatgccttacacgaacctggcggcagcgcaaaagatg

SEQ ID NO: 12673 - DNA, 103 bp, Artificial Sequence
  Synthetic Polynucleotide
taatacgactcactatagggactcattatcccgataccgtgtaaggtccaaacagaggagatggaccatgcacggtatcaacctggcggcagcgcaaaagatg

SEQ ID NO: 12674 - DNA, 103 bp, Artificial Sequence
  Synthetic Polynucleotide
taatacgactcactatagggaatcaactcattatcccgataccgtgtaagaacagaggagacttacaatgtatcgggataacctggcggcagcgcaaaagatg

SEQ ID NO: 12675 - DNA, 103 bp, Artificial Sequence
  Synthetic Polynucleotide
taatacgactcactatagggtcgtaaatcaactcattatcccgataccgtaacagaggagaacggtaatgggataatgaaacctggcggcagcgcaaaagatg

SEQ ID NO: 12676 - DNA, 103 bp, Artificial Sequence
  Synthetic Polynucleotide
taatacgactcactatagggtgtcatcgtaaatcaactcattatcccgataacagaggagaatcgggatgatgagttgaaacctggcggcagcgcaaaagatg

SEQ ID NO: 12677 - DNA, 103 bp, Artificial Sequence
  Synthetic Polynucleotide
taatacgactcactatagggtggattgtcatcgtaaatcaactcattatcaacagaggagagataatatgttgatttacaacctggcggcagcgcaaaagatg

SEQ ID NO: 12678 - DNA, 103 bp, Artificial Sequence
  Synthetic Polynucleotide
taatacgactcactatagggctttcaagatcttcttctcttgatcatcgaaacagaggagatcgatgatgaagagaagaaacctggcggcagcgcaaaagatg

SEQ ID NO: 12679 - DNA, 103 bp, Artificial Sequence
  Synthetic Polynucleotide
taatacgactcactatagggcttaatggattgtcatcgtaaatcaactcaaacagaggagatgagttatgttacgatgaaacctggcggcagcgcaaaagatg

SEQ ID NO: 12680 - DNA, 103 bp, Artificial Sequence
  Synthetic Polynucleotide
taatacgactcactatagggcacctcttaatggattgtcatcgtaaatcaaacagaggagatgatttatgatgacaatcaacctggcggcagcgcaaaagatg

SEQ ID NO: 12681 - DNA, 103 bp, Artificial Sequence
  Synthetic Polynucleotide
taatacgactcactatagggtaaaccacctcttaatggattgtcatcgtaaacagaggagatacgatatgaatccattaaacctggcggcagcgcaaaagatg

SEQ ID NO: 12682 - DNA, 103 bp, Artificial Sequence
  Synthetic Polynucleotide
taatacgactcactatagggcaatttaaaccacctcttaatggattgtcaaacagaggagatgacaaatgattaagaggaacctggcggcagcgcaaaagatg

SEQ ID NO: 12683 - DNA, 103 bp, Artificial Sequence
  Synthetic Polynucleotide
taatacgactcactataggggattgcaatttaaaccacctcttaatggataacagaggagaatccatatggaggtggttaacctggcggcagcgcaaaagatg

SEQ ID NO: 12684 - DNA, 103 bp, Artificial Sequence
  Synthetic Polynucleotide
taatacgactcactatagggagaaagattgcaatttaaaccacctcttaaaacagaggagattaagaatgggtttaaataacctggcggcagcgcaaaagatg

SEQ ID NO: 12685 - DNA, 103 bp, Artificial Sequence
  Synthetic Polynucleotide
taatacgactcactatagggtcaaaagaaagattgcaatttaaaccacctaacagaggagaaggtggatgaaattgcaaaacctggcggcagcgcaaaagatg

SEQ ID NO: 12686 - DNA, 103 bp, Artificial Sequence
  Synthetic Polynucleotide
taatacgactcactataggggattatcaaaagaaagattgcaatttaaacaacagaggagagtttaaatggcaatctttaacctggcggcagcgcaaaagatg

SEQ ID NO: 12687 - DNA, 103 bp, Artificial Sequence
  Synthetic Polynucleotide
taatacgactcactatagggaagcggattatcaaaagaaagattgcaattaacagaggagaaattgcatgctttcttttaacctggcggcagcgcaaaagatg

SEQ ID NO: 12688 - DNA, 103 bp, Artificial Sequence
  Synthetic Polynucleotide
taatacgactcactatagggttgaaaagcggattatcaaaagaaagattgaacagaggagacaatctatgttttgataaaacctggcggcagcgcaaaagatg

SEQ ID NO: 12689 - DNA, 103 bp, Artificial Sequence
  Synthetic Polynucleotide
taatacgactcactataggggaagtctttcaagatcttcttctcttgatcaacagaggagagatcaaatgaagaagatcaacctggcggcagcgcaaaagatg

SEQ ID NO: 12690 - DNA, 103 bp, Artificial Sequence
  Synthetic Polynucleotide
taatacgactcactatagggggcccttgaaaagcggattatcaaaagaaaaacagaggagatttcttatgataatccgcaacctggcggcagcgcaaaagatg

SEQ ID NO: 12691 - DNA, 103 bp, Artificial Sequence
  Synthetic Polynucleotide
taatacgactcactatagggtctctggcccttgaaaagcggattatcaaaaacagaggagatttgatatgccgcttttcaacctggcggcagcgcaaaagatg

SEQ ID NO: 12692 - DNA, 103 bp, Artificial Sequence
  Synthetic Polynucleotide
taatacgactcactatagggttaagtctctggcccttgaaaagcggattaaacagaggagataatccatgtttcaagggaacctggcggcagcgcaaaagatg

SEQ ID NO: 12693 - DNA, 103 bp, Artificial Sequence
  Synthetic Polynucleotide
taatacgactcactatagggttatgttaagtctctggcccttgaaaagcgaacagaggagacgctttatgagggccagaaacctggcggcagcgcaaaagatg

SEQ ID NO: 12694 - DNA, 103 bp, Artificial Sequence
  Synthetic Polynucleotide
taatacgactcactatagggttcaattatgttaagtctctggcccttgaaaacagaggagattcaagatgcagagacttaacctggcggcagcgcaaaagatg

SEQ ID NO: 12695 - DNA, 103 bp, Artificial Sequence
  Synthetic Polynucleotide
taatacgactcactatagggtcttcttcaattatgttaagtctctggcccaacagaggagagggccaatgacttaacataacctggcggcagcgcaaaagatg

SEQ ID NO: 12696 - DNA, 103 bp, Artificial Sequence
  Synthetic Polynucleotide
taatacgactcactatagggtcaagtcttcttcaattatgttaagtctctaacagaggagaagagacatgacataattgaacctggcggcagcgcaaaagatg

SEQ ID NO: 12697 - DNA, 103 bp, Artificial Sequence
  Synthetic Polynucleotide
taatacgactcactatagggtctaatcaagtcttcttcaattatgttaagaacagaggagacttaacatgattgaagaaaacctggcggcagcgcaaaagatg

SEQ ID NO: 12698 - DNA, 103 bp, Artificial Sequence
  Synthetic Polynucleotide
taatacgactcactatagggggtagtctaatcaagtcttcttcaattatgaacagaggagacataatatgagaagacttaacctggcggcagcgcaaaagatg

SEQ ID NO: 12699 - DNA, 103 bp, Artificial Sequence
  Synthetic Polynucleotide
taatacgactcactatagggagtaaggtagtctaatcaagtcttcttcaaaacagaggagattgaagatgacttgattaaacctggcggcagcgcaaaagatg

SEQ ID NO: 12700 - DNA, 103 bp, Artificial Sequence
  Synthetic Polynucleotide
taatacgactcactatagggtgatggaagtctttcaagatcttcttctctaacagaggagaagagaaatggatcttgaaaacctggcggcagcgcaaaagatg

SEQ ID NO: 12701 - DNA, 103 bp, Artificial Sequence
  Synthetic Polynucleotide
taatacgactcactatagggtgataagtaaggtagtctaatcaagtcttcaacagaggagagaagacatgattagactaaacctggcggcagcgcaaaagatg

SEQ ID NO: 12702 - DNA, 103 bp, Artificial Sequence
  Synthetic Polynucleotide
taatacgactcactatagggcatcctgataagtaaggtagtctaatcaagaacagaggagacttgatatgactaccttaaacctggcggcagcgcaaaagatg

SEQ ID NO: 12703 - DNA, 103 bp, Artificial Sequence
  Synthetic Polynucleotide
taatacgactcactataggggctcccatcctgataagtaaggtagtctaaaacagaggagattagacatgcttacttataacctggcggcagcgcaaaagatg

SEQ ID NO: 12704 - DNA, 103 bp, Artificial Sequence
  Synthetic Polynucleotide
taatacgactcactatagggagctagctcccatcctgataagtaaggtagaacagaggagactacctatgttatcaggaaacctggcggcagcgcaaaagatg

SEQ ID NO: 12705 - DNA, 103 bp, Artificial Sequence
  Synthetic Polynucleotide
taatacgactcactataggggttttagctagctcccatcctgataagtaaaacagaggagattacttatgaggatgggaaacctggcggcagcgcaaaagatg

SEQ ID NO: 12706 - DNA, 103 bp, Artificial Sequence
  Synthetic Polynucleotide
taatacgactcactatagggtaacagttttagctagctcccatcctgataaacagaggagatatcagatggggagctagaacctggcggcagcgcaaaagatg

SEQ ID NO: 12707 - DNA, 103 bp, Artificial Sequence
  Synthetic Polynucleotide
taatacgactcactatagggttggataacagttttagctagctcccatccaacagaggagaggatggatgctagctaaaaacctggcggcagcgcaaaagatg

SEQ ID NO: 12708 - DNA, 103 bp, Artificial Sequence
  Synthetic Polynucleotide
taatacgactcactatagggatagattggataacagttttagctagctccaacagaggagaggagctatgtaaaactgtaacctggcggcagcgcaaaagatg

SEQ ID NO: 12709 - DNA, 103 bp, Artificial Sequence
  Synthetic Polynucleotide
taatacgactcactatagggaaattatagattggataacagttttagctaaacagaggagatagctaatgctgttatccaacctggcggcagcgcaaaagatg

SEQ ID NO: 12710 - DNA, 103 bp, Artificial Sequence
  Synthetic Polynucleotide
taatacgactcactataggggtcagaaattatagattggataacagttttaacagaggagaaaaactatgatccaatctaacctggcggcagcgcaaaagatg

SEQ ID NO: 12711 - DNA, 103 bp, Artificial Sequence
  Synthetic Polynucleotide
taatacgactcactatagggtcttctgatggaagtctttcaagatcttctaacagaggagaagaagaatgtgaaagactaacctggcggcagcgcaaaagatg

SEQ ID NO: 12712 - DNA, 103 bp, Artificial Sequence
  Synthetic Polynucleotide
taatacgactcactatagggttgctgtcagaaattatagattggataacaaacagaggagatgttatatgatctataataacctggcggcagcgcaaaagatg

SEQ ID NO: 12713 - DNA, 103 bp, Artificial Sequence
  Synthetic Polynucleotide
taatacgactcactatagggaattgttgctgtcagaaattatagattggaaacagaggagatccaatatgtaatttctgaacctggcggcagcgcaaaagatg

SEQ ID NO: 12714 - DNA, 103 bp, Artificial Sequence
  Synthetic Polynucleotide
taatacgactcactatagggtgatgaattgttgctgtcagaaattatagaaacagaggagatctataatgtctgacagcaacctggcggcagcgcaaaagatg

SEQ ID NO: 12715 - DNA, 103 bp, Artificial Sequence
  Synthetic Polynucleotide
taatacgactcactatagggtccgttgatgaattgttgctgtcagaaattaacagaggagaaatttcatgcagcaacaaaacctggcggcagcgcaaaagatg

SEQ ID NO: 12716 - DNA, 103 bp, Artificial Sequence
  Synthetic Polynucleotide
taatacgactcactatagggttggatccgttgatgaattgttgctgtcagaacagaggagactgacaatgacaattcataacctggcggcagcgcaaaagatg

SEQ ID NO: 12717 - DNA, 103 bp, Artificial Sequence
  Synthetic Polynucleotide
taatacgactcactatagggactgattggatccgttgatgaattgttgctaacagaggagaagcaacatgtcatcaacgaacctggcggcagcgcaaaagatg

SEQ ID NO: 12718 - DNA, 103 bp, Artificial Sequence
  Synthetic Polynucleotide
taatacgactcactatagggccactactgattggatccgttgatgaattgaacagaggagacaattcatgaacggatccaacctggcggcagcgcaaaagatg

SEQ ID NO: 12719 - DNA, 103 bp, Artificial Sequence
  Synthetic Polynucleotide
taatacgactcactatagggtttccccactactgattggatccgttgatgaacagaggagacatcaaatgatccaatcaaacctggcggcagcgcaaaagatg

SEQ ID NO: 12720 - DNA, 103 bp, Artificial Sequence
  Synthetic Polynucleotide
taatacgactcactatagggtcgtgtttccccactactgattggatccgtaacagaggagaacggatatgatcagtagtaacctggcggcagcgcaaaagatg

SEQ ID NO: 12721 - DNA, 103 bp, Artificial Sequence
  Synthetic Polynucleotide
taatacgactcactatagggaatgatcgtgtttccccactactgattggaaacagaggagatccaatatgtagtggggaaacctggcggcagcgcaaaagatg

SEQ ID NO: 12722 - DNA, 103 bp, Artificial Sequence
  Synthetic Polynucleotide
taatacgactcactatagggatttttcttctgatggaagtctttcaagataacagaggagaatcttgatggacttccataacctggcggcagcgcaaaagatg

SEQ ID NO: 12723 - DNA, 103 bp, Artificial Sequence
  Synthetic Polynucleotide
taatacgactcactatagggtggtgaatgatcgtgtttccccactactgaaacagaggagatcagtaatggggaaacacaacctggcggcagcgcaaaagatg

SEQ ID NO: 12724 - DNA, 103 bp, Artificial Sequence
  Synthetic Polynucleotide
taatacgactcactataggggtgagtggtgaatgatcgtgtttccccactaacagaggagaagtgggatgacacgatcaaacctggcggcagcgcaaaagatg

SEQ ID NO: 12725 - DNA, 103 bp, Artificial Sequence
  Synthetic Polynucleotide
taatacgactcactatagggaagaagtgagtggtgaatgatcgtgtttccaacagaggagaggaaacatgatcattcacaacctggcggcagcgcaaaagatg

SEQ ID NO: 12726 - DNA, 103 bp, Artificial Sequence
  Synthetic Polynucleotide
taatacgactcactatagggatgtcaagaagtgagtggtgaatgatcgtgaacagaggagacacgatatgtcaccactcaacctggcggcagcgcaaaagatg

SEQ ID NO: 12727 - DNA, 103 bp, Artificial Sequence
  Synthetic Polynucleotide
taatacgactcactatagggaggatatgtcaagaagtgagtggtgaatgaaacagaggagatcattcatgactcacttcaacctggcggcagcgcaaaagatg

SEQ ID NO: 12728 - DNA, 103 bp, Artificial Sequence
  Synthetic Polynucleotide
taatacgactcactatagggatcttaggatatgtcaagaagtgagtggtgaacagaggagacaccacatgcttcttgacaacctggcggcagcgcaaaagatg

SEQ ID NO: 12729 - DNA, 103 bp, Artificial Sequence
  Synthetic Polynucleotide
taatacgactcactataggggtccaatcttaggatatgtcaagaagtgagaacagaggagactcactatgtgacatatcaacctggcggcagcgcaaaagatg

SEQ ID NO: 12730 - DNA, 103 bp, Artificial Sequence
  Synthetic Polynucleotide
taatacgactcactatagggtagtagtccaatcttaggatatgtcaagaaaacagaggagattcttgatgtatcctaagaacctggcggcagcgcaaaagatg

SEQ ID NO: 12731 - DNA, 103 bp, Artificial Sequence
  Synthetic Polynucleotide
taatacgactcactatagggctatatagtagtccaatcttaggatatgtcaacagaggagagacataatgtaagattggaacctggcggcagcgcaaaagatg

SEQ ID NO: 12732 - DNA, 103 bp, Artificial Sequence
  Synthetic Polynucleotide
taatacgactcactatagggcaaaactatatagtagtccaatcttaggataacagaggagaatcctaatgttggactacaacctggcggcagcgcaaaagatg

SEQ ID NO: 12733 - DNA, 103 bp, Artificial Sequence
  Synthetic Polynucleotide
taatacgactcactatagggatttcatttttcttctgatggaagtctttcaacagaggagagaaagaatgccatcagaaaacctggcggcagcgcaaaagatg

SEQ ID NO: 12734 - DNA, 103 bp, Artificial Sequence
  Synthetic Polynucleotide
taatacgactcactatagggtgcaccaaaactatatagtagtccaatcttaacagaggagaaagattatgctactatataacctggcggcagcgcaaaagatg

SEQ ID NO: 12735 - DNA, 103 bp, Artificial Sequence
  Synthetic Polynucleotide
taatacgactcactatagggatgagtgcaccaaaactatatagtagtccaaacagaggagatggactatgatatagtttaacctggcggcagcgcaaaagatg

SEQ ID NO: 12736 - DNA, 103 bp, Artificial Sequence
  Synthetic Polynucleotide
taatacgactcactatagggaactgatgagtgcaccaaaactatatagtaaacagaggagatactatatggttttggtgaacctggcggcagcgcaaaagatg

SEQ ID NO: 12737 - DNA, 103 bp, Artificial Sequence
  Synthetic Polynucleotide
taatacgactcactatagggataataactgatgagtgcaccaaaactataaacagaggagatatagtatgggtgcactcaacctggcggcagcgcaaaagatg

SEQ ID NO: 12738 - DNA, 103 bp, Artificial Sequence
  Synthetic Polynucleotide
taatacgactcactatagggcctagataataactgatgagtgcaccaaaaaacagaggagattttggatgactcatcagaacctggcggcagcgcaaaagatg

SEQ ID NO: 12739 - DNA, 103 bp, Artificial Sequence
  Synthetic Polynucleotide
taatacgactcactatagggtgttgcctagataataactgatgagtgcacaacagaggagagtgcacatgtcagttattaacctggcggcagcgcaaaagatg

SEQ ID NO: 12740 - DNA, 103 bp, Artificial Sequence
  Synthetic Polynucleotide
taatacgactcactatagggaatggtgttgcctagataataactgatgagaacagaggagactcatcatgtattatctaaacctggcggcagcgcaaaagatg

SEQ ID NO: 12741 - DNA, 103 bp, Artificial Sequence
  Synthetic Polynucleotide
taatacgactcactatagggctaataatggtgttgcctagataataactgaacagaggagacagttaatgtctaggcaaaacctggcggcagcgcaaaagatg

SEQ ID NO: 12742 - DNA, 103 bp, Artificial Sequence
  Synthetic Polynucleotide
taatacgactcactatagggtggttctaataatggtgttgcctagataataacagaggagaattatcatggcaacaccaaacctggcggcagcgcaaaagatg

SEQ ID NO: 12743 - DNA, 103 bp, Artificial Sequence
  Synthetic Polynucleotide
taatacgactcactatagggttttttggttctaataatggtgttgcctagaacagaggagactaggcatgaccattattaacctggcggcagcgcaaaagatg

SEQ ID NO: 12744 - DNA, 103 bp, Artificial Sequence
  Synthetic Polynucleotide
taatacgactcactatagggctgtctttgcccccactggggaatggggtaaacagaggagataccccatgccccagtggaacctggcggcagcgcaaaagatg

SEQ ID NO: 12745 - DNA, 103 bp, Artificial Sequence
  Synthetic Polynucleotide
taatacgactcactatagggagctgatttcatttttcttctgatggaagtaacagaggagaacttccatgagaagaaaaaacctggcggcagcgcaaaagatg

SEQ ID NO: 12746 - DNA, 103 bp, Artificial Sequence
  Synthetic Polynucleotide
taatacgactcactataggggtcaattttttggttctaataatggtgttgaacagaggagacaacacatgtattagaacaacctggcggcagcgcaaaagatg

SEQ ID NO: 12747 - DNA, 103 bp, Artificial Sequence
  Synthetic Polynucleotide
taatacgactcactatagggtaagagtcaattttttggttctaataatggaacagaggagaccattaatggaaccaaaaaacctggcggcagcgcaaaagatg

SEQ ID NO: 12748 - DNA, 103 bp, Artificial Sequence
  Synthetic Polynucleotide
taatacgactcactataggggttgttaagagtcaattttttggttctaataacagaggagaattagaatgaaaaaattgaacctggcggcagcgcaaaagatg

SEQ ID NO: 12749 - DNA, 103 bp, Artificial Sequence
  Synthetic Polynucleotide
taatacgactcactatagggatgaagttgttaagagtcaattttttggttaacagaggagaaaccaaatgattgactctaacctggcggcagcgcaaaagatg

SEQ ID NO: 12750 - DNA, 103 bp, Artificial Sequence
  Synthetic Polynucleotide
taatacgactcactatagggaatatatgaagttgttaagagtcaatttttaacagaggagaaaaaatatgctcttaacaaacctggcggcagcgcaaaagatg

SEQ ID NO: 12751 - DNA, 103 bp, Artificial Sequence
  Synthetic Polynucleotide
taatacgactcactatagggtaggtaatatatgaagttgttaagagtcaaaacagaggagattgactatgaacaacttcaacctggcggcagcgcaaaagatg

SEQ ID NO: 12752 - DNA, 103 bp, Artificial Sequence
  Synthetic Polynucleotide
taatacgactcactataggggtagctaggtaatatatgaagttgttaagaaacagaggagatcttaaatgcttcatataaacctggcggcagcgcaaaagatg

SEQ ID NO: 12753 - DNA, 103 bp, Artificial Sequence
  Synthetic Polynucleotide
taatacgactcactatagggtttgagtagctaggtaatatatgaagttgtaacagaggagaacaactatgtatattaccaacctggcggcagcgcaaaagatg

SEQ ID NO: 12754 - DNA, 103 bp, Artificial Sequence
  Synthetic Polynucleotide
taatacgactcactatagggatgtatttgagtagctaggtaatatatgaaaacagaggagattcataatgtacctagctaacctggcggcagcgcaaaagatg

SEQ ID NO: 12755 - DNA, 103 bp, Artificial Sequence
  Synthetic Polynucleotide
taatacgactcactatagggaaattatgtatttgagtagctaggtaatataacagaggagaatattaatgagctactcaaacctggcggcagcgcaaaagatg

SEQ ID NO: 12756 - DNA, 103 bp, Artificial Sequence
  Synthetic Polynucleotide
taatacgactcactatagggctggaagctgatttcatttttcttctgatgaacagaggagacatcagatgaaaaatgaaaacctggcggcagcgcaaaagatg

SEQ ID NO: 12757 - DNA, 103 bp, Artificial Sequence
  Synthetic Polynucleotide
taatacgactcactataggggaggtaaattatgtatttgagtagctaggtaacagaggagaacctagatgctcaaatacaacctggcggcagcgcaaaagatg

SEQ ID NO: 12758 - DNA, 103 bp, Artificial Sequence
  Synthetic Polynucleotide
taatacgactcactataggggcgatgaggtaaattatgtatttgagtagcaacagaggagagctactatgatacataataacctggcggcagcgcaaaagatg

SEQ ID NO: 12759 - DNA, 103 bp, Artificial Sequence
  Synthetic Polynucleotide
taatacgactcactatagggaacgagcgatgaggtaaattatgtatttgaaacagaggagatcaaatatgtaatttaccaacctggcggcagcgcaaaagatg

SEQ ID NO: 12760 - DNA, 103 bp, Artificial Sequence
  Synthetic Polynucleotide
taatacgactcactatagggttctcaacgagcgatgaggtaaattatgtaaacagaggagatacataatgtacctcatcaacctggcggcagcgcaaaagatg

SEQ ID NO: 12761 - DNA, 103 bp, Artificial Sequence
  Synthetic Polynucleotide
taatacgactcactatagggaaggattctcaacgagcgatgaggtaaattaacagaggagaaatttaatgcatcgctcgaacctggcggcagcgcaaaagatg

SEQ ID NO: 12762 - DNA, 103 bp, Artificial Sequence
  Synthetic Polynucleotide
taatacgactcactatagggggtttaaggattctcaacgagcgatgaggtaacagaggagaacctcaatgctcgttgagaacctggcggcagcgcaaaagatg

SEQ ID NO: 12763 - DNA, 103 bp, Artificial Sequence
  Synthetic Polynucleotide
taatacgactcactatagggaagtaggtttaaggattctcaacgagcgataacagaggagaatcgctatgtgagaatccaacctggcggcagcgcaaaagatg

SEQ ID NO: 12764 - DNA, 103 bp, Artificial Sequence
  Synthetic Polynucleotide
taatacgactcactatagggtttcaaagtaggtttaaggattctcaacgaaacagaggagatcgttgatgatccttaaaaacctggcggcagcgcaaaagatg

SEQ ID NO: 12765 - DNA, 103 bp, Artificial Sequence
  Synthetic Polynucleotide
taatacgactcactataggggcgtgtttcaaagtaggtttaaggattctcaacagaggagagagaatatgtaaacctacaacctggcggcagcgcaaaagatg

SEQ ID NO: 12766 - DNA, 103 bp, Artificial Sequence
  Synthetic Polynucleotide
taatacgactcactatagggcactagcgtgtttcaaagtaggtttaaggaaacagaggagatccttaatgctactttgaaacctggcggcagcgcaaaagatg

SEQ ID NO: 12767 - DNA, 103 bp, Artificial Sequence
  Synthetic Polynucleotide
taatacgactcactataggggtctgctggaagctgatttcatttttcttcaacagaggagagaagaaatgtgaaatcagaacctggcggcagcgcaaaagatg

SEQ ID NO: 12768 - DNA, 103 bp, Artificial Sequence
  Synthetic Polynucleotide
taatacgactcactataggggataacactagcgtgtttcaaagtaggtttaacagaggagaaaacctatgttgaaacacaacctggcggcagcgcaaaagatg

SEQ ID NO: 12769 - DNA, 103 bp, Artificial Sequence
  Synthetic Polynucleotide
taatacgactcactatagggctcgagataacactagcgtgtttcaaagtaaacagaggagatactttatgacacgctagaacctggcggcagcgcaaaagatg

SEQ ID NO: 12770 - DNA, 103 bp, Artificial Sequence
  Synthetic Polynucleotide
taatacgactcactatagggttaatctcgagataacactagcgtgtttcaaacagaggagatgaaacatgctagtgttaaacctggcggcagcgcaaaagatg

SEQ ID NO: 12771 - DNA, 103 bp, Artificial Sequence
  Synthetic Polynucleotide
taatacgactcactatagggacttattaatctcgagataacactagcgtgaacagaggagacacgctatggttatctcgaacctggcggcagcgcaaaagatg

SEQ ID NO: 12772 - DNA, 103 bp, Artificial Sequence
  Synthetic Polynucleotide
taatacgactcactatagggtcaatacttattaatctcgagataacactaaacagaggagatagtgtatgctcgagattaacctggcggcagcgcaaaagatg

SEQ ID NO: 12773 - DNA, 103 bp, Artificial Sequence
  Synthetic Polynucleotide
taatacgactcactataggggagagtcaatacttattaatctcgagataaaacagaggagattatctatggattaataaaacctggcggcagcgcaaaagatg

SEQ ID NO: 12774 - DNA, 103 bp, Artificial Sequence
  Synthetic Polynucleotide
taatacgactcactataggggaagtgagagtcaatacttattaatctcgaaacagaggagatcgagaatgataagtattaacctggcggcagcgcaaaagatg

SEQ ID NO: 12775 - DNA, 103 bp, Artificial Sequence
  Synthetic Polynucleotide
taatacgactcactatagggattgagaagtgagagtcaatacttattaataacagaggagaattaatatgtattgactcaacctggcggcagcgcaaaagatg

SEQ ID NO: 12776 - DNA, 103 bp, Artificial Sequence
  Synthetic Polynucleotide
taatacgactcactatagggtataaattgagaagtgagagtcaatacttaaacagaggagataagtaatgactctcactaacctggcggcagcgcaaaagatg

SEQ ID NO: 12777 - DNA, 103 bp, Artificial Sequence
  Synthetic Polynucleotide
taatacgactcactatagggtccaatataaattgagaagtgagagtcaataacagaggagaattgacatgcacttctcaaacctggcggcagcgcaaaagatg

SEQ ID NO: 12778 - DNA, 103 bp, Artificial Sequence
  Synthetic Polynucleotide
taatacgactcactatagggctgttgtctgctggaagctgatttcattttaacagaggagaaaaatgatgtcagcttccaacctggcggcagcgcaaaagatg

SEQ ID NO: 12779 - DNA, 103 bp, Artificial Sequence
  Synthetic Polynucleotide
taatacgactcactataggggttcctccaatataaattgagaagtgagagaacagaggagactctcaatgctcaatttaaacctggcggcagcgcaaaagatg

SEQ ID NO: 12780 - DNA, 103 bp, Artificial Sequence
  Synthetic Polynucleotide
taatacgactcactatagggcagcagttcctccaatataaattgagaagtaacagaggagaacttctatgtttatattgaacctggcggcagcgcaaaagatg

SEQ ID NO: 12781 - DNA, 103 bp, Artificial Sequence
  Synthetic Polynucleotide
taatacgactcactatagggatcaccagcagttcctccaatataaattgaaacagaggagatcaattatgattggaggaaacctggcggcagcgcaaaagatg

SEQ ID NO: 12782 - DNA, 103 bp, Artificial Sequence
  Synthetic Polynucleotide
taatacgactcactatagggcctcgatcaccagcagttcctccaatataaaacagaggagattatatatgaggaactgcaacctggcggcagcgcaaaagatg

SEQ ID NO: 12783 - DNA, 103 bp, Artificial Sequence
  Synthetic Polynucleotide
taatacgactcactatagggaaagtcctcgatcaccagcagttcctccaaaacagaggagattggagatgctgctggtgaacctggcggcagcgcaaaagatg

SEQ ID NO: 12784 - DNA, 103 bp, Artificial Sequence
  Synthetic Polynucleotide
taatacgactcactatagggatcggaaagtcctcgatcaccagcagttccaacagaggagaggaactatgggtgatcgaaacctggcggcagcgcaaaagatg

SEQ ID NO: 12785 - DNA, 103 bp, Artificial Sequence
  Synthetic Polynucleotide
taatacgactcactataggggccgcatcggaaagtcctcgatcaccagcaaacagaggagatgctggatgtcgaggactaacctggcggcagcgcaaaagatg

SEQ ID NO: 12786 - DNA, 103 bp, Artificial Sequence
  Synthetic Polynucleotide
taatacgactcactatagggatcttgccgcatcggaaagtcctcgatcacaacagaggagagtgatcatggactttccgaacctggcggcagcgcaaaagatg

SEQ ID NO: 12787 - DNA, 103 bp, Artificial Sequence
  Synthetic Polynucleotide
taatacgactcactatagggaaacaatcttgccgcatcggaaagtcctcgaacagaggagacgaggaatgtccgatgcgaacctggcggcagcgcaaaagatg

SEQ ID NO: 12788 - DNA, 103 bp, Artificial Sequence
  Synthetic Polynucleotide
taatacgactcactatagggctaagaaacaatcttgccgcatcggaaagtaacagaggagaactttcatgtgcggcaagaacctggcggcagcgcaaaagatg

SEQ ID NO: 12789 - DNA, 103 bp, Artificial Sequence
  Synthetic Polynucleotide
taatacgactcactatagggcatggctgttgtctgctggaagctgatttcaacagaggagagaaatcatgttccagcagaacctggcggcagcgcaaaagatg

SEQ ID NO: 12790 - DNA, 103 bp, Artificial Sequence
  Synthetic Polynucleotide
taatacgactcactatagggcagttctaagaaacaatcttgccgcatcggaacagaggagaccgatgatgcaagattgtaacctggcggcagcgcaaaagatg

SEQ ID NO: 12791 - DNA, 103 bp, Artificial Sequence
  Synthetic Polynucleotide
taatacgactcactatagggaatggcagttctaagaaacaatcttgccgcaacagaggagagcggcaatgttgtttcttaacctggcggcagcgcaaaagatg

SEQ ID NO: 12792 - DNA, 103 bp, Artificial Sequence
  Synthetic Polynucleotide
taatacgactcactatagggacagtaatggcagttctaagaaacaatcttaacagaggagaaagattatgtcttagaacaacctggcggcagcgcaaaagatg

SEQ ID NO: 12793 - DNA, 103 bp, Artificial Sequence
  Synthetic Polynucleotide
taatacgactcactatagggggaagacagtaatggcagttctaagaaacaaacagaggagatgtttcatggaactgccaaacctggcggcagcgcaaaagatg

SEQ ID NO: 12794 - DNA, 103 bp, Artificial Sequence
  Synthetic Polynucleotide
taatacgactcactatagggttgaaggaagacagtaatggcagttctaagaacagaggagacttagaatggccattactaacctggcggcagcgcaaaagatg

SEQ ID NO: 12795 - DNA, 103 bp, Artificial Sequence
  Synthetic Polynucleotide
taatacgactcactatagggacgaattgaaggaagacagtaatggcagttaacagaggagaaactgcatgtactgtcttaacctggcggcagcgcaaaagatg

SEQ ID NO: 12796 - DNA, 103 bp, Artificial Sequence
  Synthetic Polynucleotide
taatacgactcactatagggttctaacgaattgaaggaagacagtaatggaacagaggagaccattaatgtcttccttcaacctggcggcagcgcaaaagatg

SEQ ID NO: 12797 - DNA, 103 bp, Artificial Sequence
  Synthetic Polynucleotide
taatacgactcactatagggccactttctaacgaattgaaggaagacagtaacagaggagaactgtcatgcttcaattcaacctggcggcagcgcaaaagatg

SEQ ID NO: 12798 - DNA, 103 bp, Artificial Sequence
  Synthetic Polynucleotide
taatacgactcactatagggactatccactttctaacgaattgaaggaagaacagaggagacttcctatgattcgttagaacctggcggcagcgcaaaagatg

SEQ ID NO: 12799 - DNA, 103 bp, Artificial Sequence
  Synthetic Polynucleotide
taatacgactcactataggggttcaactatccactttctaacgaattgaaaacagaggagattcaatatgttagaaagtaacctggcggcagcgcaaaagatg

SEQ ID NO: 12800 - DNA, 103 bp, Artificial Sequence
  Synthetic Polynucleotide
taatacgactcactataggggtgaccatggctgttgtctgctggaagctgaacagaggagacagcttatggcagacaacaacctggcggcagcgcaaaagatg

SEQ ID NO: 12801 - DNA, 103 bp, Artificial Sequence
  Synthetic Polynucleotide
taatacgactcactatagggcttgcgttcaactatccactttctaacgaaaacagaggagattcgttatgaagtggataaacctggcggcagcgcaaaagatg

SEQ ID NO: 12802 - DNA, 103 bp, Artificial Sequence
  Synthetic Polynucleotide
taatacgactcactataggggctgtcttgcgttcaactatccactttctaaacagaggagatagaaaatggatagttgaaacctggcggcagcgcaaaagatg

SEQ ID NO: 12803 - DNA, 103 bp, Artificial Sequence
  Synthetic Polynucleotide
taatacgactcactataggggaatagctgtcttgcgttcaactatccactaacagaggagaagtggaatgttgaacgcaaacctggcggcagcgcaaaagatg

SEQ ID NO: 12804 - DNA, 103 bp, Artificial Sequence
  Synthetic Polynucleotide
taatacgactcactatagggcagtggaatagctgtcttgcgttcaactataacagaggagaatagttatgcgcaagacaaacctggcggcagcgcaaaagatg

SEQ ID NO: 12805 - DNA, 103 bp, Artificial Sequence
  Synthetic Polynucleotide
taatacgactcactatagggacccacagtggaatagctgtcttgcgttcaaacagaggagatgaacgatggacagctataacctggcggcagcgcaaaagatg

SEQ ID NO: 12806 - DNA, 103 bp, Artificial Sequence
  Synthetic Polynucleotide
taatacgactcactatagggagatgacccacagtggaatagctgtcttgcaacagaggagagcaagaatgctattccacaacctggcggcagcgcaaaagatg

SEQ ID NO: 12807 - DNA, 103 bp, Artificial Sequence
  Synthetic Polynucleotide
taatacgactcactatagggagggtagatgacccacagtggaatagctgtaacagaggagaacagctatgccactgtggaacctggcggcagcgcaaaagatg

SEQ ID NO: 12808 - DNA, 103 bp, Artificial Sequence
  Synthetic Polynucleotide
taatacgactcactatagggtctagagggtagatgacccacagtggaataaacagaggagatattccatggtgggtcataacctggcggcagcgcaaaagatg

SEQ ID NO: 12809 - DNA, 103 bp, Artificial Sequence
  Synthetic Polynucleotide
taatacgactcactataggggaccttctagagggtagatgacccacagtgaacagaggagacactgtatgtcatctaccaacctggcggcagcgcaaaagatg

SEQ ID NO: 12810 - DNA, 103 bp, Artificial Sequence
  Synthetic Polynucleotide
taatacgactcactatagggactttgaccttctagagggtagatgacccaaacagaggagatgggtcatgtaccctctaaacctggcggcagcgcaaaagatg

SEQ ID NO: 12811 - DNA, 103 bp, Artificial Sequence
  Synthetic Polynucleotide
taatacgactcactataggggtagtgtgaccatggctgttgtctgctggaaacagaggagatccagcatgcaacagccaaacctggcggcagcgcaaaagatg

SEQ ID NO: 12812 - DNA, 103 bp, Artificial Sequence
  Synthetic Polynucleotide
taatacgactcactatagggctaggactttgaccttctagagggtagatgaacagaggagacatctaatgtctagaaggaacctggcggcagcgcaaaagatg

SEQ ID NO: 12813 - DNA, 103 bp, Artificial Sequence
  Synthetic Polynucleotide
taatacgactcactatagggtcggactaggactttgaccttctagagggtaacagaggagaaccctcatgaaggtcaaaaacctggcggcagcgcaaaagatg

SEQ ID NO: 12814 - DNA, 103 bp, Artificial Sequence
  Synthetic Polynucleotide
taatacgactcactataggggttgatcggactaggactttgaccttctagaacagaggagactagaaatgcaaagtcctaacctggcggcagcgcaaaagatg

SEQ ID NO: 12815 - DNA, 103 bp, Artificial Sequence
  Synthetic Polynucleotide
taatacgactcactatagggaaactgttgatcggactaggactttgacctaacagaggagaaggtcaatgtcctagtccaacctggcggcagcgcaaaagatg

SEQ ID NO: 12816 - DNA, 103 bp, Artificial Sequence
  Synthetic Polynucleotide
taatacgactcactataggggtagaaaactgttgatcggactaggactttaacagaggagaaaagtcatggtccgatcaaacctggcggcagcgcaaaagatg

SEQ ID NO: 12817 - DNA, 103 bp, Artificial Sequence
  Synthetic Polynucleotide
taatacgactcactataggggtggtgtagaaaactgttgatcggactaggaacagaggagacctagtatgatcaacagtaacctggcggcagcgcaaaagatg

SEQ ID NO: 12818 - DNA, 103 bp, Artificial Sequence
  Synthetic Polynucleotide
taatacgactcactatagggatgacgtggtgtagaaaactgttgatcggaaacagaggagatccgatatgcagttttctaacctggcggcagcgcaaaagatg

SEQ ID NO: 12819 - DNA, 103 bp, Artificial Sequence
  Synthetic Polynucleotide
taatacgactcactatagggatgcgatgacgtggtgtagaaaactgttgaaacagaggagatcaacaatgttctacaccaacctggcggcagcgcaaaagatg

SEQ ID NO: 12820 - DNA, 103 bp, Artificial Sequence
  Synthetic Polynucleotide
taatacgactcactatagggcaacaatgcgatgacgtggtgtagaaaactaacagaggagaagttttatgcaccacgtcaacctggcggcagcgcaaaagatg

SEQ ID NO: 12821 - DNA, 103 bp, Artificial Sequence
  Synthetic Polynucleotide
taatacgactcactatagggtgttgcaacaatgcgatgacgtggtgtagaaacagaggagatctacaatgcgtcatcgcaacctggcggcagcgcaaaagatg

SEQ ID NO: 12822 - DNA, 103 bp, Artificial Sequence
  Synthetic Polynucleotide
taatacgactcactatagggcttccgtagtgtgaccatggctgttgtctgaacagaggagacagacaatggccatggtcaacctggcggcagcgcaaaagatg

SEQ ID NO: 12823 - DNA, 103 bp, Artificial Sequence
  Synthetic Polynucleotide
taatacgactcactatagggactcatgttgcaacaatgcgatgacgtggtaacagaggagaaccacgatgtcgcattgtaacctggcggcagcgcaaaagatg

SEQ ID NO: 12824 - DNA, 103 bp, Artificial Sequence
  Synthetic Polynucleotide
taatacgactcactatagggggaggactcatgttgcaacaatgcgatgacaacagaggagagtcatcatgttgttgcaaaacctggcggcagcgcaaaagatg

SEQ ID NO: 12825 - DNA, 103 bp, Artificial Sequence
  Synthetic Polynucleotide
taatacgactcactatagggtcgtgggaggactcatgttgcaacaatgcgaacagaggagacgcattatggcaacatgaaacctggcggcagcgcaaaagatg

SEQ ID NO: 12826 - DNA, 103 bp, Artificial Sequence
  Synthetic Polynucleotide
taatacgactcactatagggcatgatcgtgggaggactcatgttgcaacaaacagaggagatgttgcatgatgagtcctaacctggcggcagcgcaaaagatg

SEQ ID NO: 12827 - DNA, 103 bp, Artificial Sequence
  Synthetic Polynucleotide
taatacgactcactatagggacaaacatgatcgtgggaggactcatgttgaacagaggagacaacatatgtcctcccacaacctggcggcagcgcaaaagatg

SEQ ID NO: 12828 - DNA, 103 bp, Artificial Sequence
  Synthetic Polynucleotide
taatacgactcactataggggcagcacaaacatgatcgtgggaggactcaaacagaggagatgagtcatgccacgatcaaacctggcggcagcgcaaaagatg

SEQ ID NO: 12829 - DNA, 103 bp, Artificial Sequence
  Synthetic Polynucleotide
taatacgactcactatagggcttctgcagcacaaacatgatcgtgggaggaacagaggagacctcccatgatcatgtttaacctggcggcagcgcaaaagatg

SEQ ID NO: 12830 - DNA, 103 bp, Artificial Sequence
  Synthetic Polynucleotide
taatacgactcactataggggtgggcttctgcagcacaaacatgatcgtgaacagaggagacacgatatggtttgtgctaacctggcggcagcgcaaaagatg

SEQ ID NO: 12831 - DNA, 103 bp, Artificial Sequence
  Synthetic Polynucleotide
taatacgactcactatagggcgactgtgggcttctgcagcacaaacatgaaacagaggagatcatgtatgtgctgcagaaacctggcggcagcgcaaaagatg

SEQ ID NO: 12832 - DNA, 103 bp, Artificial Sequence
  Synthetic Polynucleotide
taatacgactcactatagggccactcgactgtgggcttctgcagcacaaaaacagaggagatttgtgatgcagaagcccaacctggcggcagcgcaaaagatg

SEQ ID NO: 12833 - DNA, 103 bp, Artificial Sequence
  Synthetic Polynucleotide
taatacgactcactatagggctttccttccgtagtgtgaccatggctgttaacagaggagaaacagcatgggtcacactaacctggcggcagcgcaaaagatg

SEQ ID NO: 12834 - DNA, 103 bp, Artificial Sequence
  Synthetic Polynucleotide
taatacgactcactatagggtgtctccactcgactgtgggcttctgcagcaacagaggagagctgcaatggcccacagtaacctggcggcagcgcaaaagatg

SEQ ID NO: 12835 - DNA, 103 bp, Artificial Sequence
  Synthetic Polynucleotide
taatacgactcactatagggtcaaatgtctccactcgactgtgggcttctaacagaggagaagaagcatgcagtcgagtaacctggcggcagcgcaaaagatg

SEQ ID NO: 12836 - DNA, 103 bp, Artificial Sequence
  Synthetic Polynucleotide
taatacgactcactatagggaattatcaaatgtctccactcgactgtgggaacagaggagacccacaatggagtggagaaacctggcggcagcgcaaaagatg

SEQ ID NO: 12837 - DNA, 103 bp, Artificial Sequence
  Synthetic Polynucleotide
taatacgactcactatagggaactaaattatcaaatgtctccactcgactaacagaggagaagtcgaatggagacatttaacctggcggcagcgcaaaagatg

SEQ ID NO: 12838 - DNA, 103 bp, Artificial Sequence
  Synthetic Polynucleotide
taatacgactcactatagggatataaactaaattatcaaatgtctccactaacagaggagaagtggaatgatttgataaaacctggcggcagcgcaaaagatg

SEQ ID NO: 12839 - DNA, 103 bp, Artificial Sequence
  Synthetic Polynucleotide
taatacgactcactatagggtacacatataaactaaattatcaaatgtctaacagaggagaagacatatgataatttagaacctggcggcagcgcaaaagatg

SEQ ID NO: 12840 - DNA, 103 bp, Artificial Sequence
  Synthetic Polynucleotide
taatacgactcactataggggcttttacacatataaactaaattatcaaaaacagaggagatttgatatgttagtttataacctggcggcagcgcaaaagatg

SEQ ID NO: 12841 - DNA, 103 bp, Artificial Sequence
  Synthetic Polynucleotide
taatacgactcactataggggctgtgcttttacacatataaactaaattaaacagaggagataatttatgttatatgtgaacctggcggcagcgcaaaagatg

SEQ ID NO: 12842 - DNA, 103 bp, Artificial Sequence
  Synthetic Polynucleotide
taatacgactcactatagggtacttgctgtgcttttacacatataaactaaacagaggagatagtttatgtgtgtaaaaaacctggcggcagcgcaaaagatg

SEQ ID NO: 12843 - DNA, 103 bp, Artificial Sequence
  Synthetic Polynucleotide
taatacgactcactataggggaagttacttgctgtgcttttacacatataaacagaggagatatatgatgaaaagcacaaacctggcggcagcgcaaaagatg

SEQ ID NO: 12844 - DNA, 103 bp, Artificial Sequence
  Synthetic Polynucleotide
taatacgactcactatagggctagcctttccttccgtagtgtgaccatggaacagaggagaccatggatgcactacggaaacctggcggcagcgcaaaagatg

SEQ ID NO: 12845 - DNA, 103 bp, Artificial Sequence
  Synthetic Polynucleotide
taatacgactcactatagggtgaaagaagttacttgctgtgcttttacacaacagaggagagtgtaaatgcacagcaagaacctggcggcagcgcaaaagatg

SEQ ID NO: 12846 - DNA, 103 bp, Artificial Sequence
  Synthetic Polynucleotide
taatacgactcactatagggaagcatgaaagaagttacttgctgtgctttaacagaggagaaaagcaatgcaagtaactaacctggcggcagcgcaaaagatg

SEQ ID NO: 12847 - DNA, 103 bp, Artificial Sequence
  Synthetic Polynucleotide
taatacgactcactatagggtaatgaagcatgaaagaagttacttgctgtaacagaggagaacagcaatgaacttctttaacctggcggcagcgcaaaagatg

SEQ ID NO: 12848 - DNA, 103 bp, Artificial Sequence
  Synthetic Polynucleotide
taatacgactcactatagggtatgctaatgaagcatgaaagaagttacttaacagaggagaaagtaaatgctttcatgcaacctggcggcagcgcaaaagatg

SEQ ID NO: 12849 - DNA, 103 bp, Artificial Sequence
  Synthetic Polynucleotide
taatacgactcactatagggtccagtatgctaatgaagcatgaaagaagtaacagaggagaacttctatgatgcttcataacctggcggcagcgcaaaagatg

SEQ ID NO: 12850 - DNA, 103 bp, Artificial Sequence
  Synthetic Polynucleotide
taatacgactcactatagggacttctccagtatgctaatgaagcatgaaaaacagaggagatttcatatgtcattagcaaacctggcggcagcgcaaaagatg

SEQ ID NO: 12851 - DNA, 103 bp, Artificial Sequence
  Synthetic Polynucleotide
taatacgactcactataggggatcgacttctccagtatgctaatgaagcaaacagaggagatgcttcatgagcatactgaacctggcggcagcgcaaaagatg

SEQ ID NO: 12852 - DNA, 103 bp, Artificial Sequence
  Synthetic Polynucleotide
taatacgactcactatagggttttagatcgacttctccagtatgctaatgaacagaggagacattagatgactggagaaaacctggcggcagcgcaaaagatg

SEQ ID NO: 12853 - DNA, 103 bp, Artificial Sequence
  Synthetic Polynucleotide
taatacgactcactatagggttgatttttagatcgacttctccagtatgcaacagaggagagcatacatgagaagtcgaaacctggcggcagcgcaaaagatg

SEQ ID NO: 12854 - DNA, 103 bp, Artificial Sequence
  Synthetic Polynucleotide
taatacgactcactatagggttgtcttgatttttagatcgacttctccagaacagaggagactggagatgtcgatctaaaacctggcggcagcgcaaaagatg

SEQ ID NO: 12855 - DNA, 103 bp, Artificial Sequence
  Synthetic Polynucleotide
taatacgactcactatagggttggactgtctttgcccccactggggaatgaacagaggagacattccatggtgggggcaaacctggcggcagcgcaaaagatg

SEQ ID NO: 12856 - DNA, 103 bp, Artificial Sequence
  Synthetic Polynucleotide
taatacgactcactatagggcttggctagcctttccttccgtagtgtgacaacagaggagagtcacaatgcggaaggaaaacctggcggcagcgcaaaagatg

SEQ ID NO: 12857 - DNA, 103 bp, Artificial Sequence
  Synthetic Polynucleotide
taatacgactcactatagggctcttttgtcttgatttttagatcgacttcaacagaggagagaagtcatgctaaaaatcaacctggcggcagcgcaaaagatg

SEQ ID NO: 12858 - DNA, 103 bp, Artificial Sequence
  Synthetic Polynucleotide
taatacgactcactatagggcatctctcttttgtcttgatttttagatcgaacagaggagacgatctatgaatcaagacaacctggcggcagcgcaaaagatg

SEQ ID NO: 12859 - DNA, 103 bp, Artificial Sequence
  Synthetic Polynucleotide
taatacgactcactatagggtttgtcatctctcttttgtcttgatttttaaacagaggagataaaaaatgagacaaaagaacctggcggcagcgcaaaagatg

SEQ ID NO: 12860 - DNA, 103 bp, Artificial Sequence
  Synthetic Polynucleotide
taatacgactcactatagggatatctttgtcatctctcttttgtcttgataacagaggagaatcaagatgaaagagagaaacctggcggcagcgcaaaagatg

SEQ ID NO: 12861 - DNA, 103 bp, Artificial Sequence
  Synthetic Polynucleotide
taatacgactcactatagggagataatatctttgtcatctctcttttgtcaacagaggagagacaaaatggagatgacaaacctggcggcagcgcaaaagatg

SEQ ID NO: 12862 - DNA, 103 bp, Artificial Sequence
  Synthetic Polynucleotide
taatacgactcactataggggtcaaagataatatctttgtcatctctcttaacagaggagaaagagaatggacaaagataacctggcggcagcgcaaaagatg

SEQ ID NO: 12863 - DNA, 103 bp, Artificial Sequence
  Synthetic Polynucleotide
taatacgactcactatagggtttgcgtcaaagataatatctttgtcatctaacagaggagaagatgaatgagatattataacctggcggcagcgcaaaagatg

SEQ ID NO: 12864 - DNA, 103 bp, Artificial Sequence
  Synthetic Polynucleotide
taatacgactcactatagggttccgtttgcgtcaaagataatatctttgtaacagaggagaacaaagatgttatctttgaacctggcggcagcgcaaaagatg

SEQ ID NO: 12865 - DNA, 103 bp, Artificial Sequence
  Synthetic Polynucleotide
taatacgactcactatagggttcttttccgtttgcgtcaaagataatatcaacagaggagagatattatgtttgacgcaaacctggcggcagcgcaaaagatg

SEQ ID NO: 12866 - DNA, 103 bp, Artificial Sequence
  Synthetic Polynucleotide
taatacgactcactatagggaatttttcttttccgtttgcgtcaaagataaacagaggagatatcttatgcgcaaacggaacctggcggcagcgcaaaagatg

SEQ ID NO: 12867 - DNA, 103 bp, Artificial Sequence
  Synthetic Polynucleotide
taatacgactcactataggggtgagcttggctagcctttccttccgtagtaacagaggagaactacgatgggaaaggctaacctggcggcagcgcaaaagatg

SEQ ID NO: 12868 - DNA, 103 bp, Artificial Sequence
  Synthetic Polynucleotide
taatacgactcactataggggaatgaatttttcttttccgtttgcgtcaaaacagaggagattgacgatgacggaaaagaacctggcggcagcgcaaaagatg

SEQ ID NO: 12869 - DNA, 103 bp, Artificial Sequence
  Synthetic Polynucleotide
taatacgactcactatagggtagccgaatgaatttttcttttccgtttgcaacagaggagagcaaacatgaaagaaaaaaacctggcggcagcgcaaaagatg

SEQ ID NO: 12870 - DNA, 103 bp, Artificial Sequence
  Synthetic Polynucleotide
taatacgactcactatagggctgtatagccgaatgaatttttcttttccgaacagaggagacggaaaatgaaaattcataacctggcggcagcgcaaaagatg

SEQ ID NO: 12871 - DNA, 103 bp, Artificial Sequence
  Synthetic Polynucleotide
taatacgactcactatagggatgtgctgtatagccgaatgaatttttcttaacagaggagaaagaaaatgtcattcggcaacctggcggcagcgcaaaagatg

SEQ ID NO: 12872 - DNA, 103 bp, Artificial Sequence
  Synthetic Polynucleotide
taatacgactcactatagggtctggatgtgctgtatagccgaatgaatttaacagaggagaaaattcatgcggctatacaacctggcggcagcgcaaaagatg

SEQ ID NO: 12873 - DNA, 103 bp, Artificial Sequence
  Synthetic Polynucleotide
taatacgactcactatagggtgctttctggatgtgctgtatagccgaatgaacagaggagacattcgatgatacagcacaacctggcggcagcgcaaaagatg

SEQ ID NO: 12874 - DNA, 103 bp, Artificial Sequence
  Synthetic Polynucleotide
taatacgactcactatagggagcagtgctttctggatgtgctgtatagccaacagaggagaggctatatggcacatccaaacctggcggcagcgcaaaagatg

SEQ ID NO: 12875 - DNA, 103 bp, Artificial Sequence
  Synthetic Polynucleotide
taatacgactcactatagggagaacagcagtgctttctggatgtgctgtaaacagaggagatacagcatgtccagaaagaacctggcggcagcgcaaaagatg

SEQ ID NO: 12876 - DNA, 103 bp, Artificial Sequence
  Synthetic Polynucleotide
taatacgactcactatagggaaccaagaacagcagtgctttctggatgtgaacagaggagacacatcatgaaagcactgaacctggcggcagcgcaaaagatg

SEQ ID NO: 12877 - DNA, 103 bp, Artificial Sequence
  Synthetic Polynucleotide
taatacgactcactataggggagggaaccaagaacagcagtgctttctggaacagaggagaccagaaatgactgctgttaacctggcggcagcgcaaaagatg

SEQ ID NO: 12878 - DNA, 103 bp, Artificial Sequence
  Synthetic Polynucleotide
taatacgactcactatagggcctcagtgagcttggctagcctttccttccaacagaggagaggaaggatgggctagccaaacctggcggcagcgcaaaagatg

SEQ ID NO: 12879 - DNA, 103 bp, Artificial Sequence
  Synthetic Polynucleotide
taatacgactcactataggggtctggagggaaccaagaacagcagtgcttaacagaggagaaagcacatgtgttcttggaacctggcggcagcgcaaaagatg

SEQ ID NO: 12880 - DNA, 103 bp, Artificial Sequence
  Synthetic Polynucleotide
taatacgactcactatagggggctggtctggagggaaccaagaacagcagaacagaggagactgctgatgttggttcccaacctggcggcagcgcaaaagatg

SEQ ID NO: 12881 - DNA, 103 bp, Artificial Sequence
  Synthetic Polynucleotide
taatacgactcactatagggagcaaggctggtctggagggaaccaagaacaacagaggagagttcttatgtccctccagaacctggcggcagcgcaaaagatg

SEQ ID NO: 12882 - DNA, 103 bp, Artificial Sequence
  Synthetic Polynucleotide
taatacgactcactatagggggtggagcaaggctggtctggagggaaccaaacagaggagatggttcatgccagaccagaacctggcggcagcgcaaaagatg

SEQ ID NO: 12883 - DNA, 103 bp, Artificial Sequence
  Synthetic Polynucleotide
taatacgactcactatagggatggaggtggagcaaggctggtctggagggaacagaggagaccctccatgccagccttgaacctggcggcagcgcaaaagatg

SEQ ID NO: 12884 - DNA, 103 bp, Artificial Sequence
  Synthetic Polynucleotide
taatacgactcactatagggagcagatggaggtggagcaaggctggtctgaacagaggagacagaccatgcttgctccaaacctggcggcagcgcaaaagatg

SEQ ID NO: 12885 - DNA, 103 bp, Artificial Sequence
  Synthetic Polynucleotide
taatacgactcactatagggtcgtcagcagatggaggtggagcaaggctgaacagaggagacagcctatgtccacctccaacctggcggcagcgcaaaagatg

SEQ ID NO: 12886 - DNA, 103 bp, Artificial Sequence
  Synthetic Polynucleotide
taatacgactcactatagggtagcctcgtcagcagatggaggtggagcaaaacagaggagattgctcatgctccatctgaacctggcggcagcgcaaaagatg

SEQ ID NO: 12887 - DNA, 103 bp, Artificial Sequence
  Synthetic Polynucleotide
taatacgactcactatagggatatgtagcctcgtcagcagatggaggtggaacagaggagaccacctatgtctgctgacaacctggcggcagcgcaaaagatg

SEQ ID NO: 12888 - DNA, 103 bp, Artificial Sequence
  Synthetic Polynucleotide
taatacgactcactatagggctatcatatgtagcctcgtcagcagatggaaacagaggagatccatcatgtgacgaggcaacctggcggcagcgcaaaagatg

SEQ ID NO: 12889 - DNA, 103 bp, Artificial Sequence
  Synthetic Polynucleotide
taatacgactcactataggggattgcctcagtgagcttggctagcctttcaacagaggagagaaaggatggccaagctcaacctggcggcagcgcaaaagatg

SEQ ID NO: 12890 - DNA, 103 bp, Artificial Sequence
  Synthetic Polynucleotide
taatacgactcactatagggttttcctatcatatgtagcctcgtcagcagaacagaggagactgctgatgaggctacataacctggcggcagcgcaaaagatg

SEQ ID NO: 12891 - DNA, 103 bp, Artificial Sequence
  Synthetic Polynucleotide
taatacgactcactatagggtttgtttttcctatcatatgtagcctcgtcaacagaggagagacgagatgacatatgataacctggcggcagcgcaaaagatg

SEQ ID NO: 12892 - DNA, 103 bp, Artificial Sequence
  Synthetic Polynucleotide
taatacgactcactatagggaaaactttgtttttcctatcatatgtagccaacagaggagaggctacatgtgataggaaaacctggcggcagcgcaaaagatg

SEQ ID NO: 12893 - DNA, 103 bp, Artificial Sequence
  Synthetic Polynucleotide
taatacgactcactatagggctttcaaaactttgtttttcctatcatatgaacagaggagacatatgatgggaaaaacaaacctggcggcagcgcaaaagatg

SEQ ID NO: 12894 - DNA, 103 bp, Artificial Sequence
  Synthetic Polynucleotide
taatacgactcactatagggggaagctttcaaaactttgtttttcctatcaacagaggagagataggatgaacaaagttaacctggcggcagcgcaaaagatg

SEQ ID NO: 12895 - DNA, 103 bp, Artificial Sequence
  Synthetic Polynucleotide
taatacgactcactatagggggtctggaagctttcaaaactttgtttttcaacagaggagagaaaaaatgagttttgaaaacctggcggcagcgcaaaagatg

SEQ ID NO: 12896 - DNA, 103 bp, Artificial Sequence
  Synthetic Polynucleotide
taatacgactcactatagggtgccaggtctggaagctttcaaaactttgtaacagaggagaacaaagatgtgaaagcttaacctggcggcagcgcaaaagatg

SEQ ID NO: 12897 - DNA, 103 bp, Artificial Sequence
  Synthetic Polynucleotide
taatacgactcactatagggatacttgccaggtctggaagctttcaaaacaacagaggagagttttgatggcttccagaaacctggcggcagcgcaaaagatg

SEQ ID NO: 12898 - DNA, 103 bp, Artificial Sequence
  Synthetic Polynucleotide
taatacgactcactatagggtgggaatacttgccaggtctggaagctttcaacagaggagagaaagcatgcagacctggaacctggcggcagcgcaaaagatg

SEQ ID NO: 12899 - DNA, 103 bp, Artificial Sequence
  Synthetic Polynucleotide
taatacgactcactatagggtattctgggaatacttgccaggtctggaagaacagaggagacttccaatgctggcaagtaacctggcggcagcgcaaaagatg

SEQ ID NO: 12900 - DNA, 103 bp, Artificial Sequence
  Synthetic Polynucleotide
taatacgactcactataggggaggtgattgcctcagtgagcttggctagcaacagaggagagctagcatggctcactgaaacctggcggcagcgcaaaagatg

SEQ ID NO: 12901 - DNA, 103 bp, Artificial Sequence
  Synthetic Polynucleotide
taatacgactcactatagggggttgtattctgggaatacttgccaggtctaacagaggagaagacctatgaagtattccaacctggcggcagcgcaaaagatg

SEQ ID NO: 12902 - DNA, 103 bp, Artificial Sequence
  Synthetic Polynucleotide
taatacgactcactataggggctttggttgtattctgggaatacttgccaaacagaggagatggcaaatgttcccagaaaacctggcggcagcgcaaaagatg

SEQ ID NO: 12903 - DNA, 103 bp, Artificial Sequence
  Synthetic Polynucleotide
taatacgactcactataggggtggggctttggttgtattctgggaatactaacagaggagaagtattatgagaatacaaaacctggcggcagcgcaaaagatg

SEQ ID NO: 12904 - DNA, 103 bp, Artificial Sequence
  Synthetic Polynucleotide
taatacgactcactataggggttgggtggggctttggttgtattctgggaaacagaggagatcccagatgacaaccaaaaacctggcggcagcgcaaaagatg

SEQ ID NO: 12905 - DNA, 103 bp, Artificial Sequence
  Synthetic Polynucleotide
taatacgactcactataggggtttggttgggtggggctttggttgtattcaacagaggagagaatacatgcaaagccccaacctggcggcagcgcaaaagatg

SEQ ID NO: 12906 - DNA, 103 bp, Artificial Sequence
  Synthetic Polynucleotide
taatacgactcactatagggaactggtttggttgggtggggctttggttgaacagaggagacaaccaatgccccacccaaacctggcggcagcgcaaaagatg

SEQ ID NO: 12907 - DNA, 103 bp, Artificial Sequence
  Synthetic Polynucleotide
taatacgactcactataggggcgacaactggtttggttgggtggggctttaacagaggagaaaagccatgcccaaccaaaacctggcggcagcgcaaaagatg

SEQ ID NO: 12908 - DNA, 103 bp, Artificial Sequence
  Synthetic Polynucleotide
taatacgactcactatagggacatcgcgacaactggtttggttgggtgggaacagaggagacccaccatgccaaaccagaacctggcggcagcgcaaaagatg

SEQ ID NO: 12909 - DNA, 103 bp, Artificial Sequence
  Synthetic Polynucleotide
taatacgactcactataggggagatacatcgcgacaactggtttggttggaacagaggagaccaaccatgccagttgtcaacctggcggcagcgcaaaagatg

SEQ ID NO: 12910 - DNA, 103 bp, Artificial Sequence
  Synthetic Polynucleotide
taatacgactcactatagggattgggagatacatcgcgacaactggtttgaacagaggagacaaaccatgtgtcgcgataacctggcggcagcgcaaaagatg

SEQ ID NO: 12911 - DNA, 103 bp, Artificial Sequence
  Synthetic Polynucleotide
taatacgactcactatagggatgtggaggtgattgcctcagtgagcttggaacagaggagaccaagcatgctgaggcaaaacctggcggcagcgcaaaagatg

SEQ ID NO: 12912 - DNA, 103 bp, Artificial Sequence
  Synthetic Polynucleotide
taatacgactcactataggggtgatattgggagatacatcgcgacaactgaacagaggagacagttgatgcgatgtatcaacctggcggcagcgcaaaagatg

SEQ ID NO: 12913 - DNA, 103 bp, Artificial Sequence
  Synthetic Polynucleotide
taatacgactcactatagggtgcctgtgatattgggagatacatcgcgacaacagaggagagtcgcgatgtatctcccaaacctggcggcagcgcaaaagatg

SEQ ID NO: 12914 - DNA, 103 bp, Artificial Sequence
  Synthetic Polynucleotide
taatacgactcactatagggatctgtgcctgtgatattgggagatacatcaacagaggagagatgtaatgcccaatatcaacctggcggcagcgcaaaagatg

SEQ ID NO: 12915 - DNA, 103 bp, Artificial Sequence
  Synthetic Polynucleotide
taatacgactcactatagggcacccatctgtgcctgtgatattgggagataacagaggagaatctccatgtatcacaggaacctggcggcagcgcaaaagatg

SEQ ID NO: 12916 - DNA, 103 bp, Artificial Sequence
  Synthetic Polynucleotide
taatacgactcactatagggaagggcacccatctgtgcctgtgatattggaacagaggagaccaataatgcaggcacagaacctggcggcagcgcaaaagatg

SEQ ID NO: 12917 - DNA, 103 bp, Artificial Sequence
  Synthetic Polynucleotide
taatacgactcactatagggggcagaagggcacccatctgtgcctgtgataacagaggagaatcacaatgacagatgggaacctggcggcagcgcaaaagatg

SEQ ID NO: 12918 - DNA, 103 bp, Artificial Sequence
  Synthetic Polynucleotide
taatacgactcactatagggtcattggcagaagggcacccatctgtgcctaacagaggagaaggcacatgtgggtgcccaacctggcggcagcgcaaaagatg

SEQ ID NO: 12919 - DNA, 103 bp, Artificial Sequence
  Synthetic Polynucleotide
taatacgactcactatagggaaccctcattggcagaagggcacccatctgaacagaggagacagatgatggcccttctgaacctggcggcagcgcaaaagatg

SEQ ID NO: 12920 - DNA, 103 bp, Artificial Sequence
  Synthetic Polynucleotide
taatacgactcactataggggttagaaccctcattggcagaagggcacccaacagaggagagggtgcatgtctgccaataacctggcggcagcgcaaaagatg

SEQ ID NO: 12921 - DNA, 103 bp, Artificial Sequence
  Synthetic Polynucleotide
taatacgactcactatagggttgctgttagaaccctcattggcagaagggaacagaggagacccttcatgcaatgagggaacctggcggcagcgcaaaagatg

SEQ ID NO: 12922 - DNA, 103 bp, Artificial Sequence
  Synthetic Polynucleotide
taatacgactcactatagggaagggatgtggaggtgattgcctcagtgagaacagaggagactcactatggcaatcaccaacctggcggcagcgcaaaagatg

SEQ ID NO: 12923 - DNA, 103 bp, Artificial Sequence
  Synthetic Polynucleotide
taatacgactcactatagggtgttattgctgttagaaccctcattggcagaacagaggagactgccaatgagggttctaaacctggcggcagcgcaaaagatg

SEQ ID NO: 12924 - DNA, 103 bp, Artificial Sequence
  Synthetic Polynucleotide
taatacgactcactatagggattattgttattgctgttagaaccctcattaacagaggagaaatgagatgtctaacagcaacctggcggcagcgcaaaagatg

SEQ ID NO: 12925 - DNA, 103 bp, Artificial Sequence
  Synthetic Polynucleotide
taatacgactcactatagggactaaattattgttattgctgttagaacccaacagaggagagggttcatgcagcaataaaacctggcggcagcgcaaaagatg

SEQ ID NO: 12926 - DNA, 103 bp, Artificial Sequence
  Synthetic Polynucleotide
taatacgactcactataggggcgagactaaattattgttattgctgttagaacagaggagactaacaatgataacaataaacctggcggcagcgcaaaagatg

SEQ ID NO: 12927 - DNA, 103 bp, Artificial Sequence
  Synthetic Polynucleotide
taatacgactcactatagggtctgtgcgagactaaattattgttattgctaacagaggagaagcaatatgaataatttaaacctggcggcagcgcaaaagatg

SEQ ID NO: 12928 - DNA, 103 bp, Artificial Sequence
  Synthetic Polynucleotide
taatacgactcactatagggacaattctgtgcgagactaaattattgttaaacagaggagataacaaatgtttagtctcaacctggcggcagcgcaaaagatg

SEQ ID NO: 12929 - DNA, 103 bp, Artificial Sequence
  Synthetic Polynucleotide
taatacgactcactataggggcagtacaattctgtgcgagactaaattataacagaggagaataattatgtctcgcacaaacctggcggcagcgcaaaagatg

SEQ ID NO: 12930 - DNA, 103 bp, Artificial Sequence
  Synthetic Polynucleotide
taatacgactcactatagggaaacggcagtacaattctgtgcgagactaaaacagaggagattagtcatgcacagaattaacctggcggcagcgcaaaagatg

SEQ ID NO: 12931 - DNA, 103 bp, Artificial Sequence
  Synthetic Polynucleotide
taatacgactcactataggggtaaaaaacggcagtacaattctgtgcgagaacagaggagactcgcaatgaattgtactaacctggcggcagcgcaaaagatg

SEQ ID NO: 12932 - DNA, 103 bp, Artificial Sequence
  Synthetic Polynucleotide
taatacgactcactatagggacaatgtaaaaaacggcagtacaattctgtaacagaggagaacagaaatgtactgccgtaacctggcggcagcgcaaaagatg

SEQ ID NO: 12933 - DNA, 103 bp, Artificial Sequence
  Synthetic Polynucleotide
taatacgactcactatagggttgagaagggatgtggaggtgattgcctcaaacagaggagatgaggcatgcacctccacaacctggcggcagcgcaaaagatg

SEQ ID NO: 12934 - DNA, 103 bp, Artificial Sequence
  Synthetic Polynucleotide
taatacgactcactatagggatgagacaatgtaaaaaacggcagtacaataacagaggagaattgtaatgccgttttttaacctggcggcagcgcaaaagatg

SEQ ID NO: 12935 - DNA, 103 bp, Artificial Sequence
  Synthetic Polynucleotide
taatacgactcactatagggtaattatgagacaatgtaaaaaacggcagtaacagaggagaactgccatgttttacattaacctggcggcagcgcaaaagatg

SEQ ID NO: 12936 - DNA, 103 bp, Artificial Sequence
  Synthetic Polynucleotide
taatacgactcactatagggcgttataattatgagacaatgtaaaaaacgaacagaggagacgttttatgcattgtctcaacctggcggcagcgcaaaagatg

SEQ ID NO: 12937 - DNA, 103 bp, Artificial Sequence
  Synthetic Polynucleotide
taatacgactcactatagggtctttcgttataattatgagacaatgtaaaaacagaggagatttacaatgtctcataataacctggcggcagcgcaaaagatg

SEQ ID NO: 12938 - DNA, 103 bp, Artificial Sequence
  Synthetic Polynucleotide
taatacgactcactataggggagggtctttcgttataattatgagacaataacagaggagaattgtcatgtaattataaaacctggcggcagcgcaaaagatg

SEQ ID NO: 12939 - DNA, 103 bp, Artificial Sequence
  Synthetic Polynucleotide
taatacgactcactatagggtgatagagggtctttcgttataattatgagaacagaggagactcataatgataacgaaaaacctggcggcagcgcaaaagatg

SEQ ID NO: 12940 - DNA, 103 bp, Artificial Sequence
  Synthetic Polynucleotide
taatacgactcactatagggctttctgatagagggtctttcgttataattaacagaggagaaattatatggaaagacccaacctggcggcagcgcaaaagatg

SEQ ID NO: 12941 - DNA, 103 bp, Artificial Sequence
  Synthetic Polynucleotide
taatacgactcactatagggtcagactttctgatagagggtctttcgttaaacagaggagataacgaatgaccctctataacctggcggcagcgcaaaagatg

SEQ ID NO: 12942 - DNA, 103 bp, Artificial Sequence
  Synthetic Polynucleotide
taatacgactcactatagggtcccctcagactttctgatagagggtctttaacagaggagaaaagacatgctatcagaaaacctggcggcagcgcaaaagatg

SEQ ID NO: 12943 - DNA, 103 bp, Artificial Sequence
  Synthetic Polynucleotide
taatacgactcactatagggtgttgtcccctcagactttctgatagagggaacagaggagaccctctatgagaaagtctaacctggcggcagcgcaaaagatg

SEQ ID NO: 12944 - DNA, 103 bp, Artificial Sequence
  Synthetic Polynucleotide
taatacgactcactatagggctgtcttgagaagggatgtggaggtgattgaacagaggagacaatcaatgccacatcccaacctggcggcagcgcaaaagatg

SEQ ID NO: 12945 - DNA, 103 bp, Artificial Sequence
  Synthetic Polynucleotide
taatacgactcactatagggatctctgttgtcccctcagactttctgataaacagaggagatatcagatggtctgagggaacctggcggcagcgcaaaagatg

SEQ ID NO: 12946 - DNA, 103 bp, Artificial Sequence
  Synthetic Polynucleotide
taatacgactcactatagggttacaatctctgttgtcccctcagactttcaacagaggagagaaagtatgaggggacaaaacctggcggcagcgcaaaagatg

SEQ ID NO: 12947 - DNA, 103 bp, Artificial Sequence
  Synthetic Polynucleotide
taatacgactcactatagggaagccttacaatctctgttgtcccctcagaaacagaggagatctgagatgacaacagagaacctggcggcagcgcaaaagatg

SEQ ID NO: 12948 - DNA, 103 bp, Artificial Sequence
  Synthetic Polynucleotide
taatacgactcactatagggcgagtaagccttacaatctctgttgtccccaacagaggagaggggacatgagagattgtaacctggcggcagcgcaaaagatg

SEQ ID NO: 12949 - DNA, 103 bp, Artificial Sequence
  Synthetic Polynucleotide
taatacgactcactataggggctgccgagtaagccttacaatctctgttgaacagaggagacaacagatgttgtaaggcaacctggcggcagcgcaaaagatg

SEQ ID NO: 12950 - DNA, 103 bp, Artificial Sequence
  Synthetic Polynucleotide
taatacgactcactatagggcctcagctgccgagtaagccttacaatctcaacagaggagagagattatgaggcttactaacctggcggcagcgcaaaagatg

SEQ ID NO: 12951 - DNA, 103 bp, Artificial Sequence
  Synthetic Polynucleotide
taatacgactcactatagggattgccctcagctgccgagtaagccttacaaacagaggagatgtaagatgtactcggcaaacctggcggcagcgcaaaagatg

SEQ ID NO: 12952 - DNA, 103 bp, Artificial Sequence
  Synthetic Polynucleotide
taatacgactcactatagggctggtattgccctcagctgccgagtaagccaacagaggagaggcttaatgggcagctgaaacctggcggcagcgcaaaagatg

SEQ ID NO: 12953 - DNA, 103 bp, Artificial Sequence
  Synthetic Polynucleotide
taatacgactcactatagggggtgtctggtattgccctcagctgccgagtaacagaggagaactcggatgctgagggcaaacctggcggcagcgcaaaagatg

SEQ ID NO: 12954 - DNA, 103 bp, Artificial Sequence
  Synthetic Polynucleotide
taatacgactcactatagggattgtggtgtctggtattgccctcagctgcaacagaggagagcagctatgggcaataccaacctggcggcagcgcaaaagatg

SEQ ID NO: 12955 - DNA, 103 bp, Artificial Sequence
  Synthetic Polynucleotide
taatacgactcactatagggttttcctgtcttgagaagggatgtggaggtaacagaggagaacctccatgtcccttctcaacctggcggcagcgcaaaagatg

SEQ ID NO: 12956 - DNA, 103 bp, Artificial Sequence
  Synthetic Polynucleotide
taatacgactcactatagggaatatattgtggtgtctggtattgccctcaaacagaggagatgagggatgtaccagacaaacctggcggcagcgcaaaagatg

SEQ ID NO: 12957 - DNA, 103 bp, Artificial Sequence
  Synthetic Polynucleotide
taatacgactcactataggggcggcaatatattgtggtgtctggtattgcaacagaggagagcaataatggacaccacaaacctggcggcagcgcaaaagatg

SEQ ID NO: 12958 - DNA, 103 bp, Artificial Sequence
  Synthetic Polynucleotide
taatacgactcactataggggtgaagcggcaatatattgtggtgtctggtaacagaggagaaccagaatgcacaatataaacctggcggcagcgcaaaagatg

SEQ ID NO: 12959 - DNA, 103 bp, Artificial Sequence
  Synthetic Polynucleotide
taatacgactcactatagggttcccgtgaagcggcaatatattgtggtgtaacagaggagaacaccaatgtatattgccaacctggcggcagcgcaaaagatg

SEQ ID NO: 12960 - DNA, 103 bp, Artificial Sequence
  Synthetic Polynucleotide
taatacgactcactatagggaactattcccgtgaagcggcaatatattgtaacagaggagaacaataatgtgccgcttcaacctggcggcagcgcaaaagatg

SEQ ID NO: 12961 - DNA, 103 bp, Artificial Sequence
  Synthetic Polynucleotide
taatacgactcactataggggaagaaactattcccgtgaagcggcaatataacagaggagaatattgatgcttcacgggaacctggcggcagcgcaaaagatg

SEQ ID NO: 12962 - DNA, 103 bp, Artificial Sequence
  Synthetic Polynucleotide
taatacgactcactataggggcattgaagaaactattcccgtgaagcggcaacagaggagagccgctatgcgggaatagaacctggcggcagcgcaaaagatg

SEQ ID NO: 12963 - DNA, 103 bp, Artificial Sequence
  Synthetic Polynucleotide
taatacgactcactatagggatagtgcattgaagaaactattcccgtgaaaacagaggagattcacgatgatagtttctaacctggcggcagcgcaaaagatg

SEQ ID NO: 12964 - DNA, 103 bp, Artificial Sequence
  Synthetic Polynucleotide
taatacgactcactatagggagcttatagtgcattgaagaaactattcccaacagaggagagggaatatgttcttcaataacctggcggcagcgcaaaagatg

SEQ ID NO: 12965 - DNA, 103 bp, Artificial Sequence
  Synthetic Polynucleotide
taatacgactcactatagggcatcgagcttatagtgcattgaagaaactaaacagaggagatagtttatgcaatgcactaacctggcggcagcgcaaaagatg

SEQ ID NO: 12966 - DNA, 103 bp, Artificial Sequence
  Synthetic Polynucleotide
taatacgactcactataggggtcttttggactgtctttgcccccactgggaacagaggagacccagtatgggcaaagacaacctggcggcagcgcaaaagatg

SEQ ID NO: 12967 - DNA, 103 bp, Artificial Sequence
  Synthetic Polynucleotide
taatacgactcactatagggtactgttttcctgtcttgagaagggatgtgaacagaggagacacatcatgtctcaagacaacctggcggcagcgcaaaagatg

SEQ ID NO: 12968 - DNA, 103 bp, Artificial Sequence
  Synthetic Polynucleotide
taatacgactcactataggggacttcatcgagcttatagtgcattgaagaaacagaggagatcttcaatgcactataagaacctggcggcagcgcaaaagatg

SEQ ID NO: 12969 - DNA, 103 bp, Artificial Sequence
  Synthetic Polynucleotide
taatacgactcactatagggcaaaggacttcatcgagcttatagtgcattaacagaggagaaatgcaatgtaagctcgaaacctggcggcagcgcaaaagatg

SEQ ID NO: 12970 - DNA, 103 bp, Artificial Sequence
  Synthetic Polynucleotide
taatacgactcactatagggattcccaaaggacttcatcgagcttatagtaacagaggagaactataatgtcgatgaagaacctggcggcagcgcaaaagatg

SEQ ID NO: 12971 - DNA, 103 bp, Artificial Sequence
  Synthetic Polynucleotide
taatacgactcactatagggatcaaattcccaaaggacttcatcgagcttaacagaggagaaagctcatggaagtccttaacctggcggcagcgcaaaagatg

SEQ ID NO: 12972 - DNA, 103 bp, Artificial Sequence
  Synthetic Polynucleotide
taatacgactcactatagggaaattatcaaattcccaaaggacttcatcgaacagaggagacgatgaatgcctttgggaaacctggcggcagcgcaaaagatg

SEQ ID NO: 12973 - DNA, 103 bp, Artificial Sequence
  Synthetic Polynucleotide
taatacgactcactatagggacttaaaattatcaaattcccaaaggacttaacagaggagaaagtccatggggaatttgaacctggcggcagcgcaaaagatg

SEQ ID NO: 12974 - DNA, 103 bp, Artificial Sequence
  Synthetic Polynucleotide
taatacgactcactatagggagcagacttaaaattatcaaattcccaaagaacagaggagactttggatgtttgataataacctggcggcagcgcaaaagatg

SEQ ID NO: 12975 - DNA, 103 bp, Artificial Sequence
  Synthetic Polynucleotide
taatacgactcactataggggttatagcagacttaaaattatcaaattccaacagaggagaggaattatgtaattttaaaacctggcggcagcgcaaaagatg

SEQ ID NO: 12976 - DNA, 103 bp, Artificial Sequence
  Synthetic Polynucleotide
taatacgactcactatagggcaagtgttatagcagacttaaaattatcaaaacagaggagattgataatgttaagtctgaacctggcggcagcgcaaaagatg

SEQ ID NO: 12977 - DNA, 103 bp, Artificial Sequence
  Synthetic Polynucleotide
taatacgactcactatagggttcggcaagtgttatagcagacttaaaattaacagaggagaaattttatgtctgctataaacctggcggcagcgcaaaagatg

SEQ ID NO: 12978 - DNA, 103 bp, Artificial Sequence
  Synthetic Polynucleotide
taatacgactcactatagggcatcatactgttttcctgtcttgagaagggaacagaggagacccttcatgagacaggaaaacctggcggcagcgcaaaagatg

SEQ ID NO: 12979 - DNA, 103 bp, Artificial Sequence
  Synthetic Polynucleotide
taatacgactcactatagggtcaccttcggcaagtgttatagcagacttaaacagaggagataagtcatgtataacactaacctggcggcagcgcaaaagatg

SEQ ID NO: 12980 - DNA, 103 bp, Artificial Sequence
  Synthetic Polynucleotide
taatacgactcactatagggaaccttcaccttcggcaagtgttatagcagaacagaggagactgctaatgcacttgccgaacctggcggcagcgcaaaagatg

SEQ ID NO: 12981 - DNA, 103 bp, Artificial Sequence
  Synthetic Polynucleotide
taatacgactcactatagggacccgaaccttcaccttcggcaagtgttataacagaggagaataacaatggccgaaggtaacctggcggcagcgcaaaagatg

SEQ ID NO: 12982 - DNA, 103 bp, Artificial Sequence
  Synthetic Polynucleotide
taatacgactcactatagggaatgcacccgaaccttcaccttcggcaagtaacagaggagaacttgcatgaggtgaaggaacctggcggcagcgcaaaagatg

SEQ ID NO: 12983 - DNA, 103 bp, Artificial Sequence
  Synthetic Polynucleotide
taatacgactcactatagggagagtaatgcacccgaaccttcaccttcggaacagaggagaccgaagatgaaggttcggaacctggcggcagcgcaaaagatg

SEQ ID NO: 12984 - DNA, 103 bp, Artificial Sequence
  Synthetic Polynucleotide
taatacgactcactatagggtaataagagtaatgcacccgaaccttcaccaacagaggagaggtgaaatgtcgggtgcaaacctggcggcagcgcaaaagatg

SEQ ID NO: 12985 - DNA, 103 bp, Artificial Sequence
  Synthetic Polynucleotide
taatacgactcactatagggttttgtaataagagtaatgcacccgaacctaacagaggagaaggttcatgtgcattactaacctggcggcagcgcaaaagatg

SEQ ID NO: 12986 - DNA, 103 bp, Artificial Sequence
  Synthetic Polynucleotide
taatacgactcactatagggtatatttttgtaataagagtaatgcacccgaacagaggagacgggtgatgtactcttataacctggcggcagcgcaaaagatg

SEQ ID NO: 12987 - DNA, 103 bp, Artificial Sequence
  Synthetic Polynucleotide
taatacgactcactatagggtactttatatttttgtaataagagtaatgcaacagaggagagcattaatgttattacaaaacctggcggcagcgcaaaagatg

SEQ ID NO: 12988 - DNA, 103 bp, Artificial Sequence
  Synthetic Polynucleotide
taatacgactcactataggggtttctactttatatttttgtaataagagtaacagaggagaactcttatgacaaaaataaacctggcggcagcgcaaaagatg

SEQ ID NO: 12989 - DNA, 103 bp, Artificial Sequence
  Synthetic Polynucleotide
taatacgactcactataggggtcatcatcatactgttttcctgtcttgagaacagaggagactcaagatgggaaaacagaacctggcggcagcgcaaaagatg

SEQ ID NO: 12990 - DNA, 103 bp, Artificial Sequence
  Synthetic Polynucleotide
taatacgactcactatagggacaaggtttctactttatatttttgtaataaacagaggagatattacatgaatataaagaacctggcggcagcgcaaaagatg

SEQ ID NO: 12991 - DNA, 103 bp, Artificial Sequence
  Synthetic Polynucleotide
taatacgactcactatagggaaaaaacaaggtttctactttatatttttgaacagaggagacaaaaaatgaaagtagaaaacctggcggcagcgcaaaagatg

SEQ ID NO: 12992 - DNA, 103 bp, Artificial Sequence
  Synthetic Polynucleotide
taatacgactcactataggggtattaaaaaacaaggtttctactttatataacagaggagaatataaatgagaaaccttaacctggcggcagcgcaaaagatg

SEQ ID NO: 12993 - DNA, 103 bp, Artificial Sequence
  Synthetic Polynucleotide
taatacgactcactatagggctagtgtattaaaaaacaaggtttctacttaacagaggagaaagtagatgccttgttttaacctggcggcagcgcaaaagatg

SEQ ID NO: 12994 - DNA, 103 bp, Artificial Sequence
  Synthetic Polynucleotide
taatacgactcactatagggtgtggctagtgtattaaaaaacaaggtttcaacagaggagagaaaccatgttttttaataacctggcggcagcgcaaaagatg

SEQ ID NO: 12995 - DNA, 103 bp, Artificial Sequence
  Synthetic Polynucleotide
taatacgactcactatagggtgttctgtggctagtgtattaaaaaacaagaacagaggagacttgttatgtaatacactaacctggcggcagcgcaaaagatg

SEQ ID NO: 12996 - DNA, 103 bp, Artificial Sequence
  Synthetic Polynucleotide
taatacgactcactatagggtgctgtgttctgtggctagtgtattaaaaaaacagaggagatttttaatgcactagccaaacctggcggcagcgcaaaagatg

SEQ ID NO: 12997 - DNA, 103 bp, Artificial Sequence
  Synthetic Polynucleotide
taatacgactcactatagggttcaatgctgtgttctgtggctagtgtattaacagaggagaaatacaatggccacagaaaacctggcggcagcgcaaaagatg

SEQ ID NO: 12998 - DNA, 103 bp, Artificial Sequence
  Synthetic Polynucleotide
taatacgactcactatagggtctgcttcaatgctgtgttctgtggctagtaacagaggagaactagcatgagaacacagaacctggcggcagcgcaaaagatg

SEQ ID NO: 12999 - DNA, 103 bp, Artificial Sequence
  Synthetic Polynucleotide
taatacgactcactatagggtaatttctgcttcaatgctgtgttctgtggaacagaggagaccacagatgacagcattgaacctggcggcagcgcaaaagatg

SEQ ID NO: 13000 - DNA, 103 bp, Artificial Sequence
  Synthetic Polynucleotide
taatacgactcactatagggtcgttgtcatcatcatactgttttcctgtcaacagaggagagacaggatgacagtatgaaacctggcggcagcgcaaaagatg

SEQ ID NO: 13001 - DNA, 103 bp, Artificial Sequence
  Synthetic Polynucleotide
taatacgactcactatagggagaaataatttctgcttcaatgctgtgttcaacagaggagagaacacatgattgaagcaaacctggcggcagcgcaaaagatg

SEQ ID NO: 13002 - DNA, 103 bp, Artificial Sequence
  Synthetic Polynucleotide
taatacgactcactatagggattccagaaataatttctgcttcaatgctgaacagaggagacagcatatgagcagaaataacctggcggcagcgcaaaagatg

SEQ ID NO: 13003 - DNA, 103 bp, Artificial Sequence
  Synthetic Polynucleotide
taatacgactcactatagggtagttattccagaaataatttctgcttcaaaacagaggagattgaagatgaaattatttaacctggcggcagcgcaaaagatg

SEQ ID NO: 13004 - DNA, 103 bp, Artificial Sequence
  Synthetic Polynucleotide
taatacgactcactatagggtggtgtagttattccagaaataatttctgcaacagaggagagcagaaatgatttctggaaacctggcggcagcgcaaaagatg

SEQ ID NO: 13005 - DNA, 103 bp, Artificial Sequence
  Synthetic Polynucleotide
taatacgactcactatagggattcttggtgtagttattccagaaataattaacagaggagaaattatatgtggaataacaacctggcggcagcgcaaaagatg

SEQ ID NO: 13006 - DNA, 103 bp, Artificial Sequence
  Synthetic Polynucleotide
taatacgactcactataggggaagcattcttggtgtagttattccagaaaaacagaggagatttctgatgtaactacacaacctggcggcagcgcaaaagatg

SEQ ID NO: 13007 - DNA, 103 bp, Artificial Sequence
  Synthetic Polynucleotide
taatacgactcactatagggagggagaagcattcttggtgtagttattccaacagaggagaggaataatgacaccaagaaacctggcggcagcgcaaaagatg

SEQ ID NO: 13008 - DNA, 103 bp, Artificial Sequence
  Synthetic Polynucleotide
taatacgactcactatagggataatagggagaagcattcttggtgtagttaacagaggagaaactacatgaagaatgctaacctggcggcagcgcaaaagatg

SEQ ID NO: 13009 - DNA, 103 bp, Artificial Sequence
  Synthetic Polynucleotide
taatacgactcactatagggtagacataatagggagaagcattcttggtgaacagaggagacaccaaatgtgcttctccaacctggcggcagcgcaaaagatg

SEQ ID NO: 13010 - DNA, 103 bp, Artificial Sequence
  Synthetic Polynucleotide
taatacgactcactataggggaacctagacataatagggagaagcattctaacagaggagaagaatgatgctccctattaacctggcggcagcgcaaaagatg

SEQ ID NO: 13011 - DNA, 103 bp, Artificial Sequence
  Synthetic Polynucleotide
taatacgactcactatagggggatatcgttgtcatcatcatactgttttcaacagaggagagaaaacatgatgatgatgaacctggcggcagcgcaaaagatg

SEQ ID NO: 13012 - DNA, 103 bp, Artificial Sequence
  Synthetic Polynucleotide
taatacgactcactatagggccatggaacctagacataatagggagaagcaacagaggagagcttctatgtattatgtcaacctggcggcagcgcaaaagatg

SEQ ID NO: 13013 - DNA, 103 bp, Artificial Sequence
  Synthetic Polynucleotide
taatacgactcactataggggtccaccatggaacctagacataatagggaaacagaggagatccctaatgtgtctaggtaacctggcggcagcgcaaaagatg

SEQ ID NO: 13014 - DNA, 103 bp, Artificial Sequence
  Synthetic Polynucleotide
taatacgactcactatagggtatttgtccaccatggaacctagacataataacagaggagaattatgatgaggttccataacctggcggcagcgcaaaagatg

SEQ ID NO: 13015 - DNA, 103 bp, Artificial Sequence
  Synthetic Polynucleotide
taatacgactcactatagggacttttatttgtccaccatggaacctagacaacagaggagagtctagatgccatggtggaacctggcggcagcgcaaaagatg

SEQ ID NO: 13016 - DNA, 103 bp, Artificial Sequence
  Synthetic Polynucleotide
taatacgactcactatagggaagtgacttttatttgtccaccatggaaccaacagaggagaggttccatggtggacaaaaacctggcggcagcgcaaaagatg

SEQ ID NO: 13017 - DNA, 103 bp, Artificial Sequence
  Synthetic Polynucleotide
taatacgactcactataggggtttaaagtgacttttatttgtccaccatgaacagaggagacatggtatgcaaataaaaaacctggcggcagcgcaaaagatg

SEQ ID NO: 13018 - DNA, 103 bp, Artificial Sequence
  Synthetic Polynucleotide
taatacgactcactataggggaattgtttaaagtgacttttatttgtccaaacagaggagatggacaatgaaaagtcacaacctggcggcagcgcaaaagatg

SEQ ID NO: 13019 - DNA, 103 bp, Artificial Sequence
  Synthetic Polynucleotide
taatacgactcactatagggttgcagaattgtttaaagtgacttttatttaacagaggagaaaataaatgtcactttaaaacctggcggcagcgcaaaagatg

SEQ ID NO: 13020 - DNA, 103 bp, Artificial Sequence
  Synthetic Polynucleotide
taatacgactcactatagggctggcttgcagaattgtttaaagtgactttaacagaggagaaaagtcatgttaaacaataacctggcggcagcgcaaaagatg

SEQ ID NO: 13021 - DNA, 103 bp, Artificial Sequence
  Synthetic Polynucleotide
taatacgactcactataggggtaatctggcttgcagaattgtttaaagtgaacagaggagacactttatgcaattctgcaacctggcggcagcgcaaaagatg

SEQ ID NO: 13022 - DNA, 103 bp, Artificial Sequence
  Synthetic Polynucleotide
taatacgactcactatagggaaaggggatatcgttgtcatcatcatactgaacagaggagacagtatatggatgacaacaacctggcggcagcgcaaaagatg

SEQ ID NO: 13023 - DNA, 103 bp, Artificial Sequence
  Synthetic Polynucleotide
taatacgactcactatagggtatcggtaatctggcttgcagaattgtttaaacagaggagataaacaatgctgcaagccaacctggcggcagcgcaaaagatg

SEQ ID NO: 13024 - DNA, 103 bp, Artificial Sequence
  Synthetic Polynucleotide
taatacgactcactatagggagtaatatcggtaatctggcttgcagaattaacagaggagaaattctatgagccagattaacctggcggcagcgcaaaagatg

SEQ ID NO: 13025 - DNA, 103 bp, Artificial Sequence
  Synthetic Polynucleotide
taatacgactcactatagggggattagtaatatcggtaatctggcttgcaaacagaggagatgcaagatggattaccgaaacctggcggcagcgcaaaagatg

SEQ ID NO: 13026 - DNA, 103 bp, Artificial Sequence
  Synthetic Polynucleotide
taatacgactcactatagggaacttggattagtaatatcggtaatctggcaacagaggagagccagaatgccgatattaaacctggcggcagcgcaaaagatg

SEQ ID NO: 13027 - DNA, 103 bp, Artificial Sequence
  Synthetic Polynucleotide
taatacgactcactatagggcaaccaacttggattagtaatatcggtaataacagaggagaattaccatgattactaataacctggcggcagcgcaaaagatg

SEQ ID NO: 13028 - DNA, 103 bp, Artificial Sequence
  Synthetic Polynucleotide
taatacgactcactatagggtctgccaaccaacttggattagtaatatcgaacagaggagacgatatatgtaatccaagaacctggcggcagcgcaaaagatg

SEQ ID NO: 13029 - DNA, 103 bp, Artificial Sequence
  Synthetic Polynucleotide
taatacgactcactatagggtttggtctgccaaccaacttggattagtaaaacagaggagattactaatgcaagttggtaacctggcggcagcgcaaaagatg

SEQ ID NO: 13030 - DNA, 103 bp, Artificial Sequence
  Synthetic Polynucleotide
taatacgactcactatagggagatttttggtctgccaaccaacttggattaacagaggagaaatccaatgtggttggcaaacctggcggcagcgcaaaagatg

SEQ ID NO: 13031 - DNA, 103 bp, Artificial Sequence
  Synthetic Polynucleotide
taatacgactcactatagggatcctagatttttggtctgccaaccaacttaacagaggagaaagttgatgggcagaccaaacctggcggcagcgcaaaagatg

SEQ ID NO: 13032 - DNA, 103 bp, Artificial Sequence
  Synthetic Polynucleotide
taatacgactcactatagggtagggatcctagatttttggtctgccaaccaacagaggagaggttggatgaccaaaaataacctggcggcagcgcaaaagatg

SEQ ID NO: 13033 - DNA, 103 bp, Artificial Sequence
  Synthetic Polynucleotide
taatacgactcactatagggccaggaaaggggatatcgttgtcatcatcaaacagaggagatgatgaatgcaacgatataacctggcggcagcgcaaaagatg

SEQ ID NO: 13034 - DNA, 103 bp, Artificial Sequence
  Synthetic Polynucleotide
taatacgactcactatagggttgcttagggatcctagatttttggtctgcaacagaggagagcagacatgaaatctaggaacctggcggcagcgcaaaagatg

SEQ ID NO: 13035 - DNA, 103 bp, Artificial Sequence
  Synthetic Polynucleotide
taatacgactcactatagggtctacttgcttagggatcctagatttttggaacagaggagaccaaaaatgtaggatcccaacctggcggcagcgcaaaagatg

SEQ ID NO: 13036 - DNA, 103 bp, Artificial Sequence
  Synthetic Polynucleotide
taatacgactcactatagggtaatctctacttgcttagggatcctagattaacagaggagaaatctaatgtccctaagcaacctggcggcagcgcaaaagatg

SEQ ID NO: 13037 - DNA, 103 bp, Artificial Sequence
  Synthetic Polynucleotide
taatacgactcactatagggggttataatctctacttgcttagggatcctaacagaggagaaggatcatgaagcaagtaaacctggcggcagcgcaaaagatg

SEQ ID NO: 13038 - DNA, 103 bp, Artificial Sequence
  Synthetic Polynucleotide
taatacgactcactatagggtccatggttataatctctacttgcttagggaacagaggagaccctaaatgagtagagataacctggcggcagcgcaaaagatg

SEQ ID NO: 13039 - DNA, 103 bp, Artificial Sequence
  Synthetic Polynucleotide
taatacgactcactatagggcagcatccatggttataatctctacttgctaacagaggagaagcaagatgagattataaaacctggcggcagcgcaaaagatg

SEQ ID NO: 13040 - DNA, 103 bp, Artificial Sequence
  Synthetic Polynucleotide
taatacgactcactatagggtgtttcagcatccatggttataatctctacaacagaggagagtagagatgataaccatgaacctggcggcagcgcaaaagatg

SEQ ID NO: 13041 - DNA, 103 bp, Artificial Sequence
  Synthetic Polynucleotide
taatacgactcactatagggtctgttgtttcagcatccatggttataatcaacagaggagagattatatgcatggatgcaacctggcggcagcgcaaaagatg

SEQ ID NO: 13042 - DNA, 103 bp, Artificial Sequence
  Synthetic Polynucleotide
taatacgactcactatagggtgttttctgttgtttcagcatccatggttaaacagaggagataaccaatgatgctgaaaaacctggcggcagcgcaaaagatg

SEQ ID NO: 13043 - DNA, 103 bp, Artificial Sequence
  Synthetic Polynucleotide
taatacgactcactatagggattaatgttttctgttgtttcagcatccataacagaggagaatggatatggaaacaacaaacctggcggcagcgcaaaagatg

SEQ ID NO: 13044 - DNA, 103 bp, Artificial Sequence
  Synthetic Polynucleotide
taatacgactcactatagggtgggcccaggaaaggggatatcgttgtcataacagaggagaatgacaatgatatcccctaacctggcggcagcgcaaaagatg

SEQ ID NO: 13045 - DNA, 103 bp, Artificial Sequence
  Synthetic Polynucleotide
taatacgactcactataggggaccgattaatgttttctgttgtttcagcaaacagaggagatgctgaatgaacagaaaaaacctggcggcagcgcaaaagatg

SEQ ID NO: 13046 - DNA, 103 bp, Artificial Sequence
  Synthetic Polynucleotide
taatacgactcactatagggattttgaccgattaatgttttctgttgtttaacagaggagaaaacaaatgaaaacattaaacctggcggcagcgcaaaagatg

SEQ ID NO: 13047 - DNA, 103 bp, Artificial Sequence
  Synthetic Polynucleotide
taatacgactcactataggggtacaattttgaccgattaatgttttctgtaacagaggagaacagaaatgattaatcggaacctggcggcagcgcaaaagatg

SEQ ID NO: 13048 - DNA, 103 bp, Artificial Sequence
  Synthetic Polynucleotide
taatacgactcactataggggcttcgtacaattttgaccgattaatgtttaacagaggagaaaacatatgtcggtcaaaaacctggcggcagcgcaaaagatg

SEQ ID NO: 13049 - DNA, 103 bp, Artificial Sequence
  Synthetic Polynucleotide
taatacgactcactatagggggactgcttcgtacaattttgaccgattaaaacagaggagattaatcatgcaaaattgtaacctggcggcagcgcaaaagatg

SEQ ID NO: 13050 - DNA, 103 bp, Artificial Sequence
  Synthetic Polynucleotide
taatacgactcactatagggctgttggactgcttcgtacaattttgaccgaacagaggagacggtcaatgttgtacgaaaacctggcggcagcgcaaaagatg

SEQ ID NO: 13051 - DNA, 103 bp, Artificial Sequence
  Synthetic Polynucleotide
taatacgactcactatagggatcagctgttggactgcttcgtacaattttaacagaggagaaaaattatgcgaagcagtaacctggcggcagcgcaaaagatg

SEQ ID NO: 13052 - DNA, 103 bp, Artificial Sequence
  Synthetic Polynucleotide
taatacgactcactatagggagacaatcagctgttggactgcttcgtacaaacagaggagatgtacgatgcagtccaacaacctggcggcagcgcaaaagatg

SEQ ID NO: 13053 - DNA, 103 bp, Artificial Sequence
  Synthetic Polynucleotide
taatacgactcactatagggatgtgagacaatcagctgttggactgcttcaacagaggagagaagcaatgcaacagctgaacctggcggcagcgcaaaagatg

SEQ ID NO: 13054 - DNA, 103 bp, Artificial Sequence
  Synthetic Polynucleotide
taatacgactcactatagggtcaatatgtgagacaatcagctgttggactaacagaggagaagtccaatggctgattgtaacctggcggcagcgcaaaagatg

SEQ ID NO: 13055 - DNA, 103 bp, Artificial Sequence
  Synthetic Polynucleotide
taatacgactcactatagggattgatgggcccaggaaaggggatatcgttaacagaggagaaacgatatgccctttcctaacctggcggcagcgcaaaagatg

SEQ ID NO: 13056 - DNA, 103 bp, Artificial Sequence
  Synthetic Polynucleotide
taatacgactcactatagggtcggatcaatatgtgagacaatcagctgttaacagaggagaaacagcatgttgtctcacaacctggcggcagcgcaaaagatg

SEQ ID NO: 13057 - DNA, 103 bp, Artificial Sequence
  Synthetic Polynucleotide
taatacgactcactatagggtgcattcggatcaatatgtgagacaatcagaacagaggagactgattatgtcacatattaacctggcggcagcgcaaaagatg

SEQ ID NO: 13058 - DNA, 103 bp, Artificial Sequence
  Synthetic Polynucleotide
taatacgactcactatagggttgagtgcattcggatcaatatgtgagacaaacagaggagatgtctcatgtattgatccaacctggcggcagcgcaaaagatg

SEQ ID NO: 13059 - DNA, 103 bp, Artificial Sequence
  Synthetic Polynucleotide
taatacgactcactatagggcaactttgagtgcattcggatcaatatgtgaacagaggagacacataatgatccgaatgaacctggcggcagcgcaaaagatg

SEQ ID NO: 13060 - DNA, 103 bp, Artificial Sequence
  Synthetic Polynucleotide
taatacgactcactatagggaaccacaactttgagtgcattcggatcaataacagaggagaattgatatgaatgcactcaacctggcggcagcgcaaaagatg

SEQ ID NO: 13061 - DNA, 103 bp, Artificial Sequence
  Synthetic Polynucleotide
taatacgactcactatagggttaagaaccacaactttgagtgcattcggaaacagaggagatccgaaatgactcaaagtaacctggcggcagcgcaaaagatg

SEQ ID NO: 13062 - DNA, 103 bp, Artificial Sequence
  Synthetic Polynucleotide
taatacgactcactatagggaaactttaagaaccacaactttgagtgcataacagaggagaatgcacatgaagttgtggaacctggcggcagcgcaaaagatg

SEQ ID NO: 13063 - DNA, 103 bp, Artificial Sequence
  Synthetic Polynucleotide
taatacgactcactatagggtaagaaaactttaagaaccacaactttgagaacagaggagactcaaaatggtggttcttaacctggcggcagcgcaaaagatg

SEQ ID NO: 13064 - DNA, 103 bp, Artificial Sequence
  Synthetic Polynucleotide
taatacgactcactatagggtcacttaagaaaactttaagaaccacaactaacagaggagaagttgtatgtcttaaagtaacctggcggcagcgcaaaagatg

SEQ ID NO: 13065 - DNA, 103 bp, Artificial Sequence
  Synthetic Polynucleotide
taatacgactcactatagggcaatgtcacttaagaaaactttaagaaccaaacagaggagatggttcatgaagttttctaacctggcggcagcgcaaaagatg

SEQ ID NO: 13066 - DNA, 103 bp, Artificial Sequence
  Synthetic Polynucleotide
taatacgactcactatagggttatcattgatgggcccaggaaaggggataaacagaggagatatcccatgtcctgggccaacctggcggcagcgcaaaagatg

SEQ ID NO: 13067 - DNA, 103 bp, Artificial Sequence
  Synthetic Polynucleotide
taatacgactcactatagggtccatcaatgtcacttaagaaaactttaagaacagaggagacttaaaatgttcttaagtaacctggcggcagcgcaaaagatg

SEQ ID NO: 13068 - DNA, 103 bp, Artificial Sequence
  Synthetic Polynucleotide
taatacgactcactatagggaggattccatcaatgtcacttaagaaaactaacagaggagaagttttatgaagtgacataacctggcggcagcgcaaaagatg

SEQ ID NO: 13069 - DNA, 103 bp, Artificial Sequence
  Synthetic Polynucleotide
taatacgactcactataggggccataggattccatcaatgtcacttaagaaacagaggagatcttaaatgacattgatgaacctggcggcagcgcaaaagatg

SEQ ID NO: 13070 - DNA, 103 bp, Artificial Sequence
  Synthetic Polynucleotide
taatacgactcactatagggattcagccataggattccatcaatgtcactaacagaggagaagtgacatggatggaatcaacctggcggcagcgcaaaagatg

SEQ ID NO: 13071 - DNA, 103 bp, Artificial Sequence
  Synthetic Polynucleotide
taatacgactcactatagggttatcattcagccataggattccatcaatgaacagaggagacattgaatgaatcctatgaacctggcggcagcgcaaaagatg

SEQ ID NO: 13072 - DNA, 103 bp, Artificial Sequence
  Synthetic Polynucleotide
taatacgactcactatagggtaaggttatcattcagccataggattccataacagaggagaatggaaatgtatggctgaaacctggcggcagcgcaaaagatg

SEQ ID NO: 13073 - DNA, 103 bp, Artificial Sequence
  Synthetic Polynucleotide
taatacgactcactatagggaggggtaaggttatcattcagccataggataacagaggagaatcctaatgctgaatgataacctggcggcagcgcaaaagatg

SEQ ID NO: 13074 - DNA, 103 bp, Artificial Sequence
  Synthetic Polynucleotide
taatacgactcactatagggaacaaaggggtaaggttatcattcagccataacagaggagaatggctatgtgataacctaacctggcggcagcgcaaaagatg

SEQ ID NO: 13075 - DNA, 103 bp, Artificial Sequence
  Synthetic Polynucleotide
taatacgactcactataggggcccaaacaaaggggtaaggttatcattcaaacagaggagatgaatgatgaccttacccaacctggcggcagcgcaaaagatg

SEQ ID NO: 13076 - DNA, 103 bp, Artificial Sequence
  Synthetic Polynucleotide
taatacgactcactatagggacccagcccaaacaaaggggtaaggttatcaacagaggagagataacatgacccctttgaacctggcggcagcgcaaaagatg

SEQ ID NO: 13077 - DNA, 103 bp, Artificial Sequence
  Synthetic Polynucleotide
taatacgactcactataggggttgagtcttttggactgtctttgcccccaaacagaggagatgggggatgagacagtccaacctggcggcagcgcaaaagatg

SEQ ID NO: 13078 - DNA, 103 bp, Artificial Sequence
  Synthetic Polynucleotide
taatacgactcactatagggtttcgttatcattgatgggcccaggaaaggaacagaggagacctttcatgggcccatcaaacctggcggcagcgcaaaagatg

SEQ ID NO: 13079 - DNA, 103 bp, Artificial Sequence
  Synthetic Polynucleotide
taatacgactcactatagggaagtaacccagcccaaacaaaggggtaaggaacagaggagaccttacatgtttgtttggaacctggcggcagcgcaaaagatg

SEQ ID NO: 13080 - DNA, 103 bp, Artificial Sequence
  Synthetic Polynucleotide
taatacgactcactatagggtgatcaagtaacccagcccaaacaaaggggaacagaggagaccccttatgttgggctggaacctggcggcagcgcaaaagatg

SEQ ID NO: 13081 - DNA, 103 bp, Artificial Sequence
  Synthetic Polynucleotide
taatacgactcactatagggcggcttgatcaagtaacccagcccaaacaaaacagaggagattgtttatgctgggttacaacctggcggcagcgcaaaagatg

SEQ ID NO: 13082 - DNA, 103 bp, Artificial Sequence
  Synthetic Polynucleotide
taatacgactcactataggggtgatcggcttgatcaagtaacccagcccaaacagaggagatgggctatgttacttgataacctggcggcagcgcaaaagatg

SEQ ID NO: 13083 - DNA, 103 bp, Artificial Sequence
  Synthetic Polynucleotide
taatacgactcactatagggtagaggtgatcggcttgatcaagtaacccaaacagaggagatgggttatgtgatcaagcaacctggcggcagcgcaaaagatg

SEQ ID NO: 13084 - DNA, 103 bp, Artificial Sequence
  Synthetic Polynucleotide
taatacgactcactatagggtgggctagaggtgatcggcttgatcaagtaaacagaggagatacttgatgaagccgatcaacctggcggcagcgcaaaagatg

SEQ ID NO: 13085 - DNA, 103 bp, Artificial Sequence
  Synthetic Polynucleotide
taatacgactcactataggggattttgggctagaggtgatcggcttgatcaacagaggagagatcaaatggatcacctcaacctggcggcagcgcaaaagatg

SEQ ID NO: 13086 - DNA, 103 bp, Artificial Sequence
  Synthetic Polynucleotide
taatacgactcactatagggcactagattttgggctagaggtgatcggctaacagaggagaagccgaatgcctctagccaacctggcggcagcgcaaaagatg

SEQ ID NO: 13087 - DNA, 103 bp, Artificial Sequence
  Synthetic Polynucleotide
taatacgactcactatagggccactcactagattttgggctagaggtgataacagaggagaatcaccatgagcccaaaaaacctggcggcagcgcaaaagatg

SEQ ID NO: 13088 - DNA, 103 bp, Artificial Sequence
  Synthetic Polynucleotide
taatacgactcactatagggaggtaccactcactagattttgggctagagaacagaggagactctagatgaaaatctagaacctggcggcagcgcaaaagatg

SEQ ID NO: 13089 - DNA, 103 bp, Artificial Sequence
  Synthetic Polynucleotide
taatacgactcactatagggtgagttttcgttatcattgatgggcccaggaacagaggagacctgggatgatcaatgataacctggcggcagcgcaaaagatg

SEQ ID NO: 13090 - DNA, 103 bp, Artificial Sequence
  Synthetic Polynucleotide
taatacgactcactataggggacataggtaccactcactagattttgggcaacagaggagagcccaaatgctagtgagtaacctggcggcagcgcaaaagatg

SEQ ID NO: 13091 - DNA, 103 bp, Artificial Sequence
  Synthetic Polynucleotide
taatacgactcactatagggtgagagacataggtaccactcactagatttaacagaggagaaaatctatggagtggtacaacctggcggcagcgcaaaagatg

SEQ ID NO: 13092 - DNA, 103 bp, Artificial Sequence
  Synthetic Polynucleotide
taatacgactcactatagggaggtttgagagacataggtaccactcactaaacagaggagatagtgaatggtacctatgaacctggcggcagcgcaaaagatg

SEQ ID NO: 13093 - DNA, 103 bp, Artificial Sequence
  Synthetic Polynucleotide
taatacgactcactatagggaaagaaggtttgagagacataggtaccactaacagaggagaagtggtatgtatgtctctaacctggcggcagcgcaaaagatg

SEQ ID NO: 13094 - DNA, 103 bp, Artificial Sequence
  Synthetic Polynucleotide
taatacgactcactatagggagttgaaagaaggtttgagagacataggtaaacagaggagatacctaatgctctcaaacaacctggcggcagcgcaaaagatg

SEQ ID NO: 13095 - DNA, 103 bp, Artificial Sequence
  Synthetic Polynucleotide
taatacgactcactatagggcttgaagttgaaagaaggtttgagagacataacagaggagaatgtctatgaaaccttctaacctggcggcagcgcaaaagatg

SEQ ID NO: 13096 - DNA, 103 bp, Artificial Sequence
  Synthetic Polynucleotide
taatacgactcactatagggatcgtcttgaagttgaaagaaggtttgagaaacagaggagatctcaaatgttctttcaaaacctggcggcagcgcaaaagatg

SEQ ID NO: 13097 - DNA, 103 bp, Artificial Sequence
  Synthetic Polynucleotide
taatacgactcactatagggaggtaatcgtcttgaagttgaaagaaggttaacagaggagaaaccttatgtcaacttcaaacctggcggcagcgcaaaagatg

SEQ ID NO: 13098 - DNA, 103 bp, Artificial Sequence
  Synthetic Polynucleotide
taatacgactcactatagggtgatgaggtaatcgtcttgaagttgaaagaaacagaggagatctttcatgttcaagacgaacctggcggcagcgcaaaagatg

SEQ ID NO: 13099 - DNA, 103 bp, Artificial Sequence
  Synthetic Polynucleotide
taatacgactcactataggggactctgatgaggtaatcgtcttgaagttgaacagaggagacaacttatggacgattacaacctggcggcagcgcaaaagatg

SEQ ID NO: 13100 - DNA, 103 bp, Artificial Sequence
  Synthetic Polynucleotide
taatacgactcactatagggtgttctgagttttcgttatcattgatgggcaacagaggagagcccatatgtgataacgaaacctggcggcagcgcaaaagatg

SEQ ID NO: 13101 - DNA, 103 bp, Artificial Sequence
  Synthetic Polynucleotide
taatacgactcactatagggagtatgactctgatgaggtaatcgtcttgaaacagaggagatcaagaatgttacctcataacctggcggcagcgcaaaagatg

SEQ ID NO: 13102 - DNA, 103 bp, Artificial Sequence
  Synthetic Polynucleotide
taatacgactcactatagggcaagtagtatgactctgatgaggtaatcgtaacagaggagaacgattatgtcatcagagaacctggcggcagcgcaaaagatg

SEQ ID NO: 13103 - DNA, 103 bp, Artificial Sequence
  Synthetic Polynucleotide
taatacgactcactataggggcatgcaagtagtatgactctgatgaggtaaacagaggagatacctcatgagagtcataaacctggcggcagcgcaaaagatg

SEQ ID NO: 13104 - DNA, 103 bp, Artificial Sequence
  Synthetic Polynucleotide
taatacgactcactatagggaacatgcatgcaagtagtatgactctgatgaacagaggagacatcagatgcatactactaacctggcggcagcgcaaaagatg

SEQ ID NO: 13105 - DNA, 103 bp, Artificial Sequence
  Synthetic Polynucleotide
taatacgactcactatagggtgaataacatgcatgcaagtagtatgactcaacagaggagagagtcaatgtacttgcataacctggcggcagcgcaaaagatg

SEQ ID NO: 13106 - DNA, 103 bp, Artificial Sequence
  Synthetic Polynucleotide
taatacgactcactatagggctgtttgaataacatgcatgcaagtagtataacagaggagaatactaatggcatgcatgaacctggcggcagcgcaaaagatg

SEQ ID NO: 13107 - DNA, 103 bp, Artificial Sequence
  Synthetic Polynucleotide
taatacgactcactataggggagtgctgtttgaataacatgcatgcaagtaacagaggagaacttgcatgcatgttattaacctggcggcagcgcaaaagatg

SEQ ID NO: 13108 - DNA, 103 bp, Artificial Sequence
  Synthetic Polynucleotide
taatacgactcactatagggagctggagtgctgtttgaataacatgcatgaacagaggagacatgcaatgtattcaaacaacctggcggcagcgcaaaagatg

SEQ ID NO: 13109 - DNA, 103 bp, Artificial Sequence
  Synthetic Polynucleotide
taatacgactcactatagggtttgtagctggagtgctgtttgaataacataacagaggagaatgttaatgaaacagcacaacctggcggcagcgcaaaagatg

SEQ ID NO: 13110 - DNA, 103 bp, Artificial Sequence
  Synthetic Polynucleotide
taatacgactcactatagggctgaatttgtagctggagtgctgtttgaataacagaggagaattcaaatggcactccagaacctggcggcagcgcaaaagatg

SEQ ID NO: 13111 - DNA, 103 bp, Artificial Sequence
  Synthetic Polynucleotide
taatacgactcactatagggcttgctgttctgagttttcgttatcattgaaacagaggagatcaatgatgacgaaaactaacctggcggcagcgcaaaagatg

SEQ ID NO: 13112 - DNA, 103 bp, Artificial Sequence
  Synthetic Polynucleotide
taatacgactcactatagggctcctctgaatttgtagctggagtgctgttaacagaggagaaacagcatgccagctacaaacctggcggcagcgcaaaagatg

SEQ ID NO: 13113 - DNA, 103 bp, Artificial Sequence
  Synthetic Polynucleotide
taatacgactcactatagggatgagctcctctgaatttgtagctggagtgaacagaggagacactccatgtacaaattcaacctggcggcagcgcaaaagatg

SEQ ID NO: 13114 - DNA, 103 bp, Artificial Sequence
  Synthetic Polynucleotide
taatacgactcactatagggccaatatgagctcctctgaatttgtagctgaacagaggagacagctaatgattcagaggaacctggcggcagcgcaaaagatg

SEQ ID NO: 13115 - DNA, 103 bp, Artificial Sequence
  Synthetic Polynucleotide
taatacgactcactatagggctaagccaatatgagctcctctgaatttgtaacagaggagaacaaatatggaggagctcaacctggcggcagcgcaaaagatg

SEQ ID NO: 13116 - DNA, 103 bp, Artificial Sequence
  Synthetic Polynucleotide
taatacgactcactatagggggtggctaagccaatatgagctcctctgaaaacagaggagattcagaatggctcatattaacctggcggcagcgcaaaagatg

SEQ ID NO: 13117 - DNA, 103 bp, Artificial Sequence
  Synthetic Polynucleotide
taatacgactcactataggggacaaggtggctaagccaatatgagctcctaacagaggagaaggagcatgtattggcttaacctggcggcagcgcaaaagatg

SEQ ID NO: 13118 - DNA, 103 bp, Artificial Sequence
  Synthetic Polynucleotide
taatacgactcactatagggtactggacaaggtggctaagccaatatgagaacagaggagactcataatggcttagccaaacctggcggcagcgcaaaagatg

SEQ ID NO: 13119 - DNA, 103 bp, Artificial Sequence
  Synthetic Polynucleotide
taatacgactcactatagggtggcatactggacaaggtggctaagccaataacagaggagaattggcatggccaccttgaacctggcggcagcgcaaaagatg

SEQ ID NO: 13120 - DNA, 103 bp, Artificial Sequence
  Synthetic Polynucleotide
taatacgactcactatagggatgattggcatactggacaaggtggctaagaacagaggagacttagcatgcttgtccagaacctggcggcagcgcaaaagatg

SEQ ID NO: 13121 - DNA, 103 bp, Artificial Sequence
  Synthetic Polynucleotide
taatacgactcactatagggaaattatgattggcatactggacaaggtggaacagaggagaccacctatgccagtatgcaacctggcggcagcgcaaaagatg

SEQ ID NO: 13122 - DNA, 103 bp, Artificial Sequence
  Synthetic Polynucleotide
taatacgactcactatagggatcgtcttgctgttctgagttttcgttatcaacagaggagagataacatgaactcagaaaacctggcggcagcgcaaaagatg

SEQ ID NO: 13123 - DNA, 103 bp, Artificial Sequence
  Synthetic Polynucleotide
taatacgactcactatagggaatgcaaattatgattggcatactggacaaaacagaggagattgtccatgatgccaatcaacctggcggcagcgcaaaagatg

SEQ ID NO: 13124 - DNA, 103 bp, Artificial Sequence
  Synthetic Polynucleotide
taatacgactcactatagggatctaaatgcaaattatgattggcatactgaacagaggagacagtatatgaatcataataacctggcggcagcgcaaaagatg

SEQ ID NO: 13125 - DNA, 103 bp, Artificial Sequence
  Synthetic Polynucleotide
taatacgactcactatagggatataatctaaatgcaaattatgattggcaaacagaggagatgccaaatgtaatttgcaaacctggcggcagcgcaaaagatg

SEQ ID NO: 13126 - DNA, 103 bp, Artificial Sequence
  Synthetic Polynucleotide
taatacgactcactataggggattaatataatctaaatgcaaattatgataacagaggagaatcataatgtgcatttagaacctggcggcagcgcaaaagatg

SEQ ID NO: 13127 - DNA, 103 bp, Artificial Sequence
  Synthetic Polynucleotide
taatacgactcactatagggaccgagattaatataatctaaatgcaaattaacagaggagaaatttgatgttagattataacctggcggcagcgcaaaagatg

SEQ ID NO: 13128 - DNA, 103 bp, Artificial Sequence
  Synthetic Polynucleotide
taatacgactcactataggggggaaaccgagattaatataatctaaatgcaacagaggagagcatttatgttatattaaaacctggcggcagcgcaaaagatg

SEQ ID NO: 13129 - DNA, 103 bp, Artificial Sequence
  Synthetic Polynucleotide
taatacgactcactatagggatgaagggaaaccgagattaatataatctaaacagaggagatagattatgttaatctcgaacctggcggcagcgcaaaagatg

SEQ ID NO: 13130 - DNA, 103 bp, Artificial Sequence
  Synthetic Polynucleotide
taatacgactcactatagggctccaatgaagggaaaccgagattaatataaacagaggagatatattatgctcggtttcaacctggcggcagcgcaaaagatg

SEQ ID NO: 13131 - DNA, 103 bp, Artificial Sequence
  Synthetic Polynucleotide
taatacgactcactatagggaccctctccaatgaagggaaaccgagattaaacagaggagataatctatgtttcccttcaacctggcggcagcgcaaaagatg

SEQ ID NO: 13132 - DNA, 103 bp, Artificial Sequence
  Synthetic Polynucleotide
taatacgactcactatagggataaaaccctctccaatgaagggaaaccgaaacagaggagatcggttatgcttcattggaacctggcggcagcgcaaaagatg

SEQ ID NO: 13133 - DNA, 103 bp, Artificial Sequence
  Synthetic Polynucleotide
taatacgactcactatagggggatcatcgtcttgctgttctgagttttcgaacagaggagacgaaaaatgagaacagcaaacctggcggcagcgcaaaagatg

SEQ ID NO: 13134 - DNA, 103 bp, Artificial Sequence
  Synthetic Polynucleotide
taatacgactcactatagggatggtataaaaccctctccaatgaagggaaaacagaggagattccctatgttggagaggaacctggcggcagcgcaaaagatg

SEQ ID NO: 13135 - DNA, 103 bp, Artificial Sequence
  Synthetic Polynucleotide
taatacgactcactatagggtatctatggtataaaaccctctccaatgaaaacagaggagattcattatggagggttttaacctggcggcagcgcaaaagatg

SEQ ID NO: 13136 - DNA, 103 bp, Artificial Sequence
  Synthetic Polynucleotide
taatacgactcactatagggaattgtatctatggtataaaaccctctccaaacagaggagatggagaatgttttataccaacctggcggcagcgcaaaagatg

SEQ ID NO: 13137 - DNA, 103 bp, Artificial Sequence
  Synthetic Polynucleotide
taatacgactcactataggggactaaattgtatctatggtataaaaccctaacagaggagaagggttatgtaccatagaaacctggcggcagcgcaaaagatg

SEQ ID NO: 13138 - DNA, 103 bp, Artificial Sequence
  Synthetic Polynucleotide
taatacgactcactataggggaatcgactaaattgtatctatggtataaaaacagaggagatttataatgtagatacaaaacctggcggcagcgcaaaagatg

SEQ ID NO: 13139 - DNA, 103 bp, Artificial Sequence
  Synthetic Polynucleotide
taatacgactcactatagggtctgagaatcgactaaattgtatctatggtaacagaggagaaccataatgacaatttagaacctggcggcagcgcaaaagatg

SEQ ID NO: 13140 - DNA, 103 bp, Artificial Sequence
  Synthetic Polynucleotide
taatacgactcactataggggcctttctgagaatcgactaaattgtatctaacagaggagaagatacatgttagtcgataacctggcggcagcgcaaaagatg

SEQ ID NO: 13141 - DNA, 103 bp, Artificial Sequence
  Synthetic Polynucleotide
taatacgactcactatagggaaagggcctttctgagaatcgactaaattgaacagaggagacaatttatgcgattctcaaacctggcggcagcgcaaaagatg

SEQ ID NO: 13142 - DNA, 103 bp, Artificial Sequence
  Synthetic Polynucleotide
taatacgactcactatagggaagtcaaagggcctttctgagaatcgactaaacagaggagatagtcgatgctcagaaagaacctggcggcagcgcaaaagatg

SEQ ID NO: 13143 - DNA, 103 bp, Artificial Sequence
  Synthetic Polynucleotide
taatacgactcactatagggaatggaagtcaaagggcctttctgagaatcaacagaggagagattctatgaaaggccctaacctggcggcagcgcaaaagatg

SEQ ID NO: 13144 - DNA, 103 bp, Artificial Sequence
  Synthetic Polynucleotide
taatacgactcactatagggctgttggatcatcgtcttgctgttctgagtaacagaggagaactcagatgagcaagacgaacctggcggcagcgcaaaagatg

SEQ ID NO: 13145 - DNA, 103 bp, Artificial Sequence
  Synthetic Polynucleotide
taatacgactcactatagggtggacaatggaagtcaaagggcctttctgaaacagaggagatcagaaatgccctttgacaacctggcggcagcgcaaaagatg

SEQ ID NO: 13146 - DNA, 103 bp, Artificial Sequence
  Synthetic Polynucleotide
taatacgactcactataggggatgttggacaatggaagtcaaagggccttaacagaggagaaaggccatgtgacttccaaacctggcggcagcgcaaaagatg

SEQ ID NO: 13147 - DNA, 103 bp, Artificial Sequence
  Synthetic Polynucleotide
taatacgactcactatagggcgctagatgttggacaatggaagtcaaaggaacagaggagacctttgatgtccattgtcaacctggcggcagcgcaaaagatg

SEQ ID NO: 13148 - DNA, 103 bp, Artificial Sequence
  Synthetic Polynucleotide
taatacgactcactatagggaggtgcgctagatgttggacaatggaagtcaacagaggagagacttcatgtgtccaacaaacctggcggcagcgcaaaagatg

SEQ ID NO: 13149 - DNA, 103 bp, Artificial Sequence
  Synthetic Polynucleotide
taatacgactcactatagggtctgcaggtgcgctagatgttggacaatggaacagaggagaccattgatgaacatctagaacctggcggcagcgcaaaagatg

SEQ ID NO: 13150 - DNA, 103 bp, Artificial Sequence
  Synthetic Polynucleotide
taatacgactcactatagggctcggtctgcaggtgcgctagatgttggacaacagaggagagtccaaatgctagcgcacaacctggcggcagcgcaaaagatg

SEQ ID NO: 13151 - DNA, 103 bp, Artificial Sequence
  Synthetic Polynucleotide
taatacgactcactatagggctaatctcggtctgcaggtgcgctagatgtaacagaggagaacatctatggcacctgcaaacctggcggcagcgcaaaagatg

SEQ ID NO: 13152 - DNA, 103 bp, Artificial Sequence
  Synthetic Polynucleotide
taatacgactcactatagggactccctaatctcggtctgcaggtgcgctaaacagaggagatagcgcatgtgcagaccgaacctggcggcagcgcaaaagatg

SEQ ID NO: 13153 - DNA, 103 bp, Artificial Sequence
  Synthetic Polynucleotide
taatacgactcactatagggaaccaactccctaatctcggtctgcaggtgaacagaggagacacctgatgaccgagattaacctggcggcagcgcaaaagatg

SEQ ID NO: 13154 - DNA, 103 bp, Artificial Sequence
  Synthetic Polynucleotide
taatacgactcactatagggtcattaaccaactccctaatctcggtctgcaacagaggagagcagacatggattagggaaacctggcggcagcgcaaaagatg

SEQ ID NO: 13155 - DNA, 103 bp, Artificial Sequence
  Synthetic Polynucleotide
taatacgactcactatagggagaatctgttggatcatcgtcttgctgttcaacagaggagagaacagatggacgatgataacctggcggcagcgcaaaagatg

SEQ ID NO: 13156 - DNA, 103 bp, Artificial Sequence
  Synthetic Polynucleotide
taatacgactcactatagggtatagtcattaaccaactccctaatctcggaacagaggagaccgagaatggggagttggaacctggcggcagcgcaaaagatg

SEQ ID NO: 13157 - DNA, 103 bp, Artificial Sequence
  Synthetic Polynucleotide
taatacgactcactatagggttgattatagtcattaaccaactccctaataacagaggagaattaggatgttggttaataacctggcggcagcgcaaaagatg

SEQ ID NO: 13158 - DNA, 103 bp, Artificial Sequence
  Synthetic Polynucleotide
taatacgactcactatagggctttgttgattatagtcattaaccaactccaacagaggagaggagttatgtaatgactaaacctggcggcagcgcaaaagatg

SEQ ID NO: 13159 - DNA, 103 bp, Artificial Sequence
  Synthetic Polynucleotide
taatacgactcactatagggtttgtctttgttgattatagtcattaaccaaacagaggagatggttaatgactataatcaacctggcggcagcgcaaaagatg

SEQ ID NO: 13160 - DNA, 103 bp, Artificial Sequence
  Synthetic Polynucleotide
taatacgactcactatagggtcgactttgtctttgttgattatagtcattaacagaggagaaatgacatgaatcaacaaaacctggcggcagcgcaaaagatg

SEQ ID NO: 13161 - DNA, 103 bp, Artificial Sequence
  Synthetic Polynucleotide
taatacgactcactatagggtgggttcgactttgtctttgttgattatagaacagaggagactataaatgacaaagacaaacctggcggcagcgcaaaagatg

SEQ ID NO: 13162 - DNA, 103 bp, Artificial Sequence
  Synthetic Polynucleotide
taatacgactcactatagggatgtttgggttcgactttgtctttgttgataacagaggagaatcaacatggacaaagtcaacctggcggcagcgcaaaagatg

SEQ ID NO: 13163 - DNA, 103 bp, Artificial Sequence
  Synthetic Polynucleotide
taatacgactcactatagggatgatatgtttgggttcgactttgtctttgaacagaggagacaaagaatgagtcgaaccaacctggcggcagcgcaaaagatg

SEQ ID NO: 13164 - DNA, 103 bp, Artificial Sequence
  Synthetic Polynucleotide
taatacgactcactatagggatgaaatgatatgtttgggttcgactttgtaacagaggagaacaaagatgaacccaaacaacctggcggcagcgcaaaagatg

SEQ ID NO: 13165 - DNA, 103 bp, Artificial Sequence
  Synthetic Polynucleotide
taatacgactcactatagggttttaatgaaatgatatgtttgggttcgacaacagaggagagtcgaaatgaaacatatcaacctggcggcagcgcaaaagatg

SEQ ID NO: 13166 - DNA, 103 bp, Artificial Sequence
  Synthetic Polynucleotide
taatacgactcactatagggtcctgagaatctgttggatcatcgtcttgcaacagaggagagcaagaatgtgatccaacaacctggcggcagcgcaaaagatg

SEQ ID NO: 13167 - DNA, 103 bp, Artificial Sequence
  Synthetic Polynucleotide
taatacgactcactatagggtattgttttaatgaaatgatatgtttgggtaacagaggagaacccaaatgtatcatttcaacctggcggcagcgcaaaagatg

SEQ ID NO: 13168 - DNA, 103 bp, Artificial Sequence
  Synthetic Polynucleotide
taatacgactcactatagggccttttattgttttaatgaaatgatatgttaacagaggagaaacataatgtttcattaaaacctggcggcagcgcaaaagatg

SEQ ID NO: 13169 - DNA, 103 bp, Artificial Sequence
  Synthetic Polynucleotide
taatacgactcactatagggtacgaccttttattgttttaatgaaatgataacagaggagaatcattatgttaaaacaaaacctggcggcagcgcaaaagatg

SEQ ID NO: 13170 - DNA, 103 bp, Artificial Sequence
  Synthetic Polynucleotide
taatacgactcactatagggtgtaatacgaccttttattgttttaatgaaaacagaggagattcattatgacaataaaaaacctggcggcagcgcaaaagatg

SEQ ID NO: 13171 - DNA, 103 bp, Artificial Sequence
  Synthetic Polynucleotide
taatacgactcactatagggaattttgtaatacgaccttttattgttttaaacagaggagataaaacatgaaaaggtcgaacctggcggcagcgcaaaagatg

SEQ ID NO: 13172 - DNA, 103 bp, Artificial Sequence
  Synthetic Polynucleotide
taatacgactcactatagggttaccaattttgtaatacgaccttttattgaacagaggagacaataaatggtcgtattaaacctggcggcagcgcaaaagatg

SEQ ID NO: 13173 - DNA, 103 bp, Artificial Sequence
  Synthetic Polynucleotide
taatacgactcactatagggatcatttaccaattttgtaatacgacctttaacagaggagaaaaggtatgattacaaaaaacctggcggcagcgcaaaagatg

SEQ ID NO: 13174 - DNA, 103 bp, Artificial Sequence
  Synthetic Polynucleotide
taatacgactcactatagggaggtaatcatttaccaattttgtaatacgaaacagaggagatcgtatatgaaaattggtaacctggcggcagcgcaaaagatg

SEQ ID NO: 13175 - DNA, 103 bp, Artificial Sequence
  Synthetic Polynucleotide
taatacgactcactatagggacttaaggtaatcatttaccaattttgtaaaacagaggagattacaaatgtggtaaatgaacctggcggcagcgcaaaagatg

SEQ ID NO: 13176 - DNA, 103 bp, Artificial Sequence
  Synthetic Polynucleotide
taatacgactcactatagggaaagaacttaaggtaatcatttaccaatttaacagaggagaaaattgatgaatgattacaacctggcggcagcgcaaaagatg

SEQ ID NO: 13177 - DNA, 103 bp, Artificial Sequence
  Synthetic Polynucleotide
taatacgactcactatagggtagtgtcctgagaatctgttggatcatcgtaacagaggagaacgatgatgcaacagattaacctggcggcagcgcaaaagatg

SEQ ID NO: 13178 - DNA, 103 bp, Artificial Sequence
  Synthetic Polynucleotide
taatacgactcactatagggattagaaagaacttaaggtaatcatttaccaacagaggagaggtaaaatgttaccttaaaacctggcggcagcgcaaaagatg

SEQ ID NO: 13179 - DNA, 103 bp, Artificial Sequence
  Synthetic Polynucleotide
taatacgactcactataggggtattattagaaagaacttaaggtaatcataacagaggagaatgattatgttaagttctaacctggcggcagcgcaaaagatg

SEQ ID NO: 13180 - DNA, 103 bp, Artificial Sequence
  Synthetic Polynucleotide
taatacgactcactatagggggcttgtattattagaaagaacttaaggtaaacagaggagataccttatgttctttctaaacctggcggcagcgcaaaagatg

SEQ ID NO: 13181 - DNA, 103 bp, Artificial Sequence
  Synthetic Polynucleotide
taatacgactcactatagggtttaaggcttgtattattagaaagaacttaaacagaggagataagttatgtctaataataacctggcggcagcgcaaaagatg

SEQ ID NO: 13182 - DNA, 103 bp, Artificial Sequence
  Synthetic Polynucleotide
taatacgactcactatagggtgtgctttaaggcttgtattattagaaagaaacagaggagatctttcatgtaatacaagaacctggcggcagcgcaaaagatg

SEQ ID NO: 13183 - DNA, 103 bp, Artificial Sequence
  Synthetic Polynucleotide
taatacgactcactataggggcaattgtgctttaaggcttgtattattagaacagaggagactaataatgcaagccttaaacctggcggcagcgcaaaagatg

SEQ ID NO: 13184 - DNA, 103 bp, Artificial Sequence
  Synthetic Polynucleotide
taatacgactcactatagggcatgtgcaattgtgctttaaggcttgtattaacagaggagaaatacaatgcttaaagcaaacctggcggcagcgcaaaagatg

SEQ ID NO: 13185 - DNA, 103 bp, Artificial Sequence
  Synthetic Polynucleotide
taatacgactcactatagggcttgccatgtgcaattgtgctttaaggcttaacagaggagaaagcctatgagcacaattaacctggcggcagcgcaaaagatg

SEQ ID NO: 13186 - DNA, 103 bp, Artificial Sequence
  Synthetic Polynucleotide
taatacgactcactatagggttcctcttgccatgtgcaattgtgctttaaaacagaggagattaaagatgaattgcacaaacctggcggcagcgcaaaagatg

SEQ ID NO: 13187 - DNA, 103 bp, Artificial Sequence
  Synthetic Polynucleotide
taatacgactcactatagggcttagttcctcttgccatgtgcaattgtgcaacagaggagagcacaaatgcacatggcaaacctggcggcagcgcaaaagatg

SEQ ID NO: 13188 - DNA, 103 bp, Artificial Sequence
  Synthetic Polynucleotide
taatacgactcactataggggacaagttgagtcttttggactgtctttgcaacagaggagagcaaagatggtccaaaagaacctggcggcagcgcaaaagatg

SEQ ID NO: 13189 - DNA, 103 bp, Artificial Sequence
  Synthetic Polynucleotide
taatacgactcactataggggatggtagtgtcctgagaatctgttggatcaacagaggagagatccaatggattctcagaacctggcggcagcgcaaaagatg

SEQ ID NO: 13190 - DNA, 103 bp, Artificial Sequence
  Synthetic Polynucleotide
taatacgactcactataggggagctcttagttcctcttgccatgtgcaataacagaggagaattgcaatgggcaagaggaacctggcggcagcgcaaaagatg

SEQ ID NO: 13191 - DNA, 103 bp, Artificial Sequence
  Synthetic Polynucleotide
taatacgactcactatagggtggaagagctcttagttcctcttgccatgtaacagaggagaacatggatggaggaactaaacctggcggcagcgcaaaagatg

SEQ ID NO: 13192 - DNA, 103 bp, Artificial Sequence
  Synthetic Polynucleotide
taatacgactcactatagggagatctggaagagctcttagttcctcttgcaacagaggagagcaagaatgactaagagcaacctggcggcagcgcaaaagatg

SEQ ID NO: 13193 - DNA, 103 bp, Artificial Sequence
  Synthetic Polynucleotide
taatacgactcactatagggtaattagatctggaagagctcttagttcctaacagaggagaaggaacatggagctcttcaacctggcggcagcgcaaaagatg

SEQ ID NO: 13194 - DNA, 103 bp, Artificial Sequence
  Synthetic Polynucleotide
taatacgactcactataggggacactaattagatctggaagagctcttagaacagaggagactaagaatgcttccagataacctggcggcagcgcaaaagatg

SEQ ID NO: 13195 - DNA, 103 bp, Artificial Sequence
  Synthetic Polynucleotide
taatacgactcactataggggtgcagacactaattagatctggaagagctaacagaggagaagctctatgagatctaataacctggcggcagcgcaaaagatg

SEQ ID NO: 13196 - DNA, 103 bp, Artificial Sequence
  Synthetic Polynucleotide
taatacgactcactatagggatcgagtgcagacactaattagatctggaaaacagaggagattccagatgtaattagtgaacctggcggcagcgcaaaagatg

SEQ ID NO: 13197 - DNA, 103 bp, Artificial Sequence
  Synthetic Polynucleotide
taatacgactcactatagggatagaatcgagtgcagacactaattagatcaacagaggagagatctaatgagtgtctgcaacctggcggcagcgcaaaagatg

SEQ ID NO: 13198 - DNA, 103 bp, Artificial Sequence
  Synthetic Polynucleotide
taatacgactcactataggggtatgatagaatcgagtgcagacactaattaacagaggagaaattagatgctgcactcgaacctggcggcagcgcaaaagatg

SEQ ID NO: 13199 - DNA, 103 bp, Artificial Sequence
  Synthetic Polynucleotide
taatacgactcactatagggttcgagtatgatagaatcgagtgcagacacaacagaggagagtgtctatgctcgattctaacctggcggcagcgcaaaagatg

SEQ ID NO: 13200 - DNA, 103 bp, Artificial Sequence
  Synthetic Polynucleotide
taatacgactcactatagggtcagggatggtagtgtcctgagaatctgttaacagaggagaaacagaatgtcaggacacaacctggcggcagcgcaaaagatg

SEQ ID NO: 13201 - DNA, 103 bp, Artificial Sequence
  Synthetic Polynucleotide
taatacgactcactatagggacagtttcgagtatgatagaatcgagtgcaaacagaggagatgcactatgttctatcataacctggcggcagcgcaaaagatg

SEQ ID NO: 13202 - DNA, 103 bp, Artificial Sequence
  Synthetic Polynucleotide
taatacgactcactatagggcatgaacagtttcgagtatgatagaatcgaaacagaggagatcgattatgtcatactcgaacctggcggcagcgcaaaagatg

SEQ ID NO: 13203 - DNA, 103 bp, Artificial Sequence
  Synthetic Polynucleotide
taatacgactcactatagggtttcacatgaacagtttcgagtatgatagaaacagaggagatctatcatgctcgaaactaacctggcggcagcgcaaaagatg

SEQ ID NO: 13204 - DNA, 103 bp, Artificial Sequence
  Synthetic Polynucleotide
taatacgactcactatagggccggttttcacatgaacagtttcgagtatgaacagaggagacatactatgaactgttcaaacctggcggcagcgcaaaagatg

SEQ ID NO: 13205 - DNA, 103 bp, Artificial Sequence
  Synthetic Polynucleotide
taatacgactcactatagggaggaaccggttttcacatgaacagtttcgaaacagaggagatcgaaaatgttcatgtgaaacctggcggcagcgcaaaagatg

SEQ ID NO: 13206 - DNA, 103 bp, Artificial Sequence
  Synthetic Polynucleotide
taatacgactcactataggggtactaggaaccggttttcacatgaacagtaacagaggagaactgttatggtgaaaaccaacctggcggcagcgcaaaagatg

SEQ ID NO: 13207 - DNA, 103 bp, Artificial Sequence
  Synthetic Polynucleotide
taatacgactcactatagggagtctgtactaggaaccggttttcacatgaaacagaggagatcatgtatgaaccggttcaacctggcggcagcgcaaaagatg

SEQ ID NO: 13208 - DNA, 103 bp, Artificial Sequence
  Synthetic Polynucleotide
taatacgactcactatagggtataaagtctgtactaggaaccggttttcaaacagaggagatgaaaaatggttcctagtaacctggcggcagcgcaaaagatg

SEQ ID NO: 13209 - DNA, 103 bp, Artificial Sequence
  Synthetic Polynucleotide
taatacgactcactatagggataagtataaagtctgtactaggaaccggtaacagaggagaaccggtatgtagtacagaaacctggcggcagcgcaaaagatg

SEQ ID NO: 13210 - DNA, 103 bp, Artificial Sequence
  Synthetic Polynucleotide
taatacgactcactataggggcgtgataagtataaagtctgtactaggaaaacagaggagattcctaatgcagactttaaacctggcggcagcgcaaaagatg

SEQ ID NO: 13211 - DNA, 103 bp, Artificial Sequence
  Synthetic Polynucleotide
taatacgactcactatagggtgatatcagggatggtagtgtcctgagaataacagaggagaattctcatgacactaccaaacctggcggcagcgcaaaagatg

SEQ ID NO: 13212 - DNA, 103 bp, Artificial Sequence
  Synthetic Polynucleotide
taatacgactcactatagggtgcatgcgtgataagtataaagtctgtactaacagaggagaagtacaatgtttatacttaacctggcggcagcgcaaaagatg

SEQ ID NO: 13213 - DNA, 103 bp, Artificial Sequence
  Synthetic Polynucleotide
taatacgactcactatagggaatcctgcatgcgtgataagtataaagtctaacagaggagaagacttatgacttatcacaacctggcggcagcgcaaaagatg

SEQ ID NO: 13214 - DNA, 103 bp, Artificial Sequence
  Synthetic Polynucleotide
taatacgactcactatagggttccgaatcctgcatgcgtgataagtataaaacagaggagattatacatgtcacgcatgaacctggcggcagcgcaaaagatg

SEQ ID NO: 13215 - DNA, 103 bp, Artificial Sequence
  Synthetic Polynucleotide
taatacgactcactatagggttgatttccgaatcctgcatgcgtgataagaacagaggagacttatcatgcatgcaggaaacctggcggcagcgcaaaagatg

SEQ ID NO: 13216 - DNA, 103 bp, Artificial Sequence
  Synthetic Polynucleotide
taatacgactcactatagggttagtttgatttccgaatcctgcatgcgtgaacagaggagacacgcaatgaggattcggaacctggcggcagcgcaaaagatg

SEQ ID NO: 13217 - DNA, 103 bp, Artificial Sequence
  Synthetic Polynucleotide
taatacgactcactatagggatctattagtttgatttccgaatcctgcataacagaggagaatgcagatgtcggaaatcaacctggcggcagcgcaaaagatg

SEQ ID NO: 13218 - DNA, 103 bp, Artificial Sequence
  Synthetic Polynucleotide
taatacgactcactatagggaatctatctattagtttgatttccgaatccaacagaggagaggattcatgaatcaaactaacctggcggcagcgcaaaagatg

SEQ ID NO: 13219 - DNA, 103 bp, Artificial Sequence
  Synthetic Polynucleotide
taatacgactcactatagggcggtcaatctatctattagtttgatttccgaacagaggagacggaaaatgaactaatagaacctggcggcagcgcaaaagatg

SEQ ID NO: 13220 - DNA, 103 bp, Artificial Sequence
  Synthetic Polynucleotide
taatacgactcactatagggaaggccggtcaatctatctattagtttgataacagaggagaatcaaaatgatagatagaaacctggcggcagcgcaaaagatg

SEQ ID NO: 13221 - DNA, 103 bp, Artificial Sequence
  Synthetic Polynucleotide
taatacgactcactatagggctaagaaggccggtcaatctatctattagtaacagaggagaactaatatgtagattgacaacctggcggcagcgcaaaagatg

SEQ ID NO: 13222 - DNA, 103 bp, Artificial Sequence
  Synthetic Polynucleotide
taatacgactcactatagggaacaatgatatcagggatggtagtgtcctgaacagaggagacaggacatgaccatccctaacctggcggcagcgcaaaagatg

SEQ ID NO: 13223 - DNA, 103 bp, Artificial Sequence
  Synthetic Polynucleotide
taatacgactcactatagggatagactaagaaggccggtcaatctatctaaacagaggagatagataatgtgaccggccaacctggcggcagcgcaaaagatg

SEQ ID NO: 13224 - DNA, 103 bp, Artificial Sequence
  Synthetic Polynucleotide
taatacgactcactatagggtggacatagactaagaaggccggtcaatctaacagaggagaagattgatgggccttcttaacctggcggcagcgcaaaagatg

SEQ ID NO: 13225 - DNA, 103 bp, Artificial Sequence
  Synthetic Polynucleotide
taatacgactcactatagggccatttggacatagactaagaaggccggtcaacagaggagagaccggatgtcttagtctaacctggcggcagcgcaaaagatg

SEQ ID NO: 13226 - DNA, 103 bp, Artificial Sequence
  Synthetic Polynucleotide
taatacgactcactatagggaaaaaccatttggacatagactaagaaggcaacagaggagagccttcatggtctatgtcaacctggcggcagcgcaaaagatg

SEQ ID NO: 13227 - DNA, 103 bp, Artificial Sequence
  Synthetic Polynucleotide
taatacgactcactatagggccgaaaaaaaccatttggacatagactaagaacagaggagacttagtatgtgtccaaataacctggcggcagcgcaaaagatg

SEQ ID NO: 13228 - DNA, 103 bp, Artificial Sequence
  Synthetic Polynucleotide
taatacgactcactatagggccttaccgaaaaaaaccatttggacatagaaacagaggagatctatgatgaaatggtttaacctggcggcagcgcaaaagatg

SEQ ID NO: 13229 - DNA, 103 bp, Artificial Sequence
  Synthetic Polynucleotide
taatacgactcactatagggagagtccttaccgaaaaaaaccatttggacaacagaggagagtccaaatggtttttttcaacctggcggcagcgcaaaagatg

SEQ ID NO: 13230 - DNA, 103 bp, Artificial Sequence
  Synthetic Polynucleotide
taatacgactcactatagggcgtcaagagtccttaccgaaaaaaaccattaacagaggagaaatggtatgtttcggtaaaacctggcggcagcgcaaaagatg

SEQ ID NO: 13231 - DNA, 103 bp, Artificial Sequence
  Synthetic Polynucleotide
taatacgactcactatagggttgtacgtcaagagtccttaccgaaaaaaaaacagaggagattttttatggtaaggactaacctggcggcagcgcaaaagatg

SEQ ID NO: 13232 - DNA, 103 bp, Artificial Sequence
  Synthetic Polynucleotide
taatacgactcactatagggggagtttgtacgtcaagagtccttaccgaaaacagaggagattcggtatggactcttgaaacctggcggcagcgcaaaagatg

SEQ ID NO: 13233 - DNA, 103 bp, Artificial Sequence
  Synthetic Polynucleotide
taatacgactcactataggggggtcaacaatgatatcagggatggtagtgaacagaggagacactacatgccctgatataacctggcggcagcgcaaaagatg

SEQ ID NO: 13234 - DNA, 103 bp, Artificial Sequence
  Synthetic Polynucleotide
taatacgactcactatagggtatgtggagtttgtacgtcaagagtccttaaacagaggagataaggaatgttgacgtacaacctggcggcagcgcaaaagatg

SEQ ID NO: 13235 - DNA, 103 bp, Artificial Sequence
  Synthetic Polynucleotide
taatacgactcactatagggataactatgtggagtttgtacgtcaagagtaacagaggagaactcttatggtacaaactaacctggcggcagcgcaaaagatg

SEQ ID NO: 13236 - DNA, 103 bp, Artificial Sequence
  Synthetic Polynucleotide
taatacgactcactatagggattgtataactatgtggagtttgtacgtcaaacagaggagatgacgtatgaactccacaaacctggcggcagcgcaaaagatg

SEQ ID NO: 13237 - DNA, 103 bp, Artificial Sequence
  Synthetic Polynucleotide
taatacgactcactataggggtaccattgtataactatgtggagtttgtaaacagaggagatacaaaatgcacatagttaacctggcggcagcgcaaaagatg

SEQ ID NO: 13238 - DNA, 103 bp, Artificial Sequence
  Synthetic Polynucleotide
taatacgactcactatagggtcctggtaccattgtataactatgtggagtaacagaggagaactccaatgagttatacaaacctggcggcagcgcaaaagatg

SEQ ID NO: 13239 - DNA, 103 bp, Artificial Sequence
  Synthetic Polynucleotide
taatacgactcactatagggtagtgtcctggtaccattgtataactatgtaacagaggagaacatagatgtacaatggtaacctggcggcagcgcaaaagatg

SEQ ID NO: 13240 - DNA, 103 bp, Artificial Sequence
  Synthetic Polynucleotide
taatacgactcactatagggacatatagtgtcctggtaccattgtataacaacagaggagagttataatgtggtaccagaacctggcggcagcgcaaaagatg

SEQ ID NO: 13241 - DNA, 103 bp, Artificial Sequence
  Synthetic Polynucleotide
taatacgactcactatagggaatttacatatagtgtcctggtaccattgtaacagaggagaacaatgatgccaggacacaacctggcggcagcgcaaaagatg

SEQ ID NO: 13242 - DNA, 103 bp, Artificial Sequence
  Synthetic Polynucleotide
taatacgactcactataggggggtcaatttacatatagtgtcctggtaccaacagaggagaggtaccatgacactatataacctggcggcagcgcaaaagatg

SEQ ID NO: 13243 - DNA, 103 bp, Artificial Sequence
  Synthetic Polynucleotide
taatacgactcactatagggtcttagggtcaatttacatatagtgtcctgaacagaggagacaggacatgatatgtaaaaacctggcggcagcgcaaaagatg

SEQ ID NO: 13244 - DNA, 103 bp, Artificial Sequence
  Synthetic Polynucleotide
taatacgactcactatagggcatccgggtcaacaatgatatcagggatggaacagaggagaccatccatgatatcattgaacctggcggcagcgcaaaagatg

SEQ ID NO: 13245 - DNA, 103 bp, Artificial Sequence
  Synthetic Polynucleotide
taatacgactcactatagggctctttcttagggtcaatttacatatagtgaacagaggagacactatatgtaaattgacaacctggcggcagcgcaaaagatg

SEQ ID NO: 13246 - DNA, 103 bp, Artificial Sequence
  Synthetic Polynucleotide
taatacgactcactatagggaattactctttcttagggtcaatttacataaacagaggagatatgtaatgtgaccctaaaacctggcggcagcgcaaaagatg

SEQ ID NO: 13247 - DNA, 103 bp, Artificial Sequence
  Synthetic Polynucleotide
taatacgactcactatagggtgtcgaattactctttcttagggtcaatttaacagaggagaaaattgatgctaagaaagaacctggcggcagcgcaaaagatg

SEQ ID NO: 13248 - DNA, 103 bp, Artificial Sequence
  Synthetic Polynucleotide
taatacgactcactatagggctgtgtgtcgaattactctttcttagggtcaacagaggagagaccctatgaaagagtaaaacctggcggcagcgcaaaagatg

SEQ ID NO: 13249 - DNA, 103 bp, Artificial Sequence
  Synthetic Polynucleotide
taatacgactcactataggggaactctgtgtgtcgaattactctttcttaaacagaggagataagaaatggtaattcgaaacctggcggcagcgcaaaagatg

SEQ ID NO: 13250 - DNA, 103 bp, Artificial Sequence
  Synthetic Polynucleotide
taatacgactcactatagggcttgagaactctgtgtgtcgaattactcttaacagaggagaaagagtatgtcgacacacaacctggcggcagcgcaaaagatg

SEQ ID NO: 13251 - DNA, 103 bp, Artificial Sequence
  Synthetic Polynucleotide
taatacgactcactatagggtttcacttgagaactctgtgtgtcgaattaaacagaggagataattcatgacacagagtaacctggcggcagcgcaaaagatg

SEQ ID NO: 13252 - DNA, 103 bp, Artificial Sequence
  Synthetic Polynucleotide
taatacgactcactatagggaggggtttcacttgagaactctgtgtgtcgaacagaggagacgacacatggagttctcaaacctggcggcagcgcaaaagatg

SEQ ID NO: 13253 - DNA, 103 bp, Artificial Sequence
  Synthetic Polynucleotide
taatacgactcactatagggagatgaggggtttcacttgagaactctgtgaacagaggagacacagaatgctcaagtgaaacctggcggcagcgcaaaagatg

SEQ ID NO: 13254 - DNA, 103 bp, Artificial Sequence
  Synthetic Polynucleotide
taatacgactcactatagggatctgagatgaggggtttcacttgagaactaacagaggagaagttctatggtgaaacccaacctggcggcagcgcaaaagatg

SEQ ID NO: 13255 - DNA, 103 bp, Artificial Sequence
  Synthetic Polynucleotide
taatacgactcactataggggccatcatccgggtcaacaatgatatcaggaacagaggagacctgatatgattgttgacaacctggcggcagcgcaaaagatg

SEQ ID NO: 13256 - DNA, 103 bp, Artificial Sequence
  Synthetic Polynucleotide
taatacgactcactatagggagataatctgagatgaggggtttcacttgaaacagaggagatcaagtatgacccctcataacctggcggcagcgcaaaagatg

SEQ ID NO: 13257 - DNA, 103 bp, Artificial Sequence
  Synthetic Polynucleotide
taatacgactcactatagggaccacagataatctgagatgaggggtttcaaacagaggagatgaaacatgtcatctcagaacctggcggcagcgcaaaagatg

SEQ ID NO: 13258 - DNA, 103 bp, Artificial Sequence
  Synthetic Polynucleotide
taatacgactcactatagggttgcaaccacagataatctgagatgaggggaacagaggagacccctcatgtcagattataacctggcggcagcgcaaaagatg

SEQ ID NO: 13259 - DNA, 103 bp, Artificial Sequence
  Synthetic Polynucleotide
taatacgactcactatagggtagaattgcaaccacagataatctgagatgaacagaggagacatctcatgttatctgtgaacctggcggcagcgcaaaagatg

SEQ ID NO: 13260 - DNA, 103 bp, Artificial Sequence
  Synthetic Polynucleotide
taatacgactcactataggggatattagaattgcaaccacagataatctgaacagaggagacagattatgtgtggttgcaacctggcggcagcgcaaaagatg

SEQ ID NO: 13261 - DNA, 103 bp, Artificial Sequence
  Synthetic Polynucleotide
taatacgactcactatagggaatcggatattagaattgcaaccacagataaacagaggagatatctgatgttgcaattcaacctggcggcagcgcaaaagatg

SEQ ID NO: 13262 - DNA, 103 bp, Artificial Sequence
  Synthetic Polynucleotide
taatacgactcactataggggtaacaatcggatattagaattgcaaccacaacagaggagagtggttatgattctaataaacctggcggcagcgcaaaagatg

SEQ ID NO: 13263 - DNA, 103 bp, Artificial Sequence
  Synthetic Polynucleotide
taatacgactcactatagggacggggtaacaatcggatattagaattgcaaacagaggagatgcaatatgaatatccgaaacctggcggcagcgcaaaagatg

SEQ ID NO: 13264 - DNA, 103 bp, Artificial Sequence
  Synthetic Polynucleotide
taatacgactcactatagggtactcacggggtaacaatcggatattagaaaacagaggagattctaaatgccgattgttaacctggcggcagcgcaaaagatg

SEQ ID NO: 13265 - DNA, 103 bp, Artificial Sequence
  Synthetic Polynucleotide
taatacgactcactatagggagttatactcacggggtaacaatcggatataacagaggagaatatccatgtgttaccccaacctggcggcagcgcaaaagatg

SEQ ID NO: 13266 - DNA, 103 bp, Artificial Sequence
  Synthetic Polynucleotide
taatacgactcactatagggtatctgccatcatccgggtcaacaatgataaacagaggagatatcatatgtgacccggaaacctggcggcagcgcaaaagatg

SEQ ID NO: 13267 - DNA, 103 bp, Artificial Sequence
  Synthetic Polynucleotide
taatacgactcactatagggtctggagttatactcacggggtaacaatcgaacagaggagacgattgatgccccgtgagaacctggcggcagcgcaaaagatg

SEQ ID NO: 13268 - DNA, 103 bp, Artificial Sequence
  Synthetic Polynucleotide
taatacgactcactatagggattaatctggagttatactcacggggtaacaacagaggagagttaccatgtgagtataaaacctggcggcagcgcaaaagatg

SEQ ID NO: 13269 - DNA, 103 bp, Artificial Sequence
  Synthetic Polynucleotide
taatacgactcactatagggcttatattaatctggagttatactcacgggaacagaggagacccgtgatgataactccaaacctggcggcagcgcaaaagatg

SEQ ID NO: 13270 - DNA, 103 bp, Artificial Sequence
  Synthetic Polynucleotide
taatacgactcactatagggattttcttatattaatctggagttatactcaacagaggagagagtatatgtccagattaaacctggcggcagcgcaaaagatg

SEQ ID NO: 13271 - DNA, 103 bp, Artificial Sequence
  Synthetic Polynucleotide
taatacgactcactatagggaaggtattttcttatattaatctggagttaaacagaggagataactcatgattaatataaacctggcggcagcgcaaaagatg

SEQ ID NO: 13272 - DNA, 103 bp, Artificial Sequence
  Synthetic Polynucleotide
taatacgactcactataggggacaaaaggtattttcttatattaatctggaacagaggagaccagatatgtataagaaaaacctggcggcagcgcaaaagatg

SEQ ID NO: 13273 - DNA, 103 bp, Artificial Sequence
  Synthetic Polynucleotide
taatacgactcactatagggtgcaggacaaaaggtattttcttatattaaaacagaggagattaataatggaaaataccaacctggcggcagcgcaaaagatg

SEQ ID NO: 13274 - DNA, 103 bp, Artificial Sequence
  Synthetic Polynucleotide
taatacgactcactatagggaaatttgcaggacaaaaggtattttcttataacagaggagaataagaatgtaccttttgaacctggcggcagcgcaaaagatg

SEQ ID NO: 13275 - DNA, 103 bp, Artificial Sequence
  Synthetic Polynucleotide
taatacgactcactatagggaagataaatttgcaggacaaaaggtattttaacagaggagaaaaataatgtttgtcctgaacctggcggcagcgcaaaagatg

SEQ ID NO: 13276 - DNA, 103 bp, Artificial Sequence
  Synthetic Polynucleotide
taatacgactcactatagggaatttaagataaatttgcaggacaaaaggtaacagaggagaacctttatgcctgcaaataacctggcggcagcgcaaaagatg

SEQ ID NO: 13277 - DNA, 103 bp, Artificial Sequence
  Synthetic Polynucleotide
taatacgactcactatagggtgttgtatctgccatcatccgggtcaacaaaacagaggagattgttgatgcggatgatgaacctggcggcagcgcaaaagatg

SEQ ID NO: 13278 - DNA, 103 bp, Artificial Sequence
  Synthetic Polynucleotide
taatacgactcactatagggacttgaatttaagataaatttgcaggacaaaacagaggagattgtccatgaaatttatcaacctggcggcagcgcaaaagatg

SEQ ID NO: 13279 - DNA, 103 bp, Artificial Sequence
  Synthetic Polynucleotide
taatacgactcactatagggtatgtacttgaatttaagataaatttgcagaacagaggagactgcaaatgtatcttaaaaacctggcggcagcgcaaaagatg

SEQ ID NO: 13280 - DNA, 103 bp, Artificial Sequence
  Synthetic Polynucleotide
taatacgactcactataggggagcgtatgtacttgaatttaagataaattaacagaggagaaatttaatgtaaattcaaaacctggcggcagcgcaaaagatg

SEQ ID NO: 13281 - DNA, 103 bp, Artificial Sequence
  Synthetic Polynucleotide
taatacgactcactatagggatttggagcgtatgtacttgaatttaagataacagaggagaatcttaatgtcaagtacaaacctggcggcagcgcaaaagatg

SEQ ID NO: 13282 - DNA, 103 bp, Artificial Sequence
  Synthetic Polynucleotide
taatacgactcactatagggatacgatttggagcgtatgtacttgaatttaacagaggagaaaattcatgtacatacgcaacctggcggcagcgcaaaagatg

SEQ ID NO: 13283 - DNA, 103 bp, Artificial Sequence
  Synthetic Polynucleotide
taatacgactcactatagggattttatacgatttggagcgtatgtacttgaacagaggagacaagtaatgacgctccaaaacctggcggcagcgcaaaagatg

SEQ ID NO: 13284 - DNA, 103 bp, Artificial Sequence
  Synthetic Polynucleotide
taatacgactcactatagggttaatattttatacgatttggagcgtatgtaacagaggagaacatacatgccaaatcgtaacctggcggcagcgcaaaagatg

SEQ ID NO: 13285 - DNA, 103 bp, Artificial Sequence
  Synthetic Polynucleotide
taatacgactcactatagggttttcttaatattttatacgatttggagcgaacagaggagacgctccatgtcgtataaaaacctggcggcagcgcaaaagatg

SEQ ID NO: 13286 - DNA, 103 bp, Artificial Sequence
  Synthetic Polynucleotide
taatacgactcactatagggtaactttttcttaatattttatacgatttgaacagaggagacaaatcatgtaaaatattaacctggcggcagcgcaaaagatg

SEQ ID NO: 13287 - DNA, 103 bp, Artificial Sequence
  Synthetic Polynucleotide
taatacgactcactatagggcagattaactttttcttaatattttatacgaacagaggagacgtataatgtattaagaaaacctggcggcagcgcaaaagatg

SEQ ID NO: 13288 - DNA, 103 bp, Artificial Sequence
  Synthetic Polynucleotide
taatacgactcactatagggataattgttgtatctgccatcatccgggtcaacagaggagagacccgatggatggcagaaacctggcggcagcgcaaaagatg

SEQ ID NO: 13289 - DNA, 103 bp, Artificial Sequence
  Synthetic Polynucleotide
taatacgactcactataggggcaagcagattaactttttcttaatattttaacagaggagaaaaataatgagaaaaagtaacctggcggcagcgcaaaagatg

SEQ ID NO: 13290 - DNA, 103 bp, Artificial Sequence
  Synthetic Polynucleotide
taatacgactcactatagggttaaagcaagcagattaactttttcttaataacagaggagaattaagatgaagttaatcaacctggcggcagcgcaaaagatg

SEQ ID NO: 13291 - DNA, 103 bp, Artificial Sequence
  Synthetic Polynucleotide
taatacgactcactatagggtataattaaagcaagcagattaactttttcaacagaggagagaaaaaatgaatctgcttaacctggcggcagcgcaaaagatg

SEQ ID NO: 13292 - DNA, 103 bp, Artificial Sequence
  Synthetic Polynucleotide
taatacgactcactatagggaaagttataattaaagcaagcagattaactaacagaggagaagttaaatggcttgctttaacctggcggcagcgcaaaagatg

SEQ ID NO: 13293 - DNA, 103 bp, Artificial Sequence
  Synthetic Polynucleotide
taatacgactcactatagggatattaaagttataattaaagcaagcagataacagaggagaatctgcatgctttaattaaacctggcggcagcgcaaaagatg

SEQ ID NO: 13294 - DNA, 103 bp, Artificial Sequence
  Synthetic Polynucleotide
taatacgactcactataggggtcgaatattaaagttataattaaagcaagaacagaggagacttgctatgattataactaacctggcggcagcgcaaaagatg

SEQ ID NO: 13295 - DNA, 103 bp, Artificial Sequence
  Synthetic Polynucleotide
taatacgactcactatagggtatttgtcgaatattaaagttataattaaaaacagaggagatttaatatgaactttaataacctggcggcagcgcaaaagatg

SEQ ID NO: 13296 - DNA, 103 bp, Artificial Sequence
  Synthetic Polynucleotide
taatacgactcactatagggttaactatttgtcgaatattaaagttataaaacagaggagattataaatgtaatattcgaacctggcggcagcgcaaaagatg

SEQ ID NO: 13297 - DNA, 103 bp, Artificial Sequence
  Synthetic Polynucleotide
taatacgactcactataggggaccgttaactatttgtcgaatattaaagtaacagaggagaactttaatgttcgacaaaaacctggcggcagcgcaaaagatg

SEQ ID NO: 13298 - DNA, 103 bp, Artificial Sequence
  Synthetic Polynucleotide
taatacgactcactataggggatgagaccgttaactatttgtcgaatattaacagaggagaaatattatgcaaatagttaacctggcggcagcgcaaaagatg

SEQ ID NO: 13299 - DNA, 103 bp, Artificial Sequence
  Synthetic Polynucleotide
taatacgactcactatagggaataggacaagttgagtcttttggactgtcaacagaggagagacagtatgaaagactcaaacctggcggcagcgcaaaagatg

SEQ ID NO: 13300 - DNA, 103 bp, Artificial Sequence
  Synthetic Polynucleotide
taatacgactcactatagggtctccataattgttgtatctgccatcatccaacagaggagaggatgaatgcagatacaaaacctggcggcagcgcaaaagatg

SEQ ID NO: 13301 - DNA, 103 bp, Artificial Sequence
  Synthetic Polynucleotide
taatacgactcactatagggtgagtgatgagaccgttaactatttgtcgaaacagaggagatcgacaatgagttaacggaacctggcggcagcgcaaaagatg

SEQ ID NO: 13302 - DNA, 103 bp, Artificial Sequence
  Synthetic Polynucleotide
taatacgactcactatagggatttttgagtgatgagaccgttaactatttaacagaggagaaaatagatgacggtctcaaacctggcggcagcgcaaaagatg

SEQ ID NO: 13303 - DNA, 103 bp, Artificial Sequence
  Synthetic Polynucleotide
taatacgactcactatagggatgaaatttttgagtgatgagaccgttaacaacagaggagagttaacatgctcatcactaacctggcggcagcgcaaaagatg

SEQ ID NO: 13304 - DNA, 103 bp, Artificial Sequence
  Synthetic Polynucleotide
taatacgactcactatagggtgttaatgaaatttttgagtgatgagaccgaacagaggagacggtctatgcactcaaaaaacctggcggcagcgcaaaagatg

SEQ ID NO: 13305 - DNA, 103 bp, Artificial Sequence
  Synthetic Polynucleotide
taatacgactcactatagggtcttttgttaatgaaatttttgagtgatgaaacagaggagatcatcaatgaaaaatttcaacctggcggcagcgcaaaagatg

SEQ ID NO: 13306 - DNA, 103 bp, Artificial Sequence
  Synthetic Polynucleotide
taatacgactcactataggggtacttcttttgttaatgaaatttttgagtaacagaggagaactcaaatgtttcattaaaacctggcggcagcgcaaaagatg

SEQ ID NO: 13307 - DNA, 103 bp, Artificial Sequence
  Synthetic Polynucleotide
taatacgactcactatagggtcagagtacttcttttgttaatgaaattttaacagaggagaaaaattatgttaacaaaaaacctggcggcagcgcaaaagatg

SEQ ID NO: 13308 - DNA, 103 bp, Artificial Sequence
  Synthetic Polynucleotide
taatacgactcactatagggtatactcagagtacttcttttgttaatgaaaacagaggagattcattatgaaaagaagtaacctggcggcagcgcaaaagatg

SEQ ID NO: 13309 - DNA, 103 bp, Artificial Sequence
  Synthetic Polynucleotide
taatacgactcactataggggtgaatatactcagagtacttcttttgttaaacagaggagataacaaatgaagtactctaacctggcggcagcgcaaaagatg

SEQ ID NO: 13310 - DNA, 103 bp, Artificial Sequence
  Synthetic Polynucleotide
taatacgactcactataggggatatgtgaatatactcagagtacttctttaacagaggagaaaagaaatgctctgagtaaacctggcggcagcgcaaaagatg

SEQ ID NO: 13311 - DNA, 103 bp, Artificial Sequence
  Synthetic Polynucleotide
taatacgactcactataggggatagtctccataattgttgtatctgccataacagaggagaatggcaatgacaacaattaacctggcggcagcgcaaaagatg

SEQ ID NO: 13312 - DNA, 103 bp, Artificial Sequence
  Synthetic Polynucleotide
taatacgactcactatagggcatatgatatgtgaatatactcagagtactaacagaggagaagtactatgagtatattcaacctggcggcagcgcaaaagatg

SEQ ID NO: 13313 - DNA, 103 bp, Artificial Sequence
  Synthetic Polynucleotide
taatacgactcactatagggaatcacatatgatatgtgaatatactcagaaacagaggagatctgagatgattcacataaacctggcggcagcgcaaaagatg

SEQ ID NO: 13314 - DNA, 103 bp, Artificial Sequence
  Synthetic Polynucleotide
taatacgactcactatagggatgttaatcacatatgatatgtgaatatacaacagaggagagtatatatgcatatcataaacctggcggcagcgcaaaagatg

SEQ ID NO: 13315 - DNA, 103 bp, Artificial Sequence
  Synthetic Polynucleotide
taatacgactcactatagggcttatatgttaatcacatatgatatgtgaaaacagaggagattcacaatgcatatgtgaaacctggcggcagcgcaaaagatg

SEQ ID NO: 13316 - DNA, 103 bp, Artificial Sequence
  Synthetic Polynucleotide
taatacgactcactatagggcgttgcttatatgttaatcacatatgatataacagaggagaatatcaatggtgattaacaacctggcggcagcgcaaaagatg

SEQ ID NO: 13317 - DNA, 103 bp, Artificial Sequence
  Synthetic Polynucleotide
taatacgactcactatagggtcatgcgttgcttatatgttaatcacatataacagaggagaatatgtatgtaacatataaacctggcggcagcgcaaaagatg

SEQ ID NO: 13318 - DNA, 103 bp, Artificial Sequence
  Synthetic Polynucleotide
taatacgactcactataggggcgcatcatgcgttgcttatatgttaatcaaacagaggagatgattaatgtataagcaaaacctggcggcagcgcaaaagatg

SEQ ID NO: 13319 - DNA, 103 bp, Artificial Sequence
  Synthetic Polynucleotide
taatacgactcactatagggggaaggcgcatcatgcgttgcttatatgttaacagaggagaaacataatggcaacgcataacctggcggcagcgcaaaagatg

SEQ ID NO: 13320 - DNA, 103 bp, Artificial Sequence
  Synthetic Polynucleotide
taatacgactcactatagggtaagaggaaggcgcatcatgcgttgcttataacagaggagaataagcatggcatgatgcaacctggcggcagcgcaaaagatg

SEQ ID NO: 13321 - DNA, 103 bp, Artificial Sequence
  Synthetic Polynucleotide
taatacgactcactatagggataagtaagaggaaggcgcatcatgcgttgaacagaggagacaacgcatgatgcgccttaacctggcggcagcgcaaaagatg

SEQ ID NO: 13322 - DNA, 103 bp, Artificial Sequence
  Synthetic Polynucleotide
taatacgactcactatagggactaggatagtctccataattgttgtatctaacagaggagaagatacatgaattatggaaacctggcggcagcgcaaaagatg

SEQ ID NO: 13323 - DNA, 103 bp, Artificial Sequence
  Synthetic Polynucleotide
taatacgactcactatagggacacaataagtaagaggaaggcgcatcatgaacagaggagacatgatatgccttcctctaacctggcggcagcgcaaaagatg

SEQ ID NO: 13324 - DNA, 103 bp, Artificial Sequence
  Synthetic Polynucleotide
taatacgactcactatagggtgacaacacaataagtaagaggaaggcgcaaacagaggagatgcgccatgctcttacttaacctggcggcagcgcaaaagatg

SEQ ID NO: 13325 - DNA, 103 bp, Artificial Sequence
  Synthetic Polynucleotide
taatacgactcactatagggctgcgtgacaacacaataagtaagaggaagaacagaggagacttcctatgacttattgtaacctggcggcagcgcaaaagatg

SEQ ID NO: 13326 - DNA, 103 bp, Artificial Sequence
  Synthetic Polynucleotide
taatacgactcactatagggaacgactgcgtgacaacacaataagtaagaaacagaggagatcttacatgttgtgttgtaacctggcggcagcgcaaaagatg

SEQ ID NO: 13327 - DNA, 103 bp, Artificial Sequence
  Synthetic Polynucleotide
taatacgactcactatagggagtacaacgactgcgtgacaacacaataagaacagaggagacttattatgttgtcacgcaacctggcggcagcgcaaaagatg

SEQ ID NO: 13328 - DNA, 103 bp, Artificial Sequence
  Synthetic Polynucleotide
taatacgactcactataggggaggtagtacaacgactgcgtgacaacacaaacagaggagatgtgttatgacgcagtcgaacctggcggcagcgcaaaagatg

SEQ ID NO: 13329 - DNA, 103 bp, Artificial Sequence
  Synthetic Polynucleotide
taatacgactcactatagggttttcgaggtagtacaacgactgcgtgacaaacagaggagatgtcacatggtcgttgtaaacctggcggcagcgcaaaagatg

SEQ ID NO: 13330 - DNA, 103 bp, Artificial Sequence
  Synthetic Polynucleotide
taatacgactcactatagggtggaattttcgaggtagtacaacgactgcgaacagaggagacgcagtatgtgtactaccaacctggcggcagcgcaaaagatg

SEQ ID NO: 13331 - DNA, 103 bp, Artificial Sequence
  Synthetic Polynucleotide
taatacgactcactatagggttgtttggaattttcgaggtagtacaacgaaacagaggagatcgttgatgtacctcgaaaacctggcggcagcgcaaaagatg

SEQ ID NO: 13332 - DNA, 103 bp, Artificial Sequence
  Synthetic Polynucleotide
taatacgactcactatagggatttattgtttggaattttcgaggtagtacaacagaggagagtactaatgcgaaaattcaacctggcggcagcgcaaaagatg

SEQ ID NO: 13333 - DNA, 103 bp, Artificial Sequence
  Synthetic Polynucleotide
taatacgactcactataggggtctcactaggatagtctccataattgttgaacagaggagacaacaaatgtggagactaaacctggcggcagcgcaaaagatg

SEQ ID NO: 13334 - DNA, 103 bp, Artificial Sequence
  Synthetic Polynucleotide
taatacgactcactatagggacacgatttattgtttggaattttcgaggtaacagaggagaacctcgatgattccaaacaacctggcggcagcgcaaaagatg

SEQ ID NO: 13335 - DNA, 103 bp, Artificial Sequence
  Synthetic Polynucleotide
taatacgactcactataggggatagacacgatttattgtttggaattttcaacagaggagagaaaatatgaaacaataaaacctggcggcagcgcaaaagatg

SEQ ID NO: 13336 - DNA, 103 bp, Artificial Sequence
  Synthetic Polynucleotide
taatacgactcactatagggtgcgggatagacacgatttattgtttggaaaacagaggagattccaaatgataaatcgtaacctggcggcagcgcaaaagatg

SEQ ID NO: 13337 - DNA, 103 bp, Artificial Sequence
  Synthetic Polynucleotide
taatacgactcactatagggctaaatgcgggatagacacgatttattgttaacagaggagaaacaatatgtcgtgtctaaacctggcggcagcgcaaaagatg

SEQ ID NO: 13338 - DNA, 103 bp, Artificial Sequence
  Synthetic Polynucleotide
taatacgactcactatagggagacactaaatgcgggatagacacgatttaaacagaggagataaatcatgtctatcccgaacctggcggcagcgcaaaagatg

SEQ ID NO: 13339 - DNA, 103 bp, Artificial Sequence
  Synthetic Polynucleotide
taatacgactcactatagggattaaagacactaaatgcgggatagacacgaacagaggagacgtgtcatgcccgcatttaacctggcggcagcgcaaaagatg

SEQ ID NO: 13340 - DNA, 103 bp, Artificial Sequence
  Synthetic Polynucleotide
taatacgactcactatagggcttaaattaaagacactaaatgcgggatagaacagaggagactatccatgatttagtgtaacctggcggcagcgcaaaagatg

SEQ ID NO: 13341 - DNA, 103 bp, Artificial Sequence
  Synthetic Polynucleotide
taatacgactcactataggggagatcttaaattaaagacactaaatgcggaacagaggagaccgcatatggtgtctttaaacctggcggcagcgcaaaagatg

SEQ ID NO: 13342 - DNA, 103 bp, Artificial Sequence
  Synthetic Polynucleotide
taatacgactcactataggggatttgagatcttaaattaaagacactaaaaacagaggagatttagtatgtttaatttaaacctggcggcagcgcaaaagatg

SEQ ID NO: 13343 - DNA, 103 bp, Artificial Sequence
  Synthetic Polynucleotide
taatacgactcactatagggttttggatttgagatcttaaattaaagacaaacagaggagatgtcttatgtttaagatcaacctggcggcagcgcaaaagatg

SEQ ID NO: 13344 - DNA, 103 bp, Artificial Sequence
  Synthetic Polynucleotide
taatacgactcactatagggtcgccgtctcactaggatagtctccataataacagaggagaattatgatgactatcctaaacctggcggcagcgcaaaagatg

SEQ ID NO: 13345 - DNA, 103 bp, Artificial Sequence
  Synthetic Polynucleotide
taatacgactcactatagggcagttttttggatttgagatcttaaattaaaacagaggagattaattatggatctcaaaaacctggcggcagcgcaaaagatg

SEQ ID NO: 13346 - DNA, 103 bp, Artificial Sequence
  Synthetic Polynucleotide
taatacgactcactatagggaaacccagttttttggatttgagatcttaaaacagaggagattaagaatgcaaatccaaaacctggcggcagcgcaaaagatg

SEQ ID NO: 13347 - DNA, 103 bp, Artificial Sequence
  Synthetic Polynucleotide
taatacgactcactatagggaacataaacccagttttttggatttgagataacagaggagaatctcaatgccaaaaaacaacctggcggcagcgcaaaagatg

SEQ ID NO: 13348 - DNA, 103 bp, Artificial Sequence
  Synthetic Polynucleotide
taatacgactcactatagggacatcaacataaacccagttttttggatttaacagaggagaaaatccatgaaactgggtaacctggcggcagcgcaaaagatg

SEQ ID NO: 13349 - DNA, 103 bp, Artificial Sequence
  Synthetic Polynucleotide
taatacgactcactataggggatttacatcaacataaacccagttttttgaacagaggagacaaaaaatggggtttatgaacctggcggcagcgcaaaagatg

SEQ ID NO: 13350 - DNA, 103 bp, Artificial Sequence
  Synthetic Polynucleotide
taatacgactcactatagggttattgatttacatcaacataaacccagttaacagaggagaaactggatgtatgttgataacctggcggcagcgcaaaagatg

SEQ ID NO: 13351 - DNA, 103 bp, Artificial Sequence
  Synthetic Polynucleotide
taatacgactcactatagggcggtattattgatttacatcaacataaaccaacagaggagaggtttaatgtgatgtaaaaacctggcggcagcgcaaaagatg

SEQ ID NO: 13352 - DNA, 103 bp, Artificial Sequence
  Synthetic Polynucleotide
taatacgactcactatagggaatttcggtattattgatttacatcaacataacagaggagaatgttgatgtaaatcaataacctggcggcagcgcaaaagatg

SEQ ID NO: 13353 - DNA, 103 bp, Artificial Sequence
  Synthetic Polynucleotide
taatacgactcactatagggcaagcaatttcggtattattgatttacatcaacagaggagagatgtaatgcaataatacaacctggcggcagcgcaaaagatg

SEQ ID NO: 13354 - DNA, 103 bp, Artificial Sequence
  Synthetic Polynucleotide
taatacgactcactatagggaatatcaagcaatttcggtattattgatttaacagaggagaaaatcaatgataccgaaaaacctggcggcagcgcaaaagatg

SEQ ID NO: 13355 - DNA, 103 bp, Artificial Sequence
  Synthetic Polynucleotide
taatacgactcactatagggggcattcgccgtctcactaggatagtctccaacagaggagaggagacatgcctagtgagaacctggcggcagcgcaaaagatg

SEQ ID NO: 13356 - DNA, 103 bp, Artificial Sequence
  Synthetic Polynucleotide
taatacgactcactatagggattttaatatcaagcaatttcggtattattaacagaggagaaataatatggaaattgctaacctggcggcagcgcaaaagatg

SEQ ID NO: 13357 - DNA, 103 bp, Artificial Sequence
  Synthetic Polynucleotide
taatacgactcactataggggctttattttaatatcaagcaatttcggtaaacagaggagataccgaatgtgcttgataaacctggcggcagcgcaaaagatg

SEQ ID NO: 13358 - DNA, 103 bp, Artificial Sequence
  Synthetic Polynucleotide
taatacgactcactatagggtttaagctttattttaatatcaagcaatttaacagaggagaaaattgatggatattaaaaacctggcggcagcgcaaaagatg

SEQ ID NO: 13359 - DNA, 103 bp, Artificial Sequence
  Synthetic Polynucleotide
taatacgactcactatagggaatcctttaagctttattttaatatcaagcaacagaggagagcttgaatgtaaaataaaaacctggcggcagcgcaaaagatg

SEQ ID NO: 13360 - DNA, 103 bp, Artificial Sequence
  Synthetic Polynucleotide
taatacgactcactatagggggaaaaatcctttaagctttattttaatataacagaggagaatattaatgtaaagcttaaacctggcggcagcgcaaaagatg

SEQ ID NO: 13361 - DNA, 103 bp, Artificial Sequence
  Synthetic Polynucleotide
taatacgactcactatagggtttaaggaaaaatcctttaagctttattttaacagaggagaaaaataatgcttaaaggaaacctggcggcagcgcaaaagatg

SEQ ID NO: 13362 - DNA, 103 bp, Artificial Sequence
  Synthetic Polynucleotide
taatacgactcactatagggcaccgtttaaggaaaaatcctttaagctttaacagaggagaaaagctatgaggatttttaacctggcggcagcgcaaaagatg

SEQ ID NO: 13363 - DNA, 103 bp, Artificial Sequence
  Synthetic Polynucleotide
taatacgactcactatagggaacatcaccgtttaaggaaaaatcctttaaaacagaggagattaaagatgttttccttaaacctggcggcagcgcaaaagatg

SEQ ID NO: 13364 - DNA, 103 bp, Artificial Sequence
  Synthetic Polynucleotide
taatacgactcactatagggtacctaacatcaccgtttaaggaaaaatccaacagaggagaggatttatgcttaaacggaacctggcggcagcgcaaaagatg

SEQ ID NO: 13365 - DNA, 103 bp, Artificial Sequence
  Synthetic Polynucleotide
taatacgactcactatagggctatatacctaacatcaccgtttaaggaaaaacagaggagatttcctatgacggtgatgaacctggcggcagcgcaaaagatg

SEQ ID NO: 13366 - DNA, 103 bp, Artificial Sequence
  Synthetic Polynucleotide
taatacgactcactatagggtcaggggcattcgccgtctcactaggatagaacagaggagactatccatgtgagacggcaacctggcggcagcgcaaaagatg

SEQ ID NO: 13367 - DNA, 103 bp, Artificial Sequence
  Synthetic Polynucleotide
taatacgactcactatagggctttcctatatacctaacatcaccgtttaaaacagaggagattaaacatggatgttaggaacctggcggcagcgcaaaagatg

SEQ ID NO: 13368 - DNA, 103 bp, Artificial Sequence
  Synthetic Polynucleotide
taatacgactcactatagggtcgagctttcctatatacctaacatcaccgaacagaggagacggtgaatgtaggtatataacctggcggcagcgcaaaagatg

SEQ ID NO: 13369 - DNA, 103 bp, Artificial Sequence
  Synthetic Polynucleotide
taatacgactcactatagggcgtgatcgagctttcctatatacctaacataacagaggagaatgttaatgatataggaaaacctggcggcagcgcaaaagatg

SEQ ID NO: 13370 - DNA, 103 bp, Artificial Sequence
  Synthetic Polynucleotide
taatacgactcactataggggacatcgtgatcgagctttcctatatacctaacagaggagaaggtatatgggaaagctcaacctggcggcagcgcaaaagatg

SEQ ID NO: 13371 - DNA, 103 bp, Artificial Sequence
  Synthetic Polynucleotide
taatacgactcactatagggtaagggacatcgtgatcgagctttcctataaacagaggagatataggatggctcgatcaaacctggcggcagcgcaaaagatg

SEQ ID NO: 13372 - DNA, 103 bp, Artificial Sequence
  Synthetic Polynucleotide
taatacgactcactatagggctgagtaagggacatcgtgatcgagctttcaacagaggagagaaagcatgatcacgatgaacctggcggcagcgcaaaagatg

SEQ ID NO: 13373 - DNA, 103 bp, Artificial Sequence
  Synthetic Polynucleotide
taatacgactcactatagggtttttctgagtaagggacatcgtgatcgagaacagaggagactcgatatggatgtccctaacctggcggcagcgcaaaagatg

SEQ ID NO: 13374 - DNA, 103 bp, Artificial Sequence
  Synthetic Polynucleotide
taatacgactcactatagggttttctttttctgagtaagggacatcgtgaaacagaggagatcacgaatgcccttactcaacctggcggcagcgcaaaagatg

SEQ ID NO: 13375 - DNA, 103 bp, Artificial Sequence
  Synthetic Polynucleotide
taatacgactcactatagggtccgtttttctttttctgagtaagggacataacagaggagaatgtccatgactcagaaaaacctggcggcagcgcaaaagatg

SEQ ID NO: 13376 - DNA, 103 bp, Artificial Sequence
  Synthetic Polynucleotide
taatacgactcactataggggggcttccgtttttctttttctgagtaaggaacagaggagaccttacatggaaaaagaaaacctggcggcagcgcaaaagatg

SEQ ID NO: 13377 - DNA, 103 bp, Artificial Sequence
  Synthetic Polynucleotide
taatacgactcactatagggggtcttcaggggcattcgccgtctcactagaacagaggagactagtgatgcggcgaatgaacctggcggcagcgcaaaagatg

SEQ ID NO: 13378 - DNA, 103 bp, Artificial Sequence
  Synthetic Polynucleotide
taatacgactcactatagggcaatagggcttccgtttttctttttctgagaacagaggagactcagaatgagaaaaacgaacctggcggcagcgcaaaagatg

SEQ ID NO: 13379 - DNA, 103 bp, Artificial Sequence
  Synthetic Polynucleotide
taatacgactcactatagggatggccaatagggcttccgtttttctttttaacagaggagaaaaaagatgaacggaagcaacctggcggcagcgcaaaagatg

SEQ ID NO: 13380 - DNA, 103 bp, Artificial Sequence
  Synthetic Polynucleotide
taatacgactcactatagggattaaatggccaatagggcttccgtttttcaacagaggagagaaaaaatgaagccctataacctggcggcagcgcaaaagatg

SEQ ID NO: 13381 - DNA, 103 bp, Artificial Sequence
  Synthetic Polynucleotide
taatacgactcactataggggtacgattaaatggccaatagggcttccgtaacagaggagaacggaaatgctattggccaacctggcggcagcgcaaaagatg

SEQ ID NO: 13382 - DNA, 103 bp, Artificial Sequence
  Synthetic Polynucleotide
taatacgactcactatagggtttgtgtacgattaaatggccaatagggctaacagaggagaagccctatgggccatttaaacctggcggcagcgcaaaagatg

SEQ ID NO: 13383 - DNA, 103 bp, Artificial Sequence
  Synthetic Polynucleotide
taatacgactcactatagggatatttttgtgtacgattaaatggccaataaacagaggagatattggatgtttaatcgtaacctggcggcagcgcaaaagatg

SEQ ID NO: 13384 - DNA, 103 bp, Artificial Sequence
  Synthetic Polynucleotide
taatacgactcactatagggtaaagatatttttgtgtacgattaaatggcaacagaggagagccattatgtcgtacacaaacctggcggcagcgcaaaagatg

SEQ ID NO: 13385 - DNA, 103 bp, Artificial Sequence
  Synthetic Polynucleotide
taatacgactcactatagggtttggtaaagatatttttgtgtacgattaaaacagaggagattaatcatgcacaaaaataacctggcggcagcgcaaaagatg

SEQ ID NO: 13386 - DNA, 103 bp, Artificial Sequence
  Synthetic Polynucleotide
taatacgactcactatagggaacaatttggtaaagatatttttgtgtacgaacagaggagacgtacaatgaaatatcttaacctggcggcagcgcaaaagatg

SEQ ID NO: 13387 - DNA, 103 bp, Artificial Sequence
  Synthetic Polynucleotide
taatacgactcactataggggagaaaacaatttggtaaagatatttttgtaacagaggagaacaaaaatgtctttaccaaacctggcggcagcgcaaaagatg

SEQ ID NO: 13388 - DNA, 103 bp, Artificial Sequence
  Synthetic Polynucleotide
taatacgactcactatagggaacaaggtcttcaggggcattcgccgtctcaacagaggagagagacgatgaatgcccctaacctggcggcagcgcaaaagatg

SEQ ID NO: 13389 - DNA, 103 bp, Artificial Sequence
  Synthetic Polynucleotide
taatacgactcactatagggaaaaagagaaaacaatttggtaaagatattaacagaggagaaatatcatgaccaaattgaacctggcggcagcgcaaaagatg

SEQ ID NO: 13390 - DNA, 103 bp, Artificial Sequence
  Synthetic Polynucleotide
taatacgactcactatagggacacaaaaaagagaaaacaatttggtaaagaacagaggagactttacatgattgttttcaacctggcggcagcgcaaaagatg

SEQ ID NO: 13391 - DNA, 103 bp, Artificial Sequence
  Synthetic Polynucleotide
taatacgactcactatagggtggacacacaaaaaagagaaaacaatttggaacagaggagaccaaatatgtttctctttaacctggcggcagcgcaaaagatg

SEQ ID NO: 13392 - DNA, 103 bp, Artificial Sequence
  Synthetic Polynucleotide
taatacgactcactatagggaaaagaacaaggtcttcaggggcattcgccaacagaggagaggcgaaatgccctgaagaaacctggcggcagcgcaaaagatg

SEQ ID NO: 13393 - DNA, 103 bp, Artificial Sequence
  Synthetic Polynucleotide
taatacgactcactatagggagttgaataggacaagttgagtcttttggaaacagaggagatccaaaatgctcaacttgaacctggcggcagcgcaaaagatg

SEQ ID NO: 13394 - DNA, 103 bp, Artificial Sequence
  Synthetic Polynucleotide
taatacgactcactatagggggtcaaaaagaacaaggtcttcaggggcataacagaggagaatgcccatgaagaccttgaacctggcggcagcgcaaaagatg

SEQ ID NO: 13395 - DNA, 103 bp, Artificial Sequence
  Synthetic Polynucleotide
taatacgactcactatagggttcaaggtcaaaaagaacaaggtcttcaggaacagaggagacctgaaatgcttgttcttaacctggcggcagcgcaaaagatg

SEQ ID NO: 13396 - DNA, 103 bp, Artificial Sequence
  Synthetic Polynucleotide
taatacgactcactatagggccatcttcaaggtcaaaaagaacaaggtctaacagaggagaagacctatgtctttttgaaacctggcggcagcgcaaaagatg

SEQ ID NO: 13397 - DNA, 103 bp, Artificial Sequence
  Synthetic Polynucleotide
taatacgactcactatagggcgtcaccatcttcaaggtcaaaaagaacaaaacagaggagattgttcatgttgaccttgaacctggcggcagcgcaaaagatg

SEQ ID NO: 13398 - DNA, 103 bp, Artificial Sequence
  Synthetic Polynucleotide
taatacgactcactatagggatcctcgtcaccatcttcaaggtcaaaaagaacagaggagactttttatgcttgaagataacctggcggcagcgcaaaagatg

SEQ ID NO: 13399 - DNA, 103 bp, Artificial Sequence
  Synthetic Polynucleotide
taatacgactcactatagggtgatcatcctcgtcaccatcttcaaggtcaaacagaggagatgacctatgagatggtgaaacctggcggcagcgcaaaagatg

SEQ ID NO: 13400 - DNA, 103 bp, Artificial Sequence
  Synthetic Polynucleotide
taatacgactcactataggggtcggtgatcatcctcgtcaccatcttcaaaacagaggagattgaagatggtgacgaggaacctggcggcagcgcaaaagatg

SEQ ID NO: 13401 - DNA, 103 bp, Artificial Sequence
  Synthetic Polynucleotide
taatacgactcactatagggtgacggtcggtgatcatcctcgtcaccatcaacagaggagagatggtatggaggatgataacctggcggcagcgcaaaagatg

SEQ ID NO: 13402 - DNA, 103 bp, Artificial Sequence
  Synthetic Polynucleotide
taatacgactcactataggggaacttgacggtcggtgatcatcctcgtcaaacagaggagatgacgaatgtgatcaccgaacctggcggcagcgcaaaagatg

SEQ ID NO: 13403 - DNA, 103 bp, Artificial Sequence
  Synthetic Polynucleotide
taatacgactcactatagggctgatgaacttgacggtcggtgatcatcctaacagaggagaaggatgatgaccgaccgtaacctggcggcagcgcaaaagatg

SEQ ID NO: 13404 - DNA, 103 bp, Artificial Sequence
  Synthetic Polynucleotide
taatacgactcactatagggagattagttgaataggacaagttgagtcttaacagaggagaaagactatgcttgtcctaaacctggcggcagcgcaaaagatg

SEQ ID NO: 13405 - DNA, 103 bp, Artificial Sequence
  Synthetic Polynucleotide
taatacgactcactataggggttctctgatgaacttgacggtcggtgatcaacagaggagagatcacatgccgtcaagtaacctggcggcagcgcaaaagatg

SEQ ID NO: 13406 - DNA, 103 bp, Artificial Sequence
  Synthetic Polynucleotide
taatacgactcactatagggttgttgttctctgatgaacttgacggtcggaacagaggagaccgaccatgaagttcatcaacctggcggcagcgcaaaagatg

SEQ ID NO: 13407 - DNA, 103 bp, Artificial Sequence
  Synthetic Polynucleotide
taatacgactcactataggggtttgttgttgttctctgatgaacttgacgaacagaggagacgtcaaatgcatcagagaaacctggcggcagcgcaaaagatg

SEQ ID NO: 13408 - DNA, 103 bp, Artificial Sequence
  Synthetic Polynucleotide
taatacgactcactatagggactgtgtttgttgttgttctctgatgaactaacagaggagaagttcaatggagaacaacaacctggcggcagcgcaaaagatg

SEQ ID NO: 13409 - DNA, 103 bp, Artificial Sequence
  Synthetic Polynucleotide
taatacgactcactataggggtaagactgtgtttgttgttgttctctgataacagaggagaatcagaatgcaacaacaaaacctggcggcagcgcaaaagatg

SEQ ID NO: 13410 - DNA, 103 bp, Artificial Sequence
  Synthetic Polynucleotide
taatacgactcactatagggttcctgtaagactgtgtttgttgttgttctaacagaggagaagaacaatgacaaacacaaacctggcggcagcgcaaaagatg

SEQ ID NO: 13411 - DNA, 103 bp, Artificial Sequence
  Synthetic Polynucleotide
taatacgactcactataggggtcagttcctgtaagactgtgtttgttgttaacagaggagaaacaacatgcacagtcttaacctggcggcagcgcaaaagatg

SEQ ID NO: 13412 - DNA, 103 bp, Artificial Sequence
  Synthetic Polynucleotide
taatacgactcactatagggttactgtcagttcctgtaagactgtgtttgaacagaggagacaaacaatgtcttacaggaacctggcggcagcgcaaaagatg

SEQ ID NO: 13413 - DNA, 103 bp, Artificial Sequence
  Synthetic Polynucleotide
taatacgactcactatagggttttgttactgtcagttcctgtaagactgtaacagaggagaacagtcatgcaggaactgaacctggcggcagcgcaaaagatg

SEQ ID NO: 13414 - DNA, 103 bp, Artificial Sequence
  Synthetic Polynucleotide
taatacgactcactatagggacttgttttgttactgtcagttcctgtaagaacagaggagacttacaatgactgacagtaacctggcggcagcgcaaaagatg

SEQ ID NO: 13415 - DNA, 103 bp, Artificial Sequence
  Synthetic Polynucleotide
taatacgactcactataggggcacacaataaagatcaaaaaaccttctttaacagaggagaaaagaaatgtttttgatcaacctggcggcagcgcaaaagatg

SEQ ID NO: 13416 - DNA, 103 bp, Artificial Sequence
  Synthetic Polynucleotide
taatacgactcactatagggaaaacagattagttgaataggacaagttgaaacagaggagatcaactatgcctattcaaaacctggcggcagcgcaaaagatg

SEQ ID NO: 13417 - DNA, 103 bp, Artificial Sequence
  Synthetic Polynucleotide
taatacgactcactatagggcagttacttgttttgttactgtcagttcctaacagaggagaaggaacatgcagtaacaaaacctggcggcagcgcaaaagatg

SEQ ID NO: 13418 - DNA, 103 bp, Artificial Sequence
  Synthetic Polynucleotide
taatacgactcactataggggattccagttacttgttttgttactgtcagaacagaggagactgacaatgacaaaacaaaacctggcggcagcgcaaaagatg

SEQ ID NO: 13419 - DNA, 103 bp, Artificial Sequence
  Synthetic Polynucleotide
taatacgactcactataggggtttcgattccagttacttgttttgttactaacagaggagaagtaacatgacaagtaacaacctggcggcagcgcaaaagatg

SEQ ID NO: 13420 - DNA, 103 bp, Artificial Sequence
  Synthetic Polynucleotide
taatacgactcactataggggtcgggtttcgattccagttacttgttttgaacagaggagacaaaacatgtaactggaaaacctggcggcagcgcaaaagatg

SEQ ID NO: 13421 - DNA, 103 bp, Artificial Sequence
  Synthetic Polynucleotide
taatacgactcactatagggtattagtcgggtttcgattccagttacttgaacagaggagacaagtaatgggaatcgaaaacctggcggcagcgcaaaagatg

SEQ ID NO: 13422 - DNA, 103 bp, Artificial Sequence
  Synthetic Polynucleotide
taatacgactcactatagggtggcatattagtcgggtttcgattccagttaacagaggagaaactggatgcgaaacccgaacctggcggcagcgcaaaagatg

SEQ ID NO: 13423 - DNA, 103 bp, Artificial Sequence
  Synthetic Polynucleotide
taatacgactcactatagggttctttggcatattagtcgggtttcgattcaacagaggagagaatcgatgcccgactaaaacctggcggcagcgcaaaagatg

SEQ ID NO: 13424 - DNA, 103 bp, Artificial Sequence
  Synthetic Polynucleotide
taatacgactcactatagggagtctttctttggcatattagtcgggtttcaacagaggagagaaaccatgctaatatgcaacctggcggcagcgcaaaagatg

SEQ ID NO: 13425 - DNA, 103 bp, Artificial Sequence
  Synthetic Polynucleotide
taatacgactcactatagggtgtggagtctttctttggcatattagtcggaacagaggagaccgactatgatgccaaagaacctggcggcagcgcaaaagatg

SEQ ID NO: 13426 - DNA, 103 bp, Artificial Sequence
  Synthetic Polynucleotide
taatacgactcactatagggttttgtgtggagtctttctttggcatattaaacagaggagataatatatgaaagaaagaaacctggcggcagcgcaaaagatg

SEQ ID NO: 13427 - DNA, 103 bp, Artificial Sequence
  Synthetic Polynucleotide
taatacgactcactataggggagacaaaacagattagttgaataggacaaaacagaggagattgtccatgtcaactaataacctggcggcagcgcaaaagatg

SEQ ID NO: 13428 - DNA, 103 bp, Artificial Sequence
  Synthetic Polynucleotide
taatacgactcactatagggcattgttttgtgtggagtctttctttggcaaacagaggagatgccaaatgaagactccaaacctggcggcagcgcaaaagatg

SEQ ID NO: 13429 - DNA, 103 bp, Artificial Sequence
  Synthetic Polynucleotide
taatacgactcactatagggattgtcattgttttgtgtggagtctttcttaacagaggagaaagaaaatgtccacacaaaacctggcggcagcgcaaaagatg

SEQ ID NO: 13430 - DNA, 103 bp, Artificial Sequence
  Synthetic Polynucleotide
taatacgactcactataggggcaggattgtcattgttttgtgtggagtctaacagaggagaagactcatgacaaaacaaaacctggcggcagcgcaaaagatg

SEQ ID NO: 13431 - DNA, 103 bp, Artificial Sequence
  Synthetic Polynucleotide
taatacgactcactataggggctgtgcaggattgtcattgttttgtgtggaacagaggagaccacacatgacaatgacaaacctggcggcagcgcaaaagatg

SEQ ID NO: 13432 - DNA, 103 bp, Artificial Sequence
  Synthetic Polynucleotide
taatacgactcactatagggagcccgctgtgcaggattgtcattgttttgaacagaggagacaaaacatggacaatcctaacctggcggcagcgcaaaagatg

SEQ ID NO: 13433 - DNA, 103 bp, Artificial Sequence
  Synthetic Polynucleotide
taatacgactcactatagggtcttgagcccgctgtgcaggattgtcattgaacagaggagacaatgaatgtcctgcacaaacctggcggcagcgcaaaagatg

SEQ ID NO: 13434 - DNA, 103 bp, Artificial Sequence
  Synthetic Polynucleotide
taatacgactcactatagggcgtattcttgagcccgctgtgcaggattgtaacagaggagaacaatcatgcacagcgggaacctggcggcagcgcaaaagatg

SEQ ID NO: 13435 - DNA, 103 bp, Artificial Sequence
  Synthetic Polynucleotide
taatacgactcactatagggcctggcgtattcttgagcccgctgtgcaggaacagaggagacctgcaatgcgggctcaaaacctggcggcagcgcaaaagatg

SEQ ID NO: 13436 - DNA, 103 bp, Artificial Sequence
  Synthetic Polynucleotide
taatacgactcactatagggttatccctggcgtattcttgagcccgctgtaacagaggagaacagcgatgtcaagaataaacctggcggcagcgcaaaagatg

SEQ ID NO: 13437 - DNA, 103 bp, Artificial Sequence
  Synthetic Polynucleotide
taatacgactcactatagggggatgttatccctggcgtattcttgagcccaacagaggagagggctcatgaatacgccaaacctggcggcagcgcaaaagatg

SEQ ID NO: 13438 - DNA, 103 bp, Artificial Sequence
  Synthetic Polynucleotide
taatacgactcactatagggctactgagacaaaacagattagttgaatagaacagaggagactattcatgtaatctgttaacctggcggcagcgcaaaagatg

SEQ ID NO: 13439 - DNA, 103 bp, Artificial Sequence
  Synthetic Polynucleotide
taatacgactcactatagggatcctggatgttatccctggcgtattcttgaacagaggagacaagaaatggccagggataacctggcggcagcgcaaaagatg

SEQ ID NO: 13440 - DNA, 103 bp, Artificial Sequence
  Synthetic Polynucleotide
taatacgactcactatagggggtgtatcctggatgttatccctggcgtataacagaggagaatacgcatgggataacataacctggcggcagcgcaaaagatg

SEQ ID NO: 13441 - DNA, 103 bp, Artificial Sequence
  Synthetic Polynucleotide
taatacgactcactataggggtgttggtgtatcctggatgttatccctggaacagaggagaccagggatgacatccaggaacctggcggcagcgcaaaagatg

SEQ ID NO: 13442 - DNA, 103 bp, Artificial Sequence
  Synthetic Polynucleotide
taatacgactcactatagggatggggtgttggtgtatcctggatgttatcaacagaggagagataacatgcaggatacaaacctggcggcagcgcaaaagatg

SEQ ID NO: 13443 - DNA, 103 bp, Artificial Sequence
  Synthetic Polynucleotide
taatacgactcactataggggctcgatggggtgttggtgtatcctggatgaacagaggagacatccaatgtacaccaacaacctggcggcagcgcaaaagatg

SEQ ID NO: 13444 - DNA, 103 bp, Artificial Sequence
  Synthetic Polynucleotide
taatacgactcactatagggttagagctcgatggggtgttggtgtatcctaacagaggagaaggataatgcaacaccccaacctggcggcagcgcaaaagatg

SEQ ID NO: 13445 - DNA, 103 bp, Artificial Sequence
  Synthetic Polynucleotide
taatacgactcactataggggggagttagagctcgatggggtgttggtgtaacagaggagaacaccaatgccccatcgaaacctggcggcagcgcaaaagatg

SEQ ID NO: 13446 - DNA, 103 bp, Artificial Sequence
  Synthetic Polynucleotide
taatacgactcactatagggctgatgggagttagagctcgatggggtgttaacagaggagaaacaccatgtcgagctctaacctggcggcagcgcaaaagatg

SEQ ID NO: 13447 - DNA, 103 bp, Artificial Sequence
  Synthetic Polynucleotide
taatacgactcactatagggcttcgctgatgggagttagagctcgatgggaacagaggagacccatcatgctctaactcaacctggcggcagcgcaaaagatg

SEQ ID NO: 13448 - DNA, 103 bp, Artificial Sequence
  Synthetic Polynucleotide
taatacgactcactatagggggtttcttcgctgatgggagttagagctcgaacagaggagacgagctatgactcccatcaacctggcggcagcgcaaaagatg

SEQ ID NO: 13449 - DNA, 103 bp, Artificial Sequence
  Synthetic Polynucleotide
taatacgactcactataggggtgaactactgagacaaaacagattagttgaacagaggagacaactaatgtgttttgtcaacctggcggcagcgcaaaagatg

SEQ ID NO: 13450 - DNA, 103 bp, Artificial Sequence
  Synthetic Polynucleotide
taatacgactcactataggggagccggtttcttcgctgatgggagttagaaacagaggagatctaacatgcatcagcgaaacctggcggcagcgcaaaagatg

SEQ ID NO: 13451 - DNA, 103 bp, Artificial Sequence
  Synthetic Polynucleotide
taatacgactcactatagggcattggagccggtttcttcgctgatgggagaacagaggagactcccaatggcgaagaaaaacctggcggcagcgcaaaagatg

SEQ ID NO: 13452 - DNA, 103 bp, Artificial Sequence
  Synthetic Polynucleotide
taatacgactcactataggggtgaccattggagccggtttcttcgctgataacagaggagaatcagcatggaaaccggcaacctggcggcagcgcaaaagatg

SEQ ID NO: 13453 - DNA, 103 bp, Artificial Sequence
  Synthetic Polynucleotide
taatacgactcactatagggtcattgtgaccattggagccggtttcttcgaacagaggagacgaagaatgcggctccaaaacctggcggcagcgcaaaagatg

SEQ ID NO: 13454 - DNA, 103 bp, Artificial Sequence
  Synthetic Polynucleotide
taatacgactcactatagggcatcttcattgtgaccattggagccggtttaacagaggagaaaaccgatgccaatggtcaacctggcggcagcgcaaaagatg

SEQ ID NO: 13455 - DNA, 103 bp, Artificial Sequence
  Synthetic Polynucleotide
taatacgactcactatagggaatgtcatcttcattgtgaccattggagccaacagaggagaggctccatgggtcacaataacctggcggcagcgcaaaagatg

SEQ ID NO: 13456 - DNA, 103 bp, Artificial Sequence
  Synthetic Polynucleotide
taatacgactcactatagggctatcaatgtcatcttcattgtgaccattgaacagaggagacaatggatgcaatgaagaaacctggcggcagcgcaaaagatg

SEQ ID NO: 13457 - DNA, 103 bp, Artificial Sequence
  Synthetic Polynucleotide
taatacgactcactatagggggatgctatcaatgtcatcttcattgtgacaacagaggagagtcacaatgaagatgacaaacctggcggcagcgcaaaagatg

SEQ ID NO: 13458 - DNA, 103 bp, Artificial Sequence
  Synthetic Polynucleotide
taatacgactcactatagggaggagggatgctatcaatgtcatcttcattaacagaggagaaatgaaatggacattgataacctggcggcagcgcaaaagatg

SEQ ID NO: 13459 - DNA, 103 bp, Artificial Sequence
  Synthetic Polynucleotide
taatacgactcactatagggtccaaaggagggatgctatcaatgtcatctaacagaggagaagatgaatgtgatagcataacctggcggcagcgcaaaagatg

SEQ ID NO: 13460 - DNA, 103 bp, Artificial Sequence
  Synthetic Polynucleotide
taatacgactcactatagggaatatgtgaactactgagacaaaacagattaacagaggagaaatctgatgtgtctcagtaacctggcggcagcgcaaaagatg

SEQ ID NO: 13461 - DNA, 103 bp, Artificial Sequence
  Synthetic Polynucleotide
taatacgactcactatagggctgattccaaaggagggatgctatcaatgtaacagaggagaacattgatggcatccctcaacctggcggcagcgcaaaagatg

SEQ ID NO: 13462 - DNA, 103 bp, Artificial Sequence
  Synthetic Polynucleotide
taatacgactcactatagggttcgtctgattccaaaggagggatgctatcaacagaggagagatagcatgcctcctttgaacctggcggcagcgcaaaagatg

SEQ ID NO: 13463 - DNA, 103 bp, Artificial Sequence
  Synthetic Polynucleotide
taatacgactcactatagggttttcttcgtctgattccaaaggagggatgaacagaggagacatcccatgtttggaatcaacctggcggcagcgcaaaagatg

SEQ ID NO: 13464 - DNA, 103 bp, Artificial Sequence
  Synthetic Polynucleotide
taatacgactcactatagggtgttgttttcttcgtctgattccaaaggagaacagaggagactccttatgaatcagacgaacctggcggcagcgcaaaagatg

SEQ ID NO: 13465 - DNA, 103 bp, Artificial Sequence
  Synthetic Polynucleotide
taatacgactcactatagggctcagtgttgttttcttcgtctgattccaaaacagaggagattggaaatggacgaagaaaacctggcggcagcgcaaaagatg

SEQ ID NO: 13466 - DNA, 103 bp, Artificial Sequence
  Synthetic Polynucleotide
taatacgactcactataggggttgtctcagtgttgttttcttcgtctgataacagaggagaatcagaatgagaaaacaaaacctggcggcagcgcaaaagatg

SEQ ID NO: 13467 - DNA, 103 bp, Artificial Sequence
  Synthetic Polynucleotide
taatacgactcactatagggtaatggttgtctcagtgttgttttcttcgtaacagaggagaacgaagatgacaacactgaacctggcggcagcgcaaaagatg

SEQ ID NO: 13468 - DNA, 103 bp, Artificial Sequence
  Synthetic Polynucleotide
taatacgactcactatagggggtggtaatggttgtctcagtgttgttttcaacagaggagagaaaacatgactgagacaaacctggcggcagcgcaaaagatg

SEQ ID NO: 13469 - DNA, 103 bp, Artificial Sequence
  Synthetic Polynucleotide
taatacgactcactatagggtttgtggtggtaatggttgtctcagtgttgaacagaggagacaacacatggacaaccataacctggcggcagcgcaaaagatg

SEQ ID NO: 13470 - DNA, 103 bp, Artificial Sequence
  Synthetic Polynucleotide
taatacgactcactatagggtattttttgtggtggtaatggttgtctcagaacagaggagactgagaatgccattaccaaacctggcggcagcgcaaaagatg

SEQ ID NO: 13471 - DNA, 103 bp, Artificial Sequence
  Synthetic Polynucleotide
taatacgactcactatagggtgatcaatatgtgaactactgagacaaaacaacagaggagagttttgatgcagtagttcaacctggcggcagcgcaaaagatg

SEQ ID NO: 13472 - DNA, 103 bp, Artificial Sequence
  Synthetic Polynucleotide
taatacgactcactatagggagtggtattttttgtggtggtaatggttgtaacagaggagaacaaccatgaccaccacaaacctggcggcagcgcaaaagatg

SEQ ID NO: 13473 - DNA, 103 bp, Artificial Sequence
  Synthetic Polynucleotide
taatacgactcactatagggggagcagtggtattttttgtggtggtaatgaacagaggagacattacatgcacaaaaaaaacctggcggcagcgcaaaagatg

SEQ ID NO: 13474 - DNA, 103 bp, Artificial Sequence
  Synthetic Polynucleotide
taatacgactcactatagggctggtggagcagtggtattttttgtggtggaacagaggagaccaccaatgaaaataccaaacctggcggcagcgcaaaagatg

SEQ ID NO: 13475 - DNA, 103 bp, Artificial Sequence
  Synthetic Polynucleotide
taatacgactcactatagggaggtgctggtggagcagtggtattttttgtaacagaggagaacaaaaatgaccactgctaacctggcggcagcgcaaaagatg

SEQ ID NO: 13476 - DNA, 103 bp, Artificial Sequence
  Synthetic Polynucleotide
taatacgactcactatagggtaaacaggtgctggtggagcagtggtatttaacagaggagaaaatacatgtgctccaccaacctggcggcagcgcaaaagatg

SEQ ID NO: 13477 - DNA, 103 bp, Artificial Sequence
  Synthetic Polynucleotide
taatacgactcactatagggtccgataaacaggtgctggtggagcagtggaacagaggagaccactgatgcaccagcacaacctggcggcagcgcaaaagatg

SEQ ID NO: 13478 - DNA, 103 bp, Artificial Sequence
  Synthetic Polynucleotide
taatacgactcactatagggattactccgataaacaggtgctggtggagcaacagaggagagctccaatggcacctgttaacctggcggcagcgcaaaagatg

SEQ ID NO: 13479 - DNA, 103 bp, Artificial Sequence
  Synthetic Polynucleotide
taatacgactcactatagggtctgaattactccgataaacaggtgctggtaacagaggagaaccagcatgtgtttatcgaacctggcggcagcgcaaaagatg

SEQ ID NO: 13480 - DNA, 103 bp, Artificial Sequence
  Synthetic Polynucleotide
taatacgactcactatagggccttttctgaattactccgataaacaggtgaacagaggagacacctgatgatcggagtaaacctggcggcagcgcaaaagatg

SEQ ID NO: 13481 - DNA, 103 bp, Artificial Sequence
  Synthetic Polynucleotide
taatacgactcactataggggggctccttttctgaattactccgataaacaacagaggagagtttatatgagtaattcaaacctggcggcagcgcaaaagatg

SEQ ID NO: 13482 - DNA, 103 bp, Artificial Sequence
  Synthetic Polynucleotide
taatacgactcactataggggggtatgatcaatatgtgaactactgagacaacagaggagagtctcaatggttcacataaacctggcggcagcgcaaaagatg

SEQ ID NO: 13483 - DNA, 103 bp, Artificial Sequence
  Synthetic Polynucleotide
taatacgactcactataggggggaggggctccttttctgaattactccgaaacagaggagatcggagatgttcagaaaaaacctggcggcagcgcaaaagatg

SEQ ID NO: 13484 - DNA, 103 bp, Artificial Sequence
  Synthetic Polynucleotide
taatacgactcactatagggcttgcgggaggggctccttttctgaattacaacagaggagagtaattatgaaaaggagcaacctggcggcagcgcaaaagatg

SEQ ID NO: 13485 - DNA, 103 bp, Artificial Sequence
  Synthetic Polynucleotide
taatacgactcactatagggtttttcttgcgggaggggctccttttctgaaacagaggagatcagaaatggagcccctcaacctggcggcagcgcaaaagatg

SEQ ID NO: 13486 - DNA, 103 bp, Artificial Sequence
  Synthetic Polynucleotide
taatacgactcactatagggtgggatttttcttgcgggaggggctcctttaacagaggagaaaaggaatgcctcccgcaaacctggcggcagcgcaaaagatg

SEQ ID NO: 13487 - DNA, 103 bp, Artificial Sequence
  Synthetic Polynucleotide
taatacgactcactataggggcttctgggatttttcttgcgggaggggctaacagaggagaagccccatgcgcaagaaaaacctggcggcagcgcaaaagatg

SEQ ID NO: 13488 - DNA, 103 bp, Artificial Sequence
  Synthetic Polynucleotide
taatacgactcactatagggtggttgcttctgggatttttcttgcgggagaacagaggagactcccgatggaaaaatccaacctggcggcagcgcaaaagatg

SEQ ID NO: 13489 - DNA, 103 bp, Artificial Sequence
  Synthetic Polynucleotide
taatacgactcactatagggtggtttggttgcttctgggatttttcttgcaacagaggagagcaagaatgatcccagaaaacctggcggcagcgcaaaagatg

SEQ ID NO: 13490 - DNA, 103 bp, Artificial Sequence
  Synthetic Polynucleotide
taatacgactcactatagggtcacttggtttggttgcttctgggatttttaacagaggagaaaaaatatgagaagcaacaacctggcggcagcgcaaaagatg

SEQ ID NO: 13491 - DNA, 103 bp, Artificial Sequence
  Synthetic Polynucleotide
taatacgactcactatagggaccactcacttggtttggttgcttctgggaaacagaggagatcccagatgcaaccaaacaacctggcggcagcgcaaaagatg

SEQ ID NO: 13492 - DNA, 103 bp, Artificial Sequence
  Synthetic Polynucleotide
taatacgactcactatagggtcactaccactcacttggtttggttgcttcaacagaggagagaagcaatgaaaccaagtaacctggcggcagcgcaaaagatg

SEQ ID NO: 13493 - DNA, 103 bp, Artificial Sequence
  Synthetic Polynucleotide
taatacgactcactatagggctcctgggtatgatcaatatgtgaactactaacagaggagaagtagtatgcatattgataacctggcggcagcgcaaaagatg

SEQ ID NO: 13494 - DNA, 103 bp, Artificial Sequence
  Synthetic Polynucleotide
taatacgactcactatagggtattctcactaccactcacttggtttggttaacagaggagaaaccaaatgaagtgagtgaacctggcggcagcgcaaaagatg

SEQ ID NO: 13495 - DNA, 103 bp, Artificial Sequence
  Synthetic Polynucleotide
taatacgactcactataggggtcggtattctcactaccactcacttggttaacagaggagaaaccaaatgagtggtagtaacctggcggcagcgcaaaagatg

SEQ ID NO: 13496 - DNA, 103 bp, Artificial Sequence
  Synthetic Polynucleotide
taatacgactcactatagggttattgtcggtattctcactaccactcactaacagaggagaagtgagatgtagtgagaaaacctggcggcagcgcaaaagatg

SEQ ID NO: 13497 - DNA, 103 bp, Artificial Sequence
  Synthetic Polynucleotide
taatacgactcactataggggaggtttattgtcggtattctcactaccacaacagaggagagtggtaatgagaataccgaacctggcggcagcgcaaaagatg

SEQ ID NO: 13498 - DNA, 103 bp, Artificial Sequence
  Synthetic Polynucleotide
taatacgactcactatagggtgagtgaggtttattgtcggtattctcactaacagaggagaagtgagatgaccgacaataacctggcggcagcgcaaaagatg

SEQ ID NO: 13499 - DNA, 103 bp, Artificial Sequence
  Synthetic Polynucleotide
taatacgactcactatagggtgctctgagtgaggtttattgtcggtattcaacagaggagagaatacatgcaataaaccaacctggcggcagcgcaaaagatg

SEQ ID NO: 13500 - DNA, 103 bp, Artificial Sequence
  Synthetic Polynucleotide
taatacgactcactatagggctgattgctctgagtgaggtttattgtcggaacagaggagaccgacaatgaacctcactaacctggcggcagcgcaaaagatg

SEQ ID NO: 13501 - DNA, 103 bp, Artificial Sequence
  Synthetic Polynucleotide
taatacgactcactatagggttccactgattgctctgagtgaggtttattaacagaggagaaataaaatgcactcagagaacctggcggcagcgcaaaagatg

SEQ ID NO: 13502 - DNA, 103 bp, Artificial Sequence
  Synthetic Polynucleotide
taatacgactcactatagggatttcttccactgattgctctgagtgaggtaacagaggagaacctcaatgagagcaatcaacctggcggcagcgcaaaagatg

SEQ ID NO: 13503 - DNA, 103 bp, Artificial Sequence
  Synthetic Polynucleotide
taatacgactcactataggggatacatttcttccactgattgctctgagtaacagaggagaactcagatgaatcagtggaacctggcggcagcgcaaaagatg

SEQ ID NO: 13504 - DNA, 103 bp, Artificial Sequence
  Synthetic Polynucleotide
taatacgactcactatagggtccaactcctgggtatgatcaatatgtgaaaacagaggagattcacaatgtgatcatacaacctggcggcagcgcaaaagatg

SEQ ID NO: 13505 - DNA, 103 bp, Artificial Sequence
  Synthetic Polynucleotide
taatacgactcactataggggtgtcgatacatttcttccactgattgctcaacagaggagagagcaaatggtggaagaaaacctggcggcagcgcaaaagatg

SEQ ID NO: 13506 - DNA, 103 bp, Artificial Sequence
  Synthetic Polynucleotide
taatacgactcactatagggaggatgtgtcgatacatttcttccactgataacagaggagaatcagtatgagaaatgtaaacctggcggcagcgcaaaagatg

SEQ ID NO: 13507 - DNA, 103 bp, Artificial Sequence
  Synthetic Polynucleotide
taatacgactcactatagggtttggaggatgtgtcgatacatttcttccaaacagaggagatggaagatgtgtatcgacaacctggcggcagcgcaaaagatg

SEQ ID NO: 13508 - DNA, 103 bp, Artificial Sequence
  Synthetic Polynucleotide
taatacgactcactatagggttgtgtttggaggatgtgtcgatacatttcaacagaggagagaaatgatgcgacacatcaacctggcggcagcgcaaaagatg

SEQ ID NO: 13509 - DNA, 103 bp, Artificial Sequence
  Synthetic Polynucleotide
taatacgactcactatagggggtccttgtgtttggaggatgtgtcgatacaacagaggagagtatcgatgcatcctccaaacctggcggcagcgcaaaagatg

SEQ ID NO: 13510 - DNA, 103 bp, Artificial Sequence
  Synthetic Polynucleotide
taatacgactcactatagggcaaatggtccttgtgtttggaggatgtgtcaacagaggagagacacaatgtccaaacacaacctggcggcagcgcaaaagatg

SEQ ID NO: 13511 - DNA, 103 bp, Artificial Sequence
  Synthetic Polynucleotide
taatacgactcactatagggggcatcaaatggtccttgtgtttggaggataacagaggagaatcctcatgacacaaggaaacctggcggcagcgcaaaagatg

SEQ ID NO: 13512 - DNA, 103 bp, Artificial Sequence
  Synthetic Polynucleotide
taatacgactcactatagggaggatggcatcaaatggtccttgtgtttggaacagaggagaccaaacatgaggaccattaacctggcggcagcgcaaaagatg

SEQ ID NO: 13513 - DNA, 103 bp, Artificial Sequence
  Synthetic Polynucleotide
taatacgactcactatagggagtataggatggcatcaaatggtccttgtgaacagaggagacacaagatgcatttgatgaacctggcggcagcgcaaaagatg

SEQ ID NO: 13514 - DNA, 103 bp, Artificial Sequence
  Synthetic Polynucleotide
taatacgactcactataggggtaatagtataggatggcatcaaatggtccaacagaggagaggaccaatggatgccatcaacctggcggcagcgcaaaagatg

SEQ ID NO: 13515 - DNA, 103 bp, Artificial Sequence
  Synthetic Polynucleotide
taatacgactcactatagggttaggtccaactcctgggtatgatcaatataacagaggagaatattgatgatacccaggaacctggcggcagcgcaaaagatg

SEQ ID NO: 13516 - DNA, 103 bp, Artificial Sequence
  Synthetic Polynucleotide
taatacgactcactatagggatcatgtaatagtataggatggcatcaaataacagaggagaatttgaatgcatcctataaacctggcggcagcgcaaaagatg

SEQ ID NO: 13517 - DNA, 103 bp, Artificial Sequence
  Synthetic Polynucleotide
taatacgactcactatagggccgtcatcatgtaatagtataggatggcataacagaggagaatgccaatgtatactattaacctggcggcagcgcaaaagatg

SEQ ID NO: 13518 - DNA, 103 bp, Artificial Sequence
  Synthetic Polynucleotide
taatacgactcactatagggctcctccgtcatcatgtaatagtataggataacagaggagaatcctaatgtattacatgaacctggcggcagcgcaaaagatg

SEQ ID NO: 13519 - DNA, 103 bp, Artificial Sequence
  Synthetic Polynucleotide
taatacgactcactatagggatcggctcctccgtcatcatgtaatagtataacagaggagaatactaatgcatgatgacaacctggcggcagcgcaaaagatg

SEQ ID NO: 13520 - DNA, 103 bp, Artificial Sequence
  Synthetic Polynucleotide
taatacgactcactatagggagacaatcggctcctccgtcatcatgtaataacagaggagaattacaatgtgacggaggaacctggcggcagcgcaaaagatg

SEQ ID NO: 13521 - DNA, 103 bp, Artificial Sequence
  Synthetic Polynucleotide
taatacgactcactataggggctaaagacaatcggctcctccgtcatcataacagaggagaatgatgatggaggagccgaacctggcggcagcgcaaaagatg

SEQ ID NO: 13522 - DNA, 103 bp, Artificial Sequence
  Synthetic Polynucleotide
taatacgactcactatagggctagtgctaaagacaatcggctcctccgtcaacagaggagagacggaatggccgattgtaacctggcggcagcgcaaaagatg

SEQ ID NO: 13523 - DNA, 103 bp, Artificial Sequence
  Synthetic Polynucleotide
taatacgactcactatagggcatcactagtgctaaagacaatcggctcctaacagaggagaaggagcatgttgtctttaaacctggcggcagcgcaaaagatg

SEQ ID NO: 13524 - DNA, 103 bp, Artificial Sequence
  Synthetic Polynucleotide
taatacgactcactatagggtttcccatcactagtgctaaagacaatcggaacagaggagaccgattatgtttagcactaacctggcggcagcgcaaaagatg

SEQ ID NO: 13525 - DNA, 103 bp, Artificial Sequence
  Synthetic Polynucleotide
taatacgactcactatagggtattctttcccatcactagtgctaaagacaaacagaggagatgtcttatgcactagtgaaacctggcggcagcgcaaaagatg

SEQ ID NO: 13526 - DNA, 103 bp, Artificial Sequence
  Synthetic Polynucleotide
taatacgactcactatagggtattcgcacacaataaagatcaaaaaacctaacagaggagaaggtttatggatctttataacctggcggcagcgcaaaagatg

SEQ ID NO: 13527 - DNA, 103 bp, Artificial Sequence
  Synthetic Polynucleotide
taatacgactcactatagggtggaattaggtccaactcctgggtatgatcaacagaggagagatcatatgcaggagttgaacctggcggcagcgcaaaagatg

SEQ ID NO: 13528 - DNA, 103 bp, Artificial Sequence
  Synthetic Polynucleotide
taatacgactcactatagggatacgtattctttcccatcactagtgctaaaacagaggagattagcaatggtgatgggaaacctggcggcagcgcaaaagatg

SEQ ID NO: 13529 - DNA, 103 bp, Artificial Sequence
  Synthetic Polynucleotide
taatacgactcactatagggagggtatacgtattctttcccatcactagtaacagaggagaactagtatggggaaagaaaacctggcggcagcgcaaaagatg

SEQ ID NO: 13530 - DNA, 103 bp, Artificial Sequence
  Synthetic Polynucleotide
taatacgactcactataggggaatcagggtatacgtattctttcccatcaaacagaggagatgatggatgagaatacgtaacctggcggcagcgcaaaagatg

SEQ ID NO: 13531 - DNA, 103 bp, Artificial Sequence
  Synthetic Polynucleotide
taatacgactcactatagggcaagagaatcagggtatacgtattctttccaacagaggagaggaaagatgacgtataccaacctggcggcagcgcaaaagatg

SEQ ID NO: 13532 - DNA, 103 bp, Artificial Sequence
  Synthetic Polynucleotide
taatacgactcactatagggcccttcaagagaatcagggtatacgtattcaacagaggagagaatacatgtaccctgataacctggcggcagcgcaaaagatg

SEQ ID NO: 13533 - DNA, 103 bp, Artificial Sequence
  Synthetic Polynucleotide
taatacgactcactatagggtgctccccttcaagagaatcagggtatacgaacagaggagacgtataatgtgattctctaacctggcggcagcgcaaaagatg

SEQ ID NO: 13534 - DNA, 103 bp, Artificial Sequence
  Synthetic Polynucleotide
taatacgactcactataggggtggatgctccccttcaagagaatcagggtaacagaggagaaccctgatgctcttgaagaacctggcggcagcgcaaaagatg

SEQ ID NO: 13535 - DNA, 103 bp, Artificial Sequence
  Synthetic Polynucleotide
taatacgactcactatagggccacggtggatgctccccttcaagagaatcaacagaggagagattctatggaaggggagaacctggcggcagcgcaaaagatg

SEQ ID NO: 13536 - DNA, 103 bp, Artificial Sequence
  Synthetic Polynucleotide
taatacgactcactatagggctgagccacggtggatgctccccttcaagaaacagaggagatcttgaatgggagcatccaacctggcggcagcgcaaaagatg

SEQ ID NO: 13537 - DNA, 103 bp, Artificial Sequence
  Synthetic Polynucleotide
taatacgactcactatagggtttcactgagccacggtggatgctccccttaacagaggagaaaggggatgatccaccgtaacctggcggcagcgcaaaagatg

SEQ ID NO: 13538 - DNA, 103 bp, Artificial Sequence
  Synthetic Polynucleotide
taatacgactcactatagggagctttggaattaggtccaactcctgggtaaacagaggagatacccaatggttggacctaacctggcggcagcgcaaaagatg

SEQ ID NO: 13539 - DNA, 103 bp, Artificial Sequence
  Synthetic Polynucleotide
taatacgactcactatagggctctttttcactgagccacggtggatgctcaacagaggagagagcatatgccgtggctcaacctggcggcagcgcaaaagatg

SEQ ID NO: 13540 - DNA, 103 bp, Artificial Sequence
  Synthetic Polynucleotide
taatacgactcactatagggaaggcctctttttcactgagccacggtggaaacagaggagatccaccatggctcagtgaaacctggcggcagcgcaaaagatg

SEQ ID NO: 13541 - DNA, 103 bp, Artificial Sequence
  Synthetic Polynucleotide
taatacgactcactatagggcattcaaggcctctttttcactgagccacgaacagaggagacgtggcatggtgaaaaagaacctggcggcagcgcaaaagatg

SEQ ID NO: 13542 - DNA, 103 bp, Artificial Sequence
  Synthetic Polynucleotide
taatacgactcactataggggtcctcattcaaggcctctttttcactgagaacagaggagactcagtatgaaagaggccaacctggcggcagcgcaaaagatg

SEQ ID NO: 13543 - DNA, 103 bp, Artificial Sequence
  Synthetic Polynucleotide
taatacgactcactatagggctattgtcctcattcaaggcctctttttcaaacagaggagatgaaaaatgggccttgaaaacctggcggcagcgcaaaagatg

SEQ ID NO: 13544 - DNA, 103 bp, Artificial Sequence
  Synthetic Polynucleotide
taatacgactcactatagggtaaacctattgtcctcattcaaggcctcttaacagaggagaaagaggatgtgaatgaggaacctggcggcagcgcaaaagatg

SEQ ID NO: 13545 - DNA, 103 bp, Artificial Sequence
  Synthetic Polynucleotide
taatacgactcactatagggtgtgataaacctattgtcctcattcaaggcaacagaggagagccttgatggaggacaataacctggcggcagcgcaaaagatg

SEQ ID NO: 13546 - DNA, 103 bp, Artificial Sequence
  Synthetic Polynucleotide
taatacgactcactatagggtccattgtgataaacctattgtcctcattcaacagaggagagaatgaatgcaataggttaacctggcggcagcgcaaaagatg

SEQ ID NO: 13547 - DNA, 103 bp, Artificial Sequence
  Synthetic Polynucleotide
taatacgactcactataggggatcatccattgtgataaacctattgtcctaacagaggagaaggacaatgggtttatcaaacctggcggcagcgcaaaagatg

SEQ ID NO: 13548 - DNA, 103 bp, Artificial Sequence
  Synthetic Polynucleotide
taatacgactcactatagggttgttgatcatccattgtgataaacctattaacagaggagaaataggatgatcacaatgaacctggcggcagcgcaaaagatg

SEQ ID NO: 13549 - DNA, 103 bp, Artificial Sequence
  Synthetic Polynucleotide
taatacgactcactatagggctctaagctttggaattaggtccaactcctaacagaggagaaggagtatgacctaattcaacctggcggcagcgcaaaagatg

SEQ ID NO: 13550 - DNA, 103 bp, Artificial Sequence
  Synthetic Polynucleotide
taatacgactcactatagggtagaattgttgatcatccattgtgataaacaacagaggagagtttatatgaatggatgaaacctggcggcagcgcaaaagatg

SEQ ID NO: 13551 - DNA, 103 bp, Artificial Sequence
  Synthetic Polynucleotide
taatacgactcactataggggccagtagaattgttgatcatccattgtgaaacagaggagatcacaaatgatgatcaacaacctggcggcagcgcaaaagatg

SEQ ID NO: 13552 - DNA, 103 bp, Artificial Sequence
  Synthetic Polynucleotide
taatacgactcactatagggtacaggccagtagaattgttgatcatccataacagaggagaatggatatgcaacaattcaacctggcggcagcgcaaaagatg

SEQ ID NO: 13553 - DNA, 103 bp, Artificial Sequence
  Synthetic Polynucleotide
taatacgactcactatagggttcattacaggccagtagaattgttgatcaaacagaggagatgatcaatgattctactgaacctggcggcagcgcaaaagatg

SEQ ID NO: 13554 - DNA, 103 bp, Artificial Sequence
  Synthetic Polynucleotide
taatacgactcactatagggtgtgattcattacaggccagtagaattgttaacagaggagaaacaatatgactggcctgaacctggcggcagcgcaaaagatg

SEQ ID NO: 13555 - DNA, 103 bp, Artificial Sequence
  Synthetic Polynucleotide
taatacgactcactataggggttcctgtgattcattacaggccagtagaaaacagaggagattctacatgcctgtaatgaacctggcggcagcgcaaaagatg

SEQ ID NO: 13556 - DNA, 103 bp, Artificial Sequence
  Synthetic Polynucleotide
taatacgactcactatagggaatttgttcctgtgattcattacaggccagaacagaggagactggccatgaatgaatcaaacctggcggcagcgcaaaagatg

SEQ ID NO: 13557 - DNA, 103 bp, Artificial Sequence
  Synthetic Polynucleotide
taatacgactcactatagggccatgaatttgttcctgtgattcattacagaacagaggagactgtaaatgatcacaggaaacctggcggcagcgcaaaagatg

SEQ ID NO: 13558 - DNA, 103 bp, Artificial Sequence
  Synthetic Polynucleotide
taatacgactcactataggggatagccatgaatttgttcctgtgattcataacagaggagaatgaatatgaggaacaaaaacctggcggcagcgcaaaagatg

SEQ ID NO: 13559 - DNA, 103 bp, Artificial Sequence
  Synthetic Polynucleotide
taatacgactcactatagggtgaaggatagccatgaatttgttcctgtgaaacagaggagatcacagatgcaaattcataacctggcggcagcgcaaaagatg

SEQ ID NO: 13560 - DNA, 103 bp, Artificial Sequence
  Synthetic Polynucleotide
taatacgactcactatagggtcccactctaagctttggaattaggtccaaaacagaggagattggacatgattccaaagaacctggcggcagcgcaaaagatg

SEQ ID NO: 13561 - DNA, 103 bp, Artificial Sequence
  Synthetic Polynucleotide
taatacgactcactatagggggtgctgaaggatagccatgaatttgttccaacagaggagaggaacaatgtcatggctaaacctggcggcagcgcaaaagatg

SEQ ID NO: 13562 - DNA, 103 bp, Artificial Sequence
  Synthetic Polynucleotide
taatacgactcactatagggcttgtggtgctgaaggatagccatgaatttaacagaggagaaaattcatggctatccttaacctggcggcagcgcaaaagatg

SEQ ID NO: 13563 - DNA, 103 bp, Artificial Sequence
  Synthetic Polynucleotide
taatacgactcactatagggaattacttgtggtgctgaaggatagccatgaacagaggagacatggcatgccttcagcaaacctggcggcagcgcaaaagatg

SEQ ID NO: 13564 - DNA, 103 bp, Artificial Sequence
  Synthetic Polynucleotide
taatacgactcactataggggaagaaattacttgtggtgctgaaggatagaacagaggagactatccatgagcaccacaaacctggcggcagcgcaaaagatg

SEQ ID NO: 13565 - DNA, 103 bp, Artificial Sequence
  Synthetic Polynucleotide
taatacgactcactatagggattatgaagaaattacttgtggtgctgaagaacagaggagacttcagatgcacaagtaaaacctggcggcagcgcaaaagatg

SEQ ID NO: 13566 - DNA, 103 bp, Artificial Sequence
  Synthetic Polynucleotide
taatacgactcactatagggctgtcattatgaagaaattacttgtggtgcaacagaggagagcaccaatggtaatttctaacctggcggcagcgcaaaagatg

SEQ ID NO: 13567 - DNA, 103 bp, Artificial Sequence
  Synthetic Polynucleotide
taatacgactcactatagggatgatctgtcattatgaagaaattacttgtaacagaggagaacaagtatgttcttcataaacctggcggcagcgcaaaagatg

SEQ ID NO: 13568 - DNA, 103 bp, Artificial Sequence
  Synthetic Polynucleotide
taatacgactcactatagggttacaatgatctgtcattatgaagaaattaaacagaggagataatttatgcataatgacaacctggcggcagcgcaaaagatg

SEQ ID NO: 13569 - DNA, 103 bp, Artificial Sequence
  Synthetic Polynucleotide
taatacgactcactatagggtaaccttacaatgatctgtcattatgaagaaacagaggagatcttcaatgtgacagatcaacctggcggcagcgcaaaagatg

SEQ ID NO: 13570 - DNA, 103 bp, Artificial Sequence
  Synthetic Polynucleotide
taatacgactcactatagggggtaataaccttacaatgatctgtcattataacagaggagaataatgatggatcattgtaacctggcggcagcgcaaaagatg

SEQ ID NO: 13571 - DNA, 103 bp, Artificial Sequence
  Synthetic Polynucleotide
taatacgactcactatagggctaggtcccactctaagctttggaattaggaacagaggagacctaatatgaaagcttagaacctggcggcagcgcaaaagatg

SEQ ID NO: 13572 - DNA, 103 bp, Artificial Sequence
  Synthetic Polynucleotide
taatacgactcactatagggatggtggtaataaccttacaatgatctgtcaacagaggagagacagaatgttgtaaggtaacctggcggcagcgcaaaagatg

SEQ ID NO: 13573 - DNA, 103 bp, Artificial Sequence
  Synthetic Polynucleotide
taatacgactcactatagggcagggatggtggtaataaccttacaatgataacagaggagaatcattatgaggttattaaacctggcggcagcgcaaaagatg

SEQ ID NO: 13574 - DNA, 103 bp, Artificial Sequence
  Synthetic Polynucleotide
taatacgactcactatagggtgttgcagggatggtggtaataaccttacaaacagaggagatgtaagatgattaccaccaacctggcggcagcgcaaaagatg

SEQ ID NO: 13575 - DNA, 103 bp, Artificial Sequence
  Synthetic Polynucleotide
taatacgactcactatagggtgctttgttgcagggatggtggtaataaccaacagaggagaggttatatgcaccatcccaacctggcggcagcgcaaaagatg

SEQ ID NO: 13576 - DNA, 103 bp, Artificial Sequence
  Synthetic Polynucleotide
taatacgactcactatagggtttcatgctttgttgcagggatggtggtaaaacagaggagattaccaatgtccctgcaaaacctggcggcagcgcaaaagatg

SEQ ID NO: 13577 - DNA, 103 bp, Artificial Sequence
  Synthetic Polynucleotide
taatacgactcactataggggtggttttcatgctttgttgcagggatggtaacagaggagaaccatcatggcaacaaagaacctggcggcagcgcaaaagatg

SEQ ID NO: 13578 - DNA, 103 bp, Artificial Sequence
  Synthetic Polynucleotide
taatacgactcactatagggtgagtgtggttttcatgctttgttgcagggaacagaggagaccctgcatgaaagcatgaaacctggcggcagcgcaaaagatg

SEQ ID NO: 13579 - DNA, 103 bp, Artificial Sequence
  Synthetic Polynucleotide
taatacgactcactataggggttgttgagtgtggttttcatgctttgttgaacagaggagacaacaaatgatgaaaaccaacctggcggcagcgcaaaagatg

SEQ ID NO: 13580 - DNA, 103 bp, Artificial Sequence
  Synthetic Polynucleotide
taatacgactcactatagggagggcgttgttgagtgtggttttcatgcttaacagaggagaaagcatatgaaccacactaacctggcggcagcgcaaaagatg

SEQ ID NO: 13581 - DNA, 103 bp, Artificial Sequence
  Synthetic Polynucleotide
taatacgactcactataggggtggtagggcgttgttgagtgtggttttcaaacagaggagatgaaaaatgcactcaacaaacctggcggcagcgcaaaagatg

SEQ ID NO: 13582 - DNA, 103 bp, Artificial Sequence
  Synthetic Polynucleotide
taatacgactcactatagggatacactaggtcccactctaagctttggaaaacagaggagattccaaatgttagagtggaacctggcggcagcgcaaaagatg

SEQ ID NO: 13583 - DNA, 103 bp, Artificial Sequence
  Synthetic Polynucleotide
taatacgactcactatagggatcctgtggtagggcgttgttgagtgtggtaacagaggagaaccacaatgaacaacgccaacctggcggcagcgcaaaagatg

SEQ ID NO: 13584 - DNA, 103 bp, Artificial Sequence
  Synthetic Polynucleotide
taatacgactcactatagggaaggtatcctgtggtagggcgttgttgagtaacagaggagaactcaaatgcgccctaccaacctggcggcagcgcaaaagatg

SEQ ID NO: 13585 - DNA, 103 bp, Artificial Sequence
  Synthetic Polynucleotide
taatacgactcactatagggtctccaaggtatcctgtggtagggcgttgtaacagaggagaacaacgatgtaccacaggaacctggcggcagcgcaaaagatg

SEQ ID NO: 13586 - DNA, 103 bp, Artificial Sequence
  Synthetic Polynucleotide
taatacgactcactatagggtatggtctccaaggtatcctgtggtagggcaacagaggagagccctaatgcaggataccaacctggcggcagcgcaaaagatg

SEQ ID NO: 13587 - DNA, 103 bp, Artificial Sequence
  Synthetic Polynucleotide
taatacgactcactatagggtggtgtatggtctccaaggtatcctgtggtaacagaggagaaccacaatgtaccttggaaacctggcggcagcgcaaaagatg

SEQ ID NO: 13588 - DNA, 103 bp, Artificial Sequence
  Synthetic Polynucleotide
taatacgactcactataggggatcttggtgtatggtctccaaggtatcctaacagaggagaaggataatgtggagaccaaacctggcggcagcgcaaaagatg

SEQ ID NO: 13589 - DNA, 103 bp, Artificial Sequence
  Synthetic Polynucleotide
taatacgactcactatagggctgctgatcttggtgtatggtctccaaggtaacagaggagaaccttgatgaccatacacaacctggcggcagcgcaaaagatg

SEQ ID NO: 13590 - DNA, 103 bp, Artificial Sequence
  Synthetic Polynucleotide
taatacgactcactatagggcacagctgctgatcttggtgtatggtctccaacagaggagaggagacatgacaccaagaaacctggcggcagcgcaaaagatg

SEQ ID NO: 13591 - DNA, 103 bp, Artificial Sequence
  Synthetic Polynucleotide
taatacgactcactatagggggttgcacagctgctgatcttggtgtatggaacagaggagaccatacatgaagatcagcaacctggcggcagcgcaaaagatg

SEQ ID NO: 13592 - DNA, 103 bp, Artificial Sequence
  Synthetic Polynucleotide
taatacgactcactatagggggggtggttgcacagctgctgatcttggtgaacagaggagacaccaaatgcagcagctgaacctggcggcagcgcaaaagatg

SEQ ID NO: 13593 - DNA, 103 bp, Artificial Sequence
  Synthetic Polynucleotide
taatacgactcactatagggcgaggatacactaggtcccactctaagcttaacagaggagaaagcttatggtgggacctaacctggcggcagcgcaaaagatg

SEQ ID NO: 13594 - DNA, 103 bp, Artificial Sequence
  Synthetic Polynucleotide
taatacgactcactataggggcatgggggtggttgcacagctgctgatctaacagaggagaagatcaatggctgtgcaaaacctggcggcagcgcaaaagatg

SEQ ID NO: 13595 - DNA, 103 bp, Artificial Sequence
  Synthetic Polynucleotide
taatacgactcactataggggattcgcatgggggtggttgcacagctgctaacagaggagaagcagcatggcaaccaccaacctggcggcagcgcaaaagatg

SEQ ID NO: 13596 - DNA, 103 bp, Artificial Sequence
  Synthetic Polynucleotide
taatacgactcactatagggtggtggattcgcatgggggtggttgcacagaacagaggagactgtgcatgcacccccataacctggcggcagcgcaaaagatg

SEQ ID NO: 13597 - DNA, 103 bp, Artificial Sequence
  Synthetic Polynucleotide
taatacgactcactatagggtgtggtggtggattcgcatgggggtggttgaacagaggagacaaccaatgccatgcgaaaacctggcggcagcgcaaaagatg

SEQ ID NO: 13598 - DNA, 103 bp, Artificial Sequence
  Synthetic Polynucleotide
taatacgactcactataggggtggttgtggtggtggattcgcatgggggtaacagaggagaacccccatgcgaatccacaacctggcggcagcgcaaaagatg

SEQ ID NO: 13599 - DNA, 103 bp, Artificial Sequence
  Synthetic Polynucleotide
taatacgactcactataggggtttggtggttgtggtggtggattcgcatgaacagaggagacatgcgatgccaccaccaaacctggcggcagcgcaaaagatg

SEQ ID NO: 13600 - DNA, 103 bp, Artificial Sequence
  Synthetic Polynucleotide
taatacgactcactatagggttattgtttggtggttgtggtggtggattcaacagaggagagaatccatgaccacaaccaacctggcggcagcgcaaaagatg

SEQ ID NO: 13601 - DNA, 103 bp, Artificial Sequence
  Synthetic Polynucleotide
taatacgactcactatagggtgggattattgtttggtggttgtggtggtgaacagaggagacaccacatgaaccaccaaaacctggcggcagcgcaaaagatg

SEQ ID NO: 13602 - DNA, 103 bp, Artificial Sequence
  Synthetic Polynucleotide
taatacgactcactatagggggtcttgggattattgtttggtggttgtggaacagaggagaccacaaatgccaaacaataacctggcggcagcgcaaaagatg

SEQ ID NO: 13603 - DNA, 103 bp, Artificial Sequence
  Synthetic Polynucleotide
taatacgactcactatagggggtttggtcttgggattattgtttggtggtaacagaggagaaccaccatgcaataatccaacctggcggcagcgcaaaagatg

SEQ ID NO: 13604 - DNA, 103 bp, Artificial Sequence
  Synthetic Polynucleotide
taatacgactcactatagggagccccgaggatacactaggtcccactctaaacagaggagatagagtatgacctagtgtaacctggcggcagcgcaaaagatg

SEQ ID NO: 13605 - DNA, 103 bp, Artificial Sequence
  Synthetic Polynucleotide
taatacgactcactatagggtgtgcggtttggtcttgggattattgtttgaacagaggagacaaacaatgatcccaagaaacctggcggcagcgcaaaagatg

SEQ ID NO: 13606 - DNA, 103 bp, Artificial Sequence
  Synthetic Polynucleotide
taatacgactcactatagggggatgtgtgcggtttggtcttgggattattaacagaggagaaataatatgaagaccaaaaacctggcggcagcgcaaaagatg

SEQ ID NO: 13607 - DNA, 103 bp, Artificial Sequence
  Synthetic Polynucleotide
taatacgactcactataggggatctggatgtgtgcggtttggtcttgggaaacagaggagatcccaaatgcaaaccgcaaacctggcggcagcgcaaaagatg

SEQ ID NO: 13608 - DNA, 103 bp, Artificial Sequence
  Synthetic Polynucleotide
taatacgactcactataggggggttgatctggatgtgtgcggtttggtctaacagaggagaagaccaatgcgcacacataacctggcggcagcgcaaaagatg

SEQ ID NO: 13609 - DNA, 103 bp, Artificial Sequence
  Synthetic Polynucleotide
taatacgactcactatagggggtttgggttgatctggatgtgtgcggtttaacagaggagaaaaccgatgacatccagaaacctggcggcagcgcaaaagatg

SEQ ID NO: 13610 - DNA, 103 bp, Artificial Sequence
  Synthetic Polynucleotide
taatacgactcactatagggttgagggtttgggttgatctggatgtgtgcaacagaggagagcacacatgcagatcaacaacctggcggcagcgcaaaagatg

SEQ ID NO: 13611 - DNA, 103 bp, Artificial Sequence
  Synthetic Polynucleotide
taatacgactcactatagggggtgtttgagggtttgggttgatctggatgaacagaggagacatccaatgcaacccaaaaacctggcggcagcgcaaaagatg

SEQ ID NO: 13612 - DNA, 103 bp, Artificial Sequence
  Synthetic Polynucleotide
taatacgactcactatagggggggtggtgtttgagggtttgggttgatctaacagaggagaagatcaatgcaaaccctcaacctggcggcagcgcaaaagatg

SEQ ID NO: 13613 - DNA, 103 bp, Artificial Sequence
  Synthetic Polynucleotide
taatacgactcactatagggggagtggggtggtgtttgagggtttgggttaacagaggagaaacccaatgcctcaaacaaacctggcggcagcgcaaaagatg

SEQ ID NO: 13614 - DNA, 103 bp, Artificial Sequence
  Synthetic Polynucleotide
taatacgactcactatagggatcgcggagtggggtggtgtttgagggtttaacagaggagaaaacccatgaacaccaccaacctggcggcagcgcaaaagatg

SEQ ID NO: 13615 - DNA, 103 bp, Artificial Sequence
  Synthetic Polynucleotide
taatacgactcactatagggattacagccccgaggatacactaggtcccaaacagaggagatgggacatggtgtatcctaacctggcggcagcgcaaaagatg

SEQ ID NO: 13616 - DNA, 103 bp, Artificial Sequence
  Synthetic Polynucleotide
taatacgactcactatagggctgggatcgcggagtggggtggtgtttgagaacagaggagactcaaaatgcaccccactaacctggcggcagcgcaaaagatg

SEQ ID NO: 13617 - DNA, 103 bp, Artificial Sequence
  Synthetic Polynucleotide
taatacgactcactatagggttggtctgggatcgcggagtggggtggtgtaacagaggagaacaccaatgcactccgcgaacctggcggcagcgcaaaagatg

SEQ ID NO: 13618 - DNA, 103 bp, Artificial Sequence
  Synthetic Polynucleotide
taatacgactcactatagggggagtttggtctgggatcgcggagtggggtaacagaggagaaccccaatgcgcgatcccaacctggcggcagcgcaaaagatg

SEQ ID NO: 13619 - DNA, 103 bp, Artificial Sequence
  Synthetic Polynucleotide
taatacgactcactatagggggggcggagtttggtctgggatcgcggagtaacagaggagaactccgatgtcccagaccaacctggcggcagcgcaaaagatg

SEQ ID NO: 13620 - DNA, 103 bp, Artificial Sequence
  Synthetic Polynucleotide
taatacgactcactatagggtgtctggggcggagtttggtctgggatcgcaacagaggagagcgatcatggaccaaactaacctggcggcagcgcaaaagatg

SEQ ID NO: 13621 - DNA, 103 bp, Artificial Sequence
  Synthetic Polynucleotide
taatacgactcactataggggtgcttgtctggggcggagtttggtctgggaacagaggagacccagaatgaactccgccaacctggcggcagcgcaaaagatg

SEQ ID NO: 13622 - DNA, 103 bp, Artificial Sequence
  Synthetic Polynucleotide
taatacgactcactataggggtggggtgcttgtctggggcggagtttggtaacagaggagaaccaaaatgcgccccagaaacctggcggcagcgcaaaagatg

SEQ ID NO: 13623 - DNA, 103 bp, Artificial Sequence
  Synthetic Polynucleotide
taatacgactcactataggggatgggtggggtgcttgtctggggcggagtaacagaggagaactccgatgcagacaagcaacctggcggcagcgcaaaagatg

SEQ ID NO: 13624 - DNA, 103 bp, Artificial Sequence
  Synthetic Polynucleotide
taatacgactcactatagggtctgggatgggtggggtgcttgtctggggcaacagaggagagccccaatgaagcaccccaacctggcggcagcgcaaaagatg

SEQ ID NO: 13625 - DNA, 103 bp, Artificial Sequence
  Synthetic Polynucleotide
taatacgactcactatagggcggtttctgggatgggtggggtgcttgtctaacagaggagaagacaaatgccccacccaaacctggcggcagcgcaaaagatg

SEQ ID NO: 13626 - DNA, 103 bp, Artificial Sequence
  Synthetic Polynucleotide
taatacgactcactatagggattatattacagccccgaggatacactaggaacagaggagacctagtatgtcctcggggaacctggcggcagcgcaaaagatg

SEQ ID NO: 13627 - DNA, 103 bp, Artificial Sequence
  Synthetic Polynucleotide
taatacgactcactatagggccgtgcggtttctgggatgggtggggtgctaacagaggagaagcaccatgcccatcccaaacctggcggcagcgcaaaagatg

SEQ ID NO: 13628 - DNA, 103 bp, Artificial Sequence
  Synthetic Polynucleotide
taatacgactcactatagggctcggccgtgcggtttctgggatgggtgggaacagaggagacccaccatgcccagaaacaacctggcggcagcgcaaaagatg

SEQ ID NO: 13629 - DNA, 103 bp, Artificial Sequence
  Synthetic Polynucleotide
taatacgactcactatagggcgattctcggccgtgcggtttctgggatggaacagaggagaccatccatgaaaccgcacaacctggcggcagcgcaaaagatg

SEQ ID NO: 13630 - DNA, 103 bp, Artificial Sequence
  Synthetic Polynucleotide
taatacgactcactataggggggatcgattctcggccgtgcggtttctggaacagaggagaccagaaatggcacggccgaacctggcggcagcgcaaaagatg

SEQ ID NO: 13631 - DNA, 103 bp, Artificial Sequence
  Synthetic Polynucleotide
taatacgactcactatagggtgctggggatcgattctcggccgtgcggttaacagaggagaaaccgcatggccgagaataacctggcggcagcgcaaaagatg

SEQ ID NO: 13632 - DNA, 103 bp, Artificial Sequence
  Synthetic Polynucleotide
taatacgactcactatagggttgaatgctggggatcgattctcggccgtgaacagaggagacacggcatggaatcgatcaacctggcggcagcgcaaaagatg

SEQ ID NO: 13633 - DNA, 103 bp, Artificial Sequence
  Synthetic Polynucleotide
taatacgactcactataggggcattttgaatgctggggatcgattctcggaacagaggagaccgagaatggatccccagaacctggcggcagcgcaaaagatg

SEQ ID NO: 13634 - DNA, 103 bp, Artificial Sequence
  Synthetic Polynucleotide
taatacgactcactatagggataacgcattttgaatgctggggatcgattaacagaggagaaatcgaatgccagcattcaacctggcggcagcgcaaaagatg

SEQ ID NO: 13635 - DNA, 103 bp, Artificial Sequence
  Synthetic Polynucleotide
taatacgactcactatagggtcttaataacgcattttgaatgctggggataacagaggagaatccccatgattcaaaataacctggcggcagcgcaaaagatg

SEQ ID NO: 13636 - DNA, 103 bp, Artificial Sequence
  Synthetic Polynucleotide
taatacgactcactatagggttttttcttaataacgcattttgaatgctgaacagaggagacagcatatgaaatgcgttaacctggcggcagcgcaaaagatg

SEQ ID NO: 13637 - DNA, 103 bp, Artificial Sequence
  Synthetic Polynucleotide
taatacgactcactatagggatagttattcgcacacaataaagatcaaaaaacagaggagattttgaatgttattgtgtaacctggcggcagcgcaaaagatg

SEQ ID NO: 13638 - DNA, 103 bp, Artificial Sequence
  Synthetic Polynucleotide
taatacgactcactatagggggctgattatattacagccccgaggatacaaacagaggagatgtatcatgggggctgtaaacctggcggcagcgcaaaagatg

SEQ ID NO: 13639 - DNA, 103 bp, Artificial Sequence
  Synthetic Polynucleotide
taatacgactcactatagggatatgttttttcttaataacgcattttgaaaacagaggagattcaaaatgcgttattaaaacctggcggcagcgcaaaagatg

SEQ ID NO: 13640 - DNA, 103 bp, Artificial Sequence
  Synthetic Polynucleotide
taatacgactcactatagggtcatcatatgttttttcttaataacgcattaacagaggagaaatgcgatgttaagaaaaaacctggcggcagcgcaaaagatg

SEQ ID NO: 13641 - DNA, 103 bp, Artificial Sequence
  Synthetic Polynucleotide
taatacgactcactatagggaatcttcatcatatgttttttcttaataacaacagaggagagttattatgaaaaaacataacctggcggcagcgcaaaagatg

SEQ ID NO: 13642 - DNA, 103 bp, Artificial Sequence
  Synthetic Polynucleotide
taatacgactcactataggggttttaatcttcatcatatgttttttcttaaacagaggagataagaaatgacatatgataacctggcggcagcgcaaaagatg

SEQ ID NO: 13643 - DNA, 103 bp, Artificial Sequence
  Synthetic Polynucleotide
taatacgactcactatagggtgaaggttttaatcttcatcatatgtttttaacagaggagaaaaaacatgtgatgaagaaacctggcggcagcgcaaaagatg

SEQ ID NO: 13644 - DNA, 103 bp, Artificial Sequence
  Synthetic Polynucleotide
taatacgactcactataggggttgatgaaggttttaatcttcatcatatgaacagaggagacatatgatgaagattaaaaacctggcggcagcgcaaaagatg

SEQ ID NO: 13645 - DNA, 103 bp, Artificial Sequence
  Synthetic Polynucleotide
taatacgactcactataggggcaatgttgatgaaggttttaatcttcatcaacagaggagagatgaaatgtaaaaccttaacctggcggcagcgcaaaagatg

SEQ ID NO: 13646 - DNA, 103 bp, Artificial Sequence
  Synthetic Polynucleotide
taatacgactcactatagggtctgtgcaatgttgatgaaggttttaatctaacagaggagaagattaatgccttcatcaaacctggcggcagcgcaaaagatg

SEQ ID NO: 13647 - DNA, 103 bp, Artificial Sequence
  Synthetic Polynucleotide
taatacgactcactatagggcaaagtctgtgcaatgttgatgaaggttttaacagaggagaaaaaccatgatcaacattaacctggcggcagcgcaaaagatg

SEQ ID NO: 13648 - DNA, 103 bp, Artificial Sequence
  Synthetic Polynucleotide
taatacgactcactatagggaggatcaaagtctgtgcaatgttgatgaagaacagaggagacttcatatgcattgcacaaacctggcggcagcgcaaaagatg

SEQ ID NO: 13649 - DNA, 103 bp, Artificial Sequence
  Synthetic Polynucleotide
taatacgactcactatagggtaaatggctgattatattacagccccgaggaacagaggagacctcggatgtgtaatataaacctggcggcagcgcaaaagatg

SEQ ID NO: 13650 - DNA, 103 bp, Artificial Sequence
  Synthetic Polynucleotide
taatacgactcactatagggtcctaaggatcaaagtctgtgcaatgttgaaacagaggagatcaacaatgcacagacttaacctggcggcagcgcaaaagatg

SEQ ID NO: 13651 - DNA, 103 bp, Artificial Sequence
  Synthetic Polynucleotide
taatacgactcactatagggtaaactcctaaggatcaaagtctgtgcaataacagaggagaattgcaatgactttgatcaacctggcggcagcgcaaaagatg

SEQ ID NO: 13652 - DNA, 103 bp, Artificial Sequence
  Synthetic Polynucleotide
taatacgactcactatagggtagaataaactcctaaggatcaaagtctgtaacagaggagaacagacatggatccttagaacctggcggcagcgcaaaagatg

SEQ ID NO: 13653 - DNA, 103 bp, Artificial Sequence
  Synthetic Polynucleotide
taatacgactcactatagggatagctagaataaactcctaaggatcaaagaacagaggagactttgaatgttaggagttaacctggcggcagcgcaaaagatg

SEQ ID NO: 13654 - DNA, 103 bp, Artificial Sequence
  Synthetic Polynucleotide
taatacgactcactatagggtgtagatagctagaataaactcctaaggataacagaggagaatccttatgagtttattcaacctggcggcagcgcaaaagatg

SEQ ID NO: 13655 - DNA, 103 bp, Artificial Sequence
  Synthetic Polynucleotide
taatacgactcactatagggcgttttgtagatagctagaataaactcctaaacagaggagataggagatgattctagctaacctggcggcagcgcaaaagatg

SEQ ID NO: 13656 - DNA, 103 bp, Artificial Sequence
  Synthetic Polynucleotide
taatacgactcactatagggggacccgttttgtagatagctagaataaacaacagaggagagtttatatgagctatctaaacctggcggcagcgcaaaagatg

SEQ ID NO: 13657 - DNA, 103 bp, Artificial Sequence
  Synthetic Polynucleotide
taatacgactcactataggggttttggacccgttttgtagatagctagaaaacagaggagattctagatgtctacaaaaaacctggcggcagcgcaaaagatg

SEQ ID NO: 13658 - DNA, 103 bp, Artificial Sequence
  Synthetic Polynucleotide
taatacgactcactatagggattccgttttggacccgttttgtagatagcaacagaggagagctatcatgaaaacgggtaacctggcggcagcgcaaaagatg

SEQ ID NO: 13659 - DNA, 103 bp, Artificial Sequence
  Synthetic Polynucleotide
taatacgactcactatagggaaatcattccgttttggacccgttttgtagaacagaggagactacaaatggggtccaaaaacctggcggcagcgcaaaagatg

SEQ ID NO: 13660 - DNA, 103 bp, Artificial Sequence
  Synthetic Polynucleotide
taatacgactcactatagggtgtgttaaatggctgattatattacagcccaacagaggagagggctgatgtataatcagaacctggcggcagcgcaaaagatg

SEQ ID NO: 13661 - DNA, 103 bp, Artificial Sequence
  Synthetic Polynucleotide
taatacgactcactatagggagtggaaatcattccgttttggacccgtttaacagaggagaaaacggatgcaaaacggaaacctggcggcagcgcaaaagatg

SEQ ID NO: 13662 - DNA, 103 bp, Artificial Sequence
  Synthetic Polynucleotide
taatacgactcactataggggccctagtggaaatcattccgttttggaccaacagaggagaggtccaatgcggaatgataacctggcggcagcgcaaaagatg

SEQ ID NO: 13663 - DNA, 103 bp, Artificial Sequence
  Synthetic Polynucleotide
taatacgactcactatagggctgcagccctagtggaaatcattccgttttaacagaggagaaaaacgatgtgatttccaaacctggcggcagcgcaaaagatg

SEQ ID NO: 13664 - DNA, 103 bp, Artificial Sequence
  Synthetic Polynucleotide
taatacgactcactataggggattgctgcagccctagtggaaatcattccaacagaggagaggaatgatgtccactaggaacctggcggcagcgcaaaagatg

SEQ ID NO: 13665 - DNA, 103 bp, Artificial Sequence
  Synthetic Polynucleotide
taatacgactcactatagggtcattgattgctgcagccctagtggaaatcaacagaggagagatttcatgtagggctgcaacctggcggcagcgcaaaagatg

SEQ ID NO: 13666 - DNA, 103 bp, Artificial Sequence
  Synthetic Polynucleotide
taatacgactcactatagggaaggatcattgattgctgcagccctagtggaacagaggagaccactaatgctgcagcaaaacctggcggcagcgcaaaagatg

SEQ ID NO: 13667 - DNA, 103 bp, Artificial Sequence
  Synthetic Polynucleotide
taatacgactcactatagggtaatgaaggatcattgattgctgcagccctaacagaggagaagggctatggcaatcaataacctggcggcagcgcaaaagatg

SEQ ID NO: 13668 - DNA, 103 bp, Artificial Sequence
  Synthetic Polynucleotide
taatacgactcactatagggattggtaatgaaggatcattgattgctgcaaacagaggagatgcagcatgcaatgatccaacctggcggcagcgcaaaagatg

SEQ ID NO: 13669 - DNA, 103 bp, Artificial Sequence
  Synthetic Polynucleotide
taatacgactcactatagggttctgattggtaatgaaggatcattgattgaacagaggagacaatcaatgatccttcataacctggcggcagcgcaaaagatg

SEQ ID NO: 13670 - DNA, 103 bp, Artificial Sequence
  Synthetic Polynucleotide
taatacgactcactatagggctggtttctgattggtaatgaaggatcattaacagaggagaaatgatatgtcattaccaaacctggcggcagcgcaaaagatg

SEQ ID NO: 13671 - DNA, 103 bp, Artificial Sequence
  Synthetic Polynucleotide
taatacgactcactatagggtgttatgtgttaaatggctgattatattacaacagaggagagtaataatgtcagccattaacctggcggcagcgcaaaagatg

SEQ ID NO: 13672 - DNA, 103 bp, Artificial Sequence
  Synthetic Polynucleotide
taatacgactcactataggggtacactggtttctgattggtaatgaaggaaacagaggagatccttcatgaccaatcagaacctggcggcagcgcaaaagatg

SEQ ID NO: 13673 - DNA, 103 bp, Artificial Sequence
  Synthetic Polynucleotide
taatacgactcactatagggcacgtgtacactggtttctgattggtaatgaacagaggagacattacatgtcagaaaccaacctggcggcagcgcaaaagatg

SEQ ID NO: 13674 - DNA, 103 bp, Artificial Sequence
  Synthetic Polynucleotide
taatacgactcactatagggagggccacgtgtacactggtttctgattggaacagaggagaccaatcatgaaccagtgtaacctggcggcagcgcaaaagatg

SEQ ID NO: 13675 - DNA, 103 bp, Artificial Sequence
  Synthetic Polynucleotide
taatacgactcactatagggagttcagggccacgtgtacactggtttctgaacagaggagacagaaaatggtgtacacgaacctggcggcagcgcaaaagatg

SEQ ID NO: 13676 - DNA, 103 bp, Artificial Sequence
  Synthetic Polynucleotide
taatacgactcactatagggctgatagttcagggccacgtgtacactggtaacagaggagaaccagtatgcacgtggccaacctggcggcagcgcaaaagatg

SEQ ID NO: 13677 - DNA, 103 bp, Artificial Sequence
  Synthetic Polynucleotide
taatacgactcactatagggccatcctgatagttcagggccacgtgtacaaacagaggagatgtacaatgggccctgaaaacctggcggcagcgcaaaagatg

SEQ ID NO: 13678 - DNA, 103 bp, Artificial Sequence
  Synthetic Polynucleotide
taatacgactcactataggggagatccatcctgatagttcagggccacgtaacagaggagaacgtggatgtgaactatcaacctggcggcagcgcaaaagatg

SEQ ID NO: 13679 - DNA, 103 bp, Artificial Sequence
  Synthetic Polynucleotide
taatacgactcactataggggttcggagatccatcctgatagttcagggcaacagaggagagccctgatgtatcaggataacctggcggcagcgcaaaagatg

SEQ ID NO: 13680 - DNA, 103 bp, Artificial Sequence
  Synthetic Polynucleotide
taatacgactcactatagggtaattgttcggagatccatcctgatagttcaacagaggagagaactaatgggatggatcaacctggcggcagcgcaaaagatg

SEQ ID NO: 13681 - DNA, 103 bp, Artificial Sequence
  Synthetic Polynucleotide
taatacgactcactataggggtcattaattgttcggagatccatcctgataacagaggagaatcaggatggatctccgaaacctggcggcagcgcaaaagatg

SEQ ID NO: 13682 - DNA, 103 bp, Artificial Sequence
  Synthetic Polynucleotide
taatacgactcactataggggggcttgttatgtgttaaatggctgattataacagaggagaataatcatgcatttaacaaacctggcggcagcgcaaaagatg

SEQ ID NO: 13683 - DNA, 103 bp, Artificial Sequence
  Synthetic Polynucleotide
taatacgactcactatagggtgcctgtcattaattgttcggagatccatcaacagaggagagatggaatgccgaacaataacctggcggcagcgcaaaagatg

SEQ ID NO: 13684 - DNA, 103 bp, Artificial Sequence
  Synthetic Polynucleotide
taatacgactcactatagggaattttgcctgtcattaattgttcggagataacagaggagaatctccatgcaattaatgaacctggcggcagcgcaaaagatg

SEQ ID NO: 13685 - DNA, 103 bp, Artificial Sequence
  Synthetic Polynucleotide
taatacgactcactatagggaccggaattttgcctgtcattaattgttcgaacagaggagacgaacaatgaatgacaggaacctggcggcagcgcaaaagatg

SEQ ID NO: 13686 - DNA, 103 bp, Artificial Sequence
  Synthetic Polynucleotide
taatacgactcactatagggcatgtaccggaattttgcctgtcattaattaacagaggagaaattaaatgcaggcaaaaaacctggcggcagcgcaaaagatg

SEQ ID NO: 13687 - DNA, 103 bp, Artificial Sequence
  Synthetic Polynucleotide
taatacgactcactataggggatttcatgtaccggaattttgcctgtcataacagaggagaatgacaatgaaaattccgaacctggcggcagcgcaaaagatg

SEQ ID NO: 13688 - DNA, 103 bp, Artificial Sequence
  Synthetic Polynucleotide
taatacgactcactatagggttgaagatttcatgtaccggaattttgcctaacagaggagaaggcaaatgtccggtacaaacctggcggcagcgcaaaagatg

SEQ ID NO: 13689 - DNA, 103 bp, Artificial Sequence
  Synthetic Polynucleotide
taatacgactcactatagggtgtcgttgaagatttcatgtaccggaatttaacagaggagaaaattcatgtacatgaaaaacctggcggcagcgcaaaagatg

SEQ ID NO: 13690 - DNA, 103 bp, Artificial Sequence
  Synthetic Polynucleotide
taatacgactcactatagggctcagtgtcgttgaagatttcatgtaccggaacagaggagaccggtaatggaaatcttcaacctggcggcagcgcaaaagatg

SEQ ID NO: 13691 - DNA, 103 bp, Artificial Sequence
  Synthetic Polynucleotide
taatacgactcactatagggtggggctcagtgtcgttgaagatttcatgtaacagaggagaacatgaatgcttcaacgaaacctggcggcagcgcaaaagatg

SEQ ID NO: 13692 - DNA, 103 bp, Artificial Sequence
  Synthetic Polynucleotide
taatacgactcactatagggttatgtggggctcagtgtcgttgaagatttaacagaggagaaaatctatgacgacactgaacctggcggcagcgcaaaagatg

SEQ ID NO: 13693 - DNA, 103 bp, Artificial Sequence
  Synthetic Polynucleotide
taatacgactcactatagggcagtagggcttgttatgtgttaaatggctgaacagaggagacagccaatgaacacataaaacctggcggcagcgcaaaagatg

SEQ ID NO: 13694 - DNA, 103 bp, Artificial Sequence
  Synthetic Polynucleotide
taatacgactcactatagggtgagcttatgtggggctcagtgtcgttgaaaacagaggagattcaacatgactgagcccaacctggcggcagcgcaaaagatg

SEQ ID NO: 13695 - DNA, 103 bp, Artificial Sequence
  Synthetic Polynucleotide
taatacgactcactataggggaccctgagcttatgtggggctcagtgtcgaacagaggagacgacacatggccccacataacctggcggcagcgcaaaagatg

SEQ ID NO: 13696 - DNA, 103 bp, Artificial Sequence
  Synthetic Polynucleotide
taatacgactcactatagggagtcggaccctgagcttatgtggggctcagaacagaggagactgagcatgacataagctaacctggcggcagcgcaaaagatg

SEQ ID NO: 13697 - DNA, 103 bp, Artificial Sequence
  Synthetic Polynucleotide
taatacgactcactatagggaaggcagtcggaccctgagcttatgtggggaacagaggagaccccacatgagctcagggaacctggcggcagcgcaaaagatg

SEQ ID NO: 13698 - DNA, 103 bp, Artificial Sequence
  Synthetic Polynucleotide
taatacgactcactatagggctgggaaggcagtcggaccctgagcttatgaacagaggagacataagatgagggtccgaaacctggcggcagcgcaaaagatg

SEQ ID NO: 13699 - DNA, 103 bp, Artificial Sequence
  Synthetic Polynucleotide
taatacgactcactatagggtgggtctgggaaggcagtcggaccctgagcaacagaggagagctcagatgccgactgccaacctggcggcagcgcaaaagatg

SEQ ID NO: 13700 - DNA, 103 bp, Artificial Sequence
  Synthetic Polynucleotide
taatacgactcactataggggtttttgggtctgggaaggcagtcggacccaacagaggagagggtccatgtgccttcccaacctggcggcagcgcaaaagatg

SEQ ID NO: 13701 - DNA, 103 bp, Artificial Sequence
  Synthetic Polynucleotide
taatacgactcactataggggccgtgtttttgggtctgggaaggcagtcgaacagaggagacgactgatgtcccagaccaacctggcggcagcgcaaaagatg

SEQ ID NO: 13702 - DNA, 103 bp, Artificial Sequence
  Synthetic Polynucleotide
taatacgactcactatagggggggggccgtgtttttgggtctgggaaggcaacagaggagagccttcatggacccaaaaaacctggcggcagcgcaaaagatg

SEQ ID NO: 13703 - DNA, 103 bp, Artificial Sequence
  Synthetic Polynucleotide
taatacgactcactatagggagtccggggggccgtgtttttgggtctgggaacagaggagacccagaatgaaaaacacgaacctggcggcagcgcaaaagatg

SEQ ID NO: 13704 - DNA, 103 bp, Artificial Sequence
  Synthetic Polynucleotide
taatacgactcactataggggaaaacagtagggcttgttatgtgttaaataacagaggagaatttaaatgataacaagcaacctggcggcagcgcaaaagatg

SEQ ID NO: 13705 - DNA, 103 bp, Artificial Sequence
  Synthetic Polynucleotide
taatacgactcactatagggttgcgagtccggggggccgtgtttttgggtaacagaggagaacccaaatgcacggccccaacctggcggcagcgcaaaagatg

SEQ ID NO: 13706 - DNA, 103 bp, Artificial Sequence
  Synthetic Polynucleotide
taatacgactcactataggggggtgttgcgagtccggggggccgtgttttaacagaggagaaaaacaatgccccccggaaacctggcggcagcgcaaaagatg

SEQ ID NO: 13707 - DNA, 103 bp, Artificial Sequence
  Synthetic Polynucleotide
taatacgactcactatagggtgtctgggtgttgcgagtccggggggccgtaacagaggagaacggccatgcggactcgcaacctggcggcagcgcaaaagatg

SEQ ID NO: 13708 - DNA, 103 bp, Artificial Sequence
  Synthetic Polynucleotide
taatacgactcactataggggtctgtgtctgggtgttgcgagtccgggggaacagaggagacccccgatgtcgcaacacaacctggcggcagcgcaaaagatg

SEQ ID NO: 13709 - DNA, 103 bp, Artificial Sequence
  Synthetic Polynucleotide
taatacgactcactataggggatcggtctgtgtctgggtgttgcgagtccaacagaggagaggactcatgacacccagaaacctggcggcagcgcaaaagatg

SEQ ID NO: 13710 - DNA, 103 bp, Artificial Sequence
  Synthetic Polynucleotide
taatacgactcactatagggaaccggatcggtctgtgtctgggtgttgcgaacagaggagacgcaacatgcagacacagaacctggcggcagcgcaaaagatg

SEQ ID NO: 13711 - DNA, 103 bp, Artificial Sequence
  Synthetic Polynucleotide
taatacgactcactatagggttgcaaaccggatcggtctgtgtctgggtgaacagaggagacacccaatgacagaccgaaacctggcggcagcgcaaaagatg

SEQ ID NO: 13712 - DNA, 103 bp, Artificial Sequence
  Synthetic Polynucleotide
taatacgactcactatagggtgtgattgcaaaccggatcggtctgtgtctaacagaggagaagacacatgccgatccggaacctggcggcagcgcaaaagatg

SEQ ID NO: 13713 - DNA, 103 bp, Artificial Sequence
  Synthetic Polynucleotide
taatacgactcactatagggaaaattgtgattgcaaaccggatcggtctgaacagaggagacagaccatgccggtttgcaacctggcggcagcgcaaaagatg

SEQ ID NO: 13714 - DNA, 103 bp, Artificial Sequence
  Synthetic Polynucleotide
taatacgactcactatagggtcttcaaaattgtgattgcaaaccggatcgaacagaggagacgatccatgttgcaatcaaacctggcggcagcgcaaaagatg

SEQ ID NO: 13715 - DNA, 103 bp, Artificial Sequence
  Synthetic Polynucleotide
taatacgactcactatagggaacaagaaaacagtagggcttgttatgtgtaacagaggagaacacatatgaagccctacaacctggcggcagcgcaaaagatg

SEQ ID NO: 13716 - DNA, 103 bp, Artificial Sequence
  Synthetic Polynucleotide
taatacgactcactatagggtaacgtcttcaaaattgtgattgcaaaccgaacagaggagacggtttatgatcacaattaacctggcggcagcgcaaaagatg

SEQ ID NO: 13717 - DNA, 103 bp, Artificial Sequence
  Synthetic Polynucleotide
taatacgactcactatagggttgtgtaacgtcttcaaaattgtgattgcaaacagaggagatgcaatatgaattttgaaaacctggcggcagcgcaaaagatg

SEQ ID NO: 13718 - DNA, 103 bp, Artificial Sequence
  Synthetic Polynucleotide
taatacgactcactatagggagtgcttgtgtaacgtcttcaaaattgtgaaacagaggagatcacaaatgtgaagacgtaacctggcggcagcgcaaaagatg

SEQ ID NO: 13719 - DNA, 103 bp, Artificial Sequence
  Synthetic Polynucleotide
taatacgactcactatagggatgttagtgcttgtgtaacgtcttcaaaataacagaggagaattttgatgacgttacacaacctggcggcagcgcaaaagatg

SEQ ID NO: 13720 - DNA, 103 bp, Artificial Sequence
  Synthetic Polynucleotide
taatacgactcactatagggtaatgatgttagtgcttgtgtaacgtcttcaacagaggagagaagacatgacacaagcaaacctggcggcagcgcaaaagatg

SEQ ID NO: 13721 - DNA, 103 bp, Artificial Sequence
  Synthetic Polynucleotide
taatacgactcactatagggttggttaatgatgttagtgcttgtgtaacgaacagaggagacgttacatgagcactaacaacctggcggcagcgcaaaagatg

SEQ ID NO: 13722 - DNA, 103 bp, Artificial Sequence
  Synthetic Polynucleotide
taatacgactcactatagggtgacattggttaatgatgttagtgcttgtgaacagaggagacacaagatgtaacatcataacctggcggcagcgcaaaagatg

SEQ ID NO: 13723 - DNA, 103 bp, Artificial Sequence
  Synthetic Polynucleotide
taatacgactcactatagggttgtatgacattggttaatgatgttagtgcaacagaggagagcactaatgtcattaaccaacctggcggcagcgcaaaagatg

SEQ ID NO: 13724 - DNA, 103 bp, Artificial Sequence
  Synthetic Polynucleotide
taatacgactcactatagggtgtttttgtatgacattggttaatgatgttaacagaggagaaacatcatgaaccaatgtaacctggcggcagcgcaaaagatg

SEQ ID NO: 13725 - DNA, 103 bp, Artificial Sequence
  Synthetic Polynucleotide
taatacgactcactataggggagcctgtttttgtatgacattggttaatgaacagaggagacattaaatgatgtcatacaacctggcggcagcgcaaaagatg

SEQ ID NO: 13726 - DNA, 103 bp, Artificial Sequence
  Synthetic Polynucleotide
taatacgactcactatagggggcaaaacaagaaaacagtagggcttgttaaacagaggagataacaaatgctactgtttaacctggcggcagcgcaaaagatg

SEQ ID NO: 13727 - DNA, 103 bp, Artificial Sequence
  Synthetic Polynucleotide
taatacgactcactataggggttaagagcctgtttttgtatgacattggtaacagaggagaaccaatatgatacaaaaaaacctggcggcagcgcaaaagatg

SEQ ID NO: 13728 - DNA, 103 bp, Artificial Sequence
  Synthetic Polynucleotide
taatacgactcactatagggtctaagttaagagcctgtttttgtatgacaaacagaggagatgtcatatgaaaacaggcaacctggcggcagcgcaaaagatg

SEQ ID NO: 13729 - DNA, 103 bp, Artificial Sequence
  Synthetic Polynucleotide
taatacgactcactataggggagactctaagttaagagcctgtttttgtaaacagaggagatacaaaatgaggctcttaaacctggcggcagcgcaaaagatg

SEQ ID NO: 13730 - DNA, 103 bp, Artificial Sequence
  Synthetic Polynucleotide
taatacgactcactatagggttcgagagactctaagttaagagcctgtttaacagaggagaaaacagatgcttaacttaaacctggcggcagcgcaaaagatg

SEQ ID NO: 13731 - DNA, 103 bp, Artificial Sequence
  Synthetic Polynucleotide
taatacgactcactatagggcgttgttcgagagactctaagttaagagccaacagaggagaggctctatgcttagagtcaacctggcggcagcgcaaaagatg

SEQ ID NO: 13732 - DNA, 103 bp, Artificial Sequence
  Synthetic Polynucleotide
taatacgactcactatagggtgatgcgttgttcgagagactctaagttaaaacagaggagattaactatgagtctctcgaacctggcggcagcgcaaaagatg

SEQ ID NO: 13733 - DNA, 103 bp, Artificial Sequence
  Synthetic Polynucleotide
taatacgactcactatagggatctatgatgcgttgttcgagagactctaaaacagaggagattagagatgctcgaacaaaacctggcggcagcgcaaaagatg

SEQ ID NO: 13734 - DNA, 103 bp, Artificial Sequence
  Synthetic Polynucleotide
taatacgactcactatagggtctagatctatgatgcgttgttcgagagacaacagaggagagtctctatgacaacgcataacctggcggcagcgcaaaagatg

SEQ ID NO: 13735 - DNA, 103 bp, Artificial Sequence
  Synthetic Polynucleotide
taatacgactcactatagggcattctctagatctatgatgcgttgttcgaaacagaggagatcgaacatggcatcatagaacctggcggcagcgcaaaagatg

SEQ ID NO: 13736 - DNA, 103 bp, Artificial Sequence
  Synthetic Polynucleotide
taatacgactcactatagggtaagccattctctagatctatgatgcgttgaacagaggagacaacgcatgatagatctaaacctggcggcagcgcaaaagatg

SEQ ID NO: 13737 - DNA, 103 bp, Artificial Sequence
  Synthetic Polynucleotide
taatacgactcactatagggtgcacggcaaaacaagaaaacagtagggctaacagaggagaagccctatggttttcttgaacctggcggcagcgcaaaagatg

SEQ ID NO: 13738 - DNA, 103 bp, Artificial Sequence
  Synthetic Polynucleotide
taatacgactcactatagggggctttaagccattctctagatctatgatgaacagaggagacatcatatgtctagagaaaacctggcggcagcgcaaaagatg

SEQ ID NO: 13739 - DNA, 103 bp, Artificial Sequence
  Synthetic Polynucleotide
taatacgactcactatagggacattggctttaagccattctctagatctaaacagaggagatagatcatgagaatggctaacctggcggcagcgcaaaagatg

SEQ ID NO: 13740 - DNA, 103 bp, Artificial Sequence
  Synthetic Polynucleotide
taatacgactcactataggggtcatacattggctttaagccattctctagaacagaggagactagagatgggcttaaagaacctggcggcagcgcaaaagatg

SEQ ID NO: 13741 - DNA, 103 bp, Artificial Sequence
  Synthetic Polynucleotide
taatacgactcactataggggccatgtcatacattggctttaagccattcaacagaggagagaatggatgaaagccaataacctggcggcagcgcaaaagatg

SEQ ID NO: 13742 - DNA, 103 bp, Artificial Sequence
  Synthetic Polynucleotide
taatacgactcactatagggctttagccatgtcatacattggctttaagcaacagaggagagcttaaatgcaatgtatgaacctggcggcagcgcaaaagatg

SEQ ID NO: 13743 - DNA, 103 bp, Artificial Sequence
  Synthetic Polynucleotide
taatacgactcactatagggaatgactttagccatgtcatacattggcttaacagaggagaaagccaatgtatgacatgaacctggcggcagcgcaaaagatg

SEQ ID NO: 13744 - DNA, 103 bp, Artificial Sequence
  Synthetic Polynucleotide
taatacgactcactataggggcagaaatgactttagccatgtcatacattaacagaggagaaatgtaatgcatggctaaaacctggcggcagcgcaaaagatg

SEQ ID NO: 13745 - DNA, 103 bp, Artificial Sequence
  Synthetic Polynucleotide
taatacgactcactatagggtcaatgcagaaatgactttagccatgtcataacagaggagaatgacaatgctaaagtcaaacctggcggcagcgcaaaagatg

SEQ ID NO: 13746 - DNA, 103 bp, Artificial Sequence
  Synthetic Polynucleotide
taatacgactcactatagggtctattcaatgcagaaatgactttagccataacagaggagaatggctatggtcatttctaacctggcggcagcgcaaaagatg

SEQ ID NO: 13747 - DNA, 103 bp, Artificial Sequence
  Synthetic Polynucleotide
taatacgactcactatagggcaagatctattcaatgcagaaatgactttaaacagaggagataaagtatgttctgcattaacctggcggcagcgcaaaagatg

SEQ ID NO: 13748 - DNA, 103 bp, Artificial Sequence
  Synthetic Polynucleotide
taatacgactcactatagggtcctcatagttattcgcacacaataaagataacagaggagaatctttatggtgtgcgaaaacctggcggcagcgcaaaagatg

SEQ ID NO: 13749 - DNA, 103 bp, Artificial Sequence
  Synthetic Polynucleotide
taatacgactcactatagggctaaatgcacggcaaaacaagaaaacagtaaacagaggagatactgtatgcttgttttgaacctggcggcagcgcaaaagatg

SEQ ID NO: 13750 - DNA, 103 bp, Artificial Sequence
  Synthetic Polynucleotide
taatacgactcactatagggcagcacaagatctattcaatgcagaaatgaaacagaggagatcatttatgcattgaataaacctggcggcagcgcaaaagatg

SEQ ID NO: 13751 - DNA, 103 bp, Artificial Sequence
  Synthetic Polynucleotide
taatacgactcactatagggcatctcagcacaagatctattcaatgcagaaacagaggagatctgcaatgaatagatctaacctggcggcagcgcaaaagatg

SEQ ID NO: 13752 - DNA, 103 bp, Artificial Sequence
  Synthetic Polynucleotide
taatacgactcactataggggctaccatctcagcacaagatctattcaataacagaggagaattgaaatgatcttgtgcaacctggcggcagcgcaaaagatg

SEQ ID NO: 13753 - DNA, 103 bp, Artificial Sequence
  Synthetic Polynucleotide
taatacgactcactatagggattttgctaccatctcagcacaagatctataacagaggagaatagatatggtgctgagaaacctggcggcagcgcaaaagatg

SEQ ID NO: 13754 - DNA, 103 bp, Artificial Sequence
  Synthetic Polynucleotide
taatacgactcactatagggatcatattttgctaccatctcagcacaagaaacagaggagatcttgtatggagatggtaaacctggcggcagcgcaaaagatg

SEQ ID NO: 13755 - DNA, 103 bp, Artificial Sequence
  Synthetic Polynucleotide
taatacgactcactatagggaggagatcatattttgctaccatctcagcaaacagaggagatgctgaatgggtagcaaaaacctggcggcagcgcaaaagatg

SEQ ID NO: 13756 - DNA, 103 bp, Artificial Sequence
  Synthetic Polynucleotide
taatacgactcactatagggtcaccaggagatcatattttgctaccatctaacagaggagaagatggatgcaaaatatgaacctggcggcagcgcaaaagatg

SEQ ID NO: 13757 - DNA, 103 bp, Artificial Sequence
  Synthetic Polynucleotide
taatacgactcactatagggtgtcatcaccaggagatcatattttgctacaacagaggagagtagcaatgtatgatctcaacctggcggcagcgcaaaagatg

SEQ ID NO: 13758 - DNA, 103 bp, Artificial Sequence
  Synthetic Polynucleotide
taatacgactcactatagggccagttgtcatcaccaggagatcatattttaacagaggagaaaaataatgtctcctggtaacctggcggcagcgcaaaagatg

SEQ ID NO: 13759 - DNA, 103 bp, Artificial Sequence
  Synthetic Polynucleotide
taatacgactcactatagggcgcggccagttgtcatcaccaggagatcataacagaggagaatgatcatgtggtgatgaaacctggcggcagcgcaaaagatg

SEQ ID NO: 13760 - DNA, 103 bp, Artificial Sequence
  Synthetic Polynucleotide
taatacgactcactatagggttattctaaatgcacggcaaaacaagaaaaaacagaggagattttctatgtttgccgtgaacctggcggcagcgcaaaagatg

SEQ ID NO: 13761 - DNA, 103 bp, Artificial Sequence
  Synthetic Polynucleotide
taatacgactcactatagggggttgcgcggccagttgtcatcaccaggagaacagaggagactcctgatgatgacaactaacctggcggcagcgcaaaagatg

SEQ ID NO: 13762 - DNA, 103 bp, Artificial Sequence
  Synthetic Polynucleotide
taatacgactcactataggggtggcggttgcgcggccagttgtcatcaccaacagaggagaggtgatatgaactggccgaacctggcggcagcgcaaaagatg

SEQ ID NO: 13763 - DNA, 103 bp, Artificial Sequence
  Synthetic Polynucleotide
taatacgactcactatagggcggcggtggcggttgcgcggccagttgtcaaacagaggagatgacaaatggccgcgcaaaacctggcggcagcgcaaaagatg

SEQ ID NO: 13764 - DNA, 103 bp, Artificial Sequence
  Synthetic Polynucleotide
taatacgactcactatagggtgcagcggcggtggcggttgcgcggccagtaacagaggagaactggcatggcaaccgccaacctggcggcagcgcaaaagatg

SEQ ID NO: 13765 - DNA, 103 bp, Artificial Sequence
  Synthetic Polynucleotide
taatacgactcactatagggtcagttgcagcggcggtggcggttgcgcggaacagaggagaccgcgcatgcgccaccgcaacctggcggcagcgcaaaagatg

SEQ ID NO: 13766 - DNA, 103 bp, Artificial Sequence
  Synthetic Polynucleotide
taatacgactcactatagggaagcctcagttgcagcggcggtggcggttgaacagaggagacaaccgatgccgccgctgaacctggcggcagcgcaaaagatg

SEQ ID NO: 13767 - DNA, 103 bp, Artificial Sequence
  Synthetic Polynucleotide
taatacgactcactatagggccaataagcctcagttgcagcggcggtggcaacagaggagagccaccatggctgcaactaacctggcggcagcgcaaaagatg

SEQ ID NO: 13768 - DNA, 103 bp, Artificial Sequence
  Synthetic Polynucleotide
taatacgactcactatagggtcctcccaataagcctcagttgcagcggcgaacagaggagacgccgcatgaactgaggcaacctggcggcagcgcaaaagatg

SEQ ID NO: 13769 - DNA, 103 bp, Artificial Sequence
  Synthetic Polynucleotide
taatacgactcactatagggcatgttcctcccaataagcctcagttgcagaacagaggagactgcaaatgaggcttattaacctggcggcagcgcaaaagatg

SEQ ID NO: 13770 - DNA, 103 bp, Artificial Sequence
  Synthetic Polynucleotide
taatacgactcactatagggttgtccatgttcctcccaataagcctcagtaacagaggagaactgagatgtattgggagaacctggcggcagcgcaaaagatg

SEQ ID NO: 13771 - DNA, 103 bp, Artificial Sequence
  Synthetic Polynucleotide
taatacgactcactataggggtctcttattctaaatgcacggcaaaacaaaacagaggagattgtttatgcgtgcatttaacctggcggcagcgcaaaagatg

SEQ ID NO: 13772 - DNA, 103 bp, Artificial Sequence
  Synthetic Polynucleotide
taatacgactcactatagggggtggttgtccatgttcctcccaataagccaacagaggagaggcttaatgggaggaacaaacctggcggcagcgcaaaagatg

SEQ ID NO: 13773 - DNA, 103 bp, Artificial Sequence
  Synthetic Polynucleotide
taatacgactcactatagggcaggtggtggttgtccatgttcctcccaataacagaggagaattgggatgaacatggacaacctggcggcagcgcaaaagatg

SEQ ID NO: 13774 - DNA, 103 bp, Artificial Sequence
  Synthetic Polynucleotide
taatacgactcactatagggtggtccaggtggtggttgtccatgttcctcaacagaggagagaggaaatgggacaaccaaacctggcggcagcgcaaaagatg

SEQ ID NO: 13775 - DNA, 103 bp, Artificial Sequence
  Synthetic Polynucleotide
taatacgactcactatagggagtgatggtccaggtggtggttgtccatgtaacagaggagaacatggatgaccaccaccaacctggcggcagcgcaaaagatg

SEQ ID NO: 13776 - DNA, 103 bp, Artificial Sequence
  Synthetic Polynucleotide
taatacgactcactatagggcataaagtgatggtccaggtggtggttgtcaacagaggagagacaacatgcacctggacaacctggcggcagcgcaaaagatg

SEQ ID NO: 13777 - DNA, 103 bp, Artificial Sequence
  Synthetic Polynucleotide
taatacgactcactatagggctcttcataaagtgatggtccaggtggtggaacagaggagaccaccaatgggaccatcaaacctggcggcagcgcaaaagatg

SEQ ID NO: 13778 - DNA, 103 bp, Artificial Sequence
  Synthetic Polynucleotide
taatacgactcactataggggcactctcttcataaagtgatggtccaggtaacagaggagaacctggatgatcactttaaacctggcggcagcgcaaaagatg

SEQ ID NO: 13779 - DNA, 103 bp, Artificial Sequence
  Synthetic Polynucleotide
taatacgactcactatagggtaatcgcactctcttcataaagtgatggtcaacagaggagagaccatatgtttatgaagaacctggcggcagcgcaaaagatg

SEQ ID NO: 13780 - DNA, 103 bp, Artificial Sequence
  Synthetic Polynucleotide
taatacgactcactataggggcctctaatcgcactctcttcataaagtgaaacagaggagatcacttatggaagagagtaacctggcggcagcgcaaaagatg

SEQ ID NO: 13781 - DNA, 103 bp, Artificial Sequence
  Synthetic Polynucleotide
taatacgactcactatagggatcttgcctctaatcgcactctcttcataaaacagaggagattatgaatggagtgcgataacctggcggcagcgcaaaagatg

SEQ ID NO: 13782 - DNA, 103 bp, Artificial Sequence
  Synthetic Polynucleotide
taatacgactcactatagggaagttgtctcttattctaaatgcacggcaaaacagaggagattgccgatgatttagaataacctggcggcagcgcaaaagatg

SEQ ID NO: 13783 - DNA, 103 bp, Artificial Sequence
  Synthetic Polynucleotide
taatacgactcactatagggtgttaatcttgcctctaatcgcactctcttaacagaggagaaagagaatgcgattagagaacctggcggcagcgcaaaagatg

SEQ ID NO: 13784 - DNA, 103 bp, Artificial Sequence
  Synthetic Polynucleotide
taatacgactcactatagggttgcttgttaatcttgcctctaatcgcactaacagaggagaagtgcgatgagaggcaagaacctggcggcagcgcaaaagatg

SEQ ID NO: 13785 - DNA, 103 bp, Artificial Sequence
  Synthetic Polynucleotide
taatacgactcactatagggtcctcttgcttgttaatcttgcctctaatcaacagaggagagattagatgcaagattaaaacctggcggcagcgcaaaagatg

SEQ ID NO: 13786 - DNA, 103 bp, Artificial Sequence
  Synthetic Polynucleotide
taatacgactcactatagggctttatcctcttgcttgttaatcttgcctcaacagaggagagaggcaatgttaacaagcaacctggcggcagcgcaaaagatg

SEQ ID NO: 13787 - DNA, 103 bp, Artificial Sequence
  Synthetic Polynucleotide
taatacgactcactatagggaggtactttatcctcttgcttgttaatcttaacagaggagaaagattatgaagcaagagaacctggcggcagcgcaaaagatg

SEQ ID NO: 13788 - DNA, 103 bp, Artificial Sequence
  Synthetic Polynucleotide
taatacgactcactatagggtccttaggtactttatcctcttgcttgttaaacagaggagataacaaatgagaggataaaacctggcggcagcgcaaaagatg

SEQ ID NO: 13789 - DNA, 103 bp, Artificial Sequence
  Synthetic Polynucleotide
taatacgactcactataggggaacttccttaggtactttatcctcttgctaacagaggagaagcaagatgataaagtacaacctggcggcagcgcaaaagatg

SEQ ID NO: 13790 - DNA, 103 bp, Artificial Sequence
  Synthetic Polynucleotide
taatacgactcactatagggttcttgaacttccttaggtactttatcctcaacagaggagagaggatatggtacctaagaacctggcggcagcgcaaaagatg

SEQ ID NO: 13791 - DNA, 103 bp, Artificial Sequence
  Synthetic Polynucleotide
taatacgactcactatagggaaagcttcttgaacttccttaggtactttaaacagaggagataaagtatgtaaggaagtaacctggcggcagcgcaaaagatg

SEQ ID NO: 13792 - DNA, 103 bp, Artificial Sequence
  Synthetic Polynucleotide
taatacgactcactatagggtacgaaaagcttcttgaacttccttaggtaaacagaggagatacctaatgaagttcaagaacctggcggcagcgcaaaagatg

SEQ ID NO: 13793 - DNA, 103 bp, Artificial Sequence
  Synthetic Polynucleotide
taatacgactcactatagggggtttaagttgtctcttattctaaatgcacaacagaggagagtgcatatggaataagagaacctggcggcagcgcaaaagatg

SEQ ID NO: 13794 - DNA, 103 bp, Artificial Sequence
  Synthetic Polynucleotide
taatacgactcactatagggcagattacgaaaagcttcttgaacttccttaacagaggagaaaggaaatgcaagaagctaacctggcggcagcgcaaaagatg

SEQ ID NO: 13795 - DNA, 103 bp, Artificial Sequence
  Synthetic Polynucleotide
taatacgactcactatagggctgtccagattacgaaaagcttcttgaactaacagaggagaagttcaatgagcttttcgaacctggcggcagcgcaaaagatg

SEQ ID NO: 13796 - DNA, 103 bp, Artificial Sequence
  Synthetic Polynucleotide
taatacgactcactatagggtggtactgtccagattacgaaaagcttcttaacagaggagaaagaagatgttcgtaatcaacctggcggcagcgcaaaagatg

SEQ ID NO: 13797 - DNA, 103 bp, Artificial Sequence
  Synthetic Polynucleotide
taatacgactcactatagggtgagctggtactgtccagattacgaaaagcaacagaggagagcttttatgaatctggacaacctggcggcagcgcaaaagatg

SEQ ID NO: 13798 - DNA, 103 bp, Artificial Sequence
  Synthetic Polynucleotide
taatacgactcactataggggttagtgagctggtactgtccagattacgaaacagaggagatcgtaaatgggacagtacaacctggcggcagcgcaaaagatg

SEQ ID NO: 13799 - DNA, 103 bp, Artificial Sequence
  Synthetic Polynucleotide
taatacgactcactatagggcttctgttagtgagctggtactgtccagataacagaggagaatctggatggtaccagctaacctggcggcagcgcaaaagatg

SEQ ID NO: 13800 - DNA, 103 bp, Artificial Sequence
  Synthetic Polynucleotide
taatacgactcactataggggttctcttctgttagtgagctggtactgtcaacagaggagagacagtatgagctcactaaacctggcggcagcgcaaaagatg

SEQ ID NO: 13801 - DNA, 103 bp, Artificial Sequence
  Synthetic Polynucleotide
taatacgactcactatagggccaaagttctcttctgttagtgagctggtaaacagaggagataccagatgactaacagaaacctggcggcagcgcaaaagatg

SEQ ID NO: 13802 - DNA, 103 bp, Artificial Sequence
  Synthetic Polynucleotide
taatacgactcactataggggcttgccaaagttctcttctgttagtgagcaacagaggagagctcacatgcagaagagaaacctggcggcagcgcaaaagatg

SEQ ID NO: 13803 - DNA, 103 bp, Artificial Sequence
  Synthetic Polynucleotide
taatacgactcactatagggatctggcttgccaaagttctcttctgttagaacagaggagactaacaatggagaactttaacctggcggcagcgcaaaagatg

SEQ ID NO: 13804 - DNA, 103 bp, Artificial Sequence
  Synthetic Polynucleotide
taatacgactcactatagggtcggaggtttaagttgtctcttattctaaaaacagaggagatttagaatgagagacaacaacctggcggcagcgcaaaagatg

SEQ ID NO: 13805 - DNA, 103 bp, Artificial Sequence
  Synthetic Polynucleotide
taatacgactcactataggggatatatctggcttgccaaagttctcttctaacagaggagaagaagaatgctttggcaaaacctggcggcagcgcaaaagatg

SEQ ID NO: 13806 - DNA, 103 bp, Artificial Sequence
  Synthetic Polynucleotide
taatacgactcactatagggttgcagatatatctggcttgccaaagttctaacagaggagaagaactatggcaagccagaacctggcggcagcgcaaaagatg

SEQ ID NO: 13807 - DNA, 103 bp, Artificial Sequence
  Synthetic Polynucleotide
taatacgactcactataggggtcctttgcagatatatctggcttgccaaaaacagaggagatttggcatgccagatataaacctggcggcagcgcaaaagatg

SEQ ID NO: 13808 - DNA, 103 bp, Artificial Sequence
  Synthetic Polynucleotide
taatacgactcactatagggcgtaggtcctttgcagatatatctggcttgaacagaggagacaagccatgtatatctgcaacctggcggcagcgcaaaagatg

SEQ ID NO: 13809 - DNA, 103 bp, Artificial Sequence
  Synthetic Polynucleotide
taatacgactcactatagggtgtctcgtaggtcctttgcagatatatctgaacagaggagacagataatgctgcaaaggaacctggcggcagcgcaaaagatg

SEQ ID NO: 13810 - DNA, 103 bp, Artificial Sequence
  Synthetic Polynucleotide
taatacgactcactatagggcatgatgtctcgtaggtcctttgcagatataacagaggagaatatctatgaaggacctaaacctggcggcagcgcaaaagatg

SEQ ID NO: 13811 - DNA, 103 bp, Artificial Sequence
  Synthetic Polynucleotide
taatacgactcactatagggtcatacatgatgtctcgtaggtcctttgcaaacagaggagatgcaaaatgcctacgagaaacctggcggcagcgcaaaagatg

SEQ ID NO: 13812 - DNA, 103 bp, Artificial Sequence
  Synthetic Polynucleotide
taatacgactcactatagggggtggtcatacatgatgtctcgtaggtcctaacagaggagaaggaccatggagacatcaaacctggcggcagcgcaaaagatg

SEQ ID NO: 13813 - DNA, 103 bp, Artificial Sequence
  Synthetic Polynucleotide
taatacgactcactatagggtggtaggtggtcatacatgatgtctcgtagaacagaggagactacgaatgatcatgtataacctggcggcagcgcaaaagatg

SEQ ID NO: 13814 - DNA, 103 bp, Artificial Sequence
  Synthetic Polynucleotide
taatacgactcactatagggaagcctggtaggtggtcatacatgatgtctaacagaggagaagacatatggtatgaccaaacctggcggcagcgcaaaagatg

SEQ ID NO: 13815 - DNA, 103 bp, Artificial Sequence
  Synthetic Polynucleotide
taatacgactcactatagggccgaatcggaggtttaagttgtctcttattaacagaggagaaataagatgcaacttaaaaacctggcggcagcgcaaaagatg

SEQ ID NO: 13816 - DNA, 103 bp, Artificial Sequence
  Synthetic Polynucleotide
taatacgactcactatagggtaccgaagcctggtaggtggtcatacatgaaacagaggagatcatgtatgaccacctacaacctggcggcagcgcaaaagatg

SEQ ID NO: 13817 - DNA, 103 bp, Artificial Sequence
  Synthetic Polynucleotide
taatacgactcactatagggagccgtaccgaagcctggtaggtggtcataaacagaggagatatgacatgctaccaggcaacctggcggcagcgcaaaagatg

SEQ ID NO: 13818 - DNA, 103 bp, Artificial Sequence
  Synthetic Polynucleotide
taatacgactcactatagggtgaaaagccgtaccgaagcctggtaggtggaacagaggagaccacctatgaggcttcggaacctggcggcagcgcaaaagatg

SEQ ID NO: 13819 - DNA, 103 bp, Artificial Sequence
  Synthetic Polynucleotide
taatacgactcactataggggttggtgaaaagccgtaccgaagcctggtaaacagaggagataccagatgtcggtacggaacctggcggcagcgcaaaagatg

SEQ ID NO: 13820 - DNA, 103 bp, Artificial Sequence
  Synthetic Polynucleotide
taatacgactcactataggggaccagttggtgaaaagccgtaccgaagccaacagaggagaggcttcatgacggcttttaacctggcggcagcgcaaaagatg

SEQ ID NO: 13821 - DNA, 103 bp, Artificial Sequence
  Synthetic Polynucleotide
taatacgactcactatagggacctggaccagttggtgaaaagccgtaccgaacagaggagacggtacatgttttcaccaaacctggcggcagcgcaaaagatg

SEQ ID NO: 13822 - DNA, 103 bp, Artificial Sequence
  Synthetic Polynucleotide
taatacgactcactatagggaaattacctggaccagttggtgaaaagccgaacagaggagacggcttatgaccaactggaacctggcggcagcgcaaaagatg

SEQ ID NO: 13823 - DNA, 103 bp, Artificial Sequence
  Synthetic Polynucleotide
taatacgactcactatagggcttgcaaattacctggaccagttggtgaaaaacagaggagatttcacatgctggtccagaacctggcggcagcgcaaaagatg

SEQ ID NO: 13824 - DNA, 103 bp, Artificial Sequence
  Synthetic Polynucleotide
taatacgactcactatagggcctagcttgcaaattacctggaccagttggaacagaggagaccaactatgccaggtaataacctggcggcagcgcaaaagatg

SEQ ID NO: 13825 - DNA, 103 bp, Artificial Sequence
  Synthetic Polynucleotide
taatacgactcactatagggcttttcctagcttgcaaattacctggaccaaacagaggagatggtccatgtaatttgcaaacctggcggcagcgcaaaagatg

SEQ ID NO: 13826 - DNA, 103 bp, Artificial Sequence
  Synthetic Polynucleotide
taatacgactcactatagggtgttgccgaatcggaggtttaagttgtctcaacagaggagagagacaatgtaaacctccaacctggcggcagcgcaaaagatg

SEQ ID NO: 13827 - DNA, 103 bp, Artificial Sequence
  Synthetic Polynucleotide
taatacgactcactatagggattgtcttttcctagcttgcaaattacctgaacagaggagacaggtaatgtgcaagctaaacctggcggcagcgcaaaagatg

SEQ ID NO: 13828 - DNA, 103 bp, Artificial Sequence
  Synthetic Polynucleotide
taatacgactcactataggggcagaattgtcttttcctagcttgcaaattaacagaggagaaatttgatggctaggaaaaacctggcggcagcgcaaaagatg

SEQ ID NO: 13829 - DNA, 103 bp, Artificial Sequence
  Synthetic Polynucleotide
taatacgactcactatagggccaatgcagaattgtcttttcctagcttgcaacagaggagagcaagcatggaaaagacaaacctggcggcagcgcaaaagatg

SEQ ID NO: 13830 - DNA, 103 bp, Artificial Sequence
  Synthetic Polynucleotide
taatacgactcactatagggaatgtccaatgcagaattgtcttttcctagaacagaggagactaggaatggacaattctaacctggcggcagcgcaaaagatg

SEQ ID NO: 13831 - DNA, 103 bp, Artificial Sequence
  Synthetic Polynucleotide
taatacgactcactatagggtgaataatgtccaatgcagaattgtcttttaacagaggagaaaaagaatgttctgcattaacctggcggcagcgcaaaagatg

SEQ ID NO: 13832 - DNA, 103 bp, Artificial Sequence
  Synthetic Polynucleotide
taatacgactcactatagggcagcatgaataatgtccaatgcagaattgtaacagaggagaacaattatgcattggacaaacctggcggcagcgcaaaagatg

SEQ ID NO: 13833 - DNA, 103 bp, Artificial Sequence
  Synthetic Polynucleotide
taatacgactcactataggggaactcagcatgaataatgtccaatgcagaaacagaggagatctgcaatggacattattaacctggcggcagcgcaaaagatg

SEQ ID NO: 13834 - DNA, 103 bp, Artificial Sequence
  Synthetic Polynucleotide
taatacgactcactataggggcttggaactcagcatgaataatgtccaataacagaggagaattggaatgtattcatgcaacctggcggcagcgcaaaagatg

SEQ ID NO: 13835 - DNA, 103 bp, Artificial Sequence
  Synthetic Polynucleotide
taatacgactcactatagggggctggcttggaactcagcatgaataatgtaacagaggagaacattaatgatgctgagtaacctggcggcagcgcaaaagatg

SEQ ID NO: 13836 - DNA, 103 bp, Artificial Sequence
  Synthetic Polynucleotide
taatacgactcactatagggagcaaggctggcttggaactcagcatgaataacagaggagaattcatatggagttccaaaacctggcggcagcgcaaaagatg

SEQ ID NO: 13837 - DNA, 103 bp, Artificial Sequence
  Synthetic Polynucleotide
taatacgactcactatagggccctgtgttgccgaatcggaggtttaagttaacagaggagaaacttaatgctccgattcaacctggcggcagcgcaaaagatg

SEQ ID NO: 13838 - DNA, 103 bp, Artificial Sequence
  Synthetic Polynucleotide
taatacgactcactatagggccttcagcaaggctggcttggaactcagcaaacagaggagatgctgaatgccaagccagaacctggcggcagcgcaaaagatg

SEQ ID NO: 13839 - DNA, 103 bp, Artificial Sequence
  Synthetic Polynucleotide
taatacgactcactatagggaatcaccttcagcaaggctggcttggaactaacagaggagaagttccatgccagccttgaacctggcggcagcgcaaaagatg

SEQ ID NO: 13840 - DNA, 103 bp, Artificial Sequence
  Synthetic Polynucleotide
taatacgactcactataggggggagaatcaccttcagcaaggctggcttgaacagaggagacaagccatgcttgctgaaaacctggcggcagcgcaaaagatg

SEQ ID NO: 13841 - DNA, 103 bp, Artificial Sequence
  Synthetic Polynucleotide
taatacgactcactatagggcattggggagaatcaccttcagcaaggctgaacagaggagacagcctatgtgaaggtgaaacctggcggcagcgcaaaagatg

SEQ ID NO: 13842 - DNA, 103 bp, Artificial Sequence
  Synthetic Polynucleotide
taatacgactcactataggggggcacattggggagaatcaccttcagcaaaacagaggagattgctgatggtgattctcaacctggcggcagcgcaaaagatg

SEQ ID NO: 13843 - DNA, 103 bp, Artificial Sequence
  Synthetic Polynucleotide
taatacgactcactataggggatcagggcacattggggagaatcaccttcaacagaggagagaaggtatgtctccccaaaacctggcggcagcgcaaaagatg

SEQ ID NO: 13844 - DNA, 103 bp, Artificial Sequence
  Synthetic Polynucleotide
taatacgactcactatagggatttggatcagggcacattggggagaatcaaacagaggagatgattcatgccaatgtgcaacctggcggcagcgcaaaagatg

SEQ ID NO: 13845 - DNA, 103 bp, Artificial Sequence
  Synthetic Polynucleotide
taatacgactcactatagggttgttatttggatcagggcacattggggagaacagaggagactccccatggtgccctgaaacctggcggcagcgcaaaagatg

SEQ ID NO: 13846 - DNA, 103 bp, Artificial Sequence
  Synthetic Polynucleotide
taatacgactcactatagggccgttttgttatttggatcagggcacattgaacagaggagacaatgtatgctgatccaaaacctggcggcagcgcaaaagatg

SEQ ID NO: 13847 - DNA, 103 bp, Artificial Sequence
  Synthetic Polynucleotide
taatacgactcactataggggggatccgttttgttatttggatcagggcaaacagaggagatgccctatgccaaataacaacctggcggcagcgcaaaagatg

SEQ ID NO: 13848 - DNA, 103 bp, Artificial Sequence
  Synthetic Polynucleotide
taatacgactcactatagggttattccctgtgttgccgaatcggaggtttaacagaggagaaaacctatgattcggcaaaacctggcggcagcgcaaaagatg

SEQ ID NO: 13849 - DNA, 103 bp, Artificial Sequence
  Synthetic Polynucleotide
taatacgactcactatagggagatggggatccgttttgttatttggatcaaacagaggagatgatccatgtaacaaaacaacctggcggcagcgcaaaagatg

SEQ ID NO: 13850 - DNA, 103 bp, Artificial Sequence
  Synthetic Polynucleotide
taatacgactcactatagggctggaagatggggatccgttttgttatttgaacagaggagacaaataatgaaacggatcaacctggcggcagcgcaaaagatg

SEQ ID NO: 13851 - DNA, 103 bp, Artificial Sequence
  Synthetic Polynucleotide
taatacgactcactataggggcatcctggaagatggggatccgttttgttaacagaggagaaacaaaatggatccccataacctggcggcagcgcaaaagatg

SEQ ID NO: 13852 - DNA, 103 bp, Artificial Sequence
  Synthetic Polynucleotide
taatacgactcactataggggagtggcatcctggaagatggggatccgttaacagaggagaaacggaatgccatcttccaacctggcggcagcgcaaaagatg

SEQ ID NO: 13853 - DNA, 103 bp, Artificial Sequence
  Synthetic Polynucleotide
taatacgactcactataggggggcggagtggcatcctggaagatggggataacagaggagaatccccatgttccaggataacctggcggcagcgcaaaagatg

SEQ ID NO: 13854 - DNA, 103 bp, Artificial Sequence
  Synthetic Polynucleotide
taatacgactcactatagggattgtgggcggagtggcatcctggaagatgaacagaggagacatcttatgggatgccacaacctggcggcagcgcaaaagatg

SEQ ID NO: 13855 - DNA, 103 bp, Artificial Sequence
  Synthetic Polynucleotide
taatacgactcactatagggtgtgaattgtgggcggagtggcatcctggaaacagaggagatccaggatgccactccgcaacctggcggcagcgcaaaagatg

SEQ ID NO: 13856 - DNA, 103 bp, Artificial Sequence
  Synthetic Polynucleotide
taatacgactcactataggggcggatgtgaattgtgggcggagtggcatcaacagaggagagatgccatgccgcccacaaacctggcggcagcgcaaaagatg

SEQ ID NO: 13857 - DNA, 103 bp, Artificial Sequence
  Synthetic Polynucleotide
taatacgactcactatagggcgagagcggatgtgaattgtgggcggagtgaacagaggagacactccatgcacaattcaaacctggcggcagcgcaaaagatg

SEQ ID NO: 13858 - DNA, 103 bp, Artificial Sequence
  Synthetic Polynucleotide
taatacgactcactatagggcaccacgagagcggatgtgaattgtgggcgaacagaggagacgcccaatgttcacatccaacctggcggcagcgcaaaagatg

SEQ ID NO: 13859 - DNA, 103 bp, Artificial Sequence
  Synthetic Polynucleotide
taatacgactcactatagggaatcttcctcatagttattcgcacacaataaacagaggagatattgtatgcgaataactaacctggcggcagcgcaaaagatg

SEQ ID NO: 13860 - DNA, 103 bp, Artificial Sequence
  Synthetic Polynucleotide
taatacgactcactatagggtgagattattccctgtgttgccgaatcggaaacagaggagatccgatatggcaacacagaacctggcggcagcgcaaaagatg

SEQ ID NO: 13861 - DNA, 103 bp, Artificial Sequence
  Synthetic Polynucleotide
taatacgactcactataggggatgtcaccacgagagcggatgtgaattgtaacagaggagaacaattatgatccgctctaacctggcggcagcgcaaaagatg

SEQ ID NO: 13862 - DNA, 103 bp, Artificial Sequence
  Synthetic Polynucleotide
taatacgactcactatagggcgtgggatgtcaccacgagagcggatgtgaaacagaggagatcacatatgctctcgtggaacctggcggcagcgcaaaagatg

SEQ ID NO: 13863 - DNA, 103 bp, Artificial Sequence
  Synthetic Polynucleotide
taatacgactcactatagggaggcacgtgggatgtcaccacgagagcggaaacagaggagatccgctatggtggtgacaaacctggcggcagcgcaaaagatg

SEQ ID NO: 13864 - DNA, 103 bp, Artificial Sequence
  Synthetic Polynucleotide
taatacgactcactatagggttggcaggcacgtgggatgtcaccacgagaaacagaggagatctcgtatggacatcccaaacctggcggcagcgcaaaagatg

SEQ ID NO: 13865 - DNA, 103 bp, Artificial Sequence
  Synthetic Polynucleotide
taatacgactcactatagggcttttttggcaggcacgtgggatgtcaccaaacagaggagatggtgaatgcccacgtgcaacctggcggcagcgcaaaagatg

SEQ ID NO: 13866 - DNA, 103 bp, Artificial Sequence
  Synthetic Polynucleotide
taatacgactcactatagggggagacttttttggcaggcacgtgggatgtaacagaggagaacatccatggtgcctgccaacctggcggcagcgcaaaagatg

SEQ ID NO: 13867 - DNA, 103 bp, Artificial Sequence
  Synthetic Polynucleotide
taatacgactcactatagggtggacggagacttttttggcaggcacgtggaacagaggagaccacgtatgtgccaaaaaaacctggcggcagcgcaaaagatg

SEQ ID NO: 13868 - DNA, 103 bp, Artificial Sequence
  Synthetic Polynucleotide
taatacgactcactatagggggaactggacggagacttttttggcaggcaaacagaggagatgcctgatgaaaaagtctaacctggcggcagcgcaaaagatg

SEQ ID NO: 13869 - DNA, 103 bp, Artificial Sequence
  Synthetic Polynucleotide
taatacgactcactatagggatggaggaactggacggagacttttttggcaacagaggagagccaaaatggtctccgtcaacctggcggcagcgcaaaagatg

SEQ ID NO: 13870 - DNA, 103 bp, Artificial Sequence
  Synthetic Polynucleotide
taatacgactcactatagggtggtgatggaggaactggacggagacttttaacagaggagaaaaagtatgcgtccagttaacctggcggcagcgcaaaagatg

SEQ ID NO: 13871 - DNA, 103 bp, Artificial Sequence
  Synthetic Polynucleotide
taatacgactcactatagggtctggtgagattattccctgtgttgccgaaaacagaggagattcggcatgacagggaataacctggcggcagcgcaaaagatg

SEQ ID NO: 13872 - DNA, 103 bp, Artificial Sequence
  Synthetic Polynucleotide
taatacgactcactatagggatttttggtgatggaggaactggacggagaaacagaggagatctccgatgagttcctccaacctggcggcagcgcaaaagatg

SEQ ID NO: 13873 - DNA, 103 bp, Artificial Sequence
  Synthetic Polynucleotide
taatacgactcactatagggtgtctatttttggtgatggaggaactggacaacagaggagagtccagatgctccatcacaacctggcggcagcgcaaaagatg

SEQ ID NO: 13874 - DNA, 103 bp, Artificial Sequence
  Synthetic Polynucleotide
taatacgactcactatagggacctctgtctatttttggtgatggaggaacaacagaggagagttcctatgtcaccaaaaaacctggcggcagcgcaaaagatg

SEQ ID NO: 13875 - DNA, 103 bp, Artificial Sequence
  Synthetic Polynucleotide
taatacgactcactatagggacccaacctctgtctatttttggtgatggaaacagaggagatccatcatgaaaaatagaaacctggcggcagcgcaaaagatg

SEQ ID NO: 13876 - DNA, 103 bp, Artificial Sequence
  Synthetic Polynucleotide
taatacgactcactatagggtgcaaacccaacctctgtctatttttggtgaacagaggagacaccaaatgtagacagagaacctggcggcagcgcaaaagatg

SEQ ID NO: 13877 - DNA, 103 bp, Artificial Sequence
  Synthetic Polynucleotide
taatacgactcactataggggaaaatgcaaacccaacctctgtctattttaacagaggagaaaaataatgagaggttggaacctggcggcagcgcaaaagatg

SEQ ID NO: 13878 - DNA, 103 bp, Artificial Sequence
  Synthetic Polynucleotide
taatacgactcactatagggaattggaaaatgcaaacccaacctctgtctaacagaggagaagacagatgttgggtttgaacctggcggcagcgcaaaagatg

SEQ ID NO: 13879 - DNA, 103 bp, Artificial Sequence
  Synthetic Polynucleotide
taatacgactcactatagggcctgcaattggaaaatgcaaacccaacctcaacagaggagagaggttatgtttgcatttaacctggcggcagcgcaaaagatg

SEQ ID NO: 13880 - DNA, 103 bp, Artificial Sequence
  Synthetic Polynucleotide
taatacgactcactatagggcccgtcctgcaattggaaaatgcaaacccaaacagaggagatgggttatgattttccaaaacctggcggcagcgcaaaagatg

SEQ ID NO: 13881 - DNA, 103 bp, Artificial Sequence
  Synthetic Polynucleotide
taatacgactcactataggggtcttcccgtcctgcaattggaaaatgcaaaacagaggagattgcatatgccaattgcaaacctggcggcagcgcaaaagatg

SEQ ID NO: 13882 - DNA, 103 bp, Artificial Sequence
  Synthetic Polynucleotide
taatacgactcactatagggccgggtctggtgagattattccctgtgttgaacagaggagacaacacatggaataatctaacctggcggcagcgcaaaagatg

SEQ ID NO: 13883 - DNA, 103 bp, Artificial Sequence
  Synthetic Polynucleotide
taatacgactcactatagggcaagtgtcttcccgtcctgcaattggaaaaaacagaggagattttccatgtgcaggacgaacctggcggcagcgcaaaagatg

SEQ ID NO: 13884 - DNA, 103 bp, Artificial Sequence
  Synthetic Polynucleotide
taatacgactcactataggggagcccaagtgtcttcccgtcctgcaattgaacagaggagacaattgatggacgggaagaacctggcggcagcgcaaaagatg

SEQ ID NO: 13885 - DNA, 103 bp, Artificial Sequence
  Synthetic Polynucleotide
taatacgactcactatagggatcttgagcccaagtgtcttcccgtcctgcaacagaggagagcaggaatggaagacactaacctggcggcagcgcaaaagatg

SEQ ID NO: 13886 - DNA, 103 bp, Artificial Sequence
  Synthetic Polynucleotide
taatacgactcactatagggcctatatcttgagcccaagtgtcttcccgtaacagaggagaacgggaatgcacttgggcaacctggcggcagcgcaaaagatg

SEQ ID NO: 13887 - DNA, 103 bp, Artificial Sequence
  Synthetic Polynucleotide
taatacgactcactataggggggaccctatatcttgagcccaagtgtcttaacagaggagaaagacaatggggctcaagaacctggcggcagcgcaaaagatg

SEQ ID NO: 13888 - DNA, 103 bp, Artificial Sequence
  Synthetic Polynucleotide
taatacgactcactatagggactgggggaccctatatcttgagcccaagtaacagaggagaacttggatgcaagatataaacctggcggcagcgcaaaagatg

SEQ ID NO: 13889 - DNA, 103 bp, Artificial Sequence
  Synthetic Polynucleotide
taatacgactcactatagggctttgactgggggaccctatatcttgagccaacagaggagaggctcaatgtatagggtcaacctggcggcagcgcaaaagatg

SEQ ID NO: 13890 - DNA, 103 bp, Artificial Sequence
  Synthetic Polynucleotide
taatacgactcactatagggcgtgtctttgactgggggaccctatatcttaacagaggagaaagataatgggtcccccaaacctggcggcagcgcaaaagatg

SEQ ID NO: 13891 - DNA, 103 bp, Artificial Sequence
  Synthetic Polynucleotide
taatacgactcactatagggccgcacgtgtctttgactgggggaccctataacagaggagaatagggatgcccagtcaaaacctggcggcagcgcaaaagatg

SEQ ID NO: 13892 - DNA, 103 bp, Artificial Sequence
  Synthetic Polynucleotide
taatacgactcactatagggtgggaccgcacgtgtctttgactgggggacaacagaggagagtccccatgtcaaagacaaacctggcggcagcgcaaaagatg

SEQ ID NO: 13893 - DNA, 103 bp, Artificial Sequence
  Synthetic Polynucleotide
taatacgactcactatagggcactgccgggtctggtgagattattccctgaacagaggagacagggaatgatctcaccaaacctggcggcagcgcaaaagatg

SEQ ID NO: 13894 - DNA, 103 bp, Artificial Sequence
  Synthetic Polynucleotide
taatacgactcactataggggaggatgggaccgcacgtgtctttgactggaacagaggagaccagtcatggacacgtgcaacctggcggcagcgcaaaagatg

SEQ ID NO: 13895 - DNA, 103 bp, Artificial Sequence
  Synthetic Polynucleotide
taatacgactcactatagggtgagggaggatgggaccgcacgtgtctttgaacagaggagacaaagaatggtgcggtccaacctggcggcagcgcaaaagatg

SEQ ID NO: 13896 - DNA, 103 bp, Artificial Sequence
  Synthetic Polynucleotide
taatacgactcactataggggaaggtgagggaggatgggaccgcacgtgtaacagaggagaacacgtatggtcccatccaacctggcggcagcgcaaaagatg

SEQ ID NO: 13897 - DNA, 103 bp, Artificial Sequence
  Synthetic Polynucleotide
taatacgactcactatagggtgtctgaaggtgagggaggatgggaccgcaaacagaggagatgcggtatgatcctccctaacctggcggcagcgcaaaagatg

SEQ ID NO: 13898 - DNA, 103 bp, Artificial Sequence
  Synthetic Polynucleotide
taatacgactcactataggggttgatgtctgaaggtgagggaggatgggaaacagaggagatcccatatgccctcacctaacctggcggcagcgcaaaagatg

SEQ ID NO: 13899 - DNA, 103 bp, Artificial Sequence
  Synthetic Polynucleotide
taatacgactcactatagggcatgcgttgatgtctgaaggtgagggaggaaacagaggagatcctccatgaccttcagaaacctggcggcagcgcaaaagatg

SEQ ID NO: 13900 - DNA, 103 bp, Artificial Sequence
  Synthetic Polynucleotide
taatacgactcactatagggactgccatgcgttgatgtctgaaggtgaggaacagaggagacctcacatgcagacatcaaacctggcggcagcgcaaaagatg

SEQ ID NO: 13901 - DNA, 103 bp, Artificial Sequence
  Synthetic Polynucleotide
taatacgactcactatagggttgggactgccatgcgttgatgtctgaaggaacagaggagaccttcaatgatcaacgcaaacctggcggcagcgcaaaagatg

SEQ ID NO: 13902 - DNA, 103 bp, Artificial Sequence
  Synthetic Polynucleotide
taatacgactcactatagggggtgtttgggactgccatgcgttgatgtctaacagaggagaagacatatgcgcatggcaaacctggcggcagcgcaaaagatg

SEQ ID NO: 13903 - DNA, 103 bp, Artificial Sequence
  Synthetic Polynucleotide
taatacgactcactatagggtcaccggtgtttgggactgccatgcgttgaaacagaggagatcaacgatgggcagtcccaacctggcggcagcgcaaaagatg

SEQ ID NO: 13904 - DNA, 103 bp, Artificial Sequence
  Synthetic Polynucleotide
taatacgactcactataggggaagacactgccgggtctggtgagattattaacagaggagaaataatatgaccagacccaacctggcggcagcgcaaaagatg

SEQ ID NO: 13905 - DNA, 103 bp, Artificial Sequence
  Synthetic Polynucleotide
taatacgactcactatagggctccctcaccggtgtttgggactgccatgcaacagaggagagcatggatgtcccaaacaaacctggcggcagcgcaaaagatg

SEQ ID NO: 13906 - DNA, 103 bp, Artificial Sequence
  Synthetic Polynucleotide
taatacgactcactatagggggcgcctccctcaccggtgtttgggactgcaacagaggagagcagtcatgaacaccggtaacctggcggcagcgcaaaagatg

SEQ ID NO: 13907 - DNA, 103 bp, Artificial Sequence
  Synthetic Polynucleotide
taatacgactcactatagggcgccgggcgcctccctcaccggtgtttgggaacagaggagacccaaaatgcggtgagggaacctggcggcagcgcaaaagatg

SEQ ID NO: 13908 - DNA, 103 bp, Artificial Sequence
  Synthetic Polynucleotide
taatacgactcactataggggttgtcgccgggcgcctccctcaccggtgtaacagaggagaacaccgatgagggaggcgaacctggcggcagcgcaaaagatg

SEQ ID NO: 13909 - DNA, 103 bp, Artificial Sequence
  Synthetic Polynucleotide
taatacgactcactatagggcatgtgttgtcgccgggcgcctccctcaccaacagaggagaggtgagatgggcgcccggaacctggcggcagcgcaaaagatg

SEQ ID NO: 13910 - DNA, 103 bp, Artificial Sequence
  Synthetic Polynucleotide
taatacgactcactatagggatcatcatgtgttgtcgccgggcgcctcccaacagaggagagggaggatgccggcgacaaacctggcggcagcgcaaaagatg

SEQ ID NO: 13911 - DNA, 103 bp, Artificial Sequence
  Synthetic Polynucleotide
taatacgactcactatagggagcctatcatcatgtgttgtcgccgggcgcaacagaggagagcgcccatggacaacacaaacctggcggcagcgcaaaagatg

SEQ ID NO: 13912 - DNA, 103 bp, Artificial Sequence
  Synthetic Polynucleotide
taatacgactcactatagggagatcagcctatcatcatgtgttgtcgccgaacagaggagacggcgaatgcacatgatgaacctggcggcagcgcaaaagatg

SEQ ID NO: 13913 - DNA, 103 bp, Artificial Sequence
  Synthetic Polynucleotide
taatacgactcactatagggcccgaagatcagcctatcatcatgtgttgtaacagaggagaacaacaatggatgataggaacctggcggcagcgcaaaagatg

SEQ ID NO: 13914 - DNA, 103 bp, Artificial Sequence
  Synthetic Polynucleotide
taatacgactcactatagggcttatcccgaagatcagcctatcatcatgtaacagaggagaacatgaatgtaggctgataacctggcggcagcgcaaaagatg

SEQ ID NO: 13915 - DNA, 103 bp, Artificial Sequence
  Synthetic Polynucleotide
taatacgactcactatagggagcctgaagacactgccgggtctggtgagaaacagaggagatctcacatgacccggcagaacctggcggcagcgcaaaagatg

SEQ ID NO: 13916 - DNA, 103 bp, Artificial Sequence
  Synthetic Polynucleotide
taatacgactcactatagggtgtctcttatcccgaagatcagcctatcataacagaggagaatgataatgtgatcttcgaacctggcggcagcgcaaaagatg

SEQ ID NO: 13917 - DNA, 103 bp, Artificial Sequence
  Synthetic Polynucleotide
taatacgactcactatagggtttcatgtctcttatcccgaagatcagcctaacagaggagaaggctgatgttcgggataaacctggcggcagcgcaaaagatg

SEQ ID NO: 13918 - DNA, 103 bp, Artificial Sequence
  Synthetic Polynucleotide
taatacgactcactatagggtggtttttcatgtctcttatcccgaagatcaacagaggagagatcttatggataagagaaacctggcggcagcgcaaaagatg

SEQ ID NO: 13919 - DNA, 103 bp, Artificial Sequence
  Synthetic Polynucleotide
taatacgactcactatagggctttttggtttttcatgtctcttatcccgaaacagaggagatcgggaatggagacatgaaacctggcggcagcgcaaaagatg

SEQ ID NO: 13920 - DNA, 103 bp, Artificial Sequence
  Synthetic Polynucleotide
taatacgactcactatagggaacggctttttggtttttcatgtctcttataacagaggagaataagaatgatgaaaaacaacctggcggcagcgcaaaagatg

SEQ ID NO: 13921 - DNA, 103 bp, Artificial Sequence
  Synthetic Polynucleotide
taatacgactcactatagggatgtaaacggctttttggtttttcatgtctaacagaggagaagacatatgaaaccaaaaaacctggcggcagcgcaaaagatg

SEQ ID NO: 13922 - DNA, 103 bp, Artificial Sequence
  Synthetic Polynucleotide
taatacgactcactatagggtctggatgtaaacggctttttggtttttcaaacagaggagatgaaaaatgaaaaagccgaacctggcggcagcgcaaaagatg

SEQ ID NO: 13923 - DNA, 103 bp, Artificial Sequence
  Synthetic Polynucleotide
taatacgactcactatagggttggatctggatgtaaacggctttttggttaacagaggagaaaccaaatggccgtttacaacctggcggcagcgcaaaagatg

SEQ ID NO: 13924 - DNA, 103 bp, Artificial Sequence
  Synthetic Polynucleotide
taatacgactcactatagggtgatcttggatctggatgtaaacggcttttaacagaggagaaaaagcatgttacatccaaacctggcggcagcgcaaaagatg

SEQ ID NO: 13925 - DNA, 103 bp, Artificial Sequence
  Synthetic Polynucleotide
taatacgactcactatagggactcttgatcttggatctggatgtaaacggaacagaggagaccgtttatgtccagatccaacctggcggcagcgcaaaagatg

SEQ ID NO: 13926 - DNA, 103 bp, Artificial Sequence
  Synthetic Polynucleotide
taatacgactcactatagggtatgaagcctgaagacactgccgggtctggaacagaggagaccagacatggcagtgtctaacctggcggcagcgcaaaagatg

SEQ ID NO: 13927 - DNA, 103 bp, Artificial Sequence
  Synthetic Polynucleotide
taatacgactcactatagggaagccactcttgatcttggatctggatgtaaacagaggagatacatcatgatccaagataacctggcggcagcgcaaaagatg

SEQ ID NO: 13928 - DNA, 103 bp, Artificial Sequence
  Synthetic Polynucleotide
taatacgactcactatagggtttccaagccactcttgatcttggatctggaacagaggagaccagatatgagatcaagaaacctggcggcagcgcaaaagatg

SEQ ID NO: 13929 - DNA, 103 bp, Artificial Sequence
  Synthetic Polynucleotide
taatacgactcactatagggccttatttccaagccactcttgatcttggaaacagaggagatccaagatgaagagtggcaacctggcggcagcgcaaaagatg

SEQ ID NO: 13930 - DNA, 103 bp, Artificial Sequence
  Synthetic Polynucleotide
taatacgactcactataggggtgccccttatttccaagccactcttgatcaacagaggagagatcaaatgtggcttggaaacctggcggcagcgcaaaagatg

SEQ ID NO: 13931 - DNA, 103 bp, Artificial Sequence
  Synthetic Polynucleotide
taatacgactcactatagggaacaagtgccccttatttccaagccactctaacagaggagaagagtgatgtggaaataaaacctggcggcagcgcaaaagatg

SEQ ID NO: 13932 - DNA, 103 bp, Artificial Sequence
  Synthetic Polynucleotide
taatacgactcactatagggcaaagaacaagtgccccttatttccaagccaacagaggagaggcttgatgataaggggcaacctggcggcagcgcaaaagatg

SEQ ID NO: 13933 - DNA, 103 bp, Artificial Sequence
  Synthetic Polynucleotide
taatacgactcactatagggtgagacaaagaacaagtgccccttatttccaacagaggagaggaaatatggggcacttgaacctggcggcagcgcaaaagatg

SEQ ID NO: 13934 - DNA, 103 bp, Artificial Sequence
  Synthetic Polynucleotide
taatacgactcactatagggtcctttgagacaaagaacaagtgccccttaaacagaggagataagggatgcttgttcttaacctggcggcagcgcaaaagatg

SEQ ID NO: 13935 - DNA, 103 bp, Artificial Sequence
  Synthetic Polynucleotide
taatacgactcactataggggtaagtcctttgagacaaagaacaagtgccaacagaggagaggcactatgtctttgtctaacctggcggcagcgcaaaagatg

SEQ ID NO: 13936 - DNA, 103 bp, Artificial Sequence
  Synthetic Polynucleotide
taatacgactcactatagggtttttgtaagtcctttgagacaaagaacaaaacagaggagattgttcatggtctcaaagaacctggcggcagcgcaaaagatg

SEQ ID NO: 13937 - DNA, 103 bp, Artificial Sequence
  Synthetic Polynucleotide
taatacgactcactatagggggggctatgaagcctgaagacactgccgggaacagaggagacccggcatggtcttcaggaacctggcggcagcgcaaaagatg

SEQ ID NO: 13938 - DNA, 103 bp, Artificial Sequence
  Synthetic Polynucleotide
taatacgactcactatagggccttgtttttgtaagtcctttgagacaaagaacagaggagactttgtatgaaaggacttaacctggcggcagcgcaaaagatg

SEQ ID NO: 13939 - DNA, 103 bp, Artificial Sequence
  Synthetic Polynucleotide
taatacgactcactatagggatcacccttgtttttgtaagtcctttgagaaacagaggagatctcaaatgacttacaaaaacctggcggcagcgcaaaagatg

SEQ ID NO: 13940 - DNA, 103 bp, Artificial Sequence
  Synthetic Polynucleotide
taatacgactcactatagggtcttcatcacccttgtttttgtaagtccttaacagaggagaaaggacatgcaaaaacaaaacctggcggcagcgcaaaagatg

SEQ ID NO: 13941 - DNA, 103 bp, Artificial Sequence
  Synthetic Polynucleotide
taatacgactcactatagggcttaatcttcatcacccttgtttttgtaagaacagaggagacttacaatgacaagggtgaacctggcggcagcgcaaaagatg

SEQ ID NO: 13942 - DNA, 103 bp, Artificial Sequence
  Synthetic Polynucleotide
taatacgactcactatagggtttttcttaatcttcatcacccttgtttttaacagaggagaaaaaacatgggtgatgaaaacctggcggcagcgcaaaagatg

SEQ ID NO: 13943 - DNA, 103 bp, Artificial Sequence
  Synthetic Polynucleotide
taatacgactcactataggggaggctttttcttaatcttcatcacccttgaacagaggagacaagggatgtgaagattaaacctggcggcagcgcaaaagatg

SEQ ID NO: 13944 - DNA, 103 bp, Artificial Sequence
  Synthetic Polynucleotide
taatacgactcactatagggtgaaggaggctttttcttaatcttcatcacaacagaggagagtgatgatgattaagaaaaacctggcggcagcgcaaaagatg

SEQ ID NO: 13945 - DNA, 103 bp, Artificial Sequence
  Synthetic Polynucleotide
taatacgactcactataggggcaactgaaggaggctttttcttaatcttcaacagaggagagaagatatggaaaaagccaacctggcggcagcgcaaaagatg

SEQ ID NO: 13946 - DNA, 103 bp, Artificial Sequence
  Synthetic Polynucleotide
taatacgactcactatagggtccttgcaactgaaggaggctttttcttaaaacagaggagattaagaatgagcctccttaacctggcggcagcgcaaaagatg

SEQ ID NO: 13947 - DNA, 103 bp, Artificial Sequence
  Synthetic Polynucleotide
taatacgactcactatagggttagctccttgcaactgaaggaggctttttaacagaggagaaaaaagatgccttcagttaacctggcggcagcgcaaaagatg

SEQ ID NO: 13948 - DNA, 103 bp, Artificial Sequence
  Synthetic Polynucleotide
taatacgactcactatagggatcttggggctatgaagcctgaagacactgaacagaggagacagtgtatgcaggcttcaaacctggcggcagcgcaaaagatg

SEQ ID NO: 13949 - DNA, 103 bp, Artificial Sequence
  Synthetic Polynucleotide
taatacgactcactatagggaagaattagctccttgcaactgaaggaggcaacagaggagagcctccatgagttgcaagaacctggcggcagcgcaaaagatg

SEQ ID NO: 13950 - DNA, 103 bp, Artificial Sequence
  Synthetic Polynucleotide
taatacgactcactataggggttttaagaattagctccttgcaactgaagaacagaggagacttcagatgcaaggagctaacctggcggcagcgcaaaagatg

SEQ ID NO: 13951 - DNA, 103 bp, Artificial Sequence
  Synthetic Polynucleotide
taatacgactcactatagggatgaagttttaagaattagctccttgcaacaacagaggagagttgcaatgagctaattcaacctggcggcagcgcaaaagatg

SEQ ID NO: 13952 - DNA, 103 bp, Artificial Sequence
  Synthetic Polynucleotide
taatacgactcactatagggtctagatgaagttttaagaattagctccttaacagaggagaaaggagatgattcttaaaaacctggcggcagcgcaaaagatg

SEQ ID NO: 13953 - DNA, 103 bp, Artificial Sequence
  Synthetic Polynucleotide
taatacgactcactatagggcttagtctagatgaagttttaagaattagcaacagaggagagctaatatgtaaaacttcaacctggcggcagcgcaaaagatg

SEQ ID NO: 13954 - DNA, 103 bp, Artificial Sequence
  Synthetic Polynucleotide
taatacgactcactatagggttatccttagtctagatgaagttttaagaaaacagaggagattcttaatgcttcatctaaacctggcggcagcgcaaaagatg

SEQ ID NO: 13955 - DNA, 103 bp, Artificial Sequence
  Synthetic Polynucleotide
taatacgactcactatagggtcgatttatccttagtctagatgaagttttaacagaggagaaaaactatgtctagactaaacctggcggcagcgcaaaagatg

SEQ ID NO: 13956 - DNA, 103 bp, Artificial Sequence
  Synthetic Polynucleotide
taatacgactcactatagggtggaatcgatttatccttagtctagatgaaaacagaggagattcatcatgactaaggataacctggcggcagcgcaaaagatg

SEQ ID NO: 13957 - DNA, 103 bp, Artificial Sequence
  Synthetic Polynucleotide
taatacgactcactataggggtgattggaatcgatttatccttagtctagaacagaggagactagacatgggataaatcaacctggcggcagcgcaaaagatg

SEQ ID NO: 13958 - DNA, 103 bp, Artificial Sequence
  Synthetic Polynucleotide
taatacgactcactatagggtcatcgtgattggaatcgatttatccttagaacagaggagactaaggatgaatcgattcaacctggcggcagcgcaaaagatg

SEQ ID NO: 13959 - DNA, 103 bp, Artificial Sequence
  Synthetic Polynucleotide
taatacgactcactatagggtctccatcttggggctatgaagcctgaagaaacagaggagatcttcaatgttcatagccaacctggcggcagcgcaaaagatg

SEQ ID NO: 13960 - DNA, 103 bp, Artificial Sequence
  Synthetic Polynucleotide
taatacgactcactatagggtctcctcatcgtgattggaatcgatttatcaacagaggagagataaaatgattccaatcaacctggcggcagcgcaaaagatg

SEQ ID NO: 13961 - DNA, 103 bp, Artificial Sequence
  Synthetic Polynucleotide
taatacgactcactatagggatgattctcctcatcgtgattggaatcgataacagaggagaatcgatatgaatcacgataacctggcggcagcgcaaaagatg

SEQ ID NO: 13962 - DNA, 103 bp, Artificial Sequence
  Synthetic Polynucleotide
taatacgactcactataggggtaggatgattctcctcatcgtgattggaaaacagaggagattccaaatgcgatgaggaaacctggcggcagcgcaaaagatg

SEQ ID NO: 13963 - DNA, 103 bp, Artificial Sequence
  Synthetic Polynucleotide
taatacgactcactatagggcgtgggtaggatgattctcctcatcgtgataacagaggagaatcacgatgaggagaatcaacctggcggcagcgcaaaagatg

SEQ ID NO: 13964 - DNA, 103 bp, Artificial Sequence
  Synthetic Polynucleotide
taatacgactcactatagggggtgccgtgggtaggatgattctcctcatcaacagaggagagatgagatgaatcatcctaacctggcggcagcgcaaaagatg

SEQ ID NO: 13965 - DNA, 103 bp, Artificial Sequence
  Synthetic Polynucleotide
taatacgactcactatagggcaggtggtgccgtgggtaggatgattctccaacagaggagaggagaaatgtcctacccaaacctggcggcagcgcaaaagatg

SEQ ID NO: 13966 - DNA, 103 bp, Artificial Sequence
  Synthetic Polynucleotide
taatacgactcactataggggtattcaggtggtgccgtgggtaggatgataacagaggagaatcatcatgcccacggcaaacctggcggcagcgcaaaagatg

SEQ ID NO: 13967 - DNA, 103 bp, Artificial Sequence
  Synthetic Polynucleotide
taatacgactcactatagggtccatgtattcaggtggtgccgtgggtaggaacagaggagacctaccatgggcaccaccaacctggcggcagcgcaaaagatg

SEQ ID NO: 13968 - DNA, 103 bp, Artificial Sequence
  Synthetic Polynucleotide
taatacgactcactatagggcagcctccatgtattcaggtggtgccgtggaacagaggagaccacggatgcacctgaataacctggcggcagcgcaaaagatg

SEQ ID NO: 13969 - DNA, 103 bp, Artificial Sequence
  Synthetic Polynucleotide
taatacgactcactataggggtaaacagcctccatgtattcaggtggtgcaacagaggagagcaccaatggaatacatgaacctggcggcagcgcaaaagatg

SEQ ID NO: 13970 - DNA, 103 bp, Artificial Sequence
  Synthetic Polynucleotide
taatacgactcactatagggttattaatcttcctcatagttattcgcacaaacagaggagatgtgcgatgaactatgagaacctggcggcagcgcaaaagatg

SEQ ID NO: 13971 - DNA, 103 bp, Artificial Sequence
  Synthetic Polynucleotide
taatacgactcactatagggccgactctccatcttggggctatgaagcctaacagaggagaaggcttatgagccccaagaacctggcggcagcgcaaaagatg

SEQ ID NO: 13972 - DNA, 103 bp, Artificial Sequence
  Synthetic Polynucleotide
taatacgactcactatagggattgggtaaacagcctccatgtattcaggtaacagaggagaacctgaatgcatggaggcaacctggcggcagcgcaaaagatg

SEQ ID NO: 13973 - DNA, 103 bp, Artificial Sequence
  Synthetic Polynucleotide
taatacgactcactatagggttctcattgggtaaacagcctccatgtattaacagaggagaaatacaatgaggctgtttaacctggcggcagcgcaaaagatg

SEQ ID NO: 13974 - DNA, 103 bp, Artificial Sequence
  Synthetic Polynucleotide
taatacgactcactatagggcattgttctcattgggtaaacagcctccataacagaggagaatggagatggtttacccaaacctggcggcagcgcaaaagatg

SEQ ID NO: 13975 - DNA, 103 bp, Artificial Sequence
  Synthetic Polynucleotide
taatacgactcactataggggaattcattgttctcattgggtaaacagccaacagaggagaggctgtatgcccaatgagaacctggcggcagcgcaaaagatg

SEQ ID NO: 13976 - DNA, 103 bp, Artificial Sequence
  Synthetic Polynucleotide
taatacgactcactatagggcaccagaattcattgttctcattgggtaaaaacagaggagatttaccatgtgagaacaaaacctggcggcagcgcaaaagatg

SEQ ID NO: 13977 - DNA, 103 bp, Artificial Sequence
  Synthetic Polynucleotide
taatacgactcactataggggtctgcaccagaattcattgttctcattggaacagaggagaccaatgatgacaatgaataacctggcggcagcgcaaaagatg

SEQ ID NO: 13978 - DNA, 103 bp, Artificial Sequence
  Synthetic Polynucleotide
taatacgactcactataggggtgttgtctgcaccagaattcattgttctcaacagaggagagagaacatggaattctggaacctggcggcagcgcaaaagatg

SEQ ID NO: 13979 - DNA, 103 bp, Artificial Sequence
  Synthetic Polynucleotide
taatacgactcactatagggtggcagtgttgtctgcaccagaattcattgaacagaggagacaatgaatgctggtgcagaacctggcggcagcgcaaaagatg

SEQ ID NO: 13980 - DNA, 103 bp, Artificial Sequence
  Synthetic Polynucleotide
taatacgactcactataggggccactggcagtgttgtctgcaccagaattaacagaggagaaattctatggcagacaacaacctggcggcagcgcaaaagatg

SEQ ID NO: 13981 - DNA, 103 bp, Artificial Sequence
  Synthetic Polynucleotide
taatacgactcactatagggttagggccactggcagtgttgtctgcaccaaacagaggagatggtgcatgcaacactgcaacctggcggcagcgcaaaagatg

SEQ ID NO: 13982 - DNA, 103 bp, Artificial Sequence
  Synthetic Polynucleotide
taatacgactcactatagggtgggcccgactctccatcttggggctatgaaacagaggagatcatagatgcaagatggaaacctggcggcagcgcaaaagatg

SEQ ID NO: 13983 - DNA, 103 bp, Artificial Sequence
  Synthetic Polynucleotide
taatacgactcactatagggtgtaattagggccactggcagtgttgtctgaacagaggagacagacaatgctgccagtgaacctggcggcagcgcaaaagatg

SEQ ID NO: 13984 - DNA, 103 bp, Artificial Sequence
  Synthetic Polynucleotide
taatacgactcactatagggtgttgtgtaattagggccactggcagtgttaacagaggagaaacactatgagtggccctaacctggcggcagcgcaaaagatg

SEQ ID NO: 13985 - DNA, 103 bp, Artificial Sequence
  Synthetic Polynucleotide
taatacgactcactatagggccagttgttgtgtaattagggccactggcaaacagaggagatgccagatgccctaattaaacctggcggcagcgcaaaagatg

SEQ ID NO: 13986 - DNA, 103 bp, Artificial Sequence
  Synthetic Polynucleotide
taatacgactcactatagggtcacaccagttgttgtgtaattagggccacaacagaggagagtggccatgattacacaaaacctggcggcagcgcaaaagatg

SEQ ID NO: 13987 - DNA, 103 bp, Artificial Sequence
  Synthetic Polynucleotide
taatacgactcactatagggtgtcatcacaccagttgttgtgtaattaggaacagaggagacctaatatgacaacaactaacctggcggcagcgcaaaagatg

SEQ ID NO: 13988 - DNA, 103 bp, Artificial Sequence
  Synthetic Polynucleotide
taatacgactcactatagggtcatttgtcatcacaccagttgttgtgtaaaacagaggagattacacatgaactggtgtaacctggcggcagcgcaaaagatg

SEQ ID NO: 13989 - DNA, 103 bp, Artificial Sequence
  Synthetic Polynucleotide
taatacgactcactataggggagtatcatttgtcatcacaccagttgttgaacagaggagacaacaaatggtgtgatgaaacctggcggcagcgcaaaagatg

SEQ ID NO: 13990 - DNA, 103 bp, Artificial Sequence
  Synthetic Polynucleotide
taatacgactcactatagggagagggagtatcatttgtcatcacaccagtaacagaggagaactggtatgatgacaaataacctggcggcagcgcaaaagatg

SEQ ID NO: 13991 - DNA, 103 bp, Artificial Sequence
  Synthetic Polynucleotide
taatacgactcactataggggaattagagggagtatcatttgtcatcacaaacagaggagatgtgatatgaaatgatacaacctggcggcagcgcaaaagatg

SEQ ID NO: 13992 - DNA, 103 bp, Artificial Sequence
  Synthetic Polynucleotide
taatacgactcactatagggggagtgaattagagggagtatcatttgtcaaacagaggagatgacaaatgatactccctaacctggcggcagcgcaaaagatg

SEQ ID NO: 13993 - DNA, 103 bp, Artificial Sequence
  Synthetic Polynucleotide
taatacgactcactatagggctttgtgggcccgactctccatcttggggcaacagaggagagccccaatgtggagagtcaacctggcggcagcgcaaaagatg

SEQ ID NO: 13994 - DNA, 103 bp, Artificial Sequence
  Synthetic Polynucleotide
taatacgactcactatagggtggtcggagtgaattagagggagtatcattaacagaggagaaatgatatgccctctaataacctggcggcagcgcaaaagatg

SEQ ID NO: 13995 - DNA, 103 bp, Artificial Sequence
  Synthetic Polynucleotide
taatacgactcactataggggcaactggtcggagtgaattagagggagtaaacagaggagatactccatgtaattcactaacctggcggcagcgcaaaagatg

SEQ ID NO: 13996 - DNA, 103 bp, Artificial Sequence
  Synthetic Polynucleotide
taatacgactcactatagggcatctgcaactggtcggagtgaattagaggaacagaggagacctctaatgcactccgacaacctggcggcagcgcaaaagatg

SEQ ID NO: 13997 - DNA, 103 bp, Artificial Sequence
  Synthetic Polynucleotide
taatacgactcactatagggattatcatctgcaactggtcggagtgaattaacagaggagaaattcaatgcgaccagttaacctggcggcagcgcaaaagatg

SEQ ID NO: 13998 - DNA, 103 bp, Artificial Sequence
  Synthetic Polynucleotide
taatacgactcactatagggtcaatattatcatctgcaactggtcggagtaacagaggagaactccgatgagttgcagaaacctggcggcagcgcaaaagatg

SEQ ID NO: 13999 - DNA, 103 bp, Artificial Sequence
  Synthetic Polynucleotide
taatacgactcactataggggatgatcaatattatcatctgcaactggtcaacagaggagagaccagatgcagatgataaacctggcggcagcgcaaaagatg

SEQ ID NO: 14000 - DNA, 103 bp, Artificial Sequence
  Synthetic Polynucleotide
taatacgactcactataggggctcggatgatcaatattatcatctgcaacaacagaggagagttgcaatggataatattaacctggcggcagcgcaaaagatg

SEQ ID NO: 14001 - DNA, 103 bp, Artificial Sequence
  Synthetic Polynucleotide
taatacgactcactataggggtgtggctcggatgatcaatattatcatctaacagaggagaagatgaatgtattgatcaaacctggcggcagcgcaaaagatg

SEQ ID NO: 14002 - DNA, 103 bp, Artificial Sequence
  Synthetic Polynucleotide
taatacgactcactatagggtaggcgtgtggctcggatgatcaatattataacagaggagaataataatgatcatccgaaacctggcggcagcgcaaaagatg

SEQ ID NO: 14003 - DNA, 103 bp, Artificial Sequence
  Synthetic Polynucleotide
taatacgactcactatagggactgttaggcgtgtggctcggatgatcaataacagaggagaattgatatgccgagccacaacctggcggcagcgcaaaagatg

SEQ ID NO: 14004 - DNA, 103 bp, Artificial Sequence
  Synthetic Polynucleotide
taatacgactcactatagggccatgctttgtgggcccgactctccatcttaacagaggagaaagatgatgagtcgggccaacctggcggcagcgcaaaagatg

SEQ ID NO: 14005 - DNA, 103 bp, Artificial Sequence
  Synthetic Polynucleotide
taatacgactcactataggggcaacactgttaggcgtgtggctcggatgaaacagaggagatcatccatgccacacgccaacctggcggcagcgcaaaagatg

SEQ ID NO: 14006 - DNA, 103 bp, Artificial Sequence
  Synthetic Polynucleotide
taatacgactcactatagggcagaggcaacactgttaggcgtgtggctcgaacagaggagacgagccatgcgcctaacaaacctggcggcagcgcaaaagatg

SEQ ID NO: 14007 - DNA, 103 bp, Artificial Sequence
  Synthetic Polynucleotide
taatacgactcactatagggaaatgcagaggcaacactgttaggcgtgtgaacagaggagacacacgatgaacagtgttaacctggcggcagcgcaaaagatg

SEQ ID NO: 14008 - DNA, 103 bp, Artificial Sequence
  Synthetic Polynucleotide
taatacgactcactatagggaatataaatgcagaggcaacactgttaggcaacagaggagagcctaaatgtgttgcctcaacctggcggcagcgcaaaagatg

SEQ ID NO: 14009 - DNA, 103 bp, Artificial Sequence
  Synthetic Polynucleotide
taatacgactcactatagggcttccaatataaatgcagaggcaacactgtaacagaggagaacagtgatgcctctgcataacctggcggcagcgcaaaagatg

SEQ ID NO: 14010 - DNA, 103 bp, Artificial Sequence
  Synthetic Polynucleotide
taatacgactcactatagggcatagcttccaatataaatgcagaggcaacaacagaggagagttgccatggcatttataaacctggcggcagcgcaaaagatg

SEQ ID NO: 14011 - DNA, 103 bp, Artificial Sequence
  Synthetic Polynucleotide
taatacgactcactatagggttcaccatagcttccaatataaatgcagagaacagaggagactctgcatgtatattggaaacctggcggcagcgcaaaagatg

SEQ ID NO: 14012 - DNA, 103 bp, Artificial Sequence
  Synthetic Polynucleotide
taatacgactcactatagggttacattcaccatagcttccaatataaatgaacagaggagacatttaatgtggaagctaaacctggcggcagcgcaaaagatg

SEQ ID NO: 14013 - DNA, 103 bp, Artificial Sequence
  Synthetic Polynucleotide
taatacgactcactatagggagatattacattcaccatagcttccaatataacagaggagaatattgatggctatggtgaacctggcggcagcgcaaaagatg

SEQ ID NO: 14014 - DNA, 103 bp, Artificial Sequence
  Synthetic Polynucleotide
taatacgactcactataggggggccagatattacattcaccatagcttccaacagaggagaggaagcatgggtgaatgtaacctggcggcagcgcaaaagatg

SEQ ID NO: 14015 - DNA, 103 bp, Artificial Sequence
  Synthetic Polynucleotide
taatacgactcactataggggtcatccatgctttgtgggcccgactctccaacagaggagaggagagatgggcccacaaaacctggcggcagcgcaaaagatg

SEQ ID NO: 14016 - DNA, 103 bp, Artificial Sequence
  Synthetic Polynucleotide
taatacgactcactatagggctttcgggccagatattacattcaccatagaacagaggagactatggatgatgtaatataacctggcggcagcgcaaaagatg

SEQ ID NO: 14017 - DNA, 103 bp, Artificial Sequence
  Synthetic Polynucleotide
taatacgactcactatagggcagcactttcgggccagatattacattcacaacagaggagagtgaatatgatatctggcaacctggcggcagcgcaaaagatg

SEQ ID NO: 14018 - DNA, 103 bp, Artificial Sequence
  Synthetic Polynucleotide
taatacgactcactatagggttcatcagcactttcgggccagatattacaaacagaggagatgtaatatgtggcccgaaaacctggcggcagcgcaaaagatg

SEQ ID NO: 14019 - DNA, 103 bp, Artificial Sequence
  Synthetic Polynucleotide
taatacgactcactatagggtttgcttcatcagcactttcgggccagataaacagaggagatatctgatgcgaaagtgcaacctggcggcagcgcaaaagatg

SEQ ID NO: 14020 - DNA, 103 bp, Artificial Sequence
  Synthetic Polynucleotide
taatacgactcactatagggtgggatttgcttcatcagcactttcgggccaacagaggagaggcccgatggtgctgatgaacctggcggcagcgcaaaagatg

SEQ ID NO: 14021 - DNA, 103 bp, Artificial Sequence
  Synthetic Polynucleotide
taatacgactcactatagggcagattgggatttgcttcatcagcactttcaacagaggagagaaagtatggatgaagcaaacctggcggcagcgcaaaagatg

SEQ ID NO: 14022 - DNA, 103 bp, Artificial Sequence
  Synthetic Polynucleotide
taatacgactcactataggggaagccagattgggatttgcttcatcagcaaacagaggagatgctgaatgagcaaatccaacctggcggcagcgcaaaagatg

SEQ ID NO: 14023 - DNA, 103 bp, Artificial Sequence
  Synthetic Polynucleotide
taatacgactcactatagggcagaggaagccagattgggatttgcttcataacagaggagaatgaagatgatcccaatcaacctggcggcagcgcaaaagatg

SEQ ID NO: 14024 - DNA, 103 bp, Artificial Sequence
  Synthetic Polynucleotide
taatacgactcactatagggacacccagaggaagccagattgggatttgcaacagaggagagcaaatatgaatctggctaacctggcggcagcgcaaaagatg

SEQ ID NO: 14025 - DNA, 103 bp, Artificial Sequence
  Synthetic Polynucleotide
taatacgactcactatagggcagagacacccagaggaagccagattgggaaacagaggagatcccaaatgggcttcctcaacctggcggcagcgcaaaagatg

SEQ ID NO: 14026 - DNA, 103 bp, Artificial Sequence
  Synthetic Polynucleotide
taatacgactcactatagggtgtgcgtcatccatgctttgtgggcccgacaacagaggagagtcgggatgacaaagcataacctggcggcagcgcaaaagatg

SEQ ID NO: 14027 - DNA, 103 bp, Artificial Sequence
  Synthetic Polynucleotide
taatacgactcactatagggctggtcagagacacccagaggaagccagataacagaggagaatctggatgcctctgggtaacctggcggcagcgcaaaagatg

SEQ ID NO: 14028 - DNA, 103 bp, Artificial Sequence
  Synthetic Polynucleotide
taatacgactcactataggggtcttctggtcagagacacccagaggaagcaacagaggagagcttccatggggtgtctcaacctggcggcagcgcaaaagatg

SEQ ID NO: 14029 - DNA, 103 bp, Artificial Sequence
  Synthetic Polynucleotide
taatacgactcactatagggtatatgtcttctggtcagagacacccagagaacagaggagactctggatgtctctgaccaacctggcggcagcgcaaaagatg

SEQ ID NO: 14030 - DNA, 103 bp, Artificial Sequence
  Synthetic Polynucleotide
taatacgactcactatagggaaagctatatgtcttctggtcagagacaccaacagaggagaggtgtcatggaccagaagaacctggcggcagcgcaaaagatg

SEQ ID NO: 14031 - DNA, 103 bp, Artificial Sequence
  Synthetic Polynucleotide
taatacgactcactataggggaatcaaagctatatgtcttctggtcagagaacagaggagactctgaatggaagacataaacctggcggcagcgcaaaagatg

SEQ ID NO: 14032 - DNA, 103 bp, Artificial Sequence
  Synthetic Polynucleotide
taatacgactcactatagggtggttgaatcaaagctatatgtcttctggtaacagaggagaaccagaatgcatatagctaacctggcggcagcgcaaaagatg

SEQ ID NO: 14033 - DNA, 103 bp, Artificial Sequence
  Synthetic Polynucleotide
taatacgactcactatagggagcagtggttgaatcaaagctatatgtcttaacagaggagaaagacaatgagctttgataacctggcggcagcgcaaaagatg

SEQ ID NO: 14034 - DNA, 103 bp, Artificial Sequence
  Synthetic Polynucleotide
taatacgactcactatagggatggcagcagtggttgaatcaaagctatataacagaggagaatatagatgtgattcaacaacctggcggcagcgcaaaagatg

SEQ ID NO: 14035 - DNA, 103 bp, Artificial Sequence
  Synthetic Polynucleotide
taatacgactcactataggggcataatggcagcagtggttgaatcaaagcaacagaggagagctttgatgcaaccactgaacctggcggcagcgcaaaagatg

SEQ ID NO: 14036 - DNA, 103 bp, Artificial Sequence
  Synthetic Polynucleotide
taatacgactcactatagggtgctagcataatggcagcagtggttgaatcaacagaggagagattcaatgactgctgccaacctggcggcagcgcaaaagatg

SEQ ID NO: 14037 - DNA, 103 bp, Artificial Sequence
  Synthetic Polynucleotide
taatacgactcactatagggtgcggtgtgcgtcatccatgctttgtgggcaacagaggagagcccacatggcatggatgaacctggcggcagcgcaaaagatg

SEQ ID NO: 14038 - DNA, 103 bp, Artificial Sequence
  Synthetic Polynucleotide
taatacgactcactatagggtatgatgctagcataatggcagcagtggttaacagaggagaaaccacatgtgccattataacctggcggcagcgcaaaagatg

SEQ ID NO: 14039 - DNA, 103 bp, Artificial Sequence
  Synthetic Polynucleotide
taatacgactcactatagggtggtatatgatgctagcataatggcagcagaacagaggagactgctgatgttatgctagaacctggcggcagcgcaaaagatg

SEQ ID NO: 14040 - DNA, 103 bp, Artificial Sequence
  Synthetic Polynucleotide
taatacgactcactatagggagtgatggtatatgatgctagcataatggcaacagaggagagccattatgctagcatcaaacctggcggcagcgcaaaagatg

SEQ ID NO: 14041 - DNA, 103 bp, Artificial Sequence
  Synthetic Polynucleotide
taatacgactcactatagggaaatgagtgatggtatatgatgctagcataaacagaggagatatgctatgatcatatacaacctggcggcagcgcaaaagatg

SEQ ID NO: 14042 - DNA, 103 bp, Artificial Sequence
  Synthetic Polynucleotide
taatacgactcactatagggtgccaaaatgagtgatggtatatgatgctaaacagaggagatagcatatgataccatcaaacctggcggcagcgcaaaagatg

SEQ ID NO: 14043 - DNA, 103 bp, Artificial Sequence
  Synthetic Polynucleotide
taatacgactcactatagggggttttgccaaaatgagtgatggtatatgaaacagaggagatcatatatgatcactcataacctggcggcagcgcaaaagatg

SEQ ID NO: 14044 - DNA, 103 bp, Artificial Sequence
  Synthetic Polynucleotide
taatacgactcactatagggtttgaggttttgccaaaatgagtgatggtaaacagaggagataccatatgtcattttggaacctggcggcagcgcaaaagatg

SEQ ID NO: 14045 - DNA, 103 bp, Artificial Sequence
  Synthetic Polynucleotide
taatacgactcactatagggggggatttgaggttttgccaaaatgagtgaaacagaggagatcactcatgttggcaaaaaacctggcggcagcgcaaaagatg

SEQ ID NO: 14046 - DNA, 103 bp, Artificial Sequence
  Synthetic Polynucleotide
taatacgactcactatagggcacaaggggatttgaggttttgccaaaatgaacagaggagacattttatgaaaacctcaaacctggcggcagcgcaaaagatg

SEQ ID NO: 14047 - DNA, 103 bp, Artificial Sequence
  Synthetic Polynucleotide
taatacgactcactatagggattctcacaaggggatttgaggttttgccaaacagaggagatggcaaatgctcaaatccaacctggcggcagcgcaaaagatg

SEQ ID NO: 14048 - DNA, 103 bp, Artificial Sequence
  Synthetic Polynucleotide
taatacgactcactatagggcctgatgcggtgtgcgtcatccatgctttgaacagaggagacaaagcatggatgacgcaaacctggcggcagcgcaaaagatg

SEQ ID NO: 14049 - DNA, 103 bp, Artificial Sequence
  Synthetic Polynucleotide
taatacgactcactatagggggttgattctcacaaggggatttgaggtttaacagaggagaaaacctatgatccccttgaacctggcggcagcgcaaaagatg

SEQ ID NO: 14050 - DNA, 103 bp, Artificial Sequence
  Synthetic Polynucleotide
taatacgactcactatagggaagtcggttgattctcacaaggggatttgaaacagaggagatcaaatatgcttgtgagaaacctggcggcagcgcaaaagatg

SEQ ID NO: 14051 - DNA, 103 bp, Artificial Sequence
  Synthetic Polynucleotide
taatacgactcactatagggggaccaagtcggttgattctcacaaggggaaacagaggagatcccctatggagaatcaaaacctggcggcagcgcaaaagatg

SEQ ID NO: 14052 - DNA, 103 bp, Artificial Sequence
  Synthetic Polynucleotide
taatacgactcactatagggtgccaggaccaagtcggttgattctcacaaaacagaggagattgtgaatgtcaaccgacaacctggcggcagcgcaaaagatg

SEQ ID NO: 14053 - DNA, 103 bp, Artificial Sequence
  Synthetic Polynucleotide
taatacgactcactatagggaggtatgccaggaccaagtcggttgattctaacagaggagaagaatcatgcgacttggtaacctggcggcagcgcaaaagatg

SEQ ID NO: 14054 - DNA, 103 bp, Artificial Sequence
  Synthetic Polynucleotide
taatacgactcactatagggtgatcaggtatgccaggaccaagtcggttgaacagaggagacaaccgatgtggtcctggaacctggcggcagcgcaaaagatg

SEQ ID NO: 14055 - DNA, 103 bp, Artificial Sequence
  Synthetic Polynucleotide
taatacgactcactataggggtgggtgatcaggtatgccaggaccaagtcaacagaggagagacttgatgctggcatacaacctggcggcagcgcaaaagatg

SEQ ID NO: 14056 - DNA, 103 bp, Artificial Sequence
  Synthetic Polynucleotide
taatacgactcactatagggtcgtagtgggtgatcaggtatgccaggaccaacagaggagaggtcctatgatacctgataacctggcggcagcgcaaaagatg

SEQ ID NO: 14057 - DNA, 103 bp, Artificial Sequence
  Synthetic Polynucleotide
taatacgactcactatagggaggagtcgtagtgggtgatcaggtatgccaaacagaggagatggcatatgtgatcacccaacctggcggcagcgcaaaagatg

SEQ ID NO: 14058 - DNA, 103 bp, Artificial Sequence
  Synthetic Polynucleotide
taatacgactcactatagggttcttaggagtcgtagtgggtgatcaggtaaacagaggagatacctgatgacccactacaacctggcggcagcgcaaaagatg

SEQ ID NO: 14059 - DNA, 103 bp, Artificial Sequence
  Synthetic Polynucleotide
taatacgactcactatagggcgaaacctgatgcggtgtgcgtcatccatgaacagaggagacatggaatgcgcacaccgaacctggcggcagcgcaaaagatg

SEQ ID NO: 14060 - DNA, 103 bp, Artificial Sequence
  Synthetic Polynucleotide
taatacgactcactatagggtcctattcttaggagtcgtagtgggtgatcaacagaggagagatcacatgctacgactcaacctggcggcagcgcaaaagatg

SEQ ID NO: 14061 - DNA, 103 bp, Artificial Sequence
  Synthetic Polynucleotide
taatacgactcactatagggtgatttcctattcttaggagtcgtagtgggaacagaggagacccactatgactcctaagaacctggcggcagcgcaaaagatg

SEQ ID NO: 14062 - DNA, 103 bp, Artificial Sequence
  Synthetic Polynucleotide
taatacgactcactatagggaggcttgatttcctattcttaggagtcgtaaacagaggagatacgacatgtaagaatagaacctggcggcagcgcaaaagatg

SEQ ID NO: 14063 - DNA, 103 bp, Artificial Sequence
  Synthetic Polynucleotide
taatacgactcactatagggtaggaaggcttgatttcctattcttaggagaacagaggagactcctaatgataggaaataacctggcggcagcgcaaaagatg

SEQ ID NO: 14064 - DNA, 103 bp, Artificial Sequence
  Synthetic Polynucleotide
taatacgactcactatagggtcttgtaggaaggcttgatttcctattcttaacagaggagaaagaatatgaaatcaagcaacctggcggcagcgcaaaagatg

SEQ ID NO: 14065 - DNA, 103 bp, Artificial Sequence
  Synthetic Polynucleotide
taatacgactcactatagggcaaactcttgtaggaaggcttgatttcctaaacagaggagataggaaatgaagccttccaacctggcggcagcgcaaaagatg

SEQ ID NO: 14066 - DNA, 103 bp, Artificial Sequence
  Synthetic Polynucleotide
taatacgactcactatagggtagcacaaactcttgtaggaaggcttgattaacagaggagaaatcaaatgttcctacaaaacctggcggcagcgcaaaagatg

SEQ ID NO: 14067 - DNA, 103 bp, Artificial Sequence
  Synthetic Polynucleotide
taatacgactcactatagggggaggtagcacaaactcttgtaggaaggctaacagaggagaagccttatgacaagagttaacctggcggcagcgcaaaagatg

SEQ ID NO: 14068 - DNA, 103 bp, Artificial Sequence
  Synthetic Polynucleotide
taatacgactcactataggggtacaggaggtagcacaaactcttgtaggaaacagaggagatcctacatgagtttgtgcaacctggcggcagcgcaaaagatg

SEQ ID NO: 14069 - DNA, 103 bp, Artificial Sequence
  Synthetic Polynucleotide
taatacgactcactatagggcagttgtacaggaggtagcacaaactcttgaacagaggagacaagagatggtgctacctaacctggcggcagcgcaaaagatg

SEQ ID NO: 14070 - DNA, 103 bp, Artificial Sequence
  Synthetic Polynucleotide
taatacgactcactatagggtgtttcgaaacctgatgcggtgtgcgtcataacagaggagaatgacgatgaccgcatcaaacctggcggcagcgcaaaagatg

SEQ ID NO: 14071 - DNA, 103 bp, Artificial Sequence
  Synthetic Polynucleotide
taatacgactcactatagggtgtggcagttgtacaggaggtagcacaaacaacagaggagagtttgtatgacctcctgtaacctggcggcagcgcaaaagatg

SEQ ID NO: 14072 - DNA, 103 bp, Artificial Sequence
  Synthetic Polynucleotide
taatacgactcactatagggagtattgtggcagttgtacaggaggtagcaaacagaggagatgctacatgctgtacaacaacctggcggcagcgcaaaagatg

SEQ ID NO: 14073 - DNA, 103 bp, Artificial Sequence
  Synthetic Polynucleotide
taatacgactcactatagggagtgaagtattgtggcagttgtacaggaggaacagaggagacctcctatgcaactgccaaacctggcggcagcgcaaaagatg

SEQ ID NO: 14074 - DNA, 103 bp, Artificial Sequence
  Synthetic Polynucleotide
taatacgactcactatagggtcaaaagtgaagtattgtggcagttgtacaaacagaggagatgtacaatggccacaataaacctggcggcagcgcaaaagatg

SEQ ID NO: 14075 - DNA, 103 bp, Artificial Sequence
  Synthetic Polynucleotide
taatacgactcactatagggtcagatcaaaagtgaagtattgtggcagttaacagaggagaaactgcatgaatacttcaaacctggcggcagcgcaaaagatg

SEQ ID NO: 14076 - DNA, 103 bp, Artificial Sequence
  Synthetic Polynucleotide
taatacgactcactatagggcgctgtcagatcaaaagtgaagtattgtggaacagaggagaccacaaatgttcacttttaacctggcggcagcgcaaaagatg

SEQ ID NO: 14077 - DNA, 103 bp, Artificial Sequence
  Synthetic Polynucleotide
taatacgactcactatagggttcagcgctgtcagatcaaaagtgaagtataacagaggagaatacttatgttttgatctaacctggcggcagcgcaaaagatg

SEQ ID NO: 14078 - DNA, 103 bp, Artificial Sequence
  Synthetic Polynucleotide
taatacgactcactatagggtcagcttcagcgctgtcagatcaaaagtgaaacagaggagatcacttatgatctgacagaacctggcggcagcgcaaaagatg

SEQ ID NO: 14079 - DNA, 103 bp, Artificial Sequence
  Synthetic Polynucleotide
taatacgactcactatagggggtgatcagcttcagcgctgtcagatcaaaaacagaggagatttgatatgacagcgctgaacctggcggcagcgcaaaagatg

SEQ ID NO: 14080 - DNA, 103 bp, Artificial Sequence
  Synthetic Polynucleotide
taatacgactcactatagggggctgggtgatcagcttcagcgctgtcagaaacagaggagatctgacatggctgaagctaacctggcggcagcgcaaaagatg

SEQ ID NO: 14081 - DNA, 103 bp, Artificial Sequence
  Synthetic Polynucleotide
taatacgactcactataggggactgctttcttttgcggagtctactactaaacagaggagatagtagatgactccgcaaaacctggcggcagcgcaaaagatg

SEQ ID NO: 14082 - DNA, 103 bp, Artificial Sequence
  Synthetic Polynucleotide
taatacgactcactatagggaaactggccattactagccacttccatatcaacagaggagagatatgatggtggctagtaacctggcggcagcgcaaaagatg

SEQ ID NO: 14083 - DNA, 103 bp, Artificial Sequence
  Synthetic Polynucleotide
taatacgactcactatagggcctagtgcaatcaaacaacttttcatcatgaacagaggagacatgatatgaagttgtttaacctggcggcagcgcaaaagatg

SEQ ID NO: 14084 - DNA, 103 bp, Artificial Sequence
  Synthetic Polynucleotide
taatacgactcactatagggaaggccctagtgcaatcaaacaacttttcaaacagaggagatgaaaaatggtttgattgaacctggcggcagcgcaaaagatg

SEQ ID NO: 14085 - DNA, 103 bp, Artificial Sequence
  Synthetic Polynucleotide
taatacgactcactatagggtctgtaaggccctagtgcaatcaaacaactaacagaggagaagttgtatgattgcactaaacctggcggcagcgcaaaagatg

SEQ ID NO: 14086 - DNA, 103 bp, Artificial Sequence
  Synthetic Polynucleotide
taatacgactcactatagggtgtactctgtaaggccctagtgcaatcaaaaacagaggagatttgatatgactagggccaacctggcggcagcgcaaaagatg

SEQ ID NO: 14087 - DNA, 103 bp, Artificial Sequence
  Synthetic Polynucleotide
taatacgactcactatagggccacttgtactctgtaaggccctagtgcaaaacagaggagattgcacatgggccttacaaacctggcggcagcgcaaaagatg

SEQ ID NO: 14088 - DNA, 103 bp, Artificial Sequence
  Synthetic Polynucleotide
taatacgactcactatagggatagaccacttgtactctgtaaggccctagaacagaggagactagggatgtacagagtaaacctggcggcagcgcaaaagatg

SEQ ID NO: 14089 - DNA, 103 bp, Artificial Sequence
  Synthetic Polynucleotide
taatacgactcactatagggctttcatagaccacttgtactctgtaaggcaacagaggagagccttaatgagtacaagtaacctggcggcagcgcaaaagatg

SEQ ID NO: 14090 - DNA, 103 bp, Artificial Sequence
  Synthetic Polynucleotide
taatacgactcactatagggaggttctttcatagaccacttgtactctgtaacagaggagaacagagatgaagtggtctaacctggcggcagcgcaaaagatg

SEQ ID NO: 14091 - DNA, 103 bp, Artificial Sequence
  Synthetic Polynucleotide
taatacgactcactataggggcagtaggttctttcatagaccacttgtacaacagaggagagtacaaatggtctatgaaaacctggcggcagcgcaaaagatg

SEQ ID NO: 14092 - DNA, 103 bp, Artificial Sequence
  Synthetic Polynucleotide
taatacgactcactataggggtcatgcagtaggttctttcatagaccactaacagaggagaagtggtatgtgaaagaacaacctggcggcagcgcaaaagatg

SEQ ID NO: 14093 - DNA, 103 bp, Artificial Sequence
  Synthetic Polynucleotide
taatacgactcactatagggatgctaaactggccattactagccacttccaacagaggagaggaagtatgtagtaatggaacctggcggcagcgcaaaagatg

SEQ ID NO: 14094 - DNA, 103 bp, Artificial Sequence
  Synthetic Polynucleotide
taatacgactcactatagggcccctgtcatgcagtaggttctttcatagaaacagaggagatctatgatggaacctactaacctggcggcagcgcaaaagatg

SEQ ID NO: 14095 - DNA, 103 bp, Artificial Sequence
  Synthetic Polynucleotide
taatacgactcactatagggcaggacccctgtcatgcagtaggttctttcaacagaggagagaaagaatgtactgcatgaacctggcggcagcgcaaaagatg

SEQ ID NO: 14096 - DNA, 103 bp, Artificial Sequence
  Synthetic Polynucleotide
taatacgactcactatagggtctatcaggacccctgtcatgcagtaggttaacagaggagaaacctaatgcatgacaggaacctggcggcagcgcaaaagatg

SEQ ID NO: 14097 - DNA, 103 bp, Artificial Sequence
  Synthetic Polynucleotide
taatacgactcactatagggttccttctatcaggacccctgtcatgcagtaacagaggagaactgcaatgcaggggtccaacctggcggcagcgcaaaagatg

SEQ ID NO: 14098 - DNA, 103 bp, Artificial Sequence
  Synthetic Polynucleotide
taatacgactcactatagggacattttccttctatcaggacccctgtcataacagaggagaatgacaatggtcctgataaacctggcggcagcgcaaaagatg

SEQ ID NO: 14099 - DNA, 103 bp, Artificial Sequence
  Synthetic Polynucleotide
taatacgactcactatagggacaaaacattttccttctatcaggacccctaacagaggagaaggggtatggatagaaggaacctggcggcagcgcaaaagatg

SEQ ID NO: 14100 - DNA, 103 bp, Artificial Sequence
  Synthetic Polynucleotide
taatacgactcactatagggctggaacaaaacattttccttctatcaggaaacagaggagatcctgaatgaaggaaaataacctggcggcagcgcaaaagatg

SEQ ID NO: 14101 - DNA, 103 bp, Artificial Sequence
  Synthetic Polynucleotide
taatacgactcactatagggttggtctggaacaaaacattttccttctataacagaggagaatagaaatgaaatgttttaacctggcggcagcgcaaaagatg

SEQ ID NO: 14102 - DNA, 103 bp, Artificial Sequence
  Synthetic Polynucleotide
taatacgactcactatagggacactttggtctggaacaaaacattttcctaacagaggagaaggaaaatgttttgttccaacctggcggcagcgcaaaagatg

SEQ ID NO: 14103 - DNA, 103 bp, Artificial Sequence
  Synthetic Polynucleotide
taatacgactcactatagggtgacaacactttggtctggaacaaaacattaacagaggagaaatgttatgttccagaccaacctggcggcagcgcaaaagatg

SEQ ID NO: 14104 - DNA, 103 bp, Artificial Sequence
  Synthetic Polynucleotide
taatacgactcactatagggtggccatgctaaactggccattactagccaaacagaggagatggctaatgatggccagtaacctggcggcagcgcaaaagatg

SEQ ID NO: 14105 - DNA, 103 bp, Artificial Sequence
  Synthetic Polynucleotide
taatacgactcactataggggatactgacaacactttggtctggaacaaaaacagaggagatttgttatggaccaaagtaacctggcggcagcgcaaaagatg

SEQ ID NO: 14106 - DNA, 103 bp, Artificial Sequence
  Synthetic Polynucleotide
taatacgactcactatagggttgatgatactgacaacactttggtctggaaacagaggagatccagaatgaagtgttgtaacctggcggcagcgcaaaagatg

SEQ ID NO: 14107 - DNA, 103 bp, Artificial Sequence
  Synthetic Polynucleotide
taatacgactcactatagggcatgcttgatgatactgacaacactttggtaacagaggagaaccaaaatgttgtcagtaaacctggcggcagcgcaaaagatg

SEQ ID NO: 14108 - DNA, 103 bp, Artificial Sequence
  Synthetic Polynucleotide
taatacgactcactatagggaatcccatgcttgatgatactgacaacactaacagaggagaagtgttatgagtatcatcaacctggcggcagcgcaaaagatg

SEQ ID NO: 14109 - DNA, 103 bp, Artificial Sequence
  Synthetic Polynucleotide
taatacgactcactatagggtcaaaaatcccatgcttgatgatactgacaaacagaggagatgtcagatgcatcaagcaaacctggcggcagcgcaaaagatg

SEQ ID NO: 14110 - DNA, 103 bp, Artificial Sequence
  Synthetic Polynucleotide
taatacgactcactatagggctatatcaaaaatcccatgcttgatgatacaacagaggagagtatcaatgagcatgggaaacctggcggcagcgcaaaagatg

SEQ ID NO: 14111 - DNA, 103 bp, Artificial Sequence
  Synthetic Polynucleotide
taatacgactcactatagggacttgctatatcaaaaatcccatgcttgataacagaggagaatcaagatggggatttttaacctggcggcagcgcaaaagatg

SEQ ID NO: 14112 - DNA, 103 bp, Artificial Sequence
  Synthetic Polynucleotide
taatacgactcactatagggtgaacacttgctatatcaaaaatcccatgcaacagaggagagcatggatgttttgatataacctggcggcagcgcaaaagatg

SEQ ID NO: 14113 - DNA, 103 bp, Artificial Sequence
  Synthetic Polynucleotide
taatacgactcactatagggcaatgtgaacacttgctatatcaaaaatccaacagaggagaggatttatgatatagcaaaacctggcggcagcgcaaaagatg

SEQ ID NO: 14114 - DNA, 103 bp, Artificial Sequence
  Synthetic Polynucleotide
taatacgactcactatagggacaaacaatgtgaacacttgctatatcaaaaacagaggagatttgatatggcaagtgttaacctggcggcagcgcaaaagatg

SEQ ID NO: 14115 - DNA, 103 bp, Artificial Sequence
  Synthetic Polynucleotide
taatacgactcactatagggtaagctggccatgctaaactggccattactaacagaggagaagtaatatgcagtttagcaacctggcggcagcgcaaaagatg

SEQ ID NO: 14116 - DNA, 103 bp, Artificial Sequence
  Synthetic Polynucleotide
taatacgactcactatagggaagaaacaaacaatgtgaacacttgctataaacagaggagatatagcatgtgttcacataacctggcggcagcgcaaaagatg

SEQ ID NO: 14117 - DNA, 103 bp, Artificial Sequence
  Synthetic Polynucleotide
taatacgactcactatagggccacaaagaaacaaacaatgtgaacacttgaacagaggagacaagtgatgacattgtttaacctggcggcagcgcaaaagatg

SEQ ID NO: 14118 - DNA, 103 bp, Artificial Sequence
  Synthetic Polynucleotide
taatacgactcactatagggaactgccacaaagaaacaaacaatgtgaacaacagaggagagttcacatggtttgtttcaacctggcggcagcgcaaaagatg

SEQ ID NO: 14119 - DNA, 103 bp, Artificial Sequence
  Synthetic Polynucleotide
taatacgactcactatagggcccttaactgccacaaagaaacaaacaatgaacagaggagacattgtatgtttctttgtaacctggcggcagcgcaaaagatg

SEQ ID NO: 14120 - DNA, 103 bp, Artificial Sequence
  Synthetic Polynucleotide
taatacgactcactatagggtgtttcccttaactgccacaaagaaacaaaaacagaggagatttgttatgttgtggcagaacctggcggcagcgcaaaagatg

SEQ ID NO: 14121 - DNA, 103 bp, Artificial Sequence
  Synthetic Polynucleotide
taatacgactcactatagggatatgtgtttcccttaactgccacaaagaaaacagaggagattctttatggcagttaagaacctggcggcagcgcaaaagatg

SEQ ID NO: 14122 - DNA, 103 bp, Artificial Sequence
  Synthetic Polynucleotide
taatacgactcactatagggagtttatatgtgtttcccttaactgccacaaacagaggagatgtggcatgtaagggaaaaacctggcggcagcgcaaaagatg

SEQ ID NO: 14123 - DNA, 103 bp, Artificial Sequence
  Synthetic Polynucleotide
taatacgactcactatagggcaaacagtttatatgtgtttcccttaactgaacagaggagacagttaatggaaacacataacctggcggcagcgcaaaagatg

SEQ ID NO: 14124 - DNA, 103 bp, Artificial Sequence
  Synthetic Polynucleotide
taatacgactcactatagggctgttcaaacagtttatatgtgtttcccttaacagaggagaaagggaatgacatataaaaacctggcggcagcgcaaaagatg

SEQ ID NO: 14125 - DNA, 103 bp, Artificial Sequence
  Synthetic Polynucleotide
taatacgactcactatagggtttaactgttcaaacagtttatatgtgtttaacagaggagaaaacacatgtaaactgttaacctggcggcagcgcaaaagatg

SEQ ID NO: 14126 - DNA, 103 bp, Artificial Sequence
  Synthetic Polynucleotide
taatacgactcactataggggtgtgtaagctggccatgctaaactggccaaacagaggagatggccaatgtagcatggcaacctggcggcagcgcaaaagatg

SEQ ID NO: 14127 - DNA, 103 bp, Artificial Sequence
  Synthetic Polynucleotide
taatacgactcactatagggacttctttaactgttcaaacagtttatatgaacagaggagacatataatgtgtttgaacaacctggcggcagcgcaaaagatg

SEQ ID NO: 14128 - DNA, 103 bp, Artificial Sequence
  Synthetic Polynucleotide
taatacgactcactatagggaaacgacttctttaactgttcaaacagtttaacagaggagaaaactgatggaacagttaaacctggcggcagcgcaaaagatg

SEQ ID NO: 14129 - DNA, 103 bp, Artificial Sequence
  Synthetic Polynucleotide
taatacgactcactataggggactgaaacgacttctttaactgttcaaacaacagaggagagtttgaatggttaaagaaaacctggcggcagcgcaaaagatg

SEQ ID NO: 14130 - DNA, 103 bp, Artificial Sequence
  Synthetic Polynucleotide
taatacgactcactatagggatgtagactgaaacgacttctttaactgttaacagaggagaaacagtatgagaagtcgtaacctggcggcagcgcaaaagatg

SEQ ID NO: 14131 - DNA, 103 bp, Artificial Sequence
  Synthetic Polynucleotide
taatacgactcactatagggattgcatgtagactgaaacgacttctttaaaacagaggagattaaagatgtcgtttcagaacctggcggcagcgcaaaagatg

SEQ ID NO: 14132 - DNA, 103 bp, Artificial Sequence
  Synthetic Polynucleotide
taatacgactcactataggggtatcattgcatgtagactgaaacgacttcaacagaggagagaagtcatgtcagtctacaacctggcggcagcgcaaaagatg

SEQ ID NO: 14133 - DNA, 103 bp, Artificial Sequence
  Synthetic Polynucleotide
taatacgactcactatagggtatcagtatcattgcatgtagactgaaacgaacagaggagacgtttcatgctacatgcaaacctggcggcagcgcaaaagatg

SEQ ID NO: 14134 - DNA, 103 bp, Artificial Sequence
  Synthetic Polynucleotide
taatacgactcactatagggtttattatcagtatcattgcatgtagactgaacagaggagacagtctatgtgcaatgataacctggcggcagcgcaaaagatg

SEQ ID NO: 14135 - DNA, 103 bp, Artificial Sequence
  Synthetic Polynucleotide
taatacgactcactatagggtgcactttattatcagtatcattgcatgtaaacagaggagatacatgatgtgatactgaaacctggcggcagcgcaaaagatg

SEQ ID NO: 14136 - DNA, 103 bp, Artificial Sequence
  Synthetic Polynucleotide
taatacgactcactatagggatccttgcactttattatcagtatcattgcaacagaggagagcaatgatgctgataataaacctggcggcagcgcaaaagatg

SEQ ID NO: 14137 - DNA, 103 bp, Artificial Sequence
  Synthetic Polynucleotide
taatacgactcactatagggtcgtagtgtgtaagctggccatgctaaactaacagaggagaagtttaatgtggccagctaacctggcggcagcgcaaaagatg

SEQ ID NO: 14138 - DNA, 103 bp, Artificial Sequence
  Synthetic Polynucleotide
taatacgactcactataggggtaatatccttgcactttattatcagtatcaacagaggagagatactatgaataaagtgaacctggcggcagcgcaaaagatg

SEQ ID NO: 14139 - DNA, 103 bp, Artificial Sequence
  Synthetic Polynucleotide
taatacgactcactatagggcagatgtaatatccttgcactttattatcaaacagaggagatgataaatgagtgcaaggaacctggcggcagcgcaaaagatg

SEQ ID NO: 14140 - DNA, 103 bp, Artificial Sequence
  Synthetic Polynucleotide
taatacgactcactatagggcaatgcagatgtaatatccttgcactttataacagaggagaataaagatgaaggatattaacctggcggcagcgcaaaagatg

SEQ ID NO: 14141 - DNA, 103 bp, Artificial Sequence
  Synthetic Polynucleotide
taatacgactcactatagggccccacaatgcagatgtaatatccttgcacaacagaggagagtgcaaatgtattacatcaacctggcggcagcgcaaaagatg

SEQ ID NO: 14142 - DNA, 103 bp, Artificial Sequence
  Synthetic Polynucleotide
taatacgactcactatagggtttccccccacaatgcagatgtaatatcctaacagaggagaaggataatgcatctgcataacctggcggcagcgcaaaagatg

SEQ ID NO: 14143 - DNA, 103 bp, Artificial Sequence
  Synthetic Polynucleotide
taatacgactcactatagggcagagtttccccccacaatgcagatgtaataacagaggagaattacaatggcattgtggaacctggcggcagcgcaaaagatg

SEQ ID NO: 14144 - DNA, 103 bp, Artificial Sequence
  Synthetic Polynucleotide
taatacgactcactatagggtggtgcagagtttccccccacaatgcagataacagaggagaatctgcatggtggggggaaacctggcggcagcgcaaaagatg

SEQ ID NO: 14145 - DNA, 103 bp, Artificial Sequence
  Synthetic Polynucleotide
taatacgactcactatagggtatattggtgcagagtttccccccacaatgaacagaggagacattgtatggggaaactcaacctggcggcagcgcaaaagatg

SEQ ID NO: 14146 - DNA, 103 bp, Artificial Sequence
  Synthetic Polynucleotide
taatacgactcactataggggtacatatattggtgcagagtttccccccaaacagaggagatgggggatgactctgcacaacctggcggcagcgcaaaagatg

SEQ ID NO: 14147 - DNA, 103 bp, Artificial Sequence
  Synthetic Polynucleotide
taatacgactcactatagggtgttggtacatatattggtgcagagtttccaacagaggagaggaaacatggcaccaataaacctggcggcagcgcaaaagatg

SEQ ID NO: 14148 - DNA, 103 bp, Artificial Sequence
  Synthetic Polynucleotide
taatacgactcactatagggacatttcgtagtgtgtaagctggccatgctaacagaggagaagcatgatgagcttacacaacctggcggcagcgcaaaagatg

SEQ ID NO: 14149 - DNA, 103 bp, Artificial Sequence
  Synthetic Polynucleotide
taatacgactcactatagggtcaagtgttggtacatatattggtgcagagaacagaggagactctgcatgaatatatgtaacctggcggcagcgcaaaagatg

SEQ ID NO: 14150 - DNA, 103 bp, Artificial Sequence
  Synthetic Polynucleotide
taatacgactcactatagggaatcatcaagtgttggtacatatattggtgaacagaggagacaccaaatgatgtaccaaaacctggcggcagcgcaaaagatg

SEQ ID NO: 14151 - DNA, 103 bp, Artificial Sequence
  Synthetic Polynucleotide
taatacgactcactatagggcctaaaatcatcaagtgttggtacatatataacagaggagaatatatatgccaacacttaacctggcggcagcgcaaaagatg

SEQ ID NO: 14152 - DNA, 103 bp, Artificial Sequence
  Synthetic Polynucleotide
taatacgactcactatagggatggacctaaaatcatcaagtgttggtacaaacagaggagatgtaccatgacttgatgaaacctggcggcagcgcaaaagatg

SEQ ID NO: 14153 - DNA, 103 bp, Artificial Sequence
  Synthetic Polynucleotide
taatacgactcactatagggcctccatggacctaaaatcatcaagtgttgaacagaggagacaacacatgatgattttaaacctggcggcagcgcaaaagatg

SEQ ID NO: 14154 - DNA, 103 bp, Artificial Sequence
  Synthetic Polynucleotide
taatacgactcactatagggaaatgcctccatggacctaaaatcatcaagaacagaggagacttgatatgtttaggtccaacctggcggcagcgcaaaagatg

SEQ ID NO: 14155 - DNA, 103 bp, Artificial Sequence
  Synthetic Polynucleotide
taatacgactcactatagggcctgaaaatgcctccatggacctaaaatcaaacagaggagatgatttatggtccatggaaacctggcggcagcgcaaaagatg

SEQ ID NO: 14156 - DNA, 103 bp, Artificial Sequence
  Synthetic Polynucleotide
taatacgactcactatagggagatccctgaaaatgcctccatggacctaaaacagaggagattaggtatgtggaggcataacctggcggcagcgcaaaagatg

SEQ ID NO: 14157 - DNA, 103 bp, Artificial Sequence
  Synthetic Polynucleotide
taatacgactcactatagggcctaaagatccctgaaaatgcctccatggaaacagaggagatccatgatggcattttcaaacctggcggcagcgcaaaagatg

SEQ ID NO: 14158 - DNA, 103 bp, Artificial Sequence
  Synthetic Polynucleotide
taatacgactcactatagggggtgacctaaagatccctgaaaatgcctccaacagaggagaggaggcatgttcagggataacctggcggcagcgcaaaagatg

SEQ ID NO: 14159 - DNA, 103 bp, Artificial Sequence
  Synthetic Polynucleotide
taatacgactcactatagggcatacacatttcgtagtgtgtaagctggccaacagaggagaggccagatgacacactacaacctggcggcagcgcaaaagatg

SEQ ID NO: 14160 - DNA, 103 bp, Artificial Sequence
  Synthetic Polynucleotide
taatacgactcactatagggcatgtggtgacctaaagatccctgaaaatgaacagaggagacattttatgggatctttaaacctggcggcagcgcaaaagatg

SEQ ID NO: 14161 - DNA, 103 bp, Artificial Sequence
  Synthetic Polynucleotide
taatacgactcactatagggctctccatgtggtgacctaaagatccctgaaacagaggagatcagggatgtttaggtcaaacctggcggcagcgcaaaagatg

SEQ ID NO: 14162 - DNA, 103 bp, Artificial Sequence
  Synthetic Polynucleotide
taatacgactcactatagggtggtcctctccatgtggtgacctaaagatcaacagaggagagatcttatggtcaccacaaacctggcggcagcgcaaaagatg

SEQ ID NO: 14163 - DNA, 103 bp, Artificial Sequence
  Synthetic Polynucleotide
taatacgactcactataggggatcatggtcctctccatgtggtgacctaaaacagaggagattaggtatgcacatggagaacctggcggcagcgcaaaagatg

SEQ ID NO: 14164 - DNA, 103 bp, Artificial Sequence
  Synthetic Polynucleotide
taatacgactcactatagggagctagatcatggtcctctccatgtggtgaaacagaggagatcaccaatgggagaggacaacctggcggcagcgcaaaagatg

SEQ ID NO: 14165 - DNA, 103 bp, Artificial Sequence
  Synthetic Polynucleotide
taatacgactcactatagggtccccagctagatcatggtcctctccatgtaacagaggagaacatggatgggaccatgaaacctggcggcagcgcaaaagatg

SEQ ID NO: 14166 - DNA, 103 bp, Artificial Sequence
  Synthetic Polynucleotide
taatacgactcactatagggtctcttccccagctagatcatggtcctctcaacagaggagagagaggatgatgatctagaacctggcggcagcgcaaaagatg

SEQ ID NO: 14167 - DNA, 103 bp, Artificial Sequence
  Synthetic Polynucleotide
taatacgactcactatagggagcaatctcttccccagctagatcatggtcaacagaggagagaccatatgctagctgggaacctggcggcagcgcaaaagatg

SEQ ID NO: 14168 - DNA, 103 bp, Artificial Sequence
  Synthetic Polynucleotide
taatacgactcactatagggtaagaagcaatctcttccccagctagatcaaacagaggagatgatctatgtggggaagaaacctggcggcagcgcaaaagatg

SEQ ID NO: 14169 - DNA, 103 bp, Artificial Sequence
  Synthetic Polynucleotide
taatacgactcactatagggtagagtaagaagcaatctcttccccagctaaacagaggagatagctgatgaagagattgaacctggcggcagcgcaaaagatg

SEQ ID NO: 14170 - DNA, 103 bp, Artificial Sequence
  Synthetic Polynucleotide
taatacgactcactatagggcatgtcatacacatttcgtagtgtgtaagcaacagaggagagcttacatgctacgaaataacctggcggcagcgcaaaagatg

SEQ ID NO: 14171 - DNA, 103 bp, Artificial Sequence
  Synthetic Polynucleotide
taatacgactcactatagggaacaatagagtaagaagcaatctcttccccaacagaggagaggggaaatgattgcttctaacctggcggcagcgcaaaagatg

SEQ ID NO: 14172 - DNA, 103 bp, Artificial Sequence
  Synthetic Polynucleotide
taatacgactcactatagggggtccaacaatagagtaagaagcaatctctaacagaggagaagagatatgttcttactcaacctggcggcagcgcaaaagatg

SEQ ID NO: 14173 - DNA, 103 bp, Artificial Sequence
  Synthetic Polynucleotide
taatacgactcactatagggtggcaggtccaacaatagagtaagaagcaaaacagaggagattgcttatgactctattgaacctggcggcagcgcaaaagatg

SEQ ID NO: 14174 - DNA, 103 bp, Artificial Sequence
  Synthetic Polynucleotide
taatacgactcactatagggtgcattggcaggtccaacaatagagtaagaaacagaggagatcttacatgattgttggaaacctggcggcagcgcaaaagatg

SEQ ID NO: 14175 - DNA, 103 bp, Artificial Sequence
  Synthetic Polynucleotide
taatacgactcactatagggacttttgcattggcaggtccaacaatagagaacagaggagactctatatgtggacctgcaacctggcggcagcgcaaaagatg

SEQ ID NO: 14176 - DNA, 103 bp, Artificial Sequence
  Synthetic Polynucleotide
taatacgactcactataggggaggcacttttgcattggcaggtccaacaaaacagaggagattgttgatgctgccaatgaacctggcggcagcgcaaaagatg

SEQ ID NO: 14177 - DNA, 103 bp, Artificial Sequence
  Synthetic Polynucleotide
taatacgactcactatagggactgtgaggcacttttgcattggcaggtccaacagaggagaggacctatgaatgcaaaaaacctggcggcagcgcaaaagatg

SEQ ID NO: 14178 - DNA, 103 bp, Artificial Sequence
  Synthetic Polynucleotide
taatacgactcactatagggctagcactgtgaggcacttttgcattggcaaacagaggagatgccaaatgaaaagtgccaacctggcggcagcgcaaaagatg

SEQ ID NO: 14179 - DNA, 103 bp, Artificial Sequence
  Synthetic Polynucleotide
taatacgactcactatagggctgagctagcactgtgaggcacttttgcataacagaggagaatgcaaatgtgcctcacaaacctggcggcagcgcaaaagatg

SEQ ID NO: 14180 - DNA, 103 bp, Artificial Sequence
  Synthetic Polynucleotide
taatacgactcactatagggtgtgtctgagctagcactgtgaggcactttaacagaggagaaaagtgatgcacagtgctaacctggcggcagcgcaaaagatg

SEQ ID NO: 14181 - DNA, 103 bp, Artificial Sequence
  Synthetic Polynucleotide
taatacgactcactatagggattttcatgtcatacacatttcgtagtgtgaacagaggagacacactatgaaatgtgtaaacctggcggcagcgcaaaagatg

SEQ ID NO: 14182 - DNA, 103 bp, Artificial Sequence
  Synthetic Polynucleotide
taatacgactcactatagggcttaatgtgtctgagctagcactgtgaggcaacagaggagagcctcaatgtgctagctcaacctggcggcagcgcaaaagatg

SEQ ID NO: 14183 - DNA, 103 bp, Artificial Sequence
  Synthetic Polynucleotide
taatacgactcactatagggttaggcttaatgtgtctgagctagcactgtaacagaggagaacagtgatggctcagacaaacctggcggcagcgcaaaagatg

SEQ ID NO: 14184 - DNA, 103 bp, Artificial Sequence
  Synthetic Polynucleotide
taatacgactcactatagggggcaattaggcttaatgtgtctgagctagcaacagaggagagctagcatggacacattaaacctggcggcagcgcaaaagatg

SEQ ID NO: 14185 - DNA, 103 bp, Artificial Sequence
  Synthetic Polynucleotide
taatacgactcactataggggaataggcaattaggcttaatgtgtctgagaacagaggagactcagaatgattaagcctaacctggcggcagcgcaaaagatg

SEQ ID NO: 14186 - DNA, 103 bp, Artificial Sequence
  Synthetic Polynucleotide
taatacgactcactatagggtacctgaataggcaattaggcttaatgtgtaacagaggagaacacatatggcctaattgaacctggcggcagcgcaaaagatg

SEQ ID NO: 14187 - DNA, 103 bp, Artificial Sequence
  Synthetic Polynucleotide
taatacgactcactatagggtggtatacctgaataggcaattaggcttaaaacagaggagattaagcatgattgcctataacctggcggcagcgcaaaagatg

SEQ ID NO: 14188 - DNA, 103 bp, Artificial Sequence
  Synthetic Polynucleotide
taatacgactcactatagggtaggatggtatacctgaataggcaattaggaacagaggagacctaatatgctattcaggaacctggcggcagcgcaaaagatg

SEQ ID NO: 14189 - DNA, 103 bp, Artificial Sequence
  Synthetic Polynucleotide
taatacgactcactatagggaagaataggatggtatacctgaataggcaaaacagaggagattgcctatgcaggtatacaacctggcggcagcgcaaaagatg

SEQ ID NO: 14190 - DNA, 103 bp, Artificial Sequence
  Synthetic Polynucleotide
taatacgactcactataggggagtgaagaataggatggtatacctgaataaacagaggagatattcaatgataccatccaacctggcggcagcgcaaaagatg

SEQ ID NO: 14191 - DNA, 103 bp, Artificial Sequence
  Synthetic Polynucleotide
taatacgactcactatagggatgctgagtgaagaataggatggtatacctaacagaggagaaggtatatgatcctattcaacctggcggcagcgcaaaagatg

SEQ ID NO: 14192 - DNA, 103 bp, Artificial Sequence
  Synthetic Polynucleotide
taatacgactcactatagggtgattgactgctttcttttgcggagtctacaacagaggagagtagacatggcaaaagaaaacctggcggcagcgcaaaagatg

SEQ ID NO: 14193 - DNA, 103 bp, Artificial Sequence
  Synthetic Polynucleotide
taatacgactcactatagggactcaattttcatgtcatacacatttcgtaaacagaggagatacgaaatgtgtatgacaaacctggcggcagcgcaaaagatg

SEQ ID NO: 14194 - DNA, 103 bp, Artificial Sequence
  Synthetic Polynucleotide
taatacgactcactatagggcaaggatgctgagtgaagaataggatggtaaacagaggagataccatatgattcttcacaacctggcggcagcgcaaaagatg

SEQ ID NO: 14195 - DNA, 103 bp, Artificial Sequence
  Synthetic Polynucleotide
taatacgactcactataggggcctgcaaggatgctgagtgaagaataggaaacagaggagatcctatatgtcactcagcaacctggcggcagcgcaaaagatg

SEQ ID NO: 14196 - DNA, 103 bp, Artificial Sequence
  Synthetic Polynucleotide
taatacgactcactataggggttgagcctgcaaggatgctgagtgaagaaaacagaggagattcttcatgcagcatcctaacctggcggcagcgcaaaagatg

SEQ ID NO: 14197 - DNA, 103 bp, Artificial Sequence
  Synthetic Polynucleotide
taatacgactcactatagggcttctgttgagcctgcaaggatgctgagtgaacagaggagacactcaatgtccttgcagaacctggcggcagcgcaaaagatg

SEQ ID NO: 14198 - DNA, 103 bp, Artificial Sequence
  Synthetic Polynucleotide
taatacgactcactatagggcttagcttctgttgagcctgcaaggatgctaacagaggagaagcatcatggcaggctcaaacctggcggcagcgcaaaagatg

SEQ ID NO: 14199 - DNA, 103 bp, Artificial Sequence
  Synthetic Polynucleotide
taatacgactcactatagggacatgcttagcttctgttgagcctgcaaggaacagaggagaccttgcatgctcaacagaaacctggcggcagcgcaaaagatg

SEQ ID NO: 14200 - DNA, 103 bp, Artificial Sequence
  Synthetic Polynucleotide
taatacgactcactatagggtaaatacatgcttagcttctgttgagcctgaacagaggagacaggctatgcagaagctaaacctggcggcagcgcaaaagatg

SEQ ID NO: 14201 - DNA, 103 bp, Artificial Sequence
  Synthetic Polynucleotide
taatacgactcactatagggagggctaaatacatgcttagcttctgttgaaacagaggagatcaacaatggctaagcataacctggcggcagcgcaaaagatg

SEQ ID NO: 14202 - DNA, 103 bp, Artificial Sequence
  Synthetic Polynucleotide
taatacgactcactatagggaaaccagggctaaatacatgcttagcttctaacagaggagaagaagcatggcatgtattaacctggcggcagcgcaaaagatg

SEQ ID NO: 14203 - DNA, 103 bp, Artificial Sequence
  Synthetic Polynucleotide
taatacgactcactataggggaaaaaaaccagggctaaatacatgcttagaacagaggagactaagcatgtatttagccaacctggcggcagcgcaaaagatg

SEQ ID NO: 14204 - DNA, 103 bp, Artificial Sequence
  Synthetic Polynucleotide
taatacgactcactatagggagggcactcaattttcatgtcatacacattaacagaggagaaatgtgatggacatgaaaaacctggcggcagcgcaaaagatg

SEQ ID NO: 14205 - DNA, 103 bp, Artificial Sequence
  Synthetic Polynucleotide
taatacgactcactatagggctgtggaaaaaaaccagggctaaatacatgaacagaggagacatgtaatgagccctggtaacctggcggcagcgcaaaagatg

SEQ ID NO: 14206 - DNA, 103 bp, Artificial Sequence
  Synthetic Polynucleotide
taatacgactcactatagggttaagctgtggaaaaaaaccagggctaaataacagaggagaatttagatgtggttttttaacctggcggcagcgcaaaagatg

SEQ ID NO: 14207 - DNA, 103 bp, Artificial Sequence
  Synthetic Polynucleotide
taatacgactcactatagggtgtgattaagctgtggaaaaaaaccagggcaacagaggagagccctgatgtttttccacaacctggcggcagcgcaaaagatg

SEQ ID NO: 14208 - DNA, 103 bp, Artificial Sequence
  Synthetic Polynucleotide
taatacgactcactatagggcttcgtgtgattaagctgtggaaaaaaaccaacagaggagaggttttatgccacagcttaacctggcggcagcgcaaaagatg

SEQ ID NO: 14209 - DNA, 103 bp, Artificial Sequence
  Synthetic Polynucleotide
taatacgactcactatagggtcacacttcgtgtgattaagctgtggaaaaaacagaggagattttccatggcttaatcaaacctggcggcagcgcaaaagatg

SEQ ID NO: 14210 - DNA, 103 bp, Artificial Sequence
  Synthetic Polynucleotide
taatacgactcactatagggtcttgtcacacttcgtgtgattaagctgtgaacagaggagacacagcatgatcacacgaaacctggcggcagcgcaaaagatg

SEQ ID NO: 14211 - DNA, 103 bp, Artificial Sequence
  Synthetic Polynucleotide
taatacgactcactatagggagcagtcttgtcacacttcgtgtgattaagaacagaggagacttaatatgacgaagtgtaacctggcggcagcgcaaaagatg

SEQ ID NO: 14212 - DNA, 103 bp, Artificial Sequence
  Synthetic Polynucleotide
taatacgactcactataggggggatagcagtcttgtcacacttcgtgtgaaacagaggagatcacacatggtgtgacaaaacctggcggcagcgcaaaagatg

SEQ ID NO: 14213 - DNA, 103 bp, Artificial Sequence
  Synthetic Polynucleotide
taatacgactcactatagggtgagtgggatagcagtcttgtcacacttcgaacagaggagacgaagtatgacaagactgaacctggcggcagcgcaaaagatg

SEQ ID NO: 14214 - DNA, 103 bp, Artificial Sequence
  Synthetic Polynucleotide
taatacgactcactatagggccaagtgagtgggatagcagtcttgtcacaaacagaggagatgtgacatgactgctatcaacctggcggcagcgcaaaagatg

SEQ ID NO: 14215 - DNA, 103 bp, Artificial Sequence
  Synthetic Polynucleotide
taatacgactcactataggggtgtgagggcactcaattttcatgtcatacaacagaggagagtatgaatggaaaattgaaacctggcggcagcgcaaaagatg

SEQ ID NO: 14216 - DNA, 103 bp, Artificial Sequence
  Synthetic Polynucleotide
taatacgactcactatagggcctgtccaagtgagtgggatagcagtcttgaacagaggagacaagacatgtatcccactaacctggcggcagcgcaaaagatg

SEQ ID NO: 14217 - DNA, 103 bp, Artificial Sequence
  Synthetic Polynucleotide
taatacgactcactatagggtcatccctgtccaagtgagtgggatagcagaacagaggagactgctaatgcactcacttaacctggcggcagcgcaaaagatg

SEQ ID NO: 14218 - DNA, 103 bp, Artificial Sequence
  Synthetic Polynucleotide
taatacgactcactataggggtcaatcatccctgtccaagtgagtgggataacagaggagaatcccaatgacttggacaaacctggcggcagcgcaaaagatg

SEQ ID NO: 14219 - DNA, 103 bp, Artificial Sequence
  Synthetic Polynucleotide
taatacgactcactatagggggcaagtcaatcatccctgtccaagtgagtaacagaggagaactcacatggacagggataacctggcggcagcgcaaaagatg

SEQ ID NO: 14220 - DNA, 103 bp, Artificial Sequence
  Synthetic Polynucleotide
taatacgactcactatagggacccaggcaagtcaatcatccctgtccaagaacagaggagacttggaatgggatgattgaacctggcggcagcgcaaaagatg

SEQ ID NO: 14221 - DNA, 103 bp, Artificial Sequence
  Synthetic Polynucleotide
taatacgactcactatagggatagtacccaggcaagtcaatcatccctgtaacagaggagaacagggatgattgacttgaacctggcggcagcgcaaaagatg

SEQ ID NO: 14222 - DNA, 103 bp, Artificial Sequence
  Synthetic Polynucleotide
taatacgactcactataggggcctcatagtacccaggcaagtcaatcatcaacagaggagagatgatatgcttgcctggaacctggcggcagcgcaaaagatg

SEQ ID NO: 14223 - DNA, 103 bp, Artificial Sequence
  Synthetic Polynucleotide
taatacgactcactataggggtatagcctcatagtacccaggcaagtcaaaacagaggagattgactatgctgggtactaacctggcggcagcgcaaaagatg

SEQ ID NO: 14224 - DNA, 103 bp, Artificial Sequence
  Synthetic Polynucleotide
taatacgactcactatagggaggatgtatagcctcatagtacccaggcaaaacagaggagattgcctatgtactatgagaacctggcggcagcgcaaaagatg

SEQ ID NO: 14225 - DNA, 103 bp, Artificial Sequence
  Synthetic Polynucleotide
taatacgactcactataggggtacaaggatgtatagcctcatagtacccaaacagaggagatgggtaatgtgaggctataacctggcggcagcgcaaaagatg

SEQ ID NO: 14226 - DNA, 103 bp, Artificial Sequence
  Synthetic Polynucleotide
taatacgactcactatagggtgactgtgtgagggcactcaattttcatgtaacagaggagaacatgaatgttgagtgccaacctggcggcagcgcaaaagatg

SEQ ID NO: 14227 - DNA, 103 bp, Artificial Sequence
  Synthetic Polynucleotide
taatacgactcactatagggaaactgtacaaggatgtatagcctcatagtaacagaggagaactatgatgctatacatcaacctggcggcagcgcaaaagatg

SEQ ID NO: 14228 - DNA, 103 bp, Artificial Sequence
  Synthetic Polynucleotide
taatacgactcactatagggacagaaaactgtacaaggatgtatagcctcaacagaggagagaggctatgcatccttgtaacctggcggcagcgcaaaagatg

SEQ ID NO: 14229 - DNA, 103 bp, Artificial Sequence
  Synthetic Polynucleotide
taatacgactcactatagggaaaacacagaaaactgtacaaggatgtataaacagaggagatatacaatgttgtacagtaacctggcggcagcgcaaaagatg

SEQ ID NO: 14230 - DNA, 103 bp, Artificial Sequence
  Synthetic Polynucleotide
taatacgactcactatagggctgataaaacacagaaaactgtacaaggataacagaggagaatccttatgcagttttctaacctggcggcagcgcaaaagatg

SEQ ID NO: 14231 - DNA, 103 bp, Artificial Sequence
  Synthetic Polynucleotide
taatacgactcactatagggggggcctgataaaacacagaaaactgtacaaacagaggagatgtacaatgttctgtgttaacctggcggcagcgcaaaagatg

SEQ ID NO: 14232 - DNA, 103 bp, Artificial Sequence
  Synthetic Polynucleotide
taatacgactcactataggggccccggggcctgataaaacacagaaaactaacagaggagaagttttatgtgttttatcaacctggcggcagcgcaaaagatg

SEQ ID NO: 14233 - DNA, 103 bp, Artificial Sequence
  Synthetic Polynucleotide
taatacgactcactatagggaggatgccccggggcctgataaaacacagaaacagaggagatctgtgatgtatcaggccaacctggcggcagcgcaaaagatg

SEQ ID NO: 14234 - DNA, 103 bp, Artificial Sequence
  Synthetic Polynucleotide
taatacgactcactatagggttcacaggatgccccggggcctgataaaacaacagaggagagttttaatgggccccgggaacctggcggcagcgcaaaagatg

SEQ ID NO: 14235 - DNA, 103 bp, Artificial Sequence
  Synthetic Polynucleotide
taatacgactcactatagggaatgcttcacaggatgccccggggcctgataacagaggagaatcaggatgcggggcatcaacctggcggcagcgcaaaagatg

SEQ ID NO: 14236 - DNA, 103 bp, Artificial Sequence
  Synthetic Polynucleotide
taatacgactcactatagggcagagaatgcttcacaggatgccccggggcaacagaggagagccccgatgcatcctgtgaacctggcggcagcgcaaaagatg

SEQ ID NO: 14237 - DNA, 103 bp, Artificial Sequence
  Synthetic Polynucleotide
taatacgactcactatagggaaagctgactgtgtgagggcactcaattttaacagaggagaaaaattatgtgccctcacaacctggcggcagcgcaaaagatg

SEQ ID NO: 14238 - DNA, 103 bp, Artificial Sequence
  Synthetic Polynucleotide
taatacgactcactatagggaccttcagagaatgcttcacaggatgccccaacagaggagaggggcaatgtgtgaagcaaacctggcggcagcgcaaaagatg

SEQ ID NO: 14239 - DNA, 103 bp, Artificial Sequence
  Synthetic Polynucleotide
taatacgactcactatagggatcccaccttcagagaatgcttcacaggataacagaggagaatcctgatgagcattctcaacctggcggcagcgcaaaagatg

SEQ ID NO: 14240 - DNA, 103 bp, Artificial Sequence
  Synthetic Polynucleotide
taatacgactcactatagggtgaagatcccaccttcagagaatgcttcacaacagaggagagtgaagatgtctctgaagaacctggcggcagcgcaaaagatg

SEQ ID NO: 14241 - DNA, 103 bp, Artificial Sequence
  Synthetic Polynucleotide
taatacgactcactatagggtatgttgaagatcccaccttcagagaatgcaacagaggagagcattcatggaaggtgggaacctggcggcagcgcaaaagatg

SEQ ID NO: 14242 - DNA, 103 bp, Artificial Sequence
  Synthetic Polynucleotide
taatacgactcactataggggatgttatgttgaagatcccaccttcagagaacagaggagactctgaatgtgggatcttaacctggcggcagcgcaaaagatg

SEQ ID NO: 14243 - DNA, 103 bp, Artificial Sequence
  Synthetic Polynucleotide
taatacgactcactatagggtaggggatgttatgttgaagatcccaccttaacagaggagaaaggtgatgtcttcaacaaacctggcggcagcgcaaaagatg

SEQ ID NO: 14244 - DNA, 103 bp, Artificial Sequence
  Synthetic Polynucleotide
taatacgactcactataggggcacataggggatgttatgttgaagatcccaacagaggagagggatcatgaacataacaaacctggcggcagcgcaaaagatg

SEQ ID NO: 14245 - DNA, 103 bp, Artificial Sequence
  Synthetic Polynucleotide
taatacgactcactatagggactaagcacataggggatgttatgttgaagaacagaggagacttcaaatgaacatccccaacctggcggcagcgcaaaagatg

SEQ ID NO: 14246 - DNA, 103 bp, Artificial Sequence
  Synthetic Polynucleotide
taatacgactcactatagggttgatactaagcacataggggatgttatgtaacagaggagaacataaatgcccctatgtaacctggcggcagcgcaaaagatg

SEQ ID NO: 14247 - DNA, 103 bp, Artificial Sequence
  Synthetic Polynucleotide
taatacgactcactatagggttgttttgatactaagcacataggggatgtaacagaggagaacatccatgatgtgcttaaacctggcggcagcgcaaaagatg

SEQ ID NO: 14248 - DNA, 103 bp, Artificial Sequence
  Synthetic Polynucleotide
taatacgactcactatagggtcaccaaagctgactgtgtgagggcactcaaacagaggagatgagtgatgtcacacagtaacctggcggcagcgcaaaagatg

SEQ ID NO: 14249 - DNA, 103 bp, Artificial Sequence
  Synthetic Polynucleotide
taatacgactcactatagggcgattttgttttgatactaagcacatagggaacagaggagaccctatatgcttagtatcaacctggcggcagcgcaaaagatg

SEQ ID NO: 14250 - DNA, 103 bp, Artificial Sequence
  Synthetic Polynucleotide
taatacgactcactatagggggaatcgattttgttttgatactaagcacaaacagaggagatgtgctatgtatcaaaacaacctggcggcagcgcaaaagatg

SEQ ID NO: 14251 - DNA, 103 bp, Artificial Sequence
  Synthetic Polynucleotide
taatacgactcactatagggcaaccggaatcgattttgttttgatactaaaacagaggagattagtaatgaaacaaaataacctggcggcagcgcaaaagatg

SEQ ID NO: 14252 - DNA, 103 bp, Artificial Sequence
  Synthetic Polynucleotide
taatacgactcactatagggtctgtcaaccggaatcgattttgttttgataacagaggagaatcaaaatgaaatcgattaacctggcggcagcgcaaaagatg

SEQ ID NO: 14253 - DNA, 103 bp, Artificial Sequence
  Synthetic Polynucleotide
taatacgactcactataggggctgctctgtcaaccggaatcgattttgttaacagaggagaaacaaaatggattccggtaacctggcggcagcgcaaaagatg

SEQ ID NO: 14254 - DNA, 103 bp, Artificial Sequence
  Synthetic Polynucleotide
taatacgactcactatagggtacttgctgctctgtcaaccggaatcgattaacagaggagaaatcgaatgcggttgacaaacctggcggcagcgcaaaagatg

SEQ ID NO: 14255 - DNA, 103 bp, Artificial Sequence
  Synthetic Polynucleotide
taatacgactcactatagggaagtttacttgctgctctgtcaaccggaataacagaggagaattccgatggacagagcaaacctggcggcagcgcaaaagatg

SEQ ID NO: 14256 - DNA, 103 bp, Artificial Sequence
  Synthetic Polynucleotide
taatacgactcactatagggagacaaagtttacttgctgctctgtcaaccaacagaggagaggttgaatgagcagcaagaacctggcggcagcgcaaaagatg

SEQ ID NO: 14257 - DNA, 103 bp, Artificial Sequence
  Synthetic Polynucleotide
taatacgactcactatagggttgacagacaaagtttacttgctgctctgtaacagaggagaacagagatgcaagtaaacaacctggcggcagcgcaaaagatg

SEQ ID NO: 14258 - DNA, 103 bp, Artificial Sequence
  Synthetic Polynucleotide
taatacgactcactatagggaccctttgacagacaaagtttacttgctgcaacagaggagagcagcaatgaaactttgtaacctggcggcagcgcaaaagatg

SEQ ID NO: 14259 - DNA, 103 bp, Artificial Sequence
  Synthetic Polynucleotide
taatacgactcactatagggtgttttcaccaaagctgactgtgtgagggcaacagaggagagccctcatgcagtcagctaacctggcggcagcgcaaaagatg

SEQ ID NO: 14260 - DNA, 103 bp, Artificial Sequence
  Synthetic Polynucleotide
taatacgactcactatagggtatcaaccctttgacagacaaagtttacttaacagaggagaaagtaaatgttgtctgtcaacctggcggcagcgcaaaagatg

SEQ ID NO: 14261 - DNA, 103 bp, Artificial Sequence
  Synthetic Polynucleotide
taatacgactcactatagggatccatatcaaccctttgacagacaaagttaacagaggagaaactttatgtgtcaaaggaacctggcggcagcgcaaaagatg

SEQ ID NO: 14262 - DNA, 103 bp, Artificial Sequence
  Synthetic Polynucleotide
taatacgactcactatagggataatatccatatcaaccctttgacagacaaacagaggagatgtctgatgaagggttgaaacctggcggcagcgcaaaagatg

SEQ ID NO: 14263 - DNA, 103 bp, Artificial Sequence
  Synthetic Polynucleotide
taatacgactcactatagggacacaataatatccatatcaaccctttgacaacagaggagagtcaaaatgttgatatggaacctggcggcagcgcaaaagatg

SEQ ID NO: 14264 - DNA, 103 bp, Artificial Sequence
  Synthetic Polynucleotide
taatacgactcactatagggacaatacacaataatatccatatcaaccctaacagaggagaagggttatgatggatattaacctggcggcagcgcaaaagatg

SEQ ID NO: 14265 - DNA, 103 bp, Artificial Sequence
  Synthetic Polynucleotide
taatacgactcactatagggccattacaatacacaataatatccatatcaaacagaggagatgatatatgtattattgtaacctggcggcagcgcaaaagatg

SEQ ID NO: 14266 - DNA, 103 bp, Artificial Sequence
  Synthetic Polynucleotide
taatacgactcactatagggtctggccattacaatacacaataatatccaaacagaggagatggataatgttgtgtattaacctggcggcagcgcaaaagatg

SEQ ID NO: 14267 - DNA, 103 bp, Artificial Sequence
  Synthetic Polynucleotide
taatacgactcactatagggtttcctctggccattacaatacacaataataacagaggagaattattatgtattgtaataacctggcggcagcgcaaaagatg

SEQ ID NO: 14268 - DNA, 103 bp, Artificial Sequence
  Synthetic Polynucleotide
taatacgactcactatagggatcactttcctctggccattacaatacacaaacagaggagatgtgtaatgtaatggccaaacctggcggcagcgcaaaagatg

SEQ ID NO: 14269 - DNA, 103 bp, Artificial Sequence
  Synthetic Polynucleotide
taatacgactcactatagggttaatatcactttcctctggccattacaataacagaggagaattgtaatggccagaggaaacctggcggcagcgcaaaagatg

SEQ ID NO: 14270 - DNA, 103 bp, Artificial Sequence
  Synthetic Polynucleotide
taatacgactcactatagggcacgctgttttcaccaaagctgactgtgtgaacagaggagacacacaatgagctttggtaacctggcggcagcgcaaaagatg

SEQ ID NO: 14271 - DNA, 103 bp, Artificial Sequence
  Synthetic Polynucleotide
taatacgactcactatagggttttgttaatatcactttcctctggccattaacagaggagaaatggcatgaggaaagtgaacctggcggcagcgcaaaagatg

SEQ ID NO: 14272 - DNA, 103 bp, Artificial Sequence
  Synthetic Polynucleotide
taatacgactcactatagggaaagtttttgttaatatcactttcctctggaacagaggagaccagagatgagtgatattaacctggcggcagcgcaaaagatg

SEQ ID NO: 14273 - DNA, 103 bp, Artificial Sequence
  Synthetic Polynucleotide
taatacgactcactatagggtgactaaagtttttgttaatatcactttccaacagaggagaggaaagatgtattaacaaaacctggcggcagcgcaaaagatg

SEQ ID NO: 14274 - DNA, 103 bp, Artificial Sequence
  Synthetic Polynucleotide
taatacgactcactatagggtcctatgactaaagtttttgttaatatcacaacagaggagagtgataatgacaaaaactaacctggcggcagcgcaaaagatg

SEQ ID NO: 14275 - DNA, 103 bp, Artificial Sequence
  Synthetic Polynucleotide
taatacgactcactatagggcactgtcctatgactaaagtttttgttaataacagaggagaattaacatgaactttagtaacctggcggcagcgcaaaagatg

SEQ ID NO: 14276 - DNA, 103 bp, Artificial Sequence
  Synthetic Polynucleotide
taatacgactcactatagggatatacactgtcctatgactaaagtttttgaacagaggagacaaaaaatgtagtcatagaacctggcggcagcgcaaaagatg

SEQ ID NO: 14277 - DNA, 103 bp, Artificial Sequence
  Synthetic Polynucleotide
taatacgactcactatagggagtatatatacactgtcctatgactaaagtaacagaggagaactttaatgataggacagaacctggcggcagcgcaaaagatg

SEQ ID NO: 14278 - DNA, 103 bp, Artificial Sequence
  Synthetic Polynucleotide
taatacgactcactataggggttatagtatatatacactgtcctatgactaacagaggagaagtcatatgacagtgtataacctggcggcagcgcaaaagatg

SEQ ID NO: 14279 - DNA, 103 bp, Artificial Sequence
  Synthetic Polynucleotide
taatacgactcactatagggaacttgttatagtatatatacactgtcctaaacagaggagataggacatggtatatataaacctggcggcagcgcaaaagatg

SEQ ID NO: 14280 - DNA, 103 bp, Artificial Sequence
  Synthetic Polynucleotide
taatacgactcactatagggaaataaacttgttatagtatatatacactgaacagaggagacagtgtatgtatactataaacctggcggcagcgcaaaagatg

SEQ ID NO: 14281 - DNA, 103 bp, Artificial Sequence
  Synthetic Polynucleotide
taatacgactcactatagggcctatcacgctgttttcaccaaagctgactaacagaggagaagtcagatgtggtgaaaaaacctggcggcagcgcaaaagatg

SEQ ID NO: 14282 - DNA, 103 bp, Artificial Sequence
  Synthetic Polynucleotide
taatacgactcactatagggagtgaaaataaacttgttatagtatatataaacagaggagatatataatgtataacaagaacctggcggcagcgcaaaagatg

SEQ ID NO: 14283 - DNA, 103 bp, Artificial Sequence
  Synthetic Polynucleotide
taatacgactcactataggggcagtagtgaaaataaacttgttatagtataacagaggagaatactaatgcaagtttataacctggcggcagcgcaaaagatg

SEQ ID NO: 14284 - DNA, 103 bp, Artificial Sequence
  Synthetic Polynucleotide
taatacgactcactatagggcccaggcagtagtgaaaataaacttgttataacagaggagaataacaatgttattttcaaacctggcggcagcgcaaaagatg

SEQ ID NO: 14285 - DNA, 103 bp, Artificial Sequence
  Synthetic Polynucleotide
taatacgactcactataggggctaccccaggcagtagtgaaaataaacttaacagaggagaaagtttatgttcactactaacctggcggcagcgcaaaagatg

SEQ ID NO: 14286 - DNA, 103 bp, Artificial Sequence
  Synthetic Polynucleotide
taatacgactcactatagggagtgtgctaccccaggcagtagtgaaaataaacagaggagatattttatgtactgcctgaacctggcggcagcgcaaaagatg

SEQ ID NO: 14287 - DNA, 103 bp, Artificial Sequence
  Synthetic Polynucleotide
taatacgactcactatagggaatagagtgtgctaccccaggcagtagtgaaacagaggagatcactaatgcctggggtaaacctggcggcagcgcaaaagatg

SEQ ID NO: 14288 - DNA, 103 bp, Artificial Sequence
  Synthetic Polynucleotide
taatacgactcactatagggacagcaatagagtgtgctaccccaggcagtaacagaggagaactgccatgggtagcacaaacctggcggcagcgcaaaagatg

SEQ ID NO: 14289 - DNA, 103 bp, Artificial Sequence
  Synthetic Polynucleotide
taatacgactcactataggggttcaacagcaatagagtgtgctaccccagaacagaggagactggggatgcacactctaaacctggcggcagcgcaaaagatg

SEQ ID NO: 14290 - DNA, 103 bp, Artificial Sequence
  Synthetic Polynucleotide
taatacgactcactatagggacatagttcaacagcaatagagtgtgctacaacagaggagagtagcaatgtctattgctaacctggcggcagcgcaaaagatg

SEQ ID NO: 14291 - DNA, 103 bp, Artificial Sequence
  Synthetic Polynucleotide
taatacgactcactatagggggcacacatagttcaacagcaatagagtgtaacagaggagaacactcatgtgctgttgaaacctggcggcagcgcaaaagatg

SEQ ID NO: 14292 - DNA, 103 bp, Artificial Sequence
  Synthetic Polynucleotide
taatacgactcactatagggcataacctatcacgctgttttcaccaaagcaacagaggagagctttgatgaaaacagcgaacctggcggcagcgcaaaagatg

SEQ ID NO: 14293 - DNA, 103 bp, Artificial Sequence
  Synthetic Polynucleotide
taatacgactcactatagggacccaggcacacatagttcaacagcaatagaacagaggagactattgatgttgaactataacctggcggcagcgcaaaagatg

SEQ ID NO: 14294 - DNA, 103 bp, Artificial Sequence
  Synthetic Polynucleotide
taatacgactcactatagggatggaacccaggcacacatagttcaacagcaacagaggagagctgttatgctatgtgtgaacctggcggcagcgcaaaagatg

SEQ ID NO: 14295 - DNA, 103 bp, Artificial Sequence
  Synthetic Polynucleotide
taatacgactcactatagggcaaccatggaacccaggcacacatagttcaaacagaggagatgaactatgtgtgcctggaacctggcggcagcgcaaaagatg

SEQ ID NO: 14296 - DNA, 103 bp, Artificial Sequence
  Synthetic Polynucleotide
taatacgactcactatagggtagcccaaccatggaacccaggcacacataaacagaggagatatgtgatgctgggttccaacctggcggcagcgcaaaagatg

SEQ ID NO: 14297 - DNA, 103 bp, Artificial Sequence
  Synthetic Polynucleotide
taatacgactcactatagggagctgtagcccaaccatggaacccaggcacaacagaggagagtgcctatgttccatggtaacctggcggcagcgcaaaagatg

SEQ ID NO: 14298 - DNA, 103 bp, Artificial Sequence
  Synthetic Polynucleotide
taatacgactcactatagggagggcagctgtagcccaaccatggaacccaaacagaggagatgggttatgtggttgggcaacctggcggcagcgcaaaagatg

SEQ ID NO: 14299 - DNA, 103 bp, Artificial Sequence
  Synthetic Polynucleotide
taatacgactcactatagggcaagtagggcagctgtagcccaaccatggaaacagaggagatccatgatggggctacagaacctggcggcagcgcaaaagatg

SEQ ID NO: 14300 - DNA, 103 bp, Artificial Sequence
  Synthetic Polynucleotide
taatacgactcactatagggtgtgacaagtagggcagctgtagcccaaccaacagaggagaggttggatgacagctgccaacctggcggcagcgcaaaagatg

SEQ ID NO: 14301 - DNA, 103 bp, Artificial Sequence
  Synthetic Polynucleotide
taatacgactcactatagggcaaaatgtgacaagtagggcagctgtagccaacagaggagaggctacatgtgccctactaacctggcggcagcgcaaaagatg

SEQ ID NO: 14302 - DNA, 103 bp, Artificial Sequence
  Synthetic Polynucleotide
taatacgactcactatagggcaaaacaaaatgtgacaagtagggcagctgaacagaggagacagctgatgtacttgtcaaacctggcggcagcgcaaaagatg

SEQ ID NO: 14303 - DNA, 103 bp, Artificial Sequence
  Synthetic Polynucleotide
taatacgactcactataggggttgctgattgactgctttcttttgcggagaacagaggagactccgcatgagaaagcagaacctggcggcagcgcaaaagatg

SEQ ID NO: 14304 - DNA, 103 bp, Artificial Sequence
  Synthetic Polynucleotide
taatacgactcactatagggttccacataacctatcacgctgttttcaccaacagaggagaggtgaaatgagcgtgataaacctggcggcagcgcaaaagatg

SEQ ID NO: 14305 - DNA, 103 bp, Artificial Sequence
  Synthetic Polynucleotide
taatacgactcactatagggccatccaaaacaaaatgtgacaagtagggcaacagaggagagccctaatggtcacatttaacctggcggcagcgcaaaagatg

SEQ ID NO: 14306 - DNA, 103 bp, Artificial Sequence
  Synthetic Polynucleotide
taatacgactcactatagggagaacccatccaaaacaaaatgtgacaagtaacagaggagaacttgtatgattttgtttaacctggcggcagcgcaaaagatg

SEQ ID NO: 14307 - DNA, 103 bp, Artificial Sequence
  Synthetic Polynucleotide
taatacgactcactataggggtataagaacccatccaaaacaaaatgtgaaacagaggagatcacatatggttttggataacctggcggcagcgcaaaagatg

SEQ ID NO: 14308 - DNA, 103 bp, Artificial Sequence
  Synthetic Polynucleotide
taatacgactcactatagggtgctggtataagaacccatccaaaacaaaaaacagaggagattttgtatgggatgggttaacctggcggcagcgcaaaagatg

SEQ ID NO: 14309 - DNA, 103 bp, Artificial Sequence
  Synthetic Polynucleotide
taatacgactcactataggggttattgctggtataagaacccatccaaaaaacagaggagattttggatgggttcttataacctggcggcagcgcaaaagatg

SEQ ID NO: 14310 - DNA, 103 bp, Artificial Sequence
  Synthetic Polynucleotide
taatacgactcactatagggcaaacgttattgctggtataagaacccatcaacagaggagagatgggatgttataccagaacctggcggcagcgcaaaagatg

SEQ ID NO: 14311 - DNA, 103 bp, Artificial Sequence
  Synthetic Polynucleotide
taatacgactcactataggggataacaaacgttattgctggtataagaacaacagaggagagttcttatgccagcaataaacctggcggcagcgcaaaagatg

SEQ ID NO: 14312 - DNA, 103 bp, Artificial Sequence
  Synthetic Polynucleotide
taatacgactcactataggggtaaggataacaaacgttattgctggtataaacagaggagatataccatgaataacgttaacctggcggcagcgcaaaagatg

SEQ ID NO: 14313 - DNA, 103 bp, Artificial Sequence
  Synthetic Polynucleotide
taatacgactcactatagggaaattgtaaggataacaaacgttattgctgaacagaggagacagcaaatgcgtttgttaaacctggcggcagcgcaaaagatg

SEQ ID NO: 14314 - DNA, 103 bp, Artificial Sequence
  Synthetic Polynucleotide
taatacgactcactatagggctttaaaattgtaaggataacaaacgttataacagaggagaataacgatggttatccttaacctggcggcagcgcaaaagatg

SEQ ID NO: 14315 - DNA, 103 bp, Artificial Sequence
  Synthetic Polynucleotide
taatacgactcactatagggggcaattccacataacctatcacgctgtttaacagaggagaaaacagatggataggttaaacctggcggcagcgcaaaagatg

SEQ ID NO: 14316 - DNA, 103 bp, Artificial Sequence
  Synthetic Polynucleotide
taatacgactcactatagggataaactttaaaattgtaaggataacaaacaacagaggagagtttgtatgccttacaataacctggcggcagcgcaaaagatg

SEQ ID NO: 14317 - DNA, 103 bp, Artificial Sequence
  Synthetic Polynucleotide
taatacgactcactatagggttgcaataaactttaaaattgtaaggataaaacagaggagattatccatgcaattttaaaacctggcggcagcgcaaaagatg

SEQ ID NO: 14318 - DNA, 103 bp, Artificial Sequence
  Synthetic Polynucleotide
taatacgactcactatagggaatgtttgcaataaactttaaaattgtaagaacagaggagacttacaatgttaaagtttaacctggcggcagcgcaaaagatg

SEQ ID NO: 14319 - DNA, 103 bp, Artificial Sequence
  Synthetic Polynucleotide
taatacgactcactatagggtgaaaaatgtttgcaataaactttaaaattaacagaggagaaattttatggtttattgcaacctggcggcagcgcaaaagatg

SEQ ID NO: 14320 - DNA, 103 bp, Artificial Sequence
  Synthetic Polynucleotide
taatacgactcactatagggttgtgtgaaaaatgtttgcaataaactttaaacagaggagataaagtatgttgcaaacaaacctggcggcagcgcaaaagatg

SEQ ID NO: 14321 - DNA, 103 bp, Artificial Sequence
  Synthetic Polynucleotide
taatacgactcactataggggttacttgtgtgaaaaatgtttgcaataaaaacagaggagatttattatgaacatttttaacctggcggcagcgcaaaagatg

SEQ ID NO: 14322 - DNA, 103 bp, Artificial Sequence
  Synthetic Polynucleotide
taatacgactcactatagggtcttggttacttgtgtgaaaaatgtttgcaaacagaggagatgcaaaatgttttcacacaacctggcggcagcgcaaaagatg

SEQ ID NO: 14323 - DNA, 103 bp, Artificial Sequence
  Synthetic Polynucleotide
taatacgactcactatagggtattctcttggttacttgtgtgaaaaatgtaacagaggagaacatttatgacacaagtaaacctggcggcagcgcaaaagatg

SEQ ID NO: 14324 - DNA, 103 bp, Artificial Sequence
  Synthetic Polynucleotide
taatacgactcactatagggaagcctattctcttggttacttgtgtgaaaaacagaggagatttcacatgagtaaccaaaacctggcggcagcgcaaaagatg

SEQ ID NO: 14325 - DNA, 103 bp, Artificial Sequence
  Synthetic Polynucleotide
taatacgactcactataggggatttaagcctattctcttggttacttgtgaacagaggagacacaagatgccaagagaaaacctggcggcagcgcaaaagatg

SEQ ID NO: 14326 - DNA, 103 bp, Artificial Sequence
  Synthetic Polynucleotide
taatacgactcactatagggtagggggcaattccacataacctatcacgcaacagaggagagcgtgaatggttatgtggaacctggcggcagcgcaaaagatg

SEQ ID NO: 14327 - DNA, 103 bp, Artificial Sequence
  Synthetic Polynucleotide
taatacgactcactatagggatactgatttaagcctattctcttggttacaacagaggagagtaaccatgagaataggcaacctggcggcagcgcaaaagatg

SEQ ID NO: 14328 - DNA, 103 bp, Artificial Sequence
  Synthetic Polynucleotide
taatacgactcactatagggccttaatactgatttaagcctattctcttgaacagaggagacaagagatgaggcttaaaaacctggcggcagcgcaaaagatg

SEQ ID NO: 14329 - DNA, 103 bp, Artificial Sequence
  Synthetic Polynucleotide
taatacgactcactatagggattttccttaatactgatttaagcctattcaacagaggagagaatagatgtaaatcagtaacctggcggcagcgcaaaagatg

SEQ ID NO: 14330 - DNA, 103 bp, Artificial Sequence
  Synthetic Polynucleotide
taatacgactcactatagggcctttattttccttaatactgatttaagccaacagaggagaggcttaatgcagtattaaaacctggcggcagcgcaaaagatg

SEQ ID NO: 14331 - DNA, 103 bp, Artificial Sequence
  Synthetic Polynucleotide
taatacgactcactatagggttcttcctttattttccttaatactgatttaacagaggagaaaatcaatgttaaggaaaaacctggcggcagcgcaaaagatg

SEQ ID NO: 14332 - DNA, 103 bp, Artificial Sequence
  Synthetic Polynucleotide
taatacgactcactatagggtcaaattcttcctttattttccttaatactaacagaggagaagtattatggaaaataaaaacctggcggcagcgcaaaagatg

SEQ ID NO: 14333 - DNA, 103 bp, Artificial Sequence
  Synthetic Polynucleotide
taatacgactcactatagggtcttttcaaattcttcctttattttccttaaacagaggagataaggaatgtaaaggaagaacctggcggcagcgcaaaagatg

SEQ ID NO: 14334 - DNA, 103 bp, Artificial Sequence
  Synthetic Polynucleotide
taatacgactcactatagggttttgtcttttcaaattcttcctttattttaacagaggagaaaaataatggaagaatttaacctggcggcagcgcaaaagatg

SEQ ID NO: 14335 - DNA, 103 bp, Artificial Sequence
  Synthetic Polynucleotide
taatacgactcactataggggacccttttgtcttttcaaattcttcctttaacagaggagaaaaggaatgatttgaaaaaacctggcggcagcgcaaaagatg

SEQ ID NO: 14336 - DNA, 103 bp, Artificial Sequence
  Synthetic Polynucleotide
taatacgactcactatagggccattgacccttttgtcttttcaaattcttaacagaggagaaagaatatgaaaagacaaaacctggcggcagcgcaaaagatg

SEQ ID NO: 14337 - DNA, 103 bp, Artificial Sequence
  Synthetic Polynucleotide
taatacgactcactatagggtggcatagggggcaattccacataacctataacagaggagaataggtatggtggaattgaacctggcggcagcgcaaaagatg

SEQ ID NO: 14338 - DNA, 103 bp, Artificial Sequence
  Synthetic Polynucleotide
taatacgactcactatagggacataccattgacccttttgtcttttcaaaaacagaggagatttgaaatgacaaaagggaacctggcggcagcgcaaaagatg

SEQ ID NO: 14339 - DNA, 103 bp, Artificial Sequence
  Synthetic Polynucleotide
taatacgactcactatagggatatcacataccattgacccttttgtctttaacagaggagaaaagacatgagggtcaataacctggcggcagcgcaaaagatg

SEQ ID NO: 14340 - DNA, 103 bp, Artificial Sequence
  Synthetic Polynucleotide
taatacgactcactatagggtacaaatatcacataccattgacccttttgaacagaggagacaaaagatgcaatggtataacctggcggcagcgcaaaagatg

SEQ ID NO: 14341 - DNA, 103 bp, Artificial Sequence
  Synthetic Polynucleotide
taatacgactcactataggggtatttacaaatatcacataccattgacccaacagaggagagggtcaatggtatgtgataacctggcggcagcgcaaaagatg

SEQ ID NO: 14342 - DNA, 103 bp, Artificial Sequence
  Synthetic Polynucleotide
taatacgactcactatagggcactcgtatttacaaatatcacataccattaacagaggagaaatggtatgtgatatttgaacctggcggcagcgcaaaagatg

SEQ ID NO: 14343 - DNA, 103 bp, Artificial Sequence
  Synthetic Polynucleotide
taatacgactcactatagggtttcacactcgtatttacaaatatcacataaacagaggagatatgtgatgtttgtaaataacctggcggcagcgcaaaagatg

SEQ ID NO: 14344 - DNA, 103 bp, Artificial Sequence
  Synthetic Polynucleotide
taatacgactcactatagggataagtttcacactcgtatttacaaatatcaacagaggagagatattatgaaatacgagaacctggcggcagcgcaaaagatg

SEQ ID NO: 14345 - DNA, 103 bp, Artificial Sequence
  Synthetic Polynucleotide
taatacgactcactatagggtctttataagtttcacactcgtatttacaaaacagaggagattgtaaatgcgagtgtgaaacctggcggcagcgcaaaagatg

SEQ ID NO: 14346 - DNA, 103 bp, Artificial Sequence
  Synthetic Polynucleotide
taatacgactcactatagggttagctctttataagtttcacactcgtattaacagaggagaaatacgatggtgaaacttaacctggcggcagcgcaaaagatg

SEQ ID NO: 14347 - DNA, 103 bp, Artificial Sequence
  Synthetic Polynucleotide
taatacgactcactatagggtgcctttagctctttataagtttcacactcaacagaggagagagtgtatgacttataaaaacctggcggcagcgcaaaagatg

SEQ ID NO: 14348 - DNA, 103 bp, Artificial Sequence
  Synthetic Polynucleotide
taatacgactcactataggggccaatggcatagggggcaattccacataaaacagaggagattatgtatgattgcccccaacctggcggcagcgcaaaagatg

SEQ ID NO: 14349 - DNA, 103 bp, Artificial Sequence
  Synthetic Polynucleotide
taatacgactcactatagggccatgtgcctttagctctttataagtttcaaacagaggagatgaaacatgtaaagagctaacctggcggcagcgcaaaagatg

SEQ ID NO: 14350 - DNA, 103 bp, Artificial Sequence
  Synthetic Polynucleotide
taatacgactcactatagggaaaccccatgtgcctttagctctttataagaacagaggagacttataatgagctaaaggaacctggcggcagcgcaaaagatg

SEQ ID NO: 14351 - DNA, 103 bp, Artificial Sequence
  Synthetic Polynucleotide
taatacgactcactataggggcatgaaaccccatgtgcctttagctctttaacagaggagaaaagagatgaaggcacataacctggcggcagcgcaaaagatg

SEQ ID NO: 14352 - DNA, 103 bp, Artificial Sequence
  Synthetic Polynucleotide
taatacgactcactatagggtgagggcatgaaaccccatgtgcctttagcaacagaggagagctaaaatgacatggggtaacctggcggcagcgcaaaagatg

SEQ ID NO: 14353 - DNA, 103 bp, Artificial Sequence
  Synthetic Polynucleotide
taatacgactcactataggggagactgagggcatgaaaccccatgtgcctaacagaggagaaggcacatggggtttcataacctggcggcagcgcaaaagatg

SEQ ID NO: 14354 - DNA, 103 bp, Artificial Sequence
  Synthetic Polynucleotide
taatacgactcactatagggacattgagactgagggcatgaaaccccatgaacagaggagacatgggatgtcatgccctaacctggcggcagcgcaaaagatg

SEQ ID NO: 14355 - DNA, 103 bp, Artificial Sequence
  Synthetic Polynucleotide
taatacgactcactatagggtatggacattgagactgagggcatgaaaccaacagaggagaggtttcatgccctcagtcaacctggcggcagcgcaaaagatg

SEQ ID NO: 14356 - DNA, 103 bp, Artificial Sequence
  Synthetic Polynucleotide
taatacgactcactatagggagcagtatggacattgagactgagggcatgaacagaggagacatgccatgagtctcaataacctggcggcagcgcaaaagatg

SEQ ID NO: 14357 - DNA, 103 bp, Artificial Sequence
  Synthetic Polynucleotide
taatacgactcactatagggagtgaagcagtatggacattgagactgaggaacagaggagacctcagatgcaatgtccaaacctggcggcagcgcaaaagatg

SEQ ID NO: 14358 - DNA, 103 bp, Artificial Sequence
  Synthetic Polynucleotide
taatacgactcactatagggcaatgagtgaagcagtatggacattgagacaacagaggagagtctcaatgtccatactgaacctggcggcagcgcaaaagatg

SEQ ID NO: 14359 - DNA, 103 bp, Artificial Sequence
  Synthetic Polynucleotide
taatacgactcactatagggtatcagccaatggcatagggggcaattccaaacagaggagatggaatatgcccctatgcaacctggcggcagcgcaaaagatg

SEQ ID NO: 14360 - DNA, 103 bp, Artificial Sequence
  Synthetic Polynucleotide
taatacgactcactataggggttcacaatgagtgaagcagtatggacattaacagaggagaaatgtcatgactgcttcaaacctggcggcagcgcaaaagatg

SEQ ID NO: 14361 - DNA, 103 bp, Artificial Sequence
  Synthetic Polynucleotide
taatacgactcactatagggtgttggttcacaatgagtgaagcagtatggaacagaggagaccatacatgttcactcataacctggcggcagcgcaaaagatg

SEQ ID NO: 14362 - DNA, 103 bp, Artificial Sequence
  Synthetic Polynucleotide
taatacgactcactataggggcttctgttggttcacaatgagtgaagcagaacagaggagactgcttatgtcattgtgaaacctggcggcagcgcaaaagatg

SEQ ID NO: 14363 - DNA, 103 bp, Artificial Sequence
  Synthetic Polynucleotide
taatacgactcactatagggatgccgcttctgttggttcacaatgagtgaaacagaggagatcactcatggtgaaccaaaacctggcggcagcgcaaaagatg

SEQ ID NO: 14364 - DNA, 103 bp, Artificial Sequence
  Synthetic Polynucleotide
taatacgactcactatagggctggaatgccgcttctgttggttcacaatgaacagaggagacattgtatgccaacagaaaacctggcggcagcgcaaaagatg

SEQ ID NO: 14365 - DNA, 103 bp, Artificial Sequence
  Synthetic Polynucleotide
taatacgactcactatagggtgggcctggaatgccgcttctgttggttcaaacagaggagatgaaccatgagaagcggcaacctggcggcagcgcaaaagatg

SEQ ID NO: 14366 - DNA, 103 bp, Artificial Sequence
  Synthetic Polynucleotide
taatacgactcactatagggtataatgggcctggaatgccgcttctgttgaacagaggagacaacagatgcggcattccaacctggcggcagcgcaaaagatg

SEQ ID NO: 14367 - DNA, 103 bp, Artificial Sequence
  Synthetic Polynucleotide
taatacgactcactatagggcactctataatgggcctggaatgccgcttcaacagaggagagaagcgatgttccaggccaacctggcggcagcgcaaaagatg

SEQ ID NO: 14368 - DNA, 103 bp, Artificial Sequence
  Synthetic Polynucleotide
taatacgactcactatagggtggcacactctataatgggcctggaatgccaacagaggagaggcattatgggcccattaaacctggcggcagcgcaaaagatg

SEQ ID NO: 14369 - DNA, 103 bp, Artificial Sequence
  Synthetic Polynucleotide
taatacgactcactatagggtgacttggcacactctataatgggcctggaaacagaggagatccaggatgattatagagaacctggcggcagcgcaaaagatg

SEQ ID NO: 14370 - DNA, 103 bp, Artificial Sequence
  Synthetic Polynucleotide
taatacgactcactatagggtgctgtatcagccaatggcatagggggcaaaacagaggagattgcccatgatgccattgaacctggcggcagcgcaaaagatg

SEQ ID NO: 14371 - DNA, 103 bp, Artificial Sequence
  Synthetic Polynucleotide
taatacgactcactatagggatgggtgacttggcacactctataatgggcaacagaggagagcccatatgagagtgtgcaacctggcggcagcgcaaaagatg

SEQ ID NO: 14372 - DNA, 103 bp, Artificial Sequence
  Synthetic Polynucleotide
taatacgactcactatagggaatctatgggtgacttggcacactctataaaacagaggagattatagatggtgccaagtaacctggcggcagcgcaaaagatg

SEQ ID NO: 14373 - DNA, 103 bp, Artificial Sequence
  Synthetic Polynucleotide
taatacgactcactatagggctctgaatctatgggtgacttggcacactcaacagaggagagagtgtatgaagtcacccaacctggcggcagcgcaaaagatg

SEQ ID NO: 14374 - DNA, 103 bp, Artificial Sequence
  Synthetic Polynucleotide
taatacgactcactataggggtcatctctgaatctatgggtgacttggcaaacagaggagatgccaaatgacccatagaaacctggcggcagcgcaaaagatg

SEQ ID NO: 14375 - DNA, 103 bp, Artificial Sequence
  Synthetic Polynucleotide
taatacgactcactatagggtttaagtcatctctgaatctatgggtgactaacagaggagaagtcacatgtagattcagaacctggcggcagcgcaaaagatg

SEQ ID NO: 14376 - DNA, 103 bp, Artificial Sequence
  Synthetic Polynucleotide
taatacgactcactatagggtcttttttaagtcatctctgaatctatgggaacagaggagacccataatgtcagagatgaacctggcggcagcgcaaaagatg

SEQ ID NO: 14377 - DNA, 103 bp, Artificial Sequence
  Synthetic Polynucleotide
taatacgactcactatagggaacagtcttttttaagtcatctctgaatctaacagaggagaagattcatggatgacttaaacctggcggcagcgcaaaagatg

SEQ ID NO: 14378 - DNA, 103 bp, Artificial Sequence
  Synthetic Polynucleotide
taatacgactcactatagggggagtaacagtcttttttaagtcatctctgaacagaggagacagagaatgcttaaaaaaaacctggcggcagcgcaaaagatg

SEQ ID NO: 14379 - DNA, 103 bp, Artificial Sequence
  Synthetic Polynucleotide
taatacgactcactatagggtctgaggagtaacagtcttttttaagtcataacagaggagaatgactatgaaaagactgaacctggcggcagcgcaaaagatg

SEQ ID NO: 14380 - DNA, 103 bp, Artificial Sequence
  Synthetic Polynucleotide
taatacgactcactatagggaaagttctgaggagtaacagtcttttttaaaacagaggagattaaaaatgactgttactaacctggcggcagcgcaaaagatg

SEQ ID NO: 14381 - DNA, 103 bp, Artificial Sequence
  Synthetic Polynucleotide
taatacgactcactatagggagttgtgctgtatcagccaatggcatagggaacagaggagaccctatatgattggctgaaacctggcggcagcgcaaaagatg

SEQ ID NO: 14382 - DNA, 103 bp, Artificial Sequence
  Synthetic Polynucleotide
taatacgactcactatagggggtgtaaagttctgaggagtaacagtctttaacagaggagaaaagacatgtactcctcaaacctggcggcagcgcaaaagatg

SEQ ID NO: 14383 - DNA, 103 bp, Artificial Sequence
  Synthetic Polynucleotide
taatacgactcactatagggaaccaggtgtaaagttctgaggagtaacagaacagaggagactgttaatgctcagaactaacctggcggcagcgcaaaagatg

SEQ ID NO: 14384 - DNA, 103 bp, Artificial Sequence
  Synthetic Polynucleotide
taatacgactcactatagggatagcaaccaggtgtaaagttctgaggagtaacagaggagaactcctatgaactttacaaacctggcggcagcgcaaaagatg

SEQ ID NO: 14385 - DNA, 103 bp, Artificial Sequence
  Synthetic Polynucleotide
taatacgactcactataggggtccgatagcaaccaggtgtaaagttctgaaacagaggagatcagaaatgtacacctggaacctggcggcagcgcaaaagatg

SEQ ID NO: 14386 - DNA, 103 bp, Artificial Sequence
  Synthetic Polynucleotide
taatacgactcactatagggttagtgtccgatagcaaccaggtgtaaagtaacagaggagaactttaatgctggttgctaacctggcggcagcgcaaaagatg

SEQ ID NO: 14387 - DNA, 103 bp, Artificial Sequence
  Synthetic Polynucleotide
taatacgactcactatagggcaggtttagtgtccgatagcaaccaggtgtaacagaggagaacacctatgtgctatcggaacctggcggcagcgcaaaagatg

SEQ ID NO: 14388 - DNA, 103 bp, Artificial Sequence
  Synthetic Polynucleotide
taatacgactcactatagggctgaacaggtttagtgtccgatagcaaccaaacagaggagatggttgatgtcggacactaacctggcggcagcgcaaaagatg

SEQ ID NO: 14389 - DNA, 103 bp, Artificial Sequence
  Synthetic Polynucleotide
taatacgactcactatagggtatatctgaacaggtttagtgtccgatagcaacagaggagagctatcatgcactaaaccaacctggcggcagcgcaaaagatg

SEQ ID NO: 14390 - DNA, 103 bp, Artificial Sequence
  Synthetic Polynucleotide
taatacgactcactatagggacttttatatctgaacaggtttagtgtccgaacagaggagacggacaatgaacctgttcaacctggcggcagcgcaaaagatg

SEQ ID NO: 14391 - DNA, 103 bp, Artificial Sequence
  Synthetic Polynucleotide
taatacgactcactatagggcatctacttttatatctgaacaggtttagtaacagaggagaactaaaatggttcagataaacctggcggcagcgcaaaagatg

SEQ ID NO: 14392 - DNA, 103 bp, Artificial Sequence
  Synthetic Polynucleotide
taatacgactcactataggggcaccagttgtgctgtatcagccaatggcaaacagaggagatgccatatgctgatacagaacctggcggcagcgcaaaagatg

SEQ ID NO: 14393 - DNA, 103 bp, Artificial Sequence
  Synthetic Polynucleotide
taatacgactcactatagggtataacatctacttttatatctgaacaggtaacagaggagaacctgtatggatataaaaaacctggcggcagcgcaaaagatg

SEQ ID NO: 14394 - DNA, 103 bp, Artificial Sequence
  Synthetic Polynucleotide
taatacgactcactatagggaaaaatataacatctacttttatatctgaaaacagaggagattcagaatgaaaagtagaaacctggcggcagcgcaaaagatg

SEQ ID NO: 14395 - DNA, 103 bp, Artificial Sequence
  Synthetic Polynucleotide
taatacgactcactatagggattgtaaaaatataacatctacttttatataacagaggagaatataaatgtagatgttaaacctggcggcagcgcaaaagatg

SEQ ID NO: 14396 - DNA, 103 bp, Artificial Sequence
  Synthetic Polynucleotide
taatacgactcactatagggcccacattgtaaaaatataacatctactttaacagaggagaaaagtaatggttatatttaacctggcggcagcgcaaaagatg

SEQ ID NO: 14397 - DNA, 103 bp, Artificial Sequence
  Synthetic Polynucleotide
taatacgactcactataggggcagacccacattgtaaaaatataacatctaacagaggagaagatgtatgatttttacaaacctggcggcagcgcaaaagatg

SEQ ID NO: 14398 - DNA, 103 bp, Artificial Sequence
  Synthetic Polynucleotide
taatacgactcactatagggaaaaggcagacccacattgtaaaaatataaaacagaggagattatatatgtacaatgtgaacctggcggcagcgcaaaagatg

SEQ ID NO: 14399 - DNA, 103 bp, Artificial Sequence
  Synthetic Polynucleotide
taatacgactcactatagggggaccaaaaggcagacccacattgtaaaaaaacagaggagatttttaatgtgtgggtctaacctggcggcagcgcaaaagatg

SEQ ID NO: 14400 - DNA, 103 bp, Artificial Sequence
  Synthetic Polynucleotide
taatacgactcactatagggctccaggaccaaaaggcagacccacattgtaacagaggagaacaatgatggtctgccttaacctggcggcagcgcaaaagatg

SEQ ID NO: 14401 - DNA, 103 bp, Artificial Sequence
  Synthetic Polynucleotide
taatacgactcactatagggattgactccaggaccaaaaggcagacccacaacagaggagagtgggtatgccttttggtaacctggcggcagcgcaaaagatg

SEQ ID NO: 14402 - DNA, 103 bp, Artificial Sequence
  Synthetic Polynucleotide
taatacgactcactatagggaaagtattgactccaggaccaaaaggcagaaacagaggagatctgccatgtggtcctggaacctggcggcagcgcaaaagatg

SEQ ID NO: 14403 - DNA, 103 bp, Artificial Sequence
  Synthetic Polynucleotide
taatacgactcactatagggttcaggcaccagttgtgctgtatcagccaaaacagaggagattggctatgacagcacaaaacctggcggcagcgcaaaagatg

SEQ ID NO: 14404 - DNA, 103 bp, Artificial Sequence
  Synthetic Polynucleotide
taatacgactcactatagggagcccaaagtattgactccaggaccaaaagaacagaggagacttttgatgctggagtcaaacctggcggcagcgcaaaagatg

SEQ ID NO: 14405 - DNA, 103 bp, Artificial Sequence
  Synthetic Polynucleotide
taatacgactcactatagggctggcagcccaaagtattgactccaggaccaacagaggagaggtcctatggtcaatactaacctggcggcagcgcaaaagatg

SEQ ID NO: 14406 - DNA, 103 bp, Artificial Sequence
  Synthetic Polynucleotide
taatacgactcactatagggaagcactggcagcccaaagtattgactccaaacagaggagatggagtatgtactttgggaacctggcggcagcgcaaaagatg

SEQ ID NO: 14407 - DNA, 103 bp, Artificial Sequence
  Synthetic Polynucleotide
taatacgactcactatagggttctgaagcactggcagcccaaagtattgaaacagaggagatcaataatgtgggctgccaacctggcggcagcgcaaaagatg

SEQ ID NO: 14408 - DNA, 103 bp, Artificial Sequence
  Synthetic Polynucleotide
taatacgactcactatagggggtacttctgaagcactggcagcccaaagtaacagaggagaactttgatgtgccagtgcaacctggcggcagcgcaaaagatg

SEQ ID NO: 14409 - DNA, 103 bp, Artificial Sequence
  Synthetic Polynucleotide
taatacgactcactatagggttaagggtacttctgaagcactggcagcccaacagaggagagggctgatggtgcttcagaacctggcggcagcgcaaaagatg

SEQ ID NO: 14410 - DNA, 103 bp, Artificial Sequence
  Synthetic Polynucleotide
taatacgactcactatagggaggatttaagggtacttctgaagcactggcaacagaggagagccagtatgtcagaagtaaacctggcggcagcgcaaaagatg

SEQ ID NO: 14411 - DNA, 103 bp, Artificial Sequence
  Synthetic Polynucleotide
taatacgactcactatagggcatacaggatttaagggtacttctgaagcaaacagaggagatgcttcatgagtacccttaacctggcggcagcgcaaaagatg

SEQ ID NO: 14412 - DNA, 103 bp, Artificial Sequence
  Synthetic Polynucleotide
taatacgactcactatagggcattccatacaggatttaagggtacttctgaacagaggagacagaagatgccttaaatcaacctggcggcagcgcaaaagatg

SEQ ID NO: 14413 - DNA, 103 bp, Artificial Sequence
  Synthetic Polynucleotide
taatacgactcactatagggattatcattccatacaggatttaagggtacaacagaggagagtacccatgaatcctgtaaacctggcggcagcgcaaaagatg

SEQ ID NO: 14414 - DNA, 103 bp, Artificial Sequence
  Synthetic Polynucleotide
taatacgactcactatagggcccatgttgctgattgactgctttcttttgaacagaggagacaaaagatggcagtcaataacctggcggcagcgcaaaagatg

SEQ ID NO: 14415 - DNA, 103 bp, Artificial Sequence
  Synthetic Polynucleotide
taatacgactcactataggggaactttcaggcaccagttgtgctgtatcaaacagaggagatgatacatgacaactggtaacctggcggcagcgcaaaagatg

SEQ ID NO: 14416 - DNA, 103 bp, Artificial Sequence
  Synthetic Polynucleotide
taatacgactcactatagggtgggcattatcattccatacaggatttaagaacagaggagacttaaaatgtgtatggaaaacctggcggcagcgcaaaagatg

SEQ ID NO: 14417 - DNA, 103 bp, Artificial Sequence
  Synthetic Polynucleotide
taatacgactcactatagggccccatgggcattatcattccatacaggataacagaggagaatcctgatgggaatgataaacctggcggcagcgcaaaagatg

SEQ ID NO: 14418 - DNA, 103 bp, Artificial Sequence
  Synthetic Polynucleotide
taatacgactcactatagggccctaccccatgggcattatcattccatacaacagaggagagtatggatggataatgccaacctggcggcagcgcaaaagatg

SEQ ID NO: 14419 - DNA, 103 bp, Artificial Sequence
  Synthetic Polynucleotide
taatacgactcactatagggacagaccctaccccatgggcattatcattcaacagaggagagaatgaatgtgcccatggaacctggcggcagcgcaaaagatg

SEQ ID NO: 14420 - DNA, 103 bp, Artificial Sequence
  Synthetic Polynucleotide
taatacgactcactatagggtcggtacagaccctaccccatgggcattataacagaggagaataatgatgatggggtagaacctggcggcagcgcaaaagatg

SEQ ID NO: 14421 - DNA, 103 bp, Artificial Sequence
  Synthetic Polynucleotide
taatacgactcactataggggtgcatcggtacagaccctaccccatgggcaacagaggagagcccatatggtagggtctaacctggcggcagcgcaaaagatg

SEQ ID NO: 14422 - DNA, 103 bp, Artificial Sequence
  Synthetic Polynucleotide
taatacgactcactatagggtctgtgtgcatcggtacagaccctaccccaaacagaggagatggggtatggtctgtaccaacctggcggcagcgcaaaagatg

SEQ ID NO: 14423 - DNA, 103 bp, Artificial Sequence
  Synthetic Polynucleotide
taatacgactcactatagggctaaatctgtgtgcatcggtacagaccctaaacagaggagatagggtatgtaccgatgcaacctggcggcagcgcaaaagatg

SEQ ID NO: 14424 - DNA, 103 bp, Artificial Sequence
  Synthetic Polynucleotide
taatacgactcactatagggcagctctaaatctgtgtgcatcggtacagaaacagaggagatctgtaatgatgcacacaaacctggcggcagcgcaaaagatg

SEQ ID NO: 14425 - DNA, 103 bp, Artificial Sequence
  Synthetic Polynucleotide
taatacgactcactatagggaagtccagctctaaatctgtgtgcatcggtaacagaggagaaccgatatgcacagatttaacctggcggcagcgcaaaagatg

SEQ ID NO: 14426 - DNA, 103 bp, Artificial Sequence
  Synthetic Polynucleotide
taatacgactcactatagggtacaagaactttcaggcaccagttgtgctgaacagaggagacagcacatgtggtgcctgaacctggcggcagcgcaaaagatg

SEQ ID NO: 14427 - DNA, 103 bp, Artificial Sequence
  Synthetic Polynucleotide
taatacgactcactataggggggaaaagtccagctctaaatctgtgtgcaaacagaggagatgcacaatgatttagagcaacctggcggcagcgcaaaagatg

SEQ ID NO: 14428 - DNA, 103 bp, Artificial Sequence
  Synthetic Polynucleotide
taatacgactcactatagggtgtcagggaaaagtccagctctaaatctgtaacagaggagaacagatatggagctggacaacctggcggcagcgcaaaagatg

SEQ ID NO: 14429 - DNA, 103 bp, Artificial Sequence
  Synthetic Polynucleotide
taatacgactcactatagggcttgatgtcagggaaaagtccagctctaaaaacagaggagatttagaatgggacttttcaacctggcggcagcgcaaaagatg

SEQ ID NO: 14430 - DNA, 103 bp, Artificial Sequence
  Synthetic Polynucleotide
taatacgactcactatagggttgagcttgatgtcagggaaaagtccagctaacagaggagaagctggatgtttccctgaaacctggcggcagcgcaaaagatg

SEQ ID NO: 14431 - DNA, 103 bp, Artificial Sequence
  Synthetic Polynucleotide
taatacgactcactatagggatactttgagcttgatgtcagggaaaagtcaacagaggagagactttatgctgacatcaaacctggcggcagcgcaaaagatg

SEQ ID NO: 14432 - DNA, 103 bp, Artificial Sequence
  Synthetic Polynucleotide
taatacgactcactatagggtatgtatactttgagcttgatgtcagggaaaacagaggagattccctatgatcaagctcaacctggcggcagcgcaaaagatg

SEQ ID NO: 14433 - DNA, 103 bp, Artificial Sequence
  Synthetic Polynucleotide
taatacgactcactatagggtgcggtatgtatactttgagcttgatgtcaaacagaggagatgacatatggctcaaagtaacctggcggcagcgcaaaagatg

SEQ ID NO: 14434 - DNA, 103 bp, Artificial Sequence
  Synthetic Polynucleotide
taatacgactcactatagggccttctgcggtatgtatactttgagcttgaaacagaggagatcaagcatgaagtatacaaacctggcggcagcgcaaaagatg

SEQ ID NO: 14435 - DNA, 103 bp, Artificial Sequence
  Synthetic Polynucleotide
taatacgactcactataggggtcagccttctgcggtatgtatactttgagaacagaggagactcaaaatgtacataccgaacctggcggcagcgcaaaagatg

SEQ ID NO: 14436 - DNA, 103 bp, Artificial Sequence
  Synthetic Polynucleotide
taatacgactcactataggggatttgtcagccttctgcggtatgtatactaacagaggagaagtataatgaccgcagaaaacctggcggcagcgcaaaagatg

SEQ ID NO: 14437 - DNA, 103 bp, Artificial Sequence
  Synthetic Polynucleotide
taatacgactcactatagggcgtgttacaagaactttcaggcaccagttgaacagaggagacaactgatgcctgaaagtaacctggcggcagcgcaaaagatg

SEQ ID NO: 14438 - DNA, 103 bp, Artificial Sequence
  Synthetic Polynucleotide
taatacgactcactatagggaagtggatttgtcagccttctgcggtatgtaacagaggagaacatacatgagaaggctgaacctggcggcagcgcaaaagatg

SEQ ID NO: 14439 - DNA, 103 bp, Artificial Sequence
  Synthetic Polynucleotide
taatacgactcactatagggtcttcaagtggatttgtcagccttctgcggaacagaggagaccgcagatggctgacaaaaacctggcggcagcgcaaaagatg

SEQ ID NO: 14440 - DNA, 103 bp, Artificial Sequence
  Synthetic Polynucleotide
taatacgactcactataggggtgtttcttcaagtggatttgtcagccttcaacagaggagagaaggcatgcaaatccacaacctggcggcagcgcaaaagatg

SEQ ID NO: 14441 - DNA, 103 bp, Artificial Sequence
  Synthetic Polynucleotide
taatacgactcactatagggtgcttgtgtttcttcaagtggatttgtcagaacagaggagactgacaatgccacttgaaaacctggcggcagcgcaaaagatg

SEQ ID NO: 14442 - DNA, 103 bp, Artificial Sequence
  Synthetic Polynucleotide
taatacgactcactatagggttaattgcttgtgtttcttcaagtggatttaacagaggagaaaatccatgtgaagaaacaacctggcggcagcgcaaaagatg

SEQ ID NO: 14443 - DNA, 103 bp, Artificial Sequence
  Synthetic Polynucleotide
taatacgactcactataggggaaggttaattgcttgtgtttcttcaagtgaacagaggagacacttgatgaaacacaagaacctggcggcagcgcaaaagatg

SEQ ID NO: 14444 - DNA, 103 bp, Artificial Sequence
  Synthetic Polynucleotide
taatacgactcactatagggaatgtgaaggttaattgcttgtgtttcttcaacagaggagagaagaaatgcaagcaattaacctggcggcagcgcaaaagatg

SEQ ID NO: 14445 - DNA, 103 bp, Artificial Sequence
  Synthetic Polynucleotide
taatacgactcactatagggatttcaatgtgaaggttaattgcttgtgttaacagaggagaaacacaatgaattaacctaacctggcggcagcgcaaaagatg

SEQ ID NO: 14446 - DNA, 103 bp, Artificial Sequence
  Synthetic Polynucleotide
taatacgactcactatagggcctctatttcaatgtgaaggttaattgcttaacagaggagaaagcaaatgaccttcacaaacctggcggcagcgcaaaagatg

SEQ ID NO: 14447 - DNA, 103 bp, Artificial Sequence
  Synthetic Polynucleotide
taatacgactcactatagggttgttcctctatttcaatgtgaaggttaataacagaggagaattaacatgcacattgaaaacctggcggcagcgcaaaagatg

SEQ ID NO: 14448 - DNA, 103 bp, Artificial Sequence
  Synthetic Polynucleotide
taatacgactcactatagggttgtccgtgttacaagaactttcaggcaccaacagaggagaggtgccatgaagttcttgaacctggcggcagcgcaaaagatg

SEQ ID NO: 14449 - DNA, 103 bp, Artificial Sequence
  Synthetic Polynucleotide
taatacgactcactatagggattgtttgttcctctatttcaatgtgaaggaacagaggagaccttcaatgtgaaatagaaacctggcggcagcgcaaaagatg

SEQ ID NO: 14450 - DNA, 103 bp, Artificial Sequence
  Synthetic Polynucleotide
taatacgactcactatagggcaccaattgtttgttcctctatttcaatgtaacagaggagaacattgatgtagaggaacaacctggcggcagcgcaaaagatg

SEQ ID NO: 14451 - DNA, 103 bp, Artificial Sequence
  Synthetic Polynucleotide
taatacgactcactatagggatcaacaccaattgtttgttcctctatttcaacagaggagagaaataatggaacaaacaaacctggcggcagcgcaaaagatg

SEQ ID NO: 14452 - DNA, 103 bp, Artificial Sequence
  Synthetic Polynucleotide
taatacgactcactatagggtgaacatcaacaccaattgtttgttcctctaacagaggagaagaggaatgaacaattggaacctggcggcagcgcaaaagatg

SEQ ID NO: 14453 - DNA, 103 bp, Artificial Sequence
  Synthetic Polynucleotide
taatacgactcactatagggaggcatgaacatcaacaccaattgtttgttaacagaggagaaacaaaatgttggtgttgaacctggcggcagcgcaaaagatg

SEQ ID NO: 14454 - DNA, 103 bp, Artificial Sequence
  Synthetic Polynucleotide
taatacgactcactataggggcctaaggcatgaacatcaacaccaattgtaacagaggagaacaattatggttgatgttaacctggcggcagcgcaaaagatg

SEQ ID NO: 14455 - DNA, 103 bp, Artificial Sequence
  Synthetic Polynucleotide
taatacgactcactatagggcaatggcctaaggcatgaacatcaacaccaaacagaggagatggtgtatgtgttcatgcaacctggcggcagcgcaaaagatg

SEQ ID NO: 14456 - DNA, 103 bp, Artificial Sequence
  Synthetic Polynucleotide
taatacgactcactatagggcaaaccaatggcctaaggcatgaacatcaaaacagaggagattgatgatgatgccttagaacctggcggcagcgcaaaagatg

SEQ ID NO: 14457 - DNA, 103 bp, Artificial Sequence
  Synthetic Polynucleotide
taatacgactcactatagggaccatcaaaccaatggcctaaggcatgaacaacagaggagagttcatatgttaggccataacctggcggcagcgcaaaagatg

SEQ ID NO: 14458 - DNA, 103 bp, Artificial Sequence
  Synthetic Polynucleotide
taatacgactcactatagggagccgaccatcaaaccaatggcctaaggcaaacagaggagatgccttatgccattggttaacctggcggcagcgcaaaagatg

SEQ ID NO: 14459 - DNA, 103 bp, Artificial Sequence
  Synthetic Polynucleotide
taatacgactcactatagggggtggttgtccgtgttacaagaactttcagaacagaggagactgaaaatgcttgtaacaaacctggcggcagcgcaaaagatg

SEQ ID NO: 14460 - DNA, 103 bp, Artificial Sequence
  Synthetic Polynucleotide
taatacgactcactatagggggttaagccgaccatcaaaccaatggcctaaacagaggagataggccatgggtttgatgaacctggcggcagcgcaaaagatg

SEQ ID NO: 14461 - DNA, 103 bp, Artificial Sequence
  Synthetic Polynucleotide
taatacgactcactatagggtttaaggttaagccgaccatcaaaccaatgaacagaggagacattggatggatggtcggaacctggcggcagcgcaaaagatg

SEQ ID NO: 14462 - DNA, 103 bp, Artificial Sequence
  Synthetic Polynucleotide
taatacgactcactataggggatgttttaaggttaagccgaccatcaaacaacagaggagagtttgaatgtcggcttaaaacctggcggcagcgcaaaagatg

SEQ ID NO: 14463 - DNA, 103 bp, Artificial Sequence
  Synthetic Polynucleotide
taatacgactcactatagggggaaagatgttttaaggttaagccgaccataacagaggagaatggtcatgttaaccttaaacctggcggcagcgcaaaagatg

SEQ ID NO: 14464 - DNA, 103 bp, Artificial Sequence
  Synthetic Polynucleotide
taatacgactcactatagggacagtggaaagatgttttaaggttaagccgaacagaggagacggcttatgcttaaaacaaacctggcggcagcgcaaaagatg

SEQ ID NO: 14465 - DNA, 103 bp, Artificial Sequence
  Synthetic Polynucleotide
taatacgactcactatagggccataacagtggaaagatgttttaaggttaaacagaggagataacctatgaacatctttaacctggcggcagcgcaaaagatg

SEQ ID NO: 14466 - DNA, 103 bp, Artificial Sequence
  Synthetic Polynucleotide
taatacgactcactatagggaggcaccataacagtggaaagatgttttaaaacagaggagattaaaaatgctttccactaacctggcggcagcgcaaaagatg

SEQ ID NO: 14467 - DNA, 103 bp, Artificial Sequence
  Synthetic Polynucleotide
taatacgactcactatagggcgtgcaggcaccataacagtggaaagatgtaacagaggagaacatctatgcactgttataacctggcggcagcgcaaaagatg

SEQ ID NO: 14468 - DNA, 103 bp, Artificial Sequence
  Synthetic Polynucleotide
taatacgactcactatagggtatttcgtgcaggcaccataacagtggaaaaacagaggagatttccaatgttatggtgcaacctggcggcagcgcaaaagatg

SEQ ID NO: 14469 - DNA, 103 bp, Artificial Sequence
  Synthetic Polynucleotide
taatacgactcactatagggactcgtatttcgtgcaggcaccataacagtaacagaggagaactgttatggtgcctgcaaacctggcggcagcgcaaaagatg

SEQ ID NO: 14470 - DNA, 103 bp, Artificial Sequence
  Synthetic Polynucleotide
taatacgactcactatagggtgattggtggttgtccgtgttacaagaactaacagaggagaagttctatgaacacggacaacctggcggcagcgcaaaagatg

SEQ ID NO: 14471 - DNA, 103 bp, Artificial Sequence
  Synthetic Polynucleotide
taatacgactcactataggggggatactcgtatttcgtgcaggcaccataaacagaggagatatggtatgtgcacgaaaaacctggcggcagcgcaaaagatg

SEQ ID NO: 14472 - DNA, 103 bp, Artificial Sequence
  Synthetic Polynucleotide
taatacgactcactatagggtgccagggatactcgtatttcgtgcaggcaaacagaggagatgcctgatggaaatacgaaacctggcggcagcgcaaaagatg

SEQ ID NO: 14473 - DNA, 103 bp, Artificial Sequence
  Synthetic Polynucleotide
taatacgactcactatagggcagtgtgccagggatactcgtatttcgtgcaacagaggagagcacgaatgacgagtatcaacctggcggcagcgcaaaagatg

SEQ ID NO: 14474 - DNA, 103 bp, Artificial Sequence
  Synthetic Polynucleotide
taatacgactcactatagggctttgcagtgtgccagggatactcgtatttaacagaggagaaaatacatgtatccctggaacctggcggcagcgcaaaagatg

SEQ ID NO: 14475 - DNA, 103 bp, Artificial Sequence
  Synthetic Polynucleotide
taatacgactcactatagggtgacactttgcagtgtgccagggatactcgaacagaggagacgagtaatgctggcacacaacctggcggcagcgcaaaagatg

SEQ ID NO: 14476 - DNA, 103 bp, Artificial Sequence
  Synthetic Polynucleotide
taatacgactcactatagggcataatgacactttgcagtgtgccagggataacagaggagaatccctatgacactgcaaaacctggcggcagcgcaaaagatg

SEQ ID NO: 14477 - DNA, 103 bp, Artificial Sequence
  Synthetic Polynucleotide
taatacgactcactatagggccgctcataatgacactttgcagtgtgccaaacagaggagatggcacatggcaaagtgtaacctggcggcagcgcaaaagatg

SEQ ID NO: 14478 - DNA, 103 bp, Artificial Sequence
  Synthetic Polynucleotide
taatacgactcactatagggtaatcccgctcataatgacactttgcagtgaacagaggagacactgcatggtgtcattaaacctggcggcagcgcaaaagatg

SEQ ID NO: 14479 - DNA, 103 bp, Artificial Sequence
  Synthetic Polynucleotide
taatacgactcactatagggactggtaatcccgctcataatgacactttgaacagaggagacaaagtatgattatgagcaacctggcggcagcgcaaaagatg

SEQ ID NO: 14480 - DNA, 103 bp, Artificial Sequence
  Synthetic Polynucleotide
taatacgactcactatagggctcatactggtaatcccgctcataatgacaaacagaggagatgtcatatggagcgggataacctggcggcagcgcaaaagatg

SEQ ID NO: 14481 - DNA, 103 bp, Artificial Sequence
  Synthetic Polynucleotide
taatacgactcactatagggttcattgattggtggttgtccgtgttacaaaacagaggagattgtaaatgggacaaccaaacctggcggcagcgcaaaagatg

SEQ ID NO: 14482 - DNA, 103 bp, Artificial Sequence
  Synthetic Polynucleotide
taatacgactcactatagggcttgtctcatactggtaatcccgctcataaaacagaggagattatgaatgggattaccaaacctggcggcagcgcaaaagatg

SEQ ID NO: 14483 - DNA, 103 bp, Artificial Sequence
  Synthetic Polynucleotide
taatacgactcactatagggcccaacttgtctcatactggtaatcccgctaacagaggagaagcgggatgaccagtatgaacctggcggcagcgcaaaagatg

SEQ ID NO: 14484 - DNA, 103 bp, Artificial Sequence
  Synthetic Polynucleotide
taatacgactcactatagggacagccccaacttgtctcatactggtaatcaacagaggagagattacatgtatgagacaaacctggcggcagcgcaaaagatg

SEQ ID NO: 14485 - DNA, 103 bp, Artificial Sequence
  Synthetic Polynucleotide
taatacgactcactataggggggttacagccccaacttgtctcatactggaacagaggagaccagtaatggacaagttgaacctggcggcagcgcaaaagatg

SEQ ID NO: 14486 - DNA, 103 bp, Artificial Sequence
  Synthetic Polynucleotide
taatacgactcactatagggcagctgggttacagccccaacttgtctcataacagaggagaatgagaatggttggggctaacctggcggcagcgcaaaagatg

SEQ ID NO: 14487 - DNA, 103 bp, Artificial Sequence
  Synthetic Polynucleotide
taatacgactcactataggggcaatcagctgggttacagccccaacttgtaacagaggagaacaagtatgggctgtaacaacctggcggcagcgcaaaagatg

SEQ ID NO: 14488 - DNA, 103 bp, Artificial Sequence
  Synthetic Polynucleotide
taatacgactcactatagggcctgggcaatcagctgggttacagccccaaaacagaggagattggggatgtaacccagcaacctggcggcagcgcaaaagatg

SEQ ID NO: 14489 - DNA, 103 bp, Artificial Sequence
  Synthetic Polynucleotide
taatacgactcactatagggccacccctgggcaatcagctgggttacagcaacagaggagagctgtaatgcagctgattaacctggcggcagcgcaaaagatg

SEQ ID NO: 14490 - DNA, 103 bp, Artificial Sequence
  Synthetic Polynucleotide
taatacgactcactatagggtgttcccacccctgggcaatcagctgggttaacagaggagaaacccaatggattgcccaaacctggcggcagcgcaaaagatg

SEQ ID NO: 14491 - DNA, 103 bp, Artificial Sequence
  Synthetic Polynucleotide
taatacgactcactatagggcaacctgttcccacccctgggcaatcagctaacagaggagaagctgaatgcccaggggtaacctggcggcagcgcaaaagatg

SEQ ID NO: 14492 - DNA, 103 bp, Artificial Sequence
  Synthetic Polynucleotide
taatacgactcactatagggttgtgttcattgattggtggttgtccgtgtaacagaggagaacacggatgaccaccaataacctggcggcagcgcaaaagatg

SEQ ID NO: 14493 - DNA, 103 bp, Artificial Sequence
  Synthetic Polynucleotide
taatacgactcactatagggctgtgcaacctgttcccacccctgggcaataacagaggagaattgccatggggtgggaaaacctggcggcagcgcaaaagatg

SEQ ID NO: 14494 - DNA, 103 bp, Artificial Sequence
  Synthetic Polynucleotide
taatacgactcactatagggacatgctgtgcaacctgttcccacccctggaacagaggagaccagggatgggaacaggtaacctggcggcagcgcaaaagatg

SEQ ID NO: 14495 - DNA, 103 bp, Artificial Sequence
  Synthetic Polynucleotide
taatacgactcactatagggaatccacatgctgtgcaacctgttcccaccaacagaggagaggtgggatgaggttgcacaacctggcggcagcgcaaaagatg

SEQ ID NO: 14496 - DNA, 103 bp, Artificial Sequence
  Synthetic Polynucleotide
taatacgactcactatagggggtataatccacatgctgtgcaacctgttcaacagaggagagaacagatggcacagcataacctggcggcagcgcaaaagatg

SEQ ID NO: 14497 - DNA, 103 bp, Artificial Sequence
  Synthetic Polynucleotide
taatacgactcactatagggatcaaggtataatccacatgctgtgcaaccaacagaggagaggttgcatggcatgtggaaacctggcggcagcgcaaaagatg

SEQ ID NO: 14498 - DNA, 103 bp, Artificial Sequence
  Synthetic Polynucleotide
taatacgactcactatagggaattgatcaaggtataatccacatgctgtgaacagaggagacacagcatgtggattataaacctggcggcagcgcaaaagatg

SEQ ID NO: 14499 - DNA, 103 bp, Artificial Sequence
  Synthetic Polynucleotide
taatacgactcactataggggctttaattgatcaaggtataatccacatgaacagaggagacatgtgatgtataccttgaacctggcggcagcgcaaaagatg

SEQ ID NO: 14500 - DNA, 103 bp, Artificial Sequence
  Synthetic Polynucleotide
taatacgactcactatagggaacaggctttaattgatcaaggtataatccaacagaggagaggattaatgcttgatcaaaacctggcggcagcgcaaaagatg

SEQ ID NO: 14501 - DNA, 103 bp, Artificial Sequence
  Synthetic Polynucleotide
taatacgactcactatagggctaccaacaggctttaattgatcaaggtataacagaggagaatacctatgtcaattaaaaacctggcggcagcgcaaaagatg

SEQ ID NO: 14502 - DNA, 103 bp, Artificial Sequence
  Synthetic Polynucleotide
taatacgactcactatagggatgcactaccaacaggctttaattgatcaaaacagaggagattgatcatgtaaagcctgaacctggcggcagcgcaaaagatg

SEQ ID NO: 14503 - DNA, 103 bp, Artificial Sequence
  Synthetic Polynucleotide
taatacgactcactatagggtgttattgtgttcattgattggtggttgtcaacagaggagagacaacatgcaatcaatgaacctggcggcagcgcaaaagatg

SEQ ID NO: 14504 - DNA, 103 bp, Artificial Sequence
  Synthetic Polynucleotide
taatacgactcactatagggcttatatgcactaccaacaggctttaattgaacagaggagacaattaatgcctgttggtaacctggcggcagcgcaaaagatg

SEQ ID NO: 14505 - DNA, 103 bp, Artificial Sequence
  Synthetic Polynucleotide
taatacgactcactatagggataatcttatatgcactaccaacaggctttaacagaggagaaaagccatgtggtagtgcaacctggcggcagcgcaaaagatg

SEQ ID NO: 14506 - DNA, 103 bp, Artificial Sequence
  Synthetic Polynucleotide
taatacgactcactatagggttgtaataatcttatatgcactaccaacagaacagaggagactgttgatggtgcatataaacctggcggcagcgcaaaagatg

SEQ ID NO: 14507 - DNA, 103 bp, Artificial Sequence
  Synthetic Polynucleotide
taatacgactcactatagggtcttattgtaataatcttatatgcactaccaacagaggagaggtagtatgtataagattaacctggcggcagcgcaaaagatg

SEQ ID NO: 14508 - DNA, 103 bp, Artificial Sequence
  Synthetic Polynucleotide
taatacgactcactatagggctatatcttattgtaataatcttatatgcaaacagaggagatgcataatggattattacaacctggcggcagcgcaaaagatg

SEQ ID NO: 14509 - DNA, 103 bp, Artificial Sequence
  Synthetic Polynucleotide
taatacgactcactatagggtcctgctatatcttattgtaataatcttataacagaggagaataagaatgttacaataaaacctggcggcagcgcaaaagatg

SEQ ID NO: 14510 - DNA, 103 bp, Artificial Sequence
  Synthetic Polynucleotide
taatacgactcactatagggaactttcctgctatatcttattgtaataataacagaggagaattattatgataagatataacctggcggcagcgcaaaagatg

SEQ ID NO: 14511 - DNA, 103 bp, Artificial Sequence
  Synthetic Polynucleotide
taatacgactcactatagggacacaaactttcctgctatatcttattgtaaacagaggagatacaatatgatatagcagaacctggcggcagcgcaaaagatg

SEQ ID NO: 14512 - DNA, 103 bp, Artificial Sequence
  Synthetic Polynucleotide
taatacgactcactatagggactggacacaaactttcctgctatatcttaaacagaggagataagatatggcaggaaagaacctggcggcagcgcaaaagatg

SEQ ID NO: 14513 - DNA, 103 bp, Artificial Sequence
  Synthetic Polynucleotide
taatacgactcactatagggcccaaactggacacaaactttcctgctataaacagaggagatatagcatgaaagtttgtaacctggcggcagcgcaaaagatg

SEQ ID NO: 14514 - DNA, 103 bp, Artificial Sequence
  Synthetic Polynucleotide
taatacgactcactatagggtattttgttattgtgttcattgattggtggaacagaggagaccaccaatgaatgaacacaacctggcggcagcgcaaaagatg

SEQ ID NO: 14515 - DNA, 103 bp, Artificial Sequence
  Synthetic Polynucleotide
taatacgactcactatagggtcctccccaaactggacacaaactttcctgaacagaggagacaggaaatgttgtgtccaaacctggcggcagcgcaaaagatg

SEQ ID NO: 14516 - DNA, 103 bp, Artificial Sequence
  Synthetic Polynucleotide
taatacgactcactataggggattttcctccccaaactggacacaaacttaacagaggagaaagtttatgtccagtttgaacctggcggcagcgcaaaagatg

SEQ ID NO: 14517 - DNA, 103 bp, Artificial Sequence
  Synthetic Polynucleotide
taatacgactcactatagggacatagattttcctccccaaactggacacaaacagaggagatgtgtcatgtttggggagaacctggcggcagcgcaaaagatg

SEQ ID NO: 14518 - DNA, 103 bp, Artificial Sequence
  Synthetic Polynucleotide
taatacgactcactatagggaccttacatagattttcctccccaaactggaacagaggagaccagttatgggaggaaaaaacctggcggcagcgcaaaagatg

SEQ ID NO: 14519 - DNA, 103 bp, Artificial Sequence
  Synthetic Polynucleotide
taatacgactcactatagggctatcaccttacatagattttcctccccaaaacagaggagattggggatgaaaatctataacctggcggcagcgcaaaagatg

SEQ ID NO: 14520 - DNA, 103 bp, Artificial Sequence
  Synthetic Polynucleotide
taatacgactcactatagggcatatctatcaccttacatagattttcctcaacagaggagagaggaaatgctatgtaagaacctggcggcagcgcaaaagatg

SEQ ID NO: 14521 - DNA, 103 bp, Artificial Sequence
  Synthetic Polynucleotide
taatacgactcactatagggtcattcatatctatcaccttacatagatttaacagaggagaaaatctatgtaaggtgataacctggcggcagcgcaaaagatg

SEQ ID NO: 14522 - DNA, 103 bp, Artificial Sequence
  Synthetic Polynucleotide
taatacgactcactatagggagcaatcattcatatctatcaccttacataaacagaggagatatgtaatgtgatagataaacctggcggcagcgcaaaagatg

SEQ ID NO: 14523 - DNA, 103 bp, Artificial Sequence
  Synthetic Polynucleotide
taatacgactcactataggggacaaagcaatcattcatatctatcaccttaacagaggagaaaggtgatggatatgaataacctggcggcagcgcaaaagatg

SEQ ID NO: 14524 - DNA, 103 bp, Artificial Sequence
  Synthetic Polynucleotide
taatacgactcactatagggctggagacaaagcaatcattcatatctatcaacagaggagagatagaatggaatgattgaacctggcggcagcgcaaaagatg

SEQ ID NO: 14525 - DNA, 103 bp, Artificial Sequence
  Synthetic Polynucleotide
taatacgactcactatagggatatccccatgttgctgattgactgctttcaacagaggagagaaagcatgcaatcagcaaacctggcggcagcgcaaaagatg

SEQ ID NO: 14526 - DNA, 103 bp, Artificial Sequence
  Synthetic Polynucleotide
taatacgactcactataggggggtgtattttgttattgtgttcattgattaacagaggagaaatcaaatgacacaataaaacctggcggcagcgcaaaagatg

SEQ ID NO: 14527 - DNA, 103 bp, Artificial Sequence
  Synthetic Polynucleotide
taatacgactcactatagggcatgtctggagacaaagcaatcattcatataacagaggagaatatgaatgattgctttgaacctggcggcagcgcaaaagatg

SEQ ID NO: 14528 - DNA, 103 bp, Artificial Sequence
  Synthetic Polynucleotide
taatacgactcactatagggtttaacatgtctggagacaaagcaatcattaacagaggagaaatgatatgtttgtctccaacctggcggcagcgcaaaagatg

SEQ ID NO: 14529 - DNA, 103 bp, Artificial Sequence
  Synthetic Polynucleotide
taatacgactcactatagggcatactttaacatgtctggagacaaagcaaaacagaggagattgcttatgctccagacaaacctggcggcagcgcaaaagatg

SEQ ID NO: 14530 - DNA, 103 bp, Artificial Sequence
  Synthetic Polynucleotide
taatacgactcactatagggttatacatactttaacatgtctggagacaaaacagaggagattgtctatggacatgttaaacctggcggcagcgcaaaagatg

SEQ ID NO: 14531 - DNA, 103 bp, Artificial Sequence
  Synthetic Polynucleotide
taatacgactcactatagggaccaattatacatactttaacatgtctggaaacagaggagatccagaatggttaaagtaaacctggcggcagcgcaaaagatg

SEQ ID NO: 14532 - DNA, 103 bp, Artificial Sequence
  Synthetic Polynucleotide
taatacgactcactatagggactgtaccaattatacatactttaacatgtaacagaggagaacatgtatgagtatgtataacctggcggcagcgcaaaagatg

SEQ ID NO: 14533 - DNA, 103 bp, Artificial Sequence
  Synthetic Polynucleotide
taatacgactcactatagggttgagactgtaccaattatacatactttaaaacagaggagattaaagatggtataattgaacctggcggcagcgcaaaagatg

SEQ ID NO: 14534 - DNA, 103 bp, Artificial Sequence
  Synthetic Polynucleotide
taatacgactcactataggggaattttgagactgtaccaattatacatacaacagaggagagtatgtatgattggtacaaacctggcggcagcgcaaaagatg

SEQ ID NO: 14535 - DNA, 103 bp, Artificial Sequence
  Synthetic Polynucleotide
taatacgactcactatagggtgggagaattttgagactgtaccaattataaacagaggagatataatatgtacagtctcaacctggcggcagcgcaaaagatg

SEQ ID NO: 14536 - DNA, 103 bp, Artificial Sequence
  Synthetic Polynucleotide
taatacgactcactatagggcaccttgggagaattttgagactgtaccaaaacagaggagattggtaatgtctcaaaataacctggcggcagcgcaaaagatg

SEQ ID NO: 14537 - DNA, 103 bp, Artificial Sequence
  Synthetic Polynucleotide
taatacgactcactatagggtatctgggtgtattttgttattgtgttcataacagaggagaatgaacatgataacaaaaaacctggcggcagcgcaaaagatg

SEQ ID NO: 14538 - DNA, 103 bp, Artificial Sequence
  Synthetic Polynucleotide
taatacgactcactatagggtgtatcaccttgggagaattttgagactgtaacagaggagaacagtcatgaaattctccaacctggcggcagcgcaaaagatg

SEQ ID NO: 14539 - DNA, 103 bp, Artificial Sequence
  Synthetic Polynucleotide
taatacgactcactatagggaatagtgtatcaccttgggagaattttgagaacagaggagactcaaaatgctcccaaggaacctggcggcagcgcaaaagatg

SEQ ID NO: 14540 - DNA, 103 bp, Artificial Sequence
  Synthetic Polynucleotide
taatacgactcactatagggagaataatagtgtatcaccttgggagaattaacagaggagaaattctatgaaggtgataaacctggcggcagcgcaaaagatg

SEQ ID NO: 14541 - DNA, 103 bp, Artificial Sequence
  Synthetic Polynucleotide
taatacgactcactatagggtccaaagaataatagtgtatcaccttgggaaacagaggagatcccaaatggatacactaaacctggcggcagcgcaaaagatg

SEQ ID NO: 14542 - DNA, 103 bp, Artificial Sequence
  Synthetic Polynucleotide
taatacgactcactatagggagtggtccaaagaataatagtgtatcacctaacagaggagaaggtgaatgactattattaacctggcggcagcgcaaaagatg

SEQ ID NO: 14543 - DNA, 103 bp, Artificial Sequence
  Synthetic Polynucleotide
taatacgactcactatagggcctcaagtggtccaaagaataatagtgtataacagaggagaatacacatgtattctttgaacctggcggcagcgcaaaagatg

SEQ ID NO: 14544 - DNA, 103 bp, Artificial Sequence
  Synthetic Polynucleotide
taatacgactcactatagggaccgccctcaagtggtccaaagaataatagaacagaggagactattaatgtttggaccaaacctggcggcagcgcaaaagatg

SEQ ID NO: 14545 - DNA, 103 bp, Artificial Sequence
  Synthetic Polynucleotide
taatacgactcactatagggaaaccaccgccctcaagtggtccaaagaataacagaggagaattcttatgaccacttgaaacctggcggcagcgcaaaagatg

SEQ ID NO: 14546 - DNA, 103 bp, Artificial Sequence
  Synthetic Polynucleotide
taatacgactcactatagggatatcaaaccaccgccctcaagtggtccaaaacagaggagattggacatgttgagggcgaacctggcggcagcgcaaaagatg

SEQ ID NO: 14547 - DNA, 103 bp, Artificial Sequence
  Synthetic Polynucleotide
taatacgactcactatagggtttgaatatcaaaccaccgccctcaagtggaacagaggagaccacttatgggcggtggtaacctggcggcagcgcaaaagatg

SEQ ID NO: 14548 - DNA, 103 bp, Artificial Sequence
  Synthetic Polynucleotide
taatacgactcactatagggcaacttatctgggtgtattttgttattgtgaacagaggagacacaatatgaaaatacacaacctggcggcagcgcaaaagatg

SEQ ID NO: 14549 - DNA, 103 bp, Artificial Sequence
  Synthetic Polynucleotide
taatacgactcactatagggcagtgtttgaatatcaaaccaccgccctcaaacagaggagatgagggatgtggtttgataacctggcggcagcgcaaaagatg

SEQ ID NO: 14550 - DNA, 103 bp, Artificial Sequence
  Synthetic Polynucleotide
taatacgactcactatagggtacaccagtgtttgaatatcaaaccaccgcaacagaggagagcggtgatgtgatattcaaacctggcggcagcgcaaaagatg

SEQ ID NO: 14551 - DNA, 103 bp, Artificial Sequence
  Synthetic Polynucleotide
taatacgactcactatagggagatgtacaccagtgtttgaatatcaaaccaacagaggagaggtttgatgttcaaacacaacctggcggcagcgcaaaagatg

SEQ ID NO: 14552 - DNA, 103 bp, Artificial Sequence
  Synthetic Polynucleotide
taatacgactcactatagggcatgtagatgtacaccagtgtttgaatatcaacagaggagagatattatgacactggtgaacctggcggcagcgcaaaagatg

SEQ ID NO: 14553 - DNA, 103 bp, Artificial Sequence
  Synthetic Polynucleotide
taatacgactcactatagggactggcatgtagatgtacaccagtgtttgaaacagaggagatcaaacatgggtgtacataacctggcggcagcgcaaaagatg

SEQ ID NO: 14554 - DNA, 103 bp, Artificial Sequence
  Synthetic Polynucleotide
taatacgactcactatagggtccaaactggcatgtagatgtacaccagtgaacagaggagacactggatgacatctacaaacctggcggcagcgcaaaagatg

SEQ ID NO: 14555 - DNA, 103 bp, Artificial Sequence
  Synthetic Polynucleotide
taatacgactcactataggggggtctccaaactggcatgtagatgtacacaacagaggagagtgtacatgtacatgccaaacctggcggcagcgcaaaagatg

SEQ ID NO: 14556 - DNA, 103 bp, Artificial Sequence
  Synthetic Polynucleotide
taatacgactcactatagggctcctgggtctccaaactggcatgtagatgaacagaggagacatctaatggccagtttgaacctggcggcagcgcaaaagatg

SEQ ID NO: 14557 - DNA, 103 bp, Artificial Sequence
  Synthetic Polynucleotide
taatacgactcactatagggaatatctcctgggtctccaaactggcatgtaacagaggagaacatgcatgtttggagacaacctggcggcagcgcaaaagatg

SEQ ID NO: 14558 - DNA, 103 bp, Artificial Sequence
  Synthetic Polynucleotide
taatacgactcactatagggctcataatatctcctgggtctccaaactggaacagaggagaccagttatgagacccaggaacctggcggcagcgcaaaagatg

SEQ ID NO: 14559 - DNA, 103 bp, Artificial Sequence
  Synthetic Polynucleotide
taatacgactcactatagggctctccaacttatctgggtgtattttgttaaacagaggagataacaaatgacacccagaaacctggcggcagcgcaaaagatg

SEQ ID NO: 14560 - DNA, 103 bp, Artificial Sequence
  Synthetic Polynucleotide
taatacgactcactataggggtggactcataatatctcctgggtctccaaaacagaggagattggagatgcaggagataaacctggcggcagcgcaaaagatg

SEQ ID NO: 14561 - DNA, 103 bp, Artificial Sequence
  Synthetic Polynucleotide
taatacgactcactatagggatcccgtggactcataatatctcctgggtcaacagaggagagacccaatggatattatgaacctggcggcagcgcaaaagatg

SEQ ID NO: 14562 - DNA, 103 bp, Artificial Sequence
  Synthetic Polynucleotide
taatacgactcactatagggcccttatcccgtggactcataatatctcctaacagaggagaaggagaatgtatgagtccaacctggcggcagcgcaaaagatg

SEQ ID NO: 14563 - DNA, 103 bp, Artificial Sequence
  Synthetic Polynucleotide
taatacgactcactatagggaaaatcccttatcccgtggactcataatataacagaggagaatattaatggtccacgggaacctggcggcagcgcaaaagatg

SEQ ID NO: 14564 - DNA, 103 bp, Artificial Sequence
  Synthetic Polynucleotide
taatacgactcactataggggcataaaaatcccttatcccgtggactcataacagaggagaatgagtatgcgggataagaacctggcggcagcgcaaaagatg

SEQ ID NO: 14565 - DNA, 103 bp, Artificial Sequence
  Synthetic Polynucleotide
taatacgactcactatagggtcggggcataaaaatcccttatcccgtggaaacagaggagatccacgatgtaagggattaacctggcggcagcgcaaaagatg

SEQ ID NO: 14566 - DNA, 103 bp, Artificial Sequence
  Synthetic Polynucleotide
taatacgactcactatagggggaattcggggcataaaaatcccttatcccaacagaggagagggataatggatttttataacctggcggcagcgcaaaagatg

SEQ ID NO: 14567 - DNA, 103 bp, Artificial Sequence
  Synthetic Polynucleotide
taatacgactcactatagggtccagggaattcggggcataaaaatcccttaacagaggagaaagggaatgttatgccccaacctggcggcagcgcaaaagatg

SEQ ID NO: 14568 - DNA, 103 bp, Artificial Sequence
  Synthetic Polynucleotide
taatacgactcactatagggaaacttccagggaattcggggcataaaaataacagaggagaatttttatgccccgaattaacctggcggcagcgcaaaagatg

SEQ ID NO: 14569 - DNA, 103 bp, Artificial Sequence
  Synthetic Polynucleotide
taatacgactcactatagggtcctaaaacttccagggaattcggggcataaacagaggagatatgccatgaattccctgaacctggcggcagcgcaaaagatg

SEQ ID NO: 14570 - DNA, 103 bp, Artificial Sequence
  Synthetic Polynucleotide
taatacgactcactatagggcttacctctccaacttatctgggtgtatttaacagaggagaaaatacatgcagataagtaacctggcggcagcgcaaaagatg

SEQ ID NO: 14571 - DNA, 103 bp, Artificial Sequence
  Synthetic Polynucleotide
taatacgactcactatagggcttcttcctaaaacttccagggaattcgggaacagaggagacccgaaatgcctggaagtaacctggcggcagcgcaaaagatg

SEQ ID NO: 14572 - DNA, 103 bp, Artificial Sequence
  Synthetic Polynucleotide
taatacgactcactatagggttacacttcttcctaaaacttccagggaataacagaggagaattcccatgaagttttagaacctggcggcagcgcaaaagatg

SEQ ID NO: 14573 - DNA, 103 bp, Artificial Sequence
  Synthetic Polynucleotide
taatacgactcactatagggcaaaattacacttcttcctaaaacttccagaacagaggagactggaaatgttaggaagaaacctggcggcagcgcaaaagatg

SEQ ID NO: 14574 - DNA, 103 bp, Artificial Sequence
  Synthetic Polynucleotide
taatacgactcactatagggggtagcaaaattacacttcttcctaaaactaacagaggagaagttttatgaagaagtgtaacctggcggcagcgcaaaagatg

SEQ ID NO: 14575 - DNA, 103 bp, Artificial Sequence
  Synthetic Polynucleotide
taatacgactcactatagggggggtggtagcaaaattacacttcttcctaaacagaggagataggaaatggtgtaatttaacctggcggcagcgcaaaagatg

SEQ ID NO: 14576 - DNA, 103 bp, Artificial Sequence
  Synthetic Polynucleotide
taatacgactcactatagggaaagaggggtggtagcaaaattacacttctaacagaggagaagaagtatgattttgctaaacctggcggcagcgcaaaagatg

SEQ ID NO: 14577 - DNA, 103 bp, Artificial Sequence
  Synthetic Polynucleotide
taatacgactcactatagggctcacaaagaggggtggtagcaaaattacaaacagaggagatgtaatatggctaccaccaacctggcggcagcgcaaaagatg

SEQ ID NO: 14578 - DNA, 103 bp, Artificial Sequence
  Synthetic Polynucleotide
taatacgactcactatagggtcatactcacaaagaggggtggtagcaaaaaacagaggagattttgcatgcacccctctaacctggcggcagcgcaaaagatg

SEQ ID NO: 14579 - DNA, 103 bp, Artificial Sequence
  Synthetic Polynucleotide
taatacgactcactatagggtgccatcatactcacaaagaggggtggtagaacagaggagactaccaatgctctttgtgaacctggcggcagcgcaaaagatg

SEQ ID NO: 14580 - DNA, 103 bp, Artificial Sequence
  Synthetic Polynucleotide
taatacgactcactatagggcatattgccatcatactcacaaagaggggtaacagaggagaacccctatgtgtgagtataacctggcggcagcgcaaaagatg

SEQ ID NO: 14581 - DNA, 103 bp, Artificial Sequence
  Synthetic Polynucleotide
taatacgactcactatagggtcagccttacctctccaacttatctgggtgaacagaggagacacccaatgaagttggagaacctggcggcagcgcaaaagatg

SEQ ID NO: 14582 - DNA, 103 bp, Artificial Sequence
  Synthetic Polynucleotide
taatacgactcactataggggagaccatattgccatcatactcacaaagaaacagaggagatctttgatggtatgatggaacctggcggcagcgcaaaagatg

SEQ ID NO: 14583 - DNA, 103 bp, Artificial Sequence
  Synthetic Polynucleotide
taatacgactcactatagggaacctgagaccatattgccatcatactcacaacagaggagagtgagtatgatggcaataaacctggcggcagcgcaaaagatg

SEQ ID NO: 14584 - DNA, 103 bp, Artificial Sequence
  Synthetic Polynucleotide
taatacgactcactatagggcttgtaacctgagaccatattgccatcataaacagaggagatatgatatgaatatggtcaacctggcggcagcgcaaaagatg

SEQ ID NO: 14585 - DNA, 103 bp, Artificial Sequence
  Synthetic Polynucleotide
taatacgactcactatagggactttcttgtaacctgagaccatattgccaaacagaggagatggcaaatgggtctcaggaacctggcggcagcgcaaaagatg

SEQ ID NO: 14586 - DNA, 103 bp, Artificial Sequence
  Synthetic Polynucleotide
taatacgactcactatagggccatcactttcttgtaacctgagaccatataacagaggagaatatggatgcaggttacaaacctggcggcagcgcaaaagatg

SEQ ID NO: 14587 - DNA, 103 bp, Artificial Sequence
  Synthetic Polynucleotide
taatacgactcactatagggtgttgccatcactttcttgtaacctgagacaacagaggagagtctcaatgtacaagaaaaacctggcggcagcgcaaaagatg

SEQ ID NO: 14588 - DNA, 103 bp, Artificial Sequence
  Synthetic Polynucleotide
taatacgactcactatagggtcaattgttgccatcactttcttgtaacctaacagaggagaaggttaatggaaagtgataacctggcggcagcgcaaaagatg

SEQ ID NO: 14589 - DNA, 103 bp, Artificial Sequence
  Synthetic Polynucleotide
taatacgactcactatagggaggaatcaattgttgccatcactttcttgtaacagaggagaacaagaatgtgatggcaaaacctggcggcagcgcaaaagatg

SEQ ID NO: 14590 - DNA, 103 bp, Artificial Sequence
  Synthetic Polynucleotide
taatacgactcactatagggttgaaaggaatcaattgttgccatcactttaacagaggagaaaagtgatggcaacaattaacctggcggcagcgcaaaagatg

SEQ ID NO: 14591 - DNA, 103 bp, Artificial Sequence
  Synthetic Polynucleotide
taatacgactcactatagggaaggattgaaaggaatcaattgttgccatcaacagaggagagatggcatgaattgattcaacctggcggcagcgcaaaagatg

SEQ ID NO: 14592 - DNA, 103 bp, Artificial Sequence
  Synthetic Polynucleotide
taatacgactcactatagggcctgttcagccttacctctccaacttatctaacagaggagaagataaatgggagaggtaaacctggcggcagcgcaaaagatg

SEQ ID NO: 14593 - DNA, 103 bp, Artificial Sequence
  Synthetic Polynucleotide
taatacgactcactatagggtgttaaaggattgaaaggaatcaattgttgaacagaggagacaacaaatgattcctttcaacctggcggcagcgcaaaagatg

SEQ ID NO: 14594 - DNA, 103 bp, Artificial Sequence
  Synthetic Polynucleotide
taatacgactcactatagggactggtgttaaaggattgaaaggaatcaataacagaggagaattgatatgtttcaatccaacctggcggcagcgcaaaagatg

SEQ ID NO: 14595 - DNA, 103 bp, Artificial Sequence
  Synthetic Polynucleotide
taatacgactcactatagggatagtactggtgttaaaggattgaaaggaaaacagaggagattccttatgatcctttaaaacctggcggcagcgcaaaagatg

SEQ ID NO: 14596 - DNA, 103 bp, Artificial Sequence
  Synthetic Polynucleotide
taatacgactcactatagggagtgcatagtactggtgttaaaggattgaaaacagaggagattcaatatgttaacaccaaacctggcggcagcgcaaaagatg

SEQ ID NO: 14597 - DNA, 103 bp, Artificial Sequence
  Synthetic Polynucleotide
taatacgactcactatagggagtaaagtgcatagtactggtgttaaaggaaacagaggagatcctttatgaccagtactaacctggcggcagcgcaaaagatg

SEQ ID NO: 14598 - DNA, 103 bp, Artificial Sequence
  Synthetic Polynucleotide
taatacgactcactatagggtcatcagtaaagtgcatagtactggtgttaaacagaggagataacacatgtactatgcaaacctggcggcagcgcaaaagatg

SEQ ID NO: 14599 - DNA, 103 bp, Artificial Sequence
  Synthetic Polynucleotide
taatacgactcactatagggttctctcatcagtaaagtgcatagtactggaacagaggagaccagtaatgtgcactttaaacctggcggcagcgcaaaagatg

SEQ ID NO: 14600 - DNA, 103 bp, Artificial Sequence
  Synthetic Polynucleotide
taatacgactcactatagggttctattctctcatcagtaaagtgcatagtaacagaggagaactatgatgtttactgataacctggcggcagcgcaaaagatg

SEQ ID NO: 14601 - DNA, 103 bp, Artificial Sequence
  Synthetic Polynucleotide
taatacgactcactatagggttccattctattctctcatcagtaaagtgcaacagaggagagcacttatgtgatgagagaacctggcggcagcgcaaaagatg

SEQ ID NO: 14602 - DNA, 103 bp, Artificial Sequence
  Synthetic Polynucleotide
taatacgactcactatagggggtctttccattctattctctcatcagtaaaacagaggagattactgatgagagaatagaacctggcggcagcgcaaaagatg

SEQ ID NO: 14603 - DNA, 103 bp, Artificial Sequence
  Synthetic Polynucleotide
taatacgactcactatagggttgtgcctgttcagccttacctctccaactaacagaggagaagttggatgggtaaggctaacctggcggcagcgcaaaagatg

SEQ ID NO: 14604 - DNA, 103 bp, Artificial Sequence
  Synthetic Polynucleotide
taatacgactcactatagggatcggggtctttccattctattctctcatcaacagaggagagatgagatgatagaatggaacctggcggcagcgcaaaagatg

SEQ ID NO: 14605 - DNA, 103 bp, Artificial Sequence
  Synthetic Polynucleotide
taatacgactcactatagggatcccatcggggtctttccattctattctcaacagaggagagagaatatgatggaaagaaacctggcggcagcgcaaaagatg

SEQ ID NO: 14606 - DNA, 103 bp, Artificial Sequence
  Synthetic Polynucleotide
taatacgactcactatagggttaacatcccatcggggtctttccattctaaacagaggagatagaatatgaagaccccgaacctggcggcagcgcaaaagatg

SEQ ID NO: 14607 - DNA, 103 bp, Artificial Sequence
  Synthetic Polynucleotide
taatacgactcactataggggtcccttaacatcccatcggggtctttccaaacagaggagatggaaaatgcccgatgggaacctggcggcagcgcaaaagatg

SEQ ID NO: 14608 - DNA, 103 bp, Artificial Sequence
  Synthetic Polynucleotide
taatacgactcactatagggatatggtcccttaacatcccatcggggtctaacagaggagaagacccatgtgggatgttaacctggcggcagcgcaaaagatg

SEQ ID NO: 14609 - DNA, 103 bp, Artificial Sequence
  Synthetic Polynucleotide
taatacgactcactatagggtgtttatatggtcccttaacatcccatcggaacagaggagaccgatgatgtgttaagggaacctggcggcagcgcaaaagatg

SEQ ID NO: 14610 - DNA, 103 bp, Artificial Sequence
  Synthetic Polynucleotide
taatacgactcactatagggcagaatgtttatatggtcccttaacatcccaacagaggagagggatgatgagggaccataacctggcggcagcgcaaaagatg

SEQ ID NO: 14611 - DNA, 103 bp, Artificial Sequence
  Synthetic Polynucleotide
taatacgactcactataggggttaccagaatgtttatatggtcccttaacaacagaggagagttaagatgccatataaaaacctggcggcagcgcaaaagatg

SEQ ID NO: 14612 - DNA, 103 bp, Artificial Sequence
  Synthetic Polynucleotide
taatacgactcactatagggccttagttaccagaatgtttatatggtcccaacagaggagagggaccatgtaaacattcaacctggcggcagcgcaaaagatg

SEQ ID NO: 14613 - DNA, 103 bp, Artificial Sequence
  Synthetic Polynucleotide
taatacgactcactatagggaatgtccttagttaccagaatgtttatatgaacagaggagacatataatgattctggtaaacctggcggcagcgcaaaagatg

SEQ ID NO: 14614 - DNA, 103 bp, Artificial Sequence
  Synthetic Polynucleotide
taatacgactcactatagggctggcttgtgcctgttcagccttacctctcaacagaggagagagaggatgggctgaacaaacctggcggcagcgcaaaagatg

SEQ ID NO: 14615 - DNA, 103 bp, Artificial Sequence
  Synthetic Polynucleotide
taatacgactcactatagggaagtcaatgtccttagttaccagaatgtttaacagaggagaaaacatatgggtaactaaaacctggcggcagcgcaaaagatg

SEQ ID NO: 14616 - DNA, 103 bp, Artificial Sequence
  Synthetic Polynucleotide
taatacgactcactatagggtatcaaagtcaatgtccttagttaccagaaaacagaggagattctggatgctaaggacaaacctggcggcagcgcaaaagatg

SEQ ID NO: 14617 - DNA, 103 bp, Artificial Sequence
  Synthetic Polynucleotide
taatacgactcactataggggagattatcaaagtcaatgtccttagttacaacagaggagagtaactatggacattgacaacctggcggcagcgcaaaagatg

SEQ ID NO: 14618 - DNA, 103 bp, Artificial Sequence
  Synthetic Polynucleotide
taatacgactcactatagggtcaccgagattatcaaagtcaatgtccttaaacagaggagataaggaatgtgactttgaaacctggcggcagcgcaaaagatg

SEQ ID NO: 14619 - DNA, 103 bp, Artificial Sequence
  Synthetic Polynucleotide
taatacgactcactatagggggttttcaccgagattatcaaagtcaatgtaacagaggagaacattgatgttgataatcaacctggcggcagcgcaaaagatg

SEQ ID NO: 14620 - DNA, 103 bp, Artificial Sequence
  Synthetic Polynucleotide
taatacgactcactatagggacaggggttttcaccgagattatcaaagtcaacagaggagagactttatgaatctcggtaacctggcggcagcgcaaaagatg

SEQ ID NO: 14621 - DNA, 103 bp, Artificial Sequence
  Synthetic Polynucleotide
taatacgactcactatagggattttacaggggttttcaccgagattatcaaacagaggagatgataaatgcggtgaaaaaacctggcggcagcgcaaaagatg

SEQ ID NO: 14622 - DNA, 103 bp, Artificial Sequence
  Synthetic Polynucleotide
taatacgactcactatagggagccaattttacaggggttttcaccgagataacagaggagaatctcgatgaaaacccctaacctggcggcagcgcaaaagatg

SEQ ID NO: 14623 - DNA, 103 bp, Artificial Sequence
  Synthetic Polynucleotide
taatacgactcactatagggctgcaagccaattttacaggggttttcaccaacagaggagaggtgaaatgccctgtaaaaacctggcggcagcgcaaaagatg

SEQ ID NO: 14624 - DNA, 103 bp, Artificial Sequence
  Synthetic Polynucleotide
taatacgactcactataggggatgtctgcaagccaattttacaggggtttaacagaggagaaaacccatgtaaaattggaacctggcggcagcgcaaaagatg

SEQ ID NO: 14625 - DNA, 103 bp, Artificial Sequence
  Synthetic Polynucleotide
taatacgactcactatagggtttggctggcttgtgcctgttcagccttacaacagaggagagtaaggatgaacaggcacaacctggcggcagcgcaaaagatg

SEQ ID NO: 14626 - DNA, 103 bp, Artificial Sequence
  Synthetic Polynucleotide
taatacgactcactatagggttgaggatgtctgcaagccaattttacaggaacagaggagacctgtaatgttggcttgcaacctggcggcagcgcaaaagatg

SEQ ID NO: 14627 - DNA, 103 bp, Artificial Sequence
  Synthetic Polynucleotide
taatacgactcactatagggttcaattgaggatgtctgcaagccaattttaacagaggagaaaaattatgttgcagacaaacctggcggcagcgcaaaagatg

SEQ ID NO: 14628 - DNA, 103 bp, Artificial Sequence
  Synthetic Polynucleotide
taatacgactcactataggggccccttcaattgaggatgtctgcaagccaaacagaggagatggcttatggacatcctcaacctggcggcagcgcaaaagatg

SEQ ID NO: 14629 - DNA, 103 bp, Artificial Sequence
  Synthetic Polynucleotide
taatacgactcactatagggcccaggccccttcaattgaggatgtctgcaaacagaggagatgcagaatgcctcaattgaacctggcggcagcgcaaaagatg

SEQ ID NO: 14630 - DNA, 103 bp, Artificial Sequence
  Synthetic Polynucleotide
taatacgactcactatagggagaaccccaggccccttcaattgaggatgtaacagaggagaacatccatgattgaagggaacctggcggcagcgcaaaagatg

SEQ ID NO: 14631 - DNA, 103 bp, Artificial Sequence
  Synthetic Polynucleotide
taatacgactcactatagggacaccagaaccccaggccccttcaattgagaacagaggagactcaatatgaggggcctgaacctggcggcagcgcaaaagatg

SEQ ID NO: 14632 - DNA, 103 bp, Artificial Sequence
  Synthetic Polynucleotide
taatacgactcactatagggaacctacaccagaaccccaggccccttcaaaacagaggagattgaagatgcctggggttaacctggcggcagcgcaaaagatg

SEQ ID NO: 14633 - DNA, 103 bp, Artificial Sequence
  Synthetic Polynucleotide
taatacgactcactatagggtgtaaaacctacaccagaaccccaggccccaacagaggagaggggccatgggttctggtaacctggcggcagcgcaaaagatg

SEQ ID NO: 14634 - DNA, 103 bp, Artificial Sequence
  Synthetic Polynucleotide
taatacgactcactataggggtaagtgtaaaacctacaccagaaccccagaacagaggagactggggatgtggtgtaggaacctggcggcagcgcaaaagatg

SEQ ID NO: 14635 - DNA, 103 bp, Artificial Sequence
  Synthetic Polynucleotide
taatacgactcactataggggacatgtaagtgtaaaacctacaccagaacaacagaggagagttctgatgtaggttttaaacctggcggcagcgcaaaagatg

SEQ ID NO: 14636 - DNA, 103 bp, Artificial Sequence
  Synthetic Polynucleotide
taatacgactcactatagggcttccatatccccatgttgctgattgactgaacagaggagacagtcaatgagcaacatgaacctggcggcagcgcaaaagatg

SEQ ID NO: 14637 - DNA, 103 bp, Artificial Sequence
  Synthetic Polynucleotide
taatacgactcactatagggtgaattttggctggcttgtgcctgttcagcaacagaggagagctgaaatggcacaagccaacctggcggcagcgcaaaagatg

SEQ ID NO: 14638 - DNA, 103 bp, Artificial Sequence
  Synthetic Polynucleotide
taatacgactcactatagggtactagacatgtaagtgtaaaacctacaccaacagaggagaggtgtaatgtttacacttaacctggcggcagcgcaaaagatg

SEQ ID NO: 14639 - DNA, 103 bp, Artificial Sequence
  Synthetic Polynucleotide
taatacgactcactatagggaaagatactagacatgtaagtgtaaaacctaacagaggagaaggtttatgacttacatgaacctggcggcagcgcaaaagatg

SEQ ID NO: 14640 - DNA, 103 bp, Artificial Sequence
  Synthetic Polynucleotide
taatacgactcactatagggctgttaaagatactagacatgtaagtgtaaaacagaggagattacacatgcatgtctagaacctggcggcagcgcaaaagatg

SEQ ID NO: 14641 - DNA, 103 bp, Artificial Sequence
  Synthetic Polynucleotide
taatacgactcactatagggacactctgttaaagatactagacatgtaagaacagaggagacttacaatgctagtatctaacctggcggcagcgcaaaagatg

SEQ ID NO: 14642 - DNA, 103 bp, Artificial Sequence
  Synthetic Polynucleotide
taatacgactcactataggggtgggacactctgttaaagatactagacataacagaggagaatgtctatgatctttaacaacctggcggcagcgcaaaagatg

SEQ ID NO: 14643 - DNA, 103 bp, Artificial Sequence
  Synthetic Polynucleotide
taatacgactcactatagggagaaagtgggacactctgttaaagatactaaacagaggagatagtatatgtaacagagtaacctggcggcagcgcaaaagatg

SEQ ID NO: 14644 - DNA, 103 bp, Artificial Sequence
  Synthetic Polynucleotide
taatacgactcactatagggtgtcaagaaagtgggacactctgttaaagaaacagaggagatctttaatggagtgtcccaacctggcggcagcgcaaaagatg

SEQ ID NO: 14645 - DNA, 103 bp, Artificial Sequence
  Synthetic Polynucleotide
taatacgactcactatagggattgatgtcaagaaagtgggacactctgttaacagaggagaaacagaatgtcccactttaacctggcggcagcgcaaaagatg

SEQ ID NO: 14646 - DNA, 103 bp, Artificial Sequence
  Synthetic Polynucleotide
taatacgactcactatagggccttaattgatgtcaagaaagtgggacactaacagaggagaagtgtcatgctttcttgaaacctggcggcagcgcaaaagatg

SEQ ID NO: 14647 - DNA, 103 bp, Artificial Sequence
  Synthetic Polynucleotide
taatacgactcactataggggcaagccttaattgatgtcaagaaagtgggaacagaggagacccactatgttgacatcaaacctggcggcagcgcaaaagatg

SEQ ID NO: 14648 - DNA, 103 bp, Artificial Sequence
  Synthetic Polynucleotide
taatacgactcactatagggtcaaatgaattttggctggcttgtgcctgtaacagaggagaacaggcatgagccagccaaacctggcggcagcgcaaaagatg

SEQ ID NO: 14649 - DNA, 103 bp, Artificial Sequence
  Synthetic Polynucleotide
taatacgactcactatagggttatcgcaagccttaattgatgtcaagaaaaacagaggagatttcttatgatcaattaaaacctggcggcagcgcaaaagatg

SEQ ID NO: 14650 - DNA, 103 bp, Artificial Sequence
  Synthetic Polynucleotide
taatacgactcactatagggtggctttatcgcaagccttaattgatgtcaaacagaggagatgacatatgttaaggcttaacctggcggcagcgcaaaagatg

SEQ ID NO: 14651 - DNA, 103 bp, Artificial Sequence
  Synthetic Polynucleotide
taatacgactcactatagggacaaatggctttatcgcaagccttaattgaaacagaggagatcaattatggcttgcgataacctggcggcagcgcaaaagatg

SEQ ID NO: 14652 - DNA, 103 bp, Artificial Sequence
  Synthetic Polynucleotide
taatacgactcactatagggccataacaaatggctttatcgcaagccttaaacagaggagataaggcatgcgataaagcaacctggcggcagcgcaaaagatg

SEQ ID NO: 14653 - DNA, 103 bp, Artificial Sequence
  Synthetic Polynucleotide
taatacgactcactatagggctgcaccataacaaatggctttatcgcaagaacagaggagacttgcgatgaagccatttaacctggcggcagcgcaaaagatg

SEQ ID NO: 14654 - DNA, 103 bp, Artificial Sequence
  Synthetic Polynucleotide
taatacgactcactatagggactttctgcaccataacaaatggctttatcaacagaggagagataaaatgatttgttataacctggcggcagcgcaaaagatg

SEQ ID NO: 14655 - DNA, 103 bp, Artificial Sequence
  Synthetic Polynucleotide
taatacgactcactataggggtcacactttctgcaccataacaaatggctaacagaggagaagccatatgttatggtgcaacctggcggcagcgcaaaagatg

SEQ ID NO: 14656 - DNA, 103 bp, Artificial Sequence
  Synthetic Polynucleotide
taatacgactcactatagggttaatgtcacactttctgcaccataacaaaaacagaggagatttgttatggtgcagaaaaacctggcggcagcgcaaaagatg

SEQ ID NO: 14657 - DNA, 103 bp, Artificial Sequence
  Synthetic Polynucleotide
taatacgactcactatagggtcttgttaatgtcacactttctgcaccataaacagaggagatatggtatggaaagtgtgaacctggcggcagcgcaaaagatg

SEQ ID NO: 14658 - DNA, 103 bp, Artificial Sequence
  Synthetic Polynucleotide
taatacgactcactatagggtggcctcttgttaatgtcacactttctgcaaacagaggagatgcagaatgtgtgacattaacctggcggcagcgcaaaagatg

SEQ ID NO: 14659 - DNA, 103 bp, Artificial Sequence
  Synthetic Polynucleotide
taatacgactcactatagggctgcttcaaatgaattttggctggcttgtgaacagaggagacacaagatggccaaaattaacctggcggcagcgcaaaagatg

SEQ ID NO: 14660 - DNA, 103 bp, Artificial Sequence
  Synthetic Polynucleotide
taatacgactcactatagggtgttctggcctcttgttaatgtcacactttaacagaggagaaaagtgatgcattaacaaaacctggcggcagcgcaaaagatg

SEQ ID NO: 14661 - DNA, 103 bp, Artificial Sequence
  Synthetic Polynucleotide
taatacgactcactatagggtactgtgttctggcctcttgttaatgtcacaacagaggagagtgacaatgacaagaggcaacctggcggcagcgcaaaagatg

SEQ ID NO: 14662 - DNA, 103 bp, Artificial Sequence
  Synthetic Polynucleotide
taatacgactcactatagggacttttactgtgttctggcctcttgttaataacagaggagaattaacatgaggccagaaaacctggcggcagcgcaaaagatg

SEQ ID NO: 14663 - DNA, 103 bp, Artificial Sequence
  Synthetic Polynucleotide
taatacgactcactatagggctgacacttttactgtgttctggcctcttgaacagaggagacaagagatgagaacacagaacctggcggcagcgcaaaagatg

SEQ ID NO: 14664 - DNA, 103 bp, Artificial Sequence
  Synthetic Polynucleotide
taatacgactcactatagggtttacctgacacttttactgtgttctggccaacagaggagaggccagatgacagtaaaaaacctggcggcagcgcaaaagatg

SEQ ID NO: 14665 - DNA, 103 bp, Artificial Sequence
  Synthetic Polynucleotide
taatacgactcactatagggccacctttacctgacacttttactgtgttcaacagaggagagaacacatgaaaagtgtcaacctggcggcagcgcaaaagatg

SEQ ID NO: 14666 - DNA, 103 bp, Artificial Sequence
  Synthetic Polynucleotide
taatacgactcactatagggtatgaccacctttacctgacacttttactgaacagaggagacagtaaatgtgtcaggtaaacctggcggcagcgcaaaagatg

SEQ ID NO: 14667 - DNA, 103 bp, Artificial Sequence
  Synthetic Polynucleotide
taatacgactcactatagggaccactatgaccacctttacctgacactttaacagaggagaaaagtgatgggtaaaggtaacctggcggcagcgcaaaagatg

SEQ ID NO: 14668 - DNA, 103 bp, Artificial Sequence
  Synthetic Polynucleotide
taatacgactcactataggggttgaaccactatgaccacctttacctgacaacagaggagagtcaggatgaggtggtcaaacctggcggcagcgcaaaagatg

SEQ ID NO: 14669 - DNA, 103 bp, Artificial Sequence
  Synthetic Polynucleotide
taatacgactcactatagggtgaaagttgaaccactatgaccacctttacaacagaggagagtaaagatggtcatagtgaacctggcggcagcgcaaaagatg

SEQ ID NO: 14670 - DNA, 103 bp, Artificial Sequence
  Synthetic Polynucleotide
taatacgactcactatagggagacactgcttcaaatgaattttggctggcaacagaggagagccagcatgaattcatttaacctggcggcagcgcaaaagatg

SEQ ID NO: 14671 - DNA, 103 bp, Artificial Sequence
  Synthetic Polynucleotide
taatacgactcactataggggcatttgaaagttgaaccactatgaccaccaacagaggagaggtggtatgagtggttcaaacctggcggcagcgcaaaagatg

SEQ ID NO: 14672 - DNA, 103 bp, Artificial Sequence
  Synthetic Polynucleotide
taatacgactcactatagggtgacagcatttgaaagttgaaccactatgaaacagaggagatcatagatgttcaactttaacctggcggcagcgcaaaagatg

SEQ ID NO: 14673 - DNA, 103 bp, Artificial Sequence
  Synthetic Polynucleotide
taatacgactcactatagggctccatgacagcatttgaaagttgaaccacaacagaggagagtggttatgctttcaaataacctggcggcagcgcaaaagatg

SEQ ID NO: 14674 - DNA, 103 bp, Artificial Sequence
  Synthetic Polynucleotide
taatacgactcactatagggctcttctccatgacagcatttgaaagttgaaacagaggagatcaactatgaaatgctgtaacctggcggcagcgcaaaagatg

SEQ ID NO: 14675 - DNA, 103 bp, Artificial Sequence
  Synthetic Polynucleotide
taatacgactcactataggggaacactcttctccatgacagcatttgaaaaacagaggagatttcaaatgctgtcatggaacctggcggcagcgcaaaagatg

SEQ ID NO: 14676 - DNA, 103 bp, Artificial Sequence
  Synthetic Polynucleotide
taatacgactcactatagggtttgtgaacactcttctccatgacagcattaacagaggagaaatgctatgatggagaagaacctggcggcagcgcaaaagatg

SEQ ID NO: 14677 - DNA, 103 bp, Artificial Sequence
  Synthetic Polynucleotide
taatacgactcactatagggtccaatttgtgaacactcttctccatgacaaacagaggagatgtcatatggaagagtgtaacctggcggcagcgcaaaagatg

SEQ ID NO: 14678 - DNA, 103 bp, Artificial Sequence
  Synthetic Polynucleotide
taatacgactcactatagggtggagtccaatttgtgaacactcttctccaaacagaggagatggagaatggtgttcacaaacctggcggcagcgcaaaagatg

SEQ ID NO: 14679 - DNA, 103 bp, Artificial Sequence
  Synthetic Polynucleotide
taatacgactcactatagggcagcatggagtccaatttgtgaacactcttaacagaggagaaagagtatgcacaaattgaacctggcggcagcgcaaaagatg

SEQ ID NO: 14680 - DNA, 103 bp, Artificial Sequence
  Synthetic Polynucleotide
taatacgactcactatagggtgctgcagcatggagtccaatttgtgaacaaacagaggagatgttcaatgattggactcaacctggcggcagcgcaaaagatg

SEQ ID NO: 14681 - DNA, 103 bp, Artificial Sequence
  Synthetic Polynucleotide
taatacgactcactatagggtcagcagacactgcttcaaatgaattttggaacagaggagaccaaaaatgatttgaagcaacctggcggcagcgcaaaagatg

SEQ ID NO: 14682 - DNA, 103 bp, Artificial Sequence
  Synthetic Polynucleotide
taatacgactcactatagggtggggtgctgcagcatggagtccaatttgtaacagaggagaacaaatatgactccatgcaacctggcggcagcgcaaaagatg

SEQ ID NO: 14683 - DNA, 103 bp, Artificial Sequence
  Synthetic Polynucleotide
taatacgactcactatagggcaagatggggtgctgcagcatggagtccaaaacagaggagattggacatgatgctgcagaacctggcggcagcgcaaaagatg

SEQ ID NO: 14684 - DNA, 103 bp, Artificial Sequence
  Synthetic Polynucleotide
taatacgactcactatagggtttatcaagatggggtgctgcagcatggagaacagaggagactccatatggcagcacccaacctggcggcagcgcaaaagatg

SEQ ID NO: 14685 - DNA, 103 bp, Artificial Sequence
  Synthetic Polynucleotide
taatacgactcactatagggttgactttatcaagatggggtgctgcagcaaacagaggagatgctgcatgaccccatctaacctggcggcagcgcaaaagatg

SEQ ID NO: 14686 - DNA, 103 bp, Artificial Sequence
  Synthetic Polynucleotide
taatacgactcactatagggttccattgactttatcaagatggggtgctgaacagaggagacagcacatgatcttgataaacctggcggcagcgcaaaagatg

SEQ ID NO: 14687 - DNA, 103 bp, Artificial Sequence
  Synthetic Polynucleotide
taatacgactcactatagggagaaattccattgactttatcaagatggggaacagaggagaccccatatggataaagtcaacctggcggcagcgcaaaagatg

SEQ ID NO: 14688 - DNA, 103 bp, Artificial Sequence
  Synthetic Polynucleotide
taatacgactcactatagggatttcagaaattccattgactttatcaagaaacagaggagatcttgaatgagtcaatggaacctggcggcagcgcaaaagatg

SEQ ID NO: 14689 - DNA, 103 bp, Artificial Sequence
  Synthetic Polynucleotide
taatacgactcactatagggtttcaatttcagaaattccattgactttataacagaggagaataaagatgatggaatttaacctggcggcagcgcaaaagatg

SEQ ID NO: 14690 - DNA, 103 bp, Artificial Sequence
  Synthetic Polynucleotide
taatacgactcactatagggattattttcaatttcagaaattccattgacaacagaggagagtcaatatgatttctgaaaacctggcggcagcgcaaaagatg

SEQ ID NO: 14691 - DNA, 103 bp, Artificial Sequence
  Synthetic Polynucleotide
taatacgactcactatagggactttattattttcaatttcagaaattccaaacagaggagatggaatatgtgaaattgaaacctggcggcagcgcaaaagatg

SEQ ID NO: 14692 - DNA, 103 bp, Artificial Sequence
  Synthetic Polynucleotide
taatacgactcactatagggcaacttcagcagacactgcttcaaatgaataacagaggagaattcatatgaagcagtgtaacctggcggcagcgcaaaagatg

SEQ ID NO: 14693 - DNA, 103 bp, Artificial Sequence
  Synthetic Polynucleotide
taatacgactcactatagggcatatactttattattttcaatttcagaaaaacagaggagatttctgatgttgaaaataaacctggcggcagcgcaaaagatg

SEQ ID NO: 14694 - DNA, 103 bp, Artificial Sequence
  Synthetic Polynucleotide
taatacgactcactatagggatcatcatatactttattattttcaatttcaacagaggagagaaattatgaataataaaaacctggcggcagcgcaaaagatg

SEQ ID NO: 14695 - DNA, 103 bp, Artificial Sequence
  Synthetic Polynucleotide
taatacgactcactataggggccccatcatcatatactttattattttcaaacagaggagatgaaaaatgtaaagtataaacctggcggcagcgcaaaagatg

SEQ ID NO: 14696 - DNA, 103 bp, Artificial Sequence
  Synthetic Polynucleotide
taatacgactcactataggggaggtgccccatcatcatatactttattataacagaggagaataataatgtatatgatgaacctggcggcagcgcaaaagatg

SEQ ID NO: 14697 - DNA, 103 bp, Artificial Sequence
  Synthetic Polynucleotide
taatacgactcactatagggacattgaggtgccccatcatcatatactttaacagaggagaaaagtaatggatgatgggaacctggcggcagcgcaaaagatg

SEQ ID NO: 14698 - DNA, 103 bp, Artificial Sequence
  Synthetic Polynucleotide
taatacgactcactatagggaccccacattgaggtgccccatcatcatataacagaggagaatatgaatgtggggcaccaacctggcggcagcgcaaaagatg

SEQ ID NO: 14699 - DNA, 103 bp, Artificial Sequence
  Synthetic Polynucleotide
taatacgactcactatagggactttaccccacattgaggtgccccatcataacagaggagaatgatgatgcacctcaataacctggcggcagcgcaaaagatg

SEQ ID NO: 14700 - DNA, 103 bp, Artificial Sequence
  Synthetic Polynucleotide
taatacgactcactatagggccagcactttaccccacattgaggtgccccaacagaggagaggggcaatgcaatgtgggaacctggcggcagcgcaaaagatg

SEQ ID NO: 14701 - DNA, 103 bp, Artificial Sequence
  Synthetic Polynucleotide
taatacgactcactatagggacaaaccagcactttaccccacattgaggtaacagaggagaacctcaatgtggggtaaaaacctggcggcagcgcaaaagatg

SEQ ID NO: 14702 - DNA, 103 bp, Artificial Sequence
  Synthetic Polynucleotide
taatacgactcactatagggactctacaaaccagcactttaccccacattaacagaggagaaatgtgatgtaaagtgctaacctggcggcagcgcaaaagatg

SEQ ID NO: 14703 - DNA, 103 bp, Artificial Sequence
  Synthetic Polynucleotide
taatacgactcactatagggaaggtcaacttcagcagacactgcttcaaaaacagaggagatttgaaatggtgtctgctaacctggcggcagcgcaaaagatg

SEQ ID NO: 14704 - DNA, 103 bp, Artificial Sequence
  Synthetic Polynucleotide
taatacgactcactatagggtccagactctacaaaccagcactttaccccaacagaggagaggggtaatgtgctggtttaacctggcggcagcgcaaaagatg

SEQ ID NO: 14705 - DNA, 103 bp, Artificial Sequence
  Synthetic Polynucleotide
taatacgactcactatagggcattctccagactctacaaaccagcactttaacagaggagaaaagtgatggtttgtagaaacctggcggcagcgcaaaagatg

SEQ ID NO: 14706 - DNA, 103 bp, Artificial Sequence
  Synthetic Polynucleotide
taatacgactcactatagggagatccattctccagactctacaaaccagcaacagaggagagctggtatgtagagtctgaacctggcggcagcgcaaaagatg

SEQ ID NO: 14707 - DNA, 103 bp, Artificial Sequence
  Synthetic Polynucleotide
taatacgactcactatagggccctgagatccattctccagactctacaaaaacagaggagatttgtaatgtctggagaaaacctggcggcagcgcaaaagatg

SEQ ID NO: 14708 - DNA, 103 bp, Artificial Sequence
  Synthetic Polynucleotide
taatacgactcactatagggaagatccctgagatccattctccagactctaacagaggagaagagtcatgagaatggataacctggcggcagcgcaaaagatg

SEQ ID NO: 14709 - DNA, 103 bp, Artificial Sequence
  Synthetic Polynucleotide
taatacgactcactatagggcactaaagatccctgagatccattctccagaacagaggagactggagatgggatctcagaacctggcggcagcgcaaaagatg

SEQ ID NO: 14710 - DNA, 103 bp, Artificial Sequence
  Synthetic Polynucleotide
taatacgactcactatagggattcccactaaagatccctgagatccattcaacagaggagagaatggatgtcagggatcaacctggcggcagcgcaaaagatg

SEQ ID NO: 14711 - DNA, 103 bp, Artificial Sequence
  Synthetic Polynucleotide
taatacgactcactatagggatccaattcccactaaagatccctgagatcaacagaggagagatctcatggatctttagaacctggcggcagcgcaaaagatg

SEQ ID NO: 14712 - DNA, 103 bp, Artificial Sequence
  Synthetic Polynucleotide
taatacgactcactataggggcacaatccaattcccactaaagatccctgaacagaggagacagggaatgttagtgggaaacctggcggcagcgcaaaagatg

SEQ ID NO: 14713 - DNA, 103 bp, Artificial Sequence
  Synthetic Polynucleotide
taatacgactcactataggggatgagcacaatccaattcccactaaagataacagaggagaatctttatggggaattggaacctggcggcagcgcaaaagatg

SEQ ID NO: 14714 - DNA, 103 bp, Artificial Sequence
  Synthetic Polynucleotide
taatacgactcactatagggcctttaaggtcaacttcagcagacactgctaacagaggagaagcagtatgtgctgaagtaacctggcggcagcgcaaaagatg

SEQ ID NO: 14715 - DNA, 103 bp, Artificial Sequence
  Synthetic Polynucleotide
taatacgactcactatagggaggacgatgagcacaatccaattcccactaaacagaggagatagtggatgttggattgtaacctggcggcagcgcaaaagatg

SEQ ID NO: 14716 - DNA, 103 bp, Artificial Sequence
  Synthetic Polynucleotide
taatacgactcactatagggtacagaggacgatgagcacaatccaattccaacagaggagaggaattatgttgtgctcaaacctggcggcagcgcaaaagatg

SEQ ID NO: 14717 - DNA, 103 bp, Artificial Sequence
  Synthetic Polynucleotide
taatacgactcactataggggaatatacagaggacgatgagcacaatccaaacagaggagatggattatgctcatcgtcaacctggcggcagcgcaaaagatg

SEQ ID NO: 14718 - DNA, 103 bp, Artificial Sequence
  Synthetic Polynucleotide
taatacgactcactatagggaataagaatatacagaggacgatgagcacaaacagaggagatgtgctatgcgtcctctgaacctggcggcagcgcaaaagatg

SEQ ID NO: 14719 - DNA, 103 bp, Artificial Sequence
  Synthetic Polynucleotide
taatacgactcactatagggaaaacaataagaatatacagaggacgatgaaacagaggagatcatcgatgtctgtatataacctggcggcagcgcaaaagatg

SEQ ID NO: 14720 - DNA, 103 bp, Artificial Sequence
  Synthetic Polynucleotide
taatacgactcactatagggcagtgaaaacaataagaatatacagaggacaacagaggagagtcctcatgatattcttaaacctggcggcagcgcaaaagatg

SEQ ID NO: 14721 - DNA, 103 bp, Artificial Sequence
  Synthetic Polynucleotide
taatacgactcactatagggaataccagtgaaaacaataagaatatacagaacagaggagactgtatatgcttattgttaacctggcggcagcgcaaaagatg

SEQ ID NO: 14722 - DNA, 103 bp, Artificial Sequence
  Synthetic Polynucleotide
taatacgactcactatagggtgagtaataccagtgaaaacaataagaataaacagaggagatattctatgtgttttcacaacctggcggcagcgcaaaagatg

SEQ ID NO: 14723 - DNA, 103 bp, Artificial Sequence
  Synthetic Polynucleotide
taatacgactcactataggggacactgagtaataccagtgaaaacaataaaacagaggagattattgatgtcactggtaaacctggcggcagcgcaaaagatg

SEQ ID NO: 14724 - DNA, 103 bp, Artificial Sequence
  Synthetic Polynucleotide
taatacgactcactatagggcataggacactgagtaataccagtgaaaacaacagaggagagttttcatgggtattactaacctggcggcagcgcaaaagatg

SEQ ID NO: 14725 - DNA, 103 bp, Artificial Sequence
  Synthetic Polynucleotide
taatacgactcactatagggaagttcctttaaggtcaacttcagcagacaaacagaggagatgtctgatgaagttgaccaacctggcggcagcgcaaaagatg

SEQ ID NO: 14726 - DNA, 103 bp, Artificial Sequence
  Synthetic Polynucleotide
taatacgactcactatagggcaggacataggacactgagtaataccagtgaacagaggagacactggatgtactcagtgaacctggcggcagcgcaaaagatg

SEQ ID NO: 14727 - DNA, 103 bp, Artificial Sequence
  Synthetic Polynucleotide
taatacgactcactatagggcctaacaggacataggacactgagtaatacaacagaggagagtattaatgagtgtcctaaacctggcggcagcgcaaaagatg

SEQ ID NO: 14728 - DNA, 103 bp, Artificial Sequence
  Synthetic Polynucleotide
taatacgactcactatagggtgtttcctaacaggacataggacactgagtaacagaggagaactcagatgcctatgtccaacctggcggcagcgcaaaagatg

SEQ ID NO: 14729 - DNA, 103 bp, Artificial Sequence
  Synthetic Polynucleotide
taatacgactcactatagggttttgtgtttcctaacaggacataggacacaacagaggagagtgtccatggtcctgttaaacctggcggcagcgcaaaagatg

SEQ ID NO: 14730 - DNA, 103 bp, Artificial Sequence
  Synthetic Polynucleotide
taatacgactcactatagggtgactttttgtgtttcctaacaggacatagaacagaggagactatgtatggttaggaaaaacctggcggcagcgcaaaagatg

SEQ ID NO: 14731 - DNA, 103 bp, Artificial Sequence
  Synthetic Polynucleotide
taatacgactcactatagggatttatgactttttgtgtttcctaacaggaaacagaggagatcctgtatggaaacacaaaacctggcggcagcgcaaaagatg

SEQ ID NO: 14732 - DNA, 103 bp, Artificial Sequence
  Synthetic Polynucleotide
taatacgactcactatagggcaattatttatgactttttgtgtttcctaaaacagaggagattaggaatgacaaaaagtaacctggcggcagcgcaaaagatg

SEQ ID NO: 14733 - DNA, 103 bp, Artificial Sequence
  Synthetic Polynucleotide
taatacgactcactataggggatatcaattatttatgactttttgtgtttaacagaggagaaaacacatgaagtcataaaacctggcggcagcgcaaaagatg

SEQ ID NO: 14734 - DNA, 103 bp, Artificial Sequence
  Synthetic Polynucleotide
taatacgactcactatagggggaatgatatcaattatttatgactttttgaacagaggagacaaaaaatgataaataataacctggcggcagcgcaaaagatg

SEQ ID NO: 14735 - DNA, 103 bp, Artificial Sequence
  Synthetic Polynucleotide
taatacgactcactataggggtatgggaatgatatcaattatttatgactaacagaggagaagtcatatgtaattgataaacctggcggcagcgcaaaagatg

SEQ ID NO: 14736 - DNA, 103 bp, Artificial Sequence
  Synthetic Polynucleotide
taatacgactcactatagggaacacaagttcctttaaggtcaacttcagcaacagaggagagctgaaatggaccttaaaaacctggcggcagcgcaaaagatg

SEQ ID NO: 14737 - DNA, 103 bp, Artificial Sequence
  Synthetic Polynucleotide
taatacgactcactatagggcaatagtatgggaatgatatcaattatttaaacagaggagataaataatggatatcattaacctggcggcagcgcaaaagatg

SEQ ID NO: 14738 - DNA, 103 bp, Artificial Sequence
  Synthetic Polynucleotide
taatacgactcactatagggatatacaatagtatgggaatgatatcaattaacagaggagaaattgaatgcattcccataacctggcggcagcgcaaaagatg

SEQ ID NO: 14739 - DNA, 103 bp, Artificial Sequence
  Synthetic Polynucleotide
taatacgactcactatagggaggttatatacaatagtatgggaatgatataacagaggagaatatcaatgccatactataacctggcggcagcgcaaaagatg

SEQ ID NO: 14740 - DNA, 103 bp, Artificial Sequence
  Synthetic Polynucleotide
taatacgactcactatagggtagtaaggttatatacaatagtatgggaataacagaggagaattcccatgctattgtataacctggcggcagcgcaaaagatg

SEQ ID NO: 14741 - DNA, 103 bp, Artificial Sequence
  Synthetic Polynucleotide
taatacgactcactatagggatatatagtaaggttatatacaatagtatgaacagaggagacatactatggtatataacaacctggcggcagcgcaaaagatg

SEQ ID NO: 14742 - DNA, 103 bp, Artificial Sequence
  Synthetic Polynucleotide
taatacgactcactataggggtaatatatatagtaaggttatatacaataaacagaggagatattgtatgtaaccttacaacctggcggcagcgcaaaagatg

SEQ ID NO: 14743 - DNA, 103 bp, Artificial Sequence
  Synthetic Polynucleotide
taatacgactcactatagggacaaagtaatatatatagtaaggttatataaacagaggagatatataatgttactatataacctggcggcagcgcaaaagatg

SEQ ID NO: 14744 - DNA, 103 bp, Artificial Sequence
  Synthetic Polynucleotide
taatacgactcactataggggaaatacaaagtaatatatatagtaaggttaacagaggagaaaccttatgatatatattaacctggcggcagcgcaaaagatg

SEQ ID NO: 14745 - DNA, 103 bp, Artificial Sequence
  Synthetic Polynucleotide
taatacgactcactatagggaataggaaatacaaagtaatatatatagtaaacagaggagatactatatgtattactttaacctggcggcagcgcaaaagatg

SEQ ID NO: 14746 - DNA, 103 bp, Artificial Sequence
  Synthetic Polynucleotide
taatacgactcactataggggttataataggaaatacaaagtaatatataaacagaggagatatataatgctttgtattaacctggcggcagcgcaaaagatg

SEQ ID NO: 14747 - DNA, 103 bp, Artificial Sequence
  Synthetic Polynucleotide
taatacgactcactatagggagccacttccatatccccatgttgctgattaacagaggagaaatcagatgcatggggataacctggcggcagcgcaaaagatg

SEQ ID NO: 14748 - DNA, 103 bp, Artificial Sequence
  Synthetic Polynucleotide
taatacgactcactatagggttcaaaacacaagttcctttaaggtcaactaacagaggagaagttgaatgtaaaggaacaacctggcggcagcgcaaaagatg

SEQ ID NO: 14749 - DNA, 103 bp, Artificial Sequence
  Synthetic Polynucleotide
taatacgactcactatagggggtaggttataataggaaatacaaagtaataacagaggagaattactatgtatttcctaaacctggcggcagcgcaaaagatg

SEQ ID NO: 14750 - DNA, 103 bp, Artificial Sequence
  Synthetic Polynucleotide
taatacgactcactatagggtgttaggtaggttataataggaaatacaaaaacagaggagatttgtaatgcctattataaacctggcggcagcgcaaaagatg

SEQ ID NO: 14751 - DNA, 103 bp, Artificial Sequence
  Synthetic Polynucleotide
taatacgactcactatagggtagtgtgttaggtaggttataataggaaataacagaggagaatttccatgtataacctaaacctggcggcagcgcaaaagatg

SEQ ID NO: 14752 - DNA, 103 bp, Artificial Sequence
  Synthetic Polynucleotide
taatacgactcactatagggttttttagtgtgttaggtaggttataatagaacagaggagactattaatgcctacctaaaacctggcggcagcgcaaaagatg

SEQ ID NO: 14753 - DNA, 103 bp, Artificial Sequence
  Synthetic Polynucleotide
taatacgactcactatagggctattttttttagtgtgttaggtaggttataacagaggagaataaccatgctaacacacaacctggcggcagcgcaaaagatg

SEQ ID NO: 14754 - DNA, 103 bp, Artificial Sequence
  Synthetic Polynucleotide
taatacgactcactatagggagctactattttttttagtgtgttaggtagaacagaggagactacctatgacactaaaaaacctggcggcagcgcaaaagatg

SEQ ID NO: 14755 - DNA, 103 bp, Artificial Sequence
  Synthetic Polynucleotide
taatacgactcactatagggtagacagctactattttttttagtgtgttaaacagaggagataacacatgaaaaaaaataacctggcggcagcgcaaaagatg

SEQ ID NO: 14756 - DNA, 103 bp, Artificial Sequence
  Synthetic Polynucleotide
taatacgactcactatagggatggttagacagctactattttttttagtgaacagaggagacactaaatgaaatagtagaacctggcggcagcgcaaaagatg

SEQ ID NO: 14757 - DNA, 103 bp, Artificial Sequence
  Synthetic Polynucleotide
taatacgactcactataggggttgtatggttagacagctactatttttttaacagaggagaaaaaaaatggtagctgtcaacctggcggcagcgcaaaagatg

SEQ ID NO: 14758 - DNA, 103 bp, Artificial Sequence
  Synthetic Polynucleotide
taatacgactcactatagggtctaagttgtatggttagacagctactattaacagaggagaaatagtatgtgtctaaccaacctggcggcagcgcaaaagatg

SEQ ID NO: 14759 - DNA, 103 bp, Artificial Sequence
  Synthetic Polynucleotide
taatacgactcactatagggtgtgcttcaaaacacaagttcctttaaggtaacagaggagaaccttaatggaacttgtgaacctggcggcagcgcaaaagatg

SEQ ID NO: 14760 - DNA, 103 bp, Artificial Sequence
  Synthetic Polynucleotide
taatacgactcactatagggaaaaatctaagttgtatggttagacagctaaacagaggagatagctgatgaaccatacaaacctggcggcagcgcaaaagatg

SEQ ID NO: 14761 - DNA, 103 bp, Artificial Sequence
  Synthetic Polynucleotide
taatacgactcactatagggagaaaaaaaatctaagttgtatggttagacaacagaggagagtctaaatgtacaacttaaacctggcggcagcgcaaaagatg

SEQ ID NO: 14762 - DNA, 103 bp, Artificial Sequence
  Synthetic Polynucleotide
taatacgactcactatagggcatacagaaaaaaaatctaagttgtatggtaacagaggagaaccataatgcttagatttaacctggcggcagcgcaaaagatg

SEQ ID NO: 14763 - DNA, 103 bp, Artificial Sequence
  Synthetic Polynucleotide
taatacgactcactataggggacatcatacagaaaaaaaatctaagttgtaacagaggagaacaactatgattttttttaacctggcggcagcgcaaaagatg

SEQ ID NO: 14764 - DNA, 103 bp, Artificial Sequence
  Synthetic Polynucleotide
taatacgactcactataggggttaagacatcatacagaaaaaaaatctaaaacagaggagattagatatgttttctgtaaacctggcggcagcgcaaaagatg

SEQ ID NO: 14765 - DNA, 103 bp, Artificial Sequence
  Synthetic Polynucleotide
taatacgactcactatagggaagatgttaagacatcatacagaaaaaaaaaacagaggagattttttatgtgtatgatgaacctggcggcagcgcaaaagatg

SEQ ID NO: 14766 - DNA, 103 bp, Artificial Sequence
  Synthetic Polynucleotide
taatacgactcactatagggtccgcaagatgttaagacatcatacagaaaaacagaggagatttctgatggatgtcttaaacctggcggcagcgcaaaagatg

SEQ ID NO: 14767 - DNA, 103 bp, Artificial Sequence
  Synthetic Polynucleotide
taatacgactcactatagggtagactccgcaagatgttaagacatcatacaacagaggagagtatgaatgcttaacatcaacctggcggcagcgcaaaagatg

SEQ ID NO: 14768 - DNA, 103 bp, Artificial Sequence
  Synthetic Polynucleotide
taatacgactcactatagggagtagtagactccgcaagatgttaagacataacagaggagaatgtctatgcatcttgcgaacctggcggcagcgcaaaagatg

SEQ ID NO: 14769 - DNA, 103 bp, Artificial Sequence
  Synthetic Polynucleotide
taatacgactcactatagggcattttgtgcttcaaaacacaagttcctttaacagaggagaaaaggaatgtgtgttttgaacctggcggcagcgcaaaagatg

SEQ ID NO: 14770 - DNA, 103 bp, Artificial Sequence
  Synthetic Polynucleotide
taatacgactcactatagggtctagcattttgtgcttcaaaacacaagttaacagaggagaaacttgatgtttgaagcaaacctggcggcagcgcaaaagatg

SEQ ID NO: 14771 - DNA, 103 bp, Artificial Sequence
  Synthetic Polynucleotide
taatacgactcactatagggactcctctagcattttgtgcttcaaaacacaacagaggagagtgtttatgagcacaaaaaacctggcggcagcgcaaaagatg

SEQ ID NO: 14772 - DNA, 103 bp, Artificial Sequence
  Synthetic Polynucleotide
taatacgactcactataggggtatgactcctctagcattttgtgcttcaaaacagaggagattgaagatgaaaatgctaaacctggcggcagcgcaaaagatg

SEQ ID NO: 14773 - DNA, 103 bp, Artificial Sequence
  Synthetic Polynucleotide
taatacgactcactatagggctgcggtatgactcctctagcattttgtgcaacagaggagagcacaaatggctagaggaaacctggcggcagcgcaaaagatg

SEQ ID NO: 14774 - DNA, 103 bp, Artificial Sequence
  Synthetic Polynucleotide
taatacgactcactatagggttctactgcggtatgactcctctagcatttaacagaggagaaaatgcatgaggagtcataacctggcggcagcgcaaaagatg

SEQ ID NO: 14775 - DNA, 103 bp, Artificial Sequence
  Synthetic Polynucleotide
taatacgactcactatagggtgattttctactgcggtatgactcctctagaacagaggagactagagatgtcataccgcaacctggcggcagcgcaaaagatg

SEQ ID NO: 14776 - DNA, 103 bp, Artificial Sequence
  Synthetic Polynucleotide
taatacgactcactataggggttattgattttctactgcggtatgactccaacagaggagaggagtcatgccgcagtagaacctggcggcagcgcaaaagatg

SEQ ID NO: 14777 - DNA, 103 bp, Artificial Sequence
  Synthetic Polynucleotide
taatacgactcactatagggttactagccacttccatatccccatgttgcaacagaggagagcaacaatgggatatggaaacctggcggcagcgcaaaagatg

SEQ ID NO: 14778 - DNA, 103 bp, Artificial Sequence
  Synthetic Polynucleotide
taatacgactcactatagggaacaagttattgattttctactgcggtatgaacagaggagacataccatggtagaaaataacctggcggcagcgcaaaagatg

SEQ ID NO: 14779 - DNA, 103 bp, Artificial Sequence
  Synthetic Polynucleotide
taatacgactcactataggggtcataacaagttattgattttctactgcgaacagaggagacgcagtatgaaatcaataaacctggcggcagcgcaaaagatg

SEQ ID NO: 14780 - DNA, 103 bp, Artificial Sequence
  Synthetic Polynucleotide
taatacgactcactataggggaaaggtcataacaagttattgattttctaaacagaggagatagaaaatgaataacttgaacctggcggcagcgcaaaagatg

SEQ ID NO: 14781 - DNA, 103 bp, Artificial Sequence
  Synthetic Polynucleotide
taatacgactcactatagggtacaggaaaggtcataacaagttattgattaacagaggagaaatcaaatgcttgttatgaacctggcggcagcgcaaaagatg

SEQ ID NO: 14782 - DNA, 103 bp, Artificial Sequence
  Synthetic Polynucleotide
taatacgactcactataggggctgttacaggaaaggtcataacaagttataacagaggagaataactatgtatgaccttaacctggcggcagcgcaaaagatg

SEQ ID NO: 14783 - DNA, 103 bp, Artificial Sequence
  Synthetic Polynucleotide
taatacgactcactatagggtaggtgctgttacaggaaaggtcataacaaaacagaggagattgttaatgcctttcctgaacctggcggcagcgcaaaagatg

SEQ ID NO: 14784 - DNA, 103 bp, Artificial Sequence
  Synthetic Polynucleotide
taatacgactcactatagggtacagtaggtgctgttacaggaaaggtcataacagaggagaatgaccatgcctgtaacaaacctggcggcagcgcaaaagatg

SEQ ID NO: 14785 - DNA, 103 bp, Artificial Sequence
  Synthetic Polynucleotide
taatacgactcactataggggggcttacagtaggtgctgttacaggaaagaacagaggagactttccatgaacagcaccaacctggcggcagcgcaaaagatg

SEQ ID NO: 14786 - DNA, 103 bp, Artificial Sequence
  Synthetic Polynucleotide
taatacgactcactatagggagggtgggcttacagtaggtgctgttacagaacagaggagactgtaaatgcacctactgaacctggcggcagcgcaaaagatg

SEQ ID NO: 14787 - DNA, 103 bp, Artificial Sequence
  Synthetic Polynucleotide
taatacgactcactatagggtgtacagggtgggcttacagtaggtgctgtaacagaggagaacagcaatgactgtaagcaacctggcggcagcgcaaaagatg

SEQ ID NO: 14788 - DNA, 103 bp, Artificial Sequence
  Synthetic Polynucleotide
taatacgactcactatagggggccattactagccacttccatatccccataacagaggagaatggggatgtggaagtggaacctggcggcagcgcaaaagatg

SEQ ID NO: 14789 - DNA, 103 bp, Artificial Sequence
  Synthetic Polynucleotide
taatacgactcactatagggaatcatgtacagggtgggcttacagtaggtaacagaggagaacctacatgaagcccaccaacctggcggcagcgcaaaagatg

SEQ ID NO: 14790 - DNA, 103 bp, Artificial Sequence
  Synthetic Polynucleotide
taatacgactcactatagggggtacaatcatgtacagggtgggcttacagaacagaggagactgtaaatgcaccctgtaaacctggcggcagcgcaaaagatg

SEQ ID NO: 14791 - DNA, 103 bp, Artificial Sequence
  Synthetic Polynucleotide
taatacgactcactataggggaattggtacaatcatgtacagggtgggctaacagaggagaagcccaatgtgtacatgaaacctggcggcagcgcaaaagatg

SEQ ID NO: 14792 - DNA, 103 bp, Artificial Sequence
  Synthetic Polynucleotide
taatacgactcactatagggtgcatgaattggtacaatcatgtacagggtaacagaggagaaccctgatgatgattgtaaacctggcggcagcgcaaaagatg

SEQ ID NO: 14793 - DNA, 103 bp, Artificial Sequence
  Synthetic Polynucleotide
taatacgactcactatagggttacatgcatgaattggtacaatcatgtacaacagaggagagtacatatgtgtaccaataacctggcggcagcgcaaaagatg

SEQ ID NO: 14794 - DNA, 103 bp, Artificial Sequence
  Synthetic Polynucleotide
taatacgactcactatagggtcatgttacatgcatgaattggtacaatcaaacagaggagatgattgatgcaattcatgaacctggcggcagcgcaaaagatg

SEQ ID NO: 14795 - DNA, 103 bp, Artificial Sequence
  Synthetic Polynucleotide
taatacgactcactatagggtttcatcatgttacatgcatgaattggtacaacagaggagagtaccaatgcatgcatgtaacctggcggcagcgcaaaagatg

SEQ ID NO: 14796 - DNA, 103 bp, Artificial Sequence
  Synthetic Polynucleotide
taatacgactcactatagggcaacttttcatcatgttacatgcatgaattaacagaggagaaattcaatgatgtaacataacctggcggcagcgcaaaagatg

SEQ ID NO: 14797 - DNA, 103 bp, Artificial Sequence
  Synthetic Polynucleotide
taatacgactcactatagggtcaaacaacttttcatcatgttacatgcataacagaggagaatgcatatgacatgatgaaacctggcggcagcgcaaaagatg

SEQ ID NO: 14798 - DNA, 103 bp, Artificial Sequence
  Synthetic Polynucleotide
taatacgactcactatagggtgcaatcaaacaacttttcatcatgttacaaacagaggagatgtaacatgatgaaaagtaacctggcggcagcgcaaaagatg

SEQ ID NO: 14799 - DNA, 103 bp, Artificial Sequence
  Synthetic Polynucleotide
taatacgactcactataggggtctcctcctactgtaaaacatcccttgcaaacagaggagatgcaagatgtgttttacaaacctggcggcagcgcaaaagatg

SEQ ID NO: 14800 - DNA, 103 bp, Artificial Sequence
  Synthetic Polynucleotide
taatacgactcactataggggtattatcccttcctctttttctaggtataaacagaggagatataccatgaaaaagaggaacctggcggcagcgcaaaagatg

SEQ ID NO: 14801 - DNA, 103 bp, Artificial Sequence
  Synthetic Polynucleotide
taatacgactcactatagggacagtaagtatgagggcgttccccaccagcaacagaggagagctggtatggaacgccctaacctggcggcagcgcaaaagatg

SEQ ID NO: 14802 - DNA, 103 bp, Artificial Sequence
  Synthetic Polynucleotide
taatacgactcactatagggggattgttctatacctacccaccatgccacaacagaggagagtggcaatgtgggtaggtaacctggcggcagcgcaaaagatg

SEQ ID NO: 14803 - DNA, 103 bp, Artificial Sequence
  Synthetic Polynucleotide
taatacgactcactatagggccaaaggattgttctatacctacccaccataacagaggagaatggtgatgaggtatagaaacctggcggcagcgcaaaagatg

SEQ ID NO: 14804 - DNA, 103 bp, Artificial Sequence
  Synthetic Polynucleotide
taatacgactcactataggggtactccaaaggattgttctatacctacccaacagaggagagggtagatgtagaacaataacctggcggcagcgcaaaagatg

SEQ ID NO: 14805 - DNA, 103 bp, Artificial Sequence
  Synthetic Polynucleotide
taatacgactcactataggggtaaggtactccaaaggattgttctataccaacagaggagaggtataatgcaatcctttaacctggcggcagcgcaaaagatg

SEQ ID NO: 14806 - DNA, 103 bp, Artificial Sequence
  Synthetic Polynucleotide
taatacgactcactataggggggttgtaaggtactccaaaggattgttctaacagaggagaagaacaatgctttggagtaacctggcggcagcgcaaaagatg

SEQ ID NO: 14807 - DNA, 103 bp, Artificial Sequence
  Synthetic Polynucleotide
taatacgactcactatagggtttgtgggttgtaaggtactccaaaggattaacagaggagaaatcctatggagtaccttaacctggcggcagcgcaaaagatg

SEQ ID NO: 14808 - DNA, 103 bp, Artificial Sequence
  Synthetic Polynucleotide
taatacgactcactatagggctggctttgtgggttgtaaggtactccaaaaacagaggagatttggaatgccttacaacaacctggcggcagcgcaaaagatg

SEQ ID NO: 14809 - DNA, 103 bp, Artificial Sequence
  Synthetic Polynucleotide
taatacgactcactatagggactccctggctttgtgggttgtaaggtactaacagaggagaagtaccatgcaacccacaaacctggcggcagcgcaaaagatg

SEQ ID NO: 14810 - DNA, 103 bp, Artificial Sequence
  Synthetic Polynucleotide
taatacgactcactatagggctactactccctggctttgtgggttgtaagaacagaggagacttacaatgcacaaagccaacctggcggcagcgcaaaagatg

SEQ ID NO: 14811 - DNA, 103 bp, Artificial Sequence
  Synthetic Polynucleotide
taatacgactcactatagggtgcttctactactccctggctttgtgggttaacagaggagaaacccaatgagccagggaaacctggcggcagcgcaaaagatg

SEQ ID NO: 14812 - DNA, 103 bp, Artificial Sequence
  Synthetic Polynucleotide
taatacgactcactatagggtttatacagtaagtatgagggcgttccccaaacagaggagatggggaatgccctcatacaacctggcggcagcgcaaaagatg

SEQ ID NO: 14813 - DNA, 103 bp, Artificial Sequence
  Synthetic Polynucleotide
taatacgactcactatagggttcattgcttctactactccctggctttgtaacagaggagaacaaagatggggagtagtaacctggcggcagcgcaaaagatg

SEQ ID NO: 14814 - DNA, 103 bp, Artificial Sequence
  Synthetic Polynucleotide
taatacgactcactatagggggtgattcattgcttctactactccctggcaacagaggagagccaggatgtagtagaagaacctggcggcagcgcaaaagatg

SEQ ID NO: 14815 - DNA, 103 bp, Artificial Sequence
  Synthetic Polynucleotide
taatacgactcactatagggtaggtggtgattcattgcttctactactccaacagaggagaggagtaatggaagcaatgaacctggcggcagcgcaaaagatg

SEQ ID NO: 14816 - DNA, 103 bp, Artificial Sequence
  Synthetic Polynucleotide
taatacgactcactatagggttctttaggtggtgattcattgcttctactaacagaggagaagtagaatgaatgaatcaaacctggcggcagcgcaaaagatg

SEQ ID NO: 14817 - DNA, 103 bp, Artificial Sequence
  Synthetic Polynucleotide
taatacgactcactatagggtctgattctttaggtggtgattcattgcttaacagaggagaaagcaaatgatcaccaccaacctggcggcagcgcaaaagatg

SEQ ID NO: 14818 - DNA, 103 bp, Artificial Sequence
  Synthetic Polynucleotide
taatacgactcactatagggacttatctgattctttaggtggtgattcataacagaggagaatgaatatgcacctaaagaacctggcggcagcgcaaaagatg

SEQ ID NO: 14819 - DNA, 103 bp, Artificial Sequence
  Synthetic Polynucleotide
taatacgactcactatagggattctacttatctgattctttaggtggtgaaacagaggagatcaccaatgaaagaatcaaacctggcggcagcgcaaaagatg

SEQ ID NO: 14820 - DNA, 103 bp, Artificial Sequence
  Synthetic Polynucleotide
taatacgactcactatagggctctaattctacttatctgattctttaggtaacagaggagaacctaaatgatcagataaaacctggcggcagcgcaaaagatg

SEQ ID NO: 14821 - DNA, 103 bp, Artificial Sequence
  Synthetic Polynucleotide
taatacgactcactatagggctgttctctaattctacttatctgattcttaacagaggagaaagaatatgataagtagaaacctggcggcagcgcaaaagatg

SEQ ID NO: 14822 - DNA, 103 bp, Artificial Sequence
  Synthetic Polynucleotide
taatacgactcactatagggtttgcctgttctctaattctacttatctgaaacagaggagatcagatatgtagaattagaacctggcggcagcgcaaaagatg

SEQ ID NO: 14823 - DNA, 103 bp, Artificial Sequence
  Synthetic Polynucleotide
taatacgactcactataggggtacatttatacagtaagtatgagggcgttaacagaggagaaacgccatgatacttactaacctggcggcagcgcaaaagatg

SEQ ID NO: 14824 - DNA, 103 bp, Artificial Sequence
  Synthetic Polynucleotide
taatacgactcactatagggttgtatttgcctgttctctaattctacttaaacagaggagataagtaatgttagagaacaacctggcggcagcgcaaaagatg

SEQ ID NO: 14825 - DNA, 103 bp, Artificial Sequence
  Synthetic Polynucleotide
taatacgactcactatagggttctattgtatttgcctgttctctaattctaacagaggagaagaattatggaacaggcaaacctggcggcagcgcaaaagatg

SEQ ID NO: 14826 - DNA, 103 bp, Artificial Sequence
  Synthetic Polynucleotide
taatacgactcactatagggattgtttctattgtatttgcctgttctctaaacagaggagatagagaatgggcaaatacaacctggcggcagcgcaaaagatg

SEQ ID NO: 14827 - DNA, 103 bp, Artificial Sequence
  Synthetic Polynucleotide
taatacgactcactataggggtactattgtttctattgtatttgcctgttaacagaggagaaacaggatgatacaatagaacctggcggcagcgcaaaagatg

SEQ ID NO: 14828 - DNA, 103 bp, Artificial Sequence
  Synthetic Polynucleotide
taatacgactcactatagggcatcagtactattgtttctattgtatttgcaacagaggagagcaaatatgatagaaacaaacctggcggcagcgcaaaagatg

SEQ ID NO: 14829 - DNA, 103 bp, Artificial Sequence
  Synthetic Polynucleotide
taatacgactcactatagggactgccatcagtactattgtttctattgtaaacagaggagatacaatatgaacaatagtaacctggcggcagcgcaaaagatg

SEQ ID NO: 14830 - DNA, 103 bp, Artificial Sequence
  Synthetic Polynucleotide
taatacgactcactatagggaatgaactgccatcagtactattgtttctaaacagaggagatagaaaatgtagtactgaaacctggcggcagcgcaaaagatg

SEQ ID NO: 14831 - DNA, 103 bp, Artificial Sequence
  Synthetic Polynucleotide
taatacgactcactatagggcatgcaatgaactgccatcagtactattgtaacagaggagaacaataatgctgatggcaaacctggcggcagcgcaaaagatg

SEQ ID NO: 14832 - DNA, 103 bp, Artificial Sequence
  Synthetic Polynucleotide
taatacgactcactatagggaaattcatgcaatgaactgccatcagtactaacagaggagaagtactatgggcagttcaaacctggcggcagcgcaaaagatg

SEQ ID NO: 14833 - DNA, 103 bp, Artificial Sequence
  Synthetic Polynucleotide
taatacgactcactatagggttttaaaattcatgcaatgaactgccatcaaacagaggagatgatggatgttcattgcaaacctggcggcagcgcaaaagatg

SEQ ID NO: 14834 - DNA, 103 bp, Artificial Sequence
  Synthetic Polynucleotide
taatacgactcactatagggagcgggtacatttatacagtaagtatgaggaacagaggagacctcatatgtactgtataaacctggcggcagcgcaaaagatg

SEQ ID NO: 14835 - DNA, 103 bp, Artificial Sequence
  Synthetic Polynucleotide
taatacgactcactatagggccttcttttaaaattcatgcaatgaactgcaacagaggagagcagttatgtgcatgaataacctggcggcagcgcaaaagatg

SEQ ID NO: 14836 - DNA, 103 bp, Artificial Sequence
  Synthetic Polynucleotide
taatacgactcactatagggcctccccttcttttaaaattcatgcaatgaaacagaggagatcattgatggaattttaaaacctggcggcagcgcaaaagatg

SEQ ID NO: 14837 - DNA, 103 bp, Artificial Sequence
  Synthetic Polynucleotide
taatacgactcactatagggctattcctccccttcttttaaaattcatgcaacagaggagagcatgaatgttaaaagaaaacctggcggcagcgcaaaagatg

SEQ ID NO: 14838 - DNA, 103 bp, Artificial Sequence
  Synthetic Polynucleotide
taatacgactcactatagggatcccctattcctccccttcttttaaaattaacagaggagaaattttatgagaaggggaaacctggcggcagcgcaaaagatg

SEQ ID NO: 14839 - DNA, 103 bp, Artificial Sequence
  Synthetic Polynucleotide
taatacgactcactataggggtcatatcccctattcctccccttcttttaaacagaggagataaaagatggggaggaataacctggcggcagcgcaaaagatg

SEQ ID NO: 14840 - DNA, 103 bp, Artificial Sequence
  Synthetic Polynucleotide
taatacgactcactatagggctggggtcatatcccctattcctccccttcaacagaggagagaagggatggaataggggaacctggcggcagcgcaaaagatg

SEQ ID NO: 14841 - DNA, 103 bp, Artificial Sequence
  Synthetic Polynucleotide
taatacgactcactatagggttctgctggggtcatatcccctattcctccaacagaggagaggaggaatgggggatatgaacctggcggcagcgcaaaagatg

SEQ ID NO: 14842 - DNA, 103 bp, Artificial Sequence
  Synthetic Polynucleotide
taatacgactcactatagggagtctttctgctggggtcatatcccctattaacagaggagaaataggatgtatgaccccaacctggcggcagcgcaaaagatg

SEQ ID NO: 14843 - DNA, 103 bp, Artificial Sequence
  Synthetic Polynucleotide
taatacgactcactatagggtgattagtctttctgctggggtcatatcccaacagaggagagggataatgccccagcagaacctggcggcagcgcaaaagatg

SEQ ID NO: 14844 - DNA, 103 bp, Artificial Sequence
  Synthetic Polynucleotide
taatacgactcactatagggcatgttgattagtctttctgctggggtcataacagaggagaatgaccatggcagaaagaaacctggcggcagcgcaaaagatg

SEQ ID NO: 14845 - DNA, 103 bp, Artificial Sequence
  Synthetic Polynucleotide
taatacgactcactatagggcaagaagcgggtacatttatacagtaagtaaacagaggagatacttaatgtataaatgtaacctggcggcagcgcaaaagatg

SEQ ID NO: 14846 - DNA, 103 bp, Artificial Sequence
  Synthetic Polynucleotide
taatacgactcactataggggtaatcatgttgattagtctttctgctgggaacagaggagacccagcatgaagactaataacctggcggcagcgcaaaagatg

SEQ ID NO: 14847 - DNA, 103 bp, Artificial Sequence
  Synthetic Polynucleotide
taatacgactcactatagggctgtggtaatcatgttgattagtctttctgaacagaggagacagaaaatgtaatcaacaaacctggcggcagcgcaaaagatg

SEQ ID NO: 14848 - DNA, 103 bp, Artificial Sequence
  Synthetic Polynucleotide
taatacgactcactatagggttgttctgtggtaatcatgttgattagtctaacagaggagaagactaatgaacatgattaacctggcggcagcgcaaaagatg

SEQ ID NO: 14849 - DNA, 103 bp, Artificial Sequence
  Synthetic Polynucleotide
taatacgactcactatagggatttcttgttctgtggtaatcatgttgattaacagaggagaaatcaaatggattaccacaacctggcggcagcgcaaaagatg

SEQ ID NO: 14850 - DNA, 103 bp, Artificial Sequence
  Synthetic Polynucleotide
taatacgactcactatagggattgtatttcttgttctgtggtaatcatgtaacagaggagaacatgaatgccacagaacaacctggcggcagcgcaaaagatg

SEQ ID NO: 14851 - DNA, 103 bp, Artificial Sequence
  Synthetic Polynucleotide
taatacgactcactataggggaggaattgtatttcttgttctgtggtaataacagaggagaattaccatggaacaagaaaacctggcggcagcgcaaaagatg

SEQ ID NO: 14852 - DNA, 103 bp, Artificial Sequence
  Synthetic Polynucleotide
taatacgactcactatagggctttggaggaattgtatttcttgttctgtgaacagaggagacacagaatgagaaatacaaacctggcggcagcgcaaaagatg

SEQ ID NO: 14853 - DNA, 103 bp, Artificial Sequence
  Synthetic Polynucleotide
taatacgactcactatagggtttttctttggaggaattgtatttcttgttaacagaggagaaacaagatgtacaattccaacctggcggcagcgcaaaagatg

SEQ ID NO: 14854 - DNA, 103 bp, Artificial Sequence
  Synthetic Polynucleotide
taatacgactcactatagggtgaattttttctttggaggaattgtatttcaacagaggagagaaataatgttcctccaaaacctggcggcagcgcaaaagatg

SEQ ID NO: 14855 - DNA, 103 bp, Artificial Sequence
  Synthetic Polynucleotide
taatacgactcactatagggaaatttgaattttttctttggaggaattgtaacagaggagaacaattatgccaaagaaaaacctggcggcagcgcaaaagatg

SEQ ID NO: 14856 - DNA, 103 bp, Artificial Sequence
  Synthetic Polynucleotide
taatacgactcactatagggcaatgcaagaagcgggtacatttatacagtaacagaggagaactgtaatgatgtacccgaacctggcggcagcgcaaaagatg

SEQ ID NO: 14857 - DNA, 103 bp, Artificial Sequence
  Synthetic Polynucleotide
taatacgactcactatagggttttaaaatttgaattttttctttggaggaaacagaggagatcctccatggaaaaaattaacctggcggcagcgcaaaagatg

SEQ ID NO: 14858 - DNA, 103 bp, Artificial Sequence
  Synthetic Polynucleotide
taatacgactcactataggggaaatttttaaaatttgaattttttctttgaacagaggagacaaagaatgaattcaaataacctggcggcagcgcaaaagatg

SEQ ID NO: 14859 - DNA, 103 bp, Artificial Sequence
  Synthetic Polynucleotide
taatacgactcactatagggacctggaaatttttaaaatttgaattttttaacagaggagaaaaaaaatgaaattttaaaacctggcggcagcgcaaaagatg

SEQ ID NO: 14860 - DNA, 103 bp, Artificial Sequence
  Synthetic Polynucleotide
taatacgactcactatagggaatagacctggaaatttttaaaatttgaataacagaggagaattcaaatgttaaaaattaacctggcggcagcgcaaaagatg

SEQ ID NO: 14861 - DNA, 103 bp, Artificial Sequence
  Synthetic Polynucleotide
taatacgactcactatagggtctgtaatagacctggaaatttttaaaattaacagaggagaaattttatgaatttccagaacctggcggcagcgcaaaagatg

SEQ ID NO: 14862 - DNA, 103 bp, Artificial Sequence
  Synthetic Polynucleotide
taatacgactcactatagggccttctctgtaatagacctggaaatttttaaacagaggagataaaaaatgccaggtctaaacctggcggcagcgcaaaagatg

SEQ ID NO: 14863 - DNA, 103 bp, Artificial Sequence
  Synthetic Polynucleotide
taatacgactcactatagggctctgccttctctgtaatagacctggaaataacagaggagaatttccatgtctattacaaacctggcggcagcgcaaaagatg

SEQ ID NO: 14864 - DNA, 103 bp, Artificial Sequence
  Synthetic Polynucleotide
taatacgactcactatagggctgatctctgccttctctgtaatagacctgaacagaggagacaggtcatgtacagagaaaacctggcggcagcgcaaaagatg

SEQ ID NO: 14865 - DNA, 103 bp, Artificial Sequence
  Synthetic Polynucleotide
taatacgactcactatagggcacagctgatctctgccttctctgtaatagaacagaggagactattaatgagaaggcagaacctggcggcagcgcaaaagatg

SEQ ID NO: 14866 - DNA, 103 bp, Artificial Sequence
  Synthetic Polynucleotide
taatacgactcactatagggctttccacagctgatctctgccttctctgtaacagaggagaacagagatggcagagatcaacctggcggcagcgcaaaagatg

SEQ ID NO: 14867 - DNA, 103 bp, Artificial Sequence
  Synthetic Polynucleotide
taatacgactcactataggggaatacaatgcaagaagcgggtacatttataacagaggagaataaatatgcccgcttctaacctggcggcagcgcaaaagatg

SEQ ID NO: 14868 - DNA, 103 bp, Artificial Sequence
  Synthetic Polynucleotide
taatacgactcactatagggaggtcctttccacagctgatctctgccttcaacagaggagagaaggcatggatcagctgaacctggcggcagcgcaaaagatg

SEQ ID NO: 14869 - DNA, 103 bp, Artificial Sequence
  Synthetic Polynucleotide
taatacgactcactatagggtcaccaggtcctttccacagctgatctctgaacagaggagacagagaatggctgtggaaaacctggcggcagcgcaaaagatg

SEQ ID NO: 14870 - DNA, 103 bp, Artificial Sequence
  Synthetic Polynucleotide
taatacgactcactataggggtagttcaccaggtcctttccacagctgataacagaggagaatcagcatgggaaaggacaacctggcggcagcgcaaaagatg

SEQ ID NO: 14871 - DNA, 103 bp, Artificial Sequence
  Synthetic Polynucleotide
taatacgactcactatagggccacagtagttcaccaggtcctttccacagaacagaggagactgtggatgggacctggtaacctggcggcagcgcaaaagatg

SEQ ID NO: 14872 - DNA, 103 bp, Artificial Sequence
  Synthetic Polynucleotide
taatacgactcactatagggcccttccacagtagttcaccaggtcctttcaacagaggagagaaaggatgtggtgaactaacctggcggcagcgcaaaagatg

SEQ ID NO: 14873 - DNA, 103 bp, Artificial Sequence
  Synthetic Polynucleotide
taatacgactcactatagggcttctcccttccacagtagttcaccaggtcaacagaggagagacctgatgaactactgtaacctggcggcagcgcaaaagatg

SEQ ID NO: 14874 - DNA, 103 bp, Artificial Sequence
  Synthetic Polynucleotide
taatacgactcactatagggtgctccttctcccttccacagtagttcaccaacagaggagaggtgaaatgctgtggaagaacctggcggcagcgcaaaagatg

SEQ ID NO: 14875 - DNA, 103 bp, Artificial Sequence
  Synthetic Polynucleotide
taatacgactcactatagggatgactgctccttctcccttccacagtagtaacagaggagaactactatggaagggagaaacctggcggcagcgcaaaagatg

SEQ ID NO: 14876 - DNA, 103 bp, Artificial Sequence
  Synthetic Polynucleotide
taatacgactcactatagggtgactatgactgctccttctcccttccacaaacagaggagatgtggaatggagaaggagaacctggcggcagcgcaaaagatg

SEQ ID NO: 14877 - DNA, 103 bp, Artificial Sequence
  Synthetic Polynucleotide
taatacgactcactatagggtaccttgactatgactgctccttctcccttaacagaggagaaagggaatgggagcagtcaacctggcggcagcgcaaaagatg

SEQ ID NO: 14878 - DNA, 103 bp, Artificial Sequence
  Synthetic Polynucleotide
taatacgactcactatagggcgactgaatacaatgcaagaagcgggtacaaacagaggagatgtaccatgttcttgcataacctggcggcagcgcaaaagatg

SEQ ID NO: 14879 - DNA, 103 bp, Artificial Sequence
  Synthetic Polynucleotide
taatacgactcactataggggtccctaccttgactatgactgctccttctaacagaggagaagaaggatgagtcatagtaacctggcggcagcgcaaaagatg

SEQ ID NO: 14880 - DNA, 103 bp, Artificial Sequence
  Synthetic Polynucleotide
taatacgactcactatagggtgtctgtccctaccttgactatgactgctcaacagaggagagagcagatgtagtcaaggaacctggcggcagcgcaaaagatg

SEQ ID NO: 14881 - DNA, 103 bp, Artificial Sequence
  Synthetic Polynucleotide
taatacgactcactatagggttttatgtctgtccctaccttgactatgacaacagaggagagtcataatgaaggtagggaacctggcggcagcgcaaaagatg

SEQ ID NO: 14882 - DNA, 103 bp, Artificial Sequence
  Synthetic Polynucleotide
taatacgactcactatagggactacttttatgtctgtccctaccttgactaacagaggagaagtcaaatgagggacagaaacctggcggcagcgcaaaagatg

SEQ ID NO: 14883 - DNA, 103 bp, Artificial Sequence
  Synthetic Polynucleotide
taatacgactcactatagggttggtactacttttatgtctgtccctacctaacagaggagaaggtagatgcagacataaaacctggcggcagcgcaaaagatg

SEQ ID NO: 14884 - DNA, 103 bp, Artificial Sequence
  Synthetic Polynucleotide
taatacgactcactatagggccttcttggtactacttttatgtctgtcccaacagaggagagggacaatgataaaagtaaacctggcggcagcgcaaaagatg

SEQ ID NO: 14885 - DNA, 103 bp, Artificial Sequence
  Synthetic Polynucleotide
taatacgactcactataggggccttccttcttggtactacttttatgtctaacagaggagaagacatatgagtagtaccaacctggcggcagcgcaaaagatg

SEQ ID NO: 14886 - DNA, 103 bp, Artificial Sequence
  Synthetic Polynucleotide
taatacgactcactatagggtcttggccttccttcttggtactacttttaaacagaggagataaaagatgtaccaagaaaacctggcggcagcgcaaaagatg

SEQ ID NO: 14887 - DNA, 103 bp, Artificial Sequence
  Synthetic Polynucleotide
taatacgactcactataggggataatcttggccttccttcttggtactacaacagaggagagtagtaatgagaaggaagaacctggcggcagcgcaaaagatg

SEQ ID NO: 14888 - DNA, 103 bp, Artificial Sequence
  Synthetic Polynucleotide
taatacgactcactatagggtccctgataatcttggccttccttcttggtaacagaggagaaccaagatggaaggccaaaacctggcggcagcgcaaaagatg

SEQ ID NO: 14889 - DNA, 103 bp, Artificial Sequence
  Synthetic Polynucleotide
taatacgactcactatagggcagagcgactgaatacaatgcaagaagcggaacagaggagaccgcttatggcattgtataacctggcggcagcgcaaaagatg

SEQ ID NO: 14890 - DNA, 103 bp, Artificial Sequence
  Synthetic Polynucleotide
taatacgactcactatagggcatagtccctgataatcttggccttccttcaacagaggagagaaggaatgccaagattaaacctggcggcagcgcaaaagatg

SEQ ID NO: 14891 - DNA, 103 bp, Artificial Sequence
  Synthetic Polynucleotide
taatacgactcactatagggtcctccatagtccctgataatcttggccttaacagaggagaaaggccatgattatcaggaacctggcggcagcgcaaaagatg

SEQ ID NO: 14892 - DNA, 103 bp, Artificial Sequence
  Synthetic Polynucleotide
taatacgactcactatagggtgtcttcctccatagtccctgataatcttgaacagaggagacaagatatgcagggactaaacctggcggcagcgcaaaagatg

SEQ ID NO: 14893 - DNA, 103 bp, Artificial Sequence
  Synthetic Polynucleotide
taatacgactcactataggggttcctgtcttcctccatagtccctgataaaacagaggagattatcaatgactatggagaacctggcggcagcgcaaaagatg

SEQ ID NO: 14894 - DNA, 103 bp, Artificial Sequence
  Synthetic Polynucleotide
taatacgactcactatagggatccagttcctgtcttcctccatagtccctaacagaggagaagggacatgggaggaagaaacctggcggcagcgcaaaagatg

SEQ ID NO: 14895 - DNA, 103 bp, Artificial Sequence
  Synthetic Polynucleotide
taatacgactcactatagggctactatccagttcctgtcttcctccatagaacagaggagactatggatgaagacaggaaacctggcggcagcgcaaaagatg

SEQ ID NO: 14896 - DNA, 103 bp, Artificial Sequence
  Synthetic Polynucleotide
taatacgactcactatagggggggactactatccagttcctgtcttcctcaacagaggagagaggaaatgaggaactggaacctggcggcagcgcaaaagatg

SEQ ID NO: 14897 - DNA, 103 bp, Artificial Sequence
  Synthetic Polynucleotide
taatacgactcactatagggcaggtggggactactatccagttcctgtctaacagaggagaagacagatgctggatagtaacctggcggcagcgcaaaagatg

SEQ ID NO: 14898 - DNA, 103 bp, Artificial Sequence
  Synthetic Polynucleotide
taatacgactcactatagggccctccaggtggggactactatccagttccaacagaggagaggaactatgtagtagtccaacctggcggcagcgcaaaagatg

SEQ ID NO: 14899 - DNA, 103 bp, Artificial Sequence
  Synthetic Polynucleotide
taatacgactcactatagggtggcaccctccaggtggggactactatccaaacagaggagatggataatggtccccaccaacctggcggcagcgcaaaagatg

SEQ ID NO: 14900 - DNA, 103 bp, Artificial Sequence
  Synthetic Polynucleotide
taatacgactcactatagggctccgcagagcgactgaatacaatgcaagaaacagaggagatcttgcatggtattcagtaacctggcggcagcgcaaaagatg

SEQ ID NO: 14901 - DNA, 103 bp, Artificial Sequence
  Synthetic Polynucleotide
taatacgactcactatagggctccctggcaccctccaggtggggactactaacagaggagaagtagtatgcacctggagaacctggcggcagcgcaaaagatg

SEQ ID NO: 14902 - DNA, 103 bp, Artificial Sequence
  Synthetic Polynucleotide
taatacgactcactatagggccatcctccctggcaccctccaggtggggaaacagaggagatccccaatgggagggtgcaacctggcggcagcgcaaaagatg

SEQ ID NO: 14903 - DNA, 103 bp, Artificial Sequence
  Synthetic Polynucleotide
taatacgactcactatagggtttctccatcctccctggcaccctccaggtaacagaggagaacctggatggtgccagggaacctggcggcagcgcaaaagatg

SEQ ID NO: 14904 - DNA, 103 bp, Artificial Sequence
  Synthetic Polynucleotide
taatacgactcactatagggtgccatttctccatcctccctggcaccctcaacagaggagagagggtatgagggaggataacctggcggcagcgcaaaagatg

SEQ ID NO: 14905 - DNA, 103 bp, Artificial Sequence
  Synthetic Polynucleotide
taatacgactcactataggggggcatgccatttctccatcctccctggcaaacagaggagatgccagatgggatggagaaacctggcggcagcgcaaaagatg

SEQ ID NO: 14906 - DNA, 103 bp, Artificial Sequence
  Synthetic Polynucleotide
taatacgactcactataggggacaagggcatgccatttctccatcctcccaacagaggagagggaggatggagaaatggaacctggcggcagcgcaaaagatg

SEQ ID NO: 14907 - DNA, 103 bp, Artificial Sequence
  Synthetic Polynucleotide
taatacgactcactatagggtacttgacaagggcatgccatttctccatcaacagaggagagatggaatgatggcatgcaacctggcggcagcgcaaaagatg

SEQ ID NO: 14908 - DNA, 103 bp, Artificial Sequence
  Synthetic Polynucleotide
taatacgactcactatagggtcaggtacttgacaagggcatgccatttctaacagaggagaagaaatatgatgcccttgaacctggcggcagcgcaaaagatg

SEQ ID NO: 14909 - DNA, 103 bp, Artificial Sequence
  Synthetic Polynucleotide
taatacgactcactataggggtatttcaggtacttgacaagggcatgccaaacagaggagatggcatatgcttgtcaagaacctggcggcagcgcaaaagatg

SEQ ID NO: 14910 - DNA, 103 bp, Artificial Sequence
  Synthetic Polynucleotide
taatacgactcactataggggttctgtatttcaggtacttgacaagggcaaacagaggagatgccctatgcaagtacctaacctggcggcagcgcaaaagatg

SEQ ID NO: 14911 - DNA, 103 bp, Artificial Sequence
  Synthetic Polynucleotide
taatacgactcactatagggatctggtattatcccttcctctttttctagaacagaggagactagaaatggaggaagggaacctggcggcagcgcaaaagatg

SEQ ID NO: 14912 - DNA, 103 bp, Artificial Sequence
  Synthetic Polynucleotide
taatacgactcactatagggagcctctccgcagagcgactgaatacaatgaacagaggagacattgtatgcagtcgctcaacctggcggcagcgcaaaagatg

SEQ ID NO: 14913 - DNA, 103 bp, Artificial Sequence
  Synthetic Polynucleotide
taatacgactcactatagggcttttgttctgtatttcaggtacttgacaaaacagaggagattgtcaatgacctgaaataacctggcggcagcgcaaaagatg

SEQ ID NO: 14914 - DNA, 103 bp, Artificial Sequence
  Synthetic Polynucleotide
taatacgactcactatagggtaggtcttttgttctgtatttcaggtacttaacagaggagaaagtacatgaaatacagaaacctggcggcagcgcaaaagatg

SEQ ID NO: 14915 - DNA, 103 bp, Artificial Sequence
  Synthetic Polynucleotide
taatacgactcactatagggtcctctaggtcttttgttctgtatttcaggaacagaggagacctgaaatgcagaacaaaaacctggcggcagcgcaaaagatg

SEQ ID NO: 14916 - DNA, 103 bp, Artificial Sequence
  Synthetic Polynucleotide
taatacgactcactataggggcacctcctctaggtcttttgttctgtattaacagaggagaaatacaatgcaaaagaccaacctggcggcagcgcaaaagatg

SEQ ID NO: 14917 - DNA, 103 bp, Artificial Sequence
  Synthetic Polynucleotide
taatacgactcactatagggatagcgcacctcctctaggtcttttgttctaacagaggagaagaacaatggacctagagaacctggcggcagcgcaaaagatg

SEQ ID NO: 14918 - DNA, 103 bp, Artificial Sequence
  Synthetic Polynucleotide
taatacgactcactatagggggaacatagcgcacctcctctaggtcttttaacagaggagaaaaagaatgagaggaggtaacctggcggcagcgcaaaagatg

SEQ ID NO: 14919 - DNA, 103 bp, Artificial Sequence
  Synthetic Polynucleotide
taatacgactcactatagggggtggggaacatagcgcacctcctctaggtaacagaggagaacctagatgaggtgcgctaacctggcggcagcgcaaaagatg

SEQ ID NO: 14920 - DNA, 103 bp, Artificial Sequence
  Synthetic Polynucleotide
taatacgactcactatagggcttgtggtggggaacatagcgcacctcctcaacagaggagagaggagatgcgctatgttaacctggcggcagcgcaaaagatg

SEQ ID NO: 14921 - DNA, 103 bp, Artificial Sequence
  Synthetic Polynucleotide
taatacgactcactatagggcccaccttgtggtggggaacatagcgcaccaacagaggagaggtgcgatgtgttccccaaacctggcggcagcgcaaaagatg

SEQ ID NO: 14922 - DNA, 103 bp, Artificial Sequence
  Synthetic Polynucleotide
taatacgactcactatagggcccatcccaccttgtggtggggaacatagcaacagaggagagctatgatgcccaccacaaacctggcggcagcgcaaaagatg

SEQ ID NO: 14923 - DNA, 103 bp, Artificial Sequence
  Synthetic Polynucleotide
taatacgactcactatagggctgccagcctctccgcagagcgactgaataaacagaggagatattcaatggctctgcggaacctggcggcagcgcaaaagatg

SEQ ID NO: 14924 - DNA, 103 bp, Artificial Sequence
  Synthetic Polynucleotide
taatacgactcactatagggccatgcccatcccaccttgtggtggggaacaacagaggagagttcccatgcacaaggtgaacctggcggcagcgcaaaagatg

SEQ ID NO: 14925 - DNA, 103 bp, Artificial Sequence
  Synthetic Polynucleotide
taatacgactcactataggggtccaccatgcccatcccaccttgtggtggaacagaggagaccaccaatgggtgggatgaacctggcggcagcgcaaaagatg

SEQ ID NO: 14926 - DNA, 103 bp, Artificial Sequence
  Synthetic Polynucleotide
taatacgactcactatagggtgcaagtccaccatgcccatcccaccttgtaacagaggagaacaaggatggatgggcataacctggcggcagcgcaaaagatg

SEQ ID NO: 14927 - DNA, 103 bp, Artificial Sequence
  Synthetic Polynucleotide
taatacgactcactatagggcctgctgcaagtccaccatgcccatcccacaacagaggagagtgggaatggcatggtggaacctggcggcagcgcaaaagatg

SEQ ID NO: 14928 - DNA, 103 bp, Artificial Sequence
  Synthetic Polynucleotide
taatacgactcactatagggattaccctgctgcaagtccaccatgcccataacagaggagaatgggcatggtggacttgaacctggcggcagcgcaaaagatg

SEQ ID NO: 14929 - DNA, 103 bp, Artificial Sequence
  Synthetic Polynucleotide
taatacgactcactatagggggaatattaccctgctgcaagtccaccatgaacagaggagacatggtatgcttgcagcaaacctggcggcagcgcaaaagatg

SEQ ID NO: 14930 - DNA, 103 bp, Artificial Sequence
  Synthetic Polynucleotide
taatacgactcactatagggtagtgggaatattaccctgctgcaagtccaaacagaggagatggactatgagcagggtaaacctggcggcagcgcaaaagatg

SEQ ID NO: 14931 - DNA, 103 bp, Artificial Sequence
  Synthetic Polynucleotide
taatacgactcactatagggccttgtagtgggaatattaccctgctgcaaaacagaggagattgcagatgggtaatattaacctggcggcagcgcaaaagatg

SEQ ID NO: 14932 - DNA, 103 bp, Artificial Sequence
  Synthetic Polynucleotide
taatacgactcactatagggtttttccttgtagtgggaatattaccctgcaacagaggagagcagggatgtattcccacaacctggcggcagcgcaaaagatg

SEQ ID NO: 14933 - DNA, 103 bp, Artificial Sequence
  Synthetic Polynucleotide
taatacgactcactatagggatgactttttccttgtagtgggaatattacaacagaggagagtaataatgccactacaaaacctggcggcagcgcaaaagatg

SEQ ID NO: 14934 - DNA, 103 bp, Artificial Sequence
  Synthetic Polynucleotide
taatacgactcactatagggtcgatctgccagcctctccgcagagcgactaacagaggagaagtcgcatggcggagaggaacctggcggcagcgcaaaagatg

SEQ ID NO: 14935 - DNA, 103 bp, Artificial Sequence
  Synthetic Polynucleotide
taatacgactcactatagggtctagatgactttttccttgtagtgggaataacagaggagaattcccatgacaaggaaaaacctggcggcagcgcaaaagatg

SEQ ID NO: 14936 - DNA, 103 bp, Artificial Sequence
  Synthetic Polynucleotide
taatacgactcactataggggtatttctagatgactttttccttgtagtgaacagaggagacactacatggaaaaagtcaacctggcggcagcgcaaaagatg

SEQ ID NO: 14937 - DNA, 103 bp, Artificial Sequence
  Synthetic Polynucleotide
taatacgactcactatagggtgcctgtatttctagatgactttttccttgaacagaggagacaaggaatgagtcatctaaacctggcggcagcgcaaaagatg

SEQ ID NO: 14938 - DNA, 103 bp, Artificial Sequence
  Synthetic Polynucleotide
taatacgactcactatagggcaatatgcctgtatttctagatgactttttaacagaggagaaaaaagatgtctagaaataacctggcggcagcgcaaaagatg

SEQ ID NO: 14939 - DNA, 103 bp, Artificial Sequence
  Synthetic Polynucleotide
taatacgactcactatagggggttccaatatgcctgtatttctagatgacaacagaggagagtcatcatgaaatacaggaacctggcggcagcgcaaaagatg

SEQ ID NO: 14940 - DNA, 103 bp, Artificial Sequence
  Synthetic Polynucleotide
taatacgactcactatagggtgttaggttccaatatgcctgtatttctagaacagaggagactagaaatgcaggcatataacctggcggcagcgcaaaagatg

SEQ ID NO: 14941 - DNA, 103 bp, Artificial Sequence
  Synthetic Polynucleotide
taatacgactcactatagggtctggtgttaggttccaatatgcctgtattaacagaggagaaatacaatgatattggaaaacctggcggcagcgcaaaagatg

SEQ ID NO: 14942 - DNA, 103 bp, Artificial Sequence
  Synthetic Polynucleotide
taatacgactcactatagggctttttctggtgttaggttccaatatgcctaacagaggagaaggcatatgggaacctaaaacctggcggcagcgcaaaagatg

SEQ ID NO: 14943 - DNA, 103 bp, Artificial Sequence
  Synthetic Polynucleotide
taatacgactcactatagggccatcctttttctggtgttaggttccaataaacagaggagatattggatgctaacaccaaacctggcggcagcgcaaaagatg

SEQ ID NO: 14944 - DNA, 103 bp, Artificial Sequence
  Synthetic Polynucleotide
taatacgactcactataggggagagccatcctttttctggtgttaggttcaacagaggagagaacctatgaccagaaaaaacctggcggcagcgcaaaagatg

SEQ ID NO: 14945 - DNA, 103 bp, Artificial Sequence
  Synthetic Polynucleotide
taatacgactcactatagggagggctcgatctgccagcctctccgcagagaacagaggagactctgcatggaggctggcaacctggcggcagcgcaaaagatg

SEQ ID NO: 14946 - DNA, 103 bp, Artificial Sequence
  Synthetic Polynucleotide
taatacgactcactataggggagaggagagccatcctttttctggtgttaaacagaggagataacacatgaaaaaggataacctggcggcagcgcaaaagatg

SEQ ID NO: 14947 - DNA, 103 bp, Artificial Sequence
  Synthetic Polynucleotide
taatacgactcactatagggtgcatgagaggagagccatcctttttctggaacagaggagaccagaaatgggatggctcaacctggcggcagcgcaaaagatg

SEQ ID NO: 14948 - DNA, 103 bp, Artificial Sequence
  Synthetic Polynucleotide
taatacgactcactatagggcttactgcatgagaggagagccatccttttaacagaggagaaaaaggatggctctcctcaacctggcggcagcgcaaaagatg

SEQ ID NO: 14949 - DNA, 103 bp, Artificial Sequence
  Synthetic Polynucleotide
taatacgactcactatagggttaatcttactgcatgagaggagagccatcaacagaggagagatggcatgcctctcatgaacctggcggcagcgcaaaagatg

SEQ ID NO: 14950 - DNA, 103 bp, Artificial Sequence
  Synthetic Polynucleotide
taatacgactcactatagggccaggttaatcttactgcatgagaggagagaacagaggagactctccatgcatgcagtaaacctggcggcagcgcaaaagatg

SEQ ID NO: 14951 - DNA, 103 bp, Artificial Sequence
  Synthetic Polynucleotide
taatacgactcactataggggtataccaggttaatcttactgcatgagagaacagaggagactctcaatgagtaagattaacctggcggcagcgcaaaagatg

SEQ ID NO: 14952 - DNA, 103 bp, Artificial Sequence
  Synthetic Polynucleotide
taatacgactcactatagggtttctgtataccaggttaatcttactgcataacagaggagaatgcagatggattaacctaacctggcggcagcgcaaaagatg

SEQ ID NO: 14953 - DNA, 103 bp, Artificial Sequence
  Synthetic Polynucleotide
taatacgactcactataggggaacttttctgtataccaggttaatcttacaacagaggagagtaagaatgacctggtataacctggcggcagcgcaaaagatg

SEQ ID NO: 14954 - DNA, 103 bp, Artificial Sequence
  Synthetic Polynucleotide
taatacgactcactataggggtccagaacttttctgtataccaggttaataacagaggagaattaacatggtatacagaaacctggcggcagcgcaaaagatg

SEQ ID NO: 14955 - DNA, 103 bp, Artificial Sequence
  Synthetic Polynucleotide
taatacgactcactatagggcatctgtccagaacttttctgtataccaggaacagaggagacctggtatgcagaaaagtaacctggcggcagcgcaaaagatg

SEQ ID NO: 14956 - DNA, 103 bp, Artificial Sequence
  Synthetic Polynucleotide
taatacgactcactatagggctctcagggctcgatctgccagcctctccgaacagaggagacggagaatgtggcagatcaacctggcggcagcgcaaaagatg

SEQ ID NO: 14957 - DNA, 103 bp, Artificial Sequence
  Synthetic Polynucleotide
taatacgactcactatagggggtaacatctgtccagaacttttctgtataaacagaggagatatacaatgaagttctggaacctggcggcagcgcaaaagatg

SEQ ID NO: 14958 - DNA, 103 bp, Artificial Sequence
  Synthetic Polynucleotide
taatacgactcactatagggtctggggtaacatctgtccagaacttttctaacagaggagaagaaaaatgctggacagaaacctggcggcagcgcaaaagatg

SEQ ID NO: 14959 - DNA, 103 bp, Artificial Sequence
  Synthetic Polynucleotide
taatacgactcactatagggcacagtctggggtaacatctgtccagaactaacagaggagaagttctatgcagatgttaaacctggcggcagcgcaaaagatg

SEQ ID NO: 14960 - DNA, 103 bp, Artificial Sequence
  Synthetic Polynucleotide
taatacgactcactataggggtctgcacagtctggggtaacatctgtccaaacagaggagatggacaatggttaccccaaacctggcggcagcgcaaaagatg

SEQ ID NO: 14961 - DNA, 103 bp, Artificial Sequence
  Synthetic Polynucleotide
taatacgactcactatagggaggatgtctgcacagtctggggtaacatctaacagaggagaagatgtatgcccagactgaacctggcggcagcgcaaaagatg

SEQ ID NO: 14962 - DNA, 103 bp, Artificial Sequence
  Synthetic Polynucleotide
taatacgactcactataggggtattaggatgtctgcacagtctggggtaaaacagaggagattacccatgactgtgcagaacctggcggcagcgcaaaagatg

SEQ ID NO: 14963 - DNA, 103 bp, Artificial Sequence
  Synthetic Polynucleotide
taatacgactcactataggggctatgtattaggatgtctgcacagtctggaacagaggagaccagacatggcagacatcaacctggcggcagcgcaaaagatg

SEQ ID NO: 14964 - DNA, 103 bp, Artificial Sequence
  Synthetic Polynucleotide
taatacgactcactatagggtaagtgctatgtattaggatgtctgcacagaacagaggagactgtgcatgcatcctaataacctggcggcagcgcaaaagatg

SEQ ID NO: 14965 - DNA, 103 bp, Artificial Sequence
  Synthetic Polynucleotide
taatacgactcactatagggagaaataagtgctatgtattaggatgtctgaacagaggagacagacaatgtaatacataaacctggcggcagcgcaaaagatg

SEQ ID NO: 14966 - DNA, 103 bp, Artificial Sequence
  Synthetic Polynucleotide
taatacgactcactataggggcaagagaaataagtgctatgtattaggataacagaggagaatcctaatgcatagcactaacctggcggcagcgcaaaagatg

SEQ ID NO: 14967 - DNA, 103 bp, Artificial Sequence
  Synthetic Polynucleotide
taatacgactcactatagggagaacctctcagggctcgatctgccagcctaacagaggagaaggctgatggatcgagccaacctggcggcagcgcaaaagatg

SEQ ID NO: 14968 - DNA, 103 bp, Artificial Sequence
  Synthetic Polynucleotide
taatacgactcactataggggtaaagcaagagaaataagtgctatgtattaacagaggagaaatacaatgcacttatttaacctggcggcagcgcaaaagatg

SEQ ID NO: 14969 - DNA, 103 bp, Artificial Sequence
  Synthetic Polynucleotide
taatacgactcactatagggctgccgtaaagcaagagaaataagtgctataacagaggagaatagcaatgatttctcttaacctggcggcagcgcaaaagatg

SEQ ID NO: 14970 - DNA, 103 bp, Artificial Sequence
  Synthetic Polynucleotide
taatacgactcactatagggttcacctgccgtaaagcaagagaaataagtaacagaggagaacttatatgtcttgctttaacctggcggcagcgcaaaagatg

SEQ ID NO: 14971 - DNA, 103 bp, Artificial Sequence
  Synthetic Polynucleotide
taatacgactcactatagggcttacttcacctgccgtaaagcaagagaaaaacagaggagatttctcatgctttacggcaacctggcggcagcgcaaaagatg

SEQ ID NO: 14972 - DNA, 103 bp, Artificial Sequence
  Synthetic Polynucleotide
taatacgactcactatagggctcttcttacttcacctgccgtaaagcaagaacagaggagacttgctatgcggcaggtgaacctggcggcagcgcaaaagatg

SEQ ID NO: 14973 - DNA, 103 bp, Artificial Sequence
  Synthetic Polynucleotide
taatacgactcactataggggatggctcttcttacttcacctgccgtaaaaacagaggagatttacgatgggtgaagtaaacctggcggcagcgcaaaagatg

SEQ ID NO: 14974 - DNA, 103 bp, Artificial Sequence
  Synthetic Polynucleotide
taatacgactcactatagggcctctgatggctcttcttacttcacctgccaacagaggagaggcaggatgagtaagaagaacctggcggcagcgcaaaagatg

SEQ ID NO: 14975 - DNA, 103 bp, Artificial Sequence
  Synthetic Polynucleotide
taatacgactcactatagggtttcccctctgatggctcttcttacttcacaacagaggagagtgaagatggaagagccaaacctggcggcagcgcaaaagatg

SEQ ID NO: 14976 - DNA, 103 bp, Artificial Sequence
  Synthetic Polynucleotide
taatacgactcactatagggtaacttttcccctctgatggctcttcttacaacagaggagagtaagaatggccatcagaaacctggcggcagcgcaaaagatg

SEQ ID NO: 14977 - DNA, 103 bp, Artificial Sequence
  Synthetic Polynucleotide
taatacgactcactataggggacaataacttttcccctctgatggctcttaacagaggagaaagagcatgcagaggggaaacctggcggcagcgcaaaagatg

SEQ ID NO: 14978 - DNA, 103 bp, Artificial Sequence
  Synthetic Polynucleotide
taatacgactcactatagggtggagagaacctctcagggctcgatctgccaacagaggagaggcagaatgagccctgagaacctggcggcagcgcaaaagatg

SEQ ID NO: 14979 - DNA, 103 bp, Artificial Sequence
  Synthetic Polynucleotide
taatacgactcactatagggagcaggacaataacttttcccctctgatggaacagaggagaccatcaatggggaaaagtaacctggcggcagcgcaaaagatg

SEQ ID NO: 14980 - DNA, 103 bp, Artificial Sequence
  Synthetic Polynucleotide
taatacgactcactataggggttgcagcaggacaataacttttcccctctaacagaggagaagagggatgaagttattgaacctggcggcagcgcaaaagatg

SEQ ID NO: 14981 - DNA, 103 bp, Artificial Sequence
  Synthetic Polynucleotide
taatacgactcactatagggggatagttgcagcaggacaataacttttccaacagaggagaggaaaaatgattgtcctgaacctggcggcagcgcaaaagatg

SEQ ID NO: 14982 - DNA, 103 bp, Artificial Sequence
  Synthetic Polynucleotide
taatacgactcactatagggcttggggatagttgcagcaggacaataactaacagaggagaagttatatgcctgctgcaaacctggcggcagcgcaaaagatg

SEQ ID NO: 14983 - DNA, 103 bp, Artificial Sequence
  Synthetic Polynucleotide
taatacgactcactatagggatgagcttggggatagttgcagcaggacaaaacagaggagattgtccatgtgcaactataacctggcggcagcgcaaaagatg

SEQ ID NO: 14984 - DNA, 103 bp, Artificial Sequence
  Synthetic Polynucleotide
taatacgactcactataggggctttatgagcttggggatagttgcagcagaacagaggagactgctgatgctatccccaaacctggcggcagcgcaaaagatg

SEQ ID NO: 14985 - DNA, 103 bp, Artificial Sequence
  Synthetic Polynucleotide
taatacgactcactatagggcctgtgctttatgagcttggggatagttgcaacagaggagagcaactatgcccaagctcaacctggcggcagcgcaaaagatg

SEQ ID NO: 14986 - DNA, 103 bp, Artificial Sequence
  Synthetic Polynucleotide
taatacgactcactatagggtggtacctgtgctttatgagcttggggataaacagaggagatatcccatggctcataaaaacctggcggcagcgcaaaagatg

SEQ ID NO: 14987 - DNA, 103 bp, Artificial Sequence
  Synthetic Polynucleotide
taatacgactcactatagggagtgatggtacctgtgctttatgagcttggaacagaggagaccaagcatgtaaagcacaaacctggcggcagcgcaaaagatg

SEQ ID NO: 14988 - DNA, 103 bp, Artificial Sequence
  Synthetic Polynucleotide
taatacgactcactatagggattgaagtgatggtacctgtgctttatgagaacagaggagactcataatgcacaggtacaacctggcggcagcgcaaaagatg

SEQ ID NO: 14989 - DNA, 103 bp, Artificial Sequence
  Synthetic Polynucleotide
taatacgactcactatagggagtgctggagagaacctctcagggctcgataacagaggagaatcgagatgtgagaggttaacctggcggcagcgcaaaagatg

SEQ ID NO: 14990 - DNA, 103 bp, Artificial Sequence
  Synthetic Polynucleotide
taatacgactcactatagggtaggtattgaagtgatggtacctgtgctttaacagaggagaaaagcaatggtaccatcaaacctggcggcagcgcaaaagatg

SEQ ID NO: 14991 - DNA, 103 bp, Artificial Sequence
  Synthetic Polynucleotide
taatacgactcactatagggagggctaggtattgaagtgatggtacctgtaacagaggagaacaggtatgatcacttcaaacctggcggcagcgcaaaagatg

SEQ ID NO: 14992 - DNA, 103 bp, Artificial Sequence
  Synthetic Polynucleotide
taatacgactcactatagggctactagggctaggtattgaagtgatggtaaacagaggagataccatatgttcaataccaacctggcggcagcgcaaaagatg

SEQ ID NO: 14993 - DNA, 103 bp, Artificial Sequence
  Synthetic Polynucleotide
taatacgactcactatagggtactactactagggctaggtattgaagtgaaacagaggagatcacttatgtacctagccaacctggcggcagcgcaaaagatg

SEQ ID NO: 14994 - DNA, 103 bp, Artificial Sequence
  Synthetic Polynucleotide
taatacgactcactatagggtgttgtactactactagggctaggtattgaaacagaggagatcaataatgagccctagtaacctggcggcagcgcaaaagatg

SEQ ID NO: 14995 - DNA, 103 bp, Artificial Sequence
  Synthetic Polynucleotide
taatacgactcactatagggcattttgttgtactactactagggctaggtaacagaggagaacctagatgtagtagtagaacctggcggcagcgcaaaagatg

SEQ ID NO: 14996 - DNA, 103 bp, Artificial Sequence
  Synthetic Polynucleotide
taatacgactcactatagggtctgtcattttgttgtactactactagggcaacagaggagagccctaatggtagtacaaaacctggcggcagcgcaaaagatg

SEQ ID NO: 14997 - DNA, 103 bp, Artificial Sequence
  Synthetic Polynucleotide
taatacgactcactatagggtggggtctgtcattttgttgtactactactaacagaggagaagtagtatgacaacaaaaaacctggcggcagcgcaaaagatg

SEQ ID NO: 14998 - DNA, 103 bp, Artificial Sequence
  Synthetic Polynucleotide
taatacgactcactatagggttctctggggtctgtcattttgttgtactaaacagaggagatagtacatgaaaatgacaaacctggcggcagcgcaaaagatg

SEQ ID NO: 14999 - DNA, 103 bp, Artificial Sequence
  Synthetic Polynucleotide
taatacgactcactatagggaccctttctctggggtctgtcattttgttgaacagaggagacaacaaatggacagacccaacctggcggcagcgcaaaagatg

SEQ ID NO: 15000 - DNA, 103 bp, Artificial Sequence
  Synthetic Polynucleotide
taatacgactcactatagggctgctagtgctggagagaacctctcagggcaacagaggagagccctgatgggttctctcaacctggcggcagcgcaaaagatg

SEQ ID NO: 15001 - DNA, 103 bp, Artificial Sequence
  Synthetic Polynucleotide
taatacgactcactataggggcggtaccctttctctggggtctgtcatttaacagaggagaaaatgaatgaccccagagaacctggcggcagcgcaaaagatg

SEQ ID NO: 15002 - DNA, 103 bp, Artificial Sequence
  Synthetic Polynucleotide
taatacgactcactatagggtcctggcggtaccctttctctggggtctgtaacagaggagaacagacatgagagaaaggaacctggcggcagcgcaaaagatg

SEQ ID NO: 15003 - DNA, 103 bp, Artificial Sequence
  Synthetic Polynucleotide
taatacgactcactatagggctgtttcctggcggtaccctttctctggggaacagaggagaccccagatgaagggtaccaacctggcggcagcgcaaaagatg

SEQ ID NO: 15004 - DNA, 103 bp, Artificial Sequence
  Synthetic Polynucleotide
taatacgactcactatagggctccactgtttcctggcggtaccctttctcaacagaggagagagaaaatgtaccgccagaacctggcggcagcgcaaaagatg

SEQ ID NO: 15005 - DNA, 103 bp, Artificial Sequence
  Synthetic Polynucleotide
taatacgactcactatagggctcttctccactgtttcctggcggtaccctaacagaggagaagggtaatgccaggaaacaacctggcggcagcgcaaaagatg

SEQ ID NO: 15006 - DNA, 103 bp, Artificial Sequence
  Synthetic Polynucleotide
taatacgactcactatagggatggtctcttctccactgtttcctggcggtaacagaggagaaccgccatgaaacagtggaacctggcggcagcgcaaaagatg

SEQ ID NO: 15007 - DNA, 103 bp, Artificial Sequence
  Synthetic Polynucleotide
taatacgactcactatagggctccaatggtctcttctccactgtttcctgaacagaggagacaggaaatggtggagaagaacctggcggcagcgcaaaagatg

SEQ ID NO: 15008 - DNA, 103 bp, Artificial Sequence
  Synthetic Polynucleotide
taatacgactcactatagggggcctctccaatggtctcttctccactgttaacagaggagaaacagtatggaagagaccaacctggcggcagcgcaaaagatg

SEQ ID NO: 15009 - DNA, 103 bp, Artificial Sequence
  Synthetic Polynucleotide
taatacgactcactatagggtcgaaggcctctccaatggtctcttctccaaacagaggagatggagaatggaccattggaacctggcggcagcgcaaaagatg

SEQ ID NO: 15010 - DNA, 103 bp, Artificial Sequence
  Synthetic Polynucleotide
taatacgactcactataggggccactcgaaggcctctccaatggtctcttaacagaggagaaagagaatgttggagaggaacctggcggcagcgcaaaagatg

SEQ ID NO: 15011 - DNA, 103 bp, Artificial Sequence
  Synthetic Polynucleotide
taatacgactcactatagggtctacctgctagtgctggagagaacctctcaacagaggagagagaggatgtctccagcaaacctggcggcagcgcaaaagatg

SEQ ID NO: 15012 - DNA, 103 bp, Artificial Sequence
  Synthetic Polynucleotide
taatacgactcactatagggctctagccactcgaaggcctctccaatggtaacagaggagaaccattatggaggccttcaacctggcggcagcgcaaaagatg

SEQ ID NO: 15013 - DNA, 103 bp, Artificial Sequence
  Synthetic Polynucleotide
taatacgactcactataggggtcctctctagccactcgaaggcctctccaaacagaggagatggagaatgcttcgagtgaacctggcggcagcgcaaaagatg

SEQ ID NO: 15014 - DNA, 103 bp, Artificial Sequence
  Synthetic Polynucleotide
taatacgactcactatagggctatggtcctctctagccactcgaaggcctaacagaggagaaggcctatgagtggctagaacctggcggcagcgcaaaagatg

SEQ ID NO: 15015 - DNA, 103 bp, Artificial Sequence
  Synthetic Polynucleotide
taatacgactcactatagggggcttctatggtcctctctagccactcgaaaacagaggagattcgagatgctagagaggaacctggcggcagcgcaaaagatg

SEQ ID NO: 15016 - DNA, 103 bp, Artificial Sequence
  Synthetic Polynucleotide
taatacgactcactatagggtttaaggcttctatggtcctctctagccacaacagaggagagtggctatggaggaccataacctggcggcagcgcaaaagatg

SEQ ID NO: 15017 - DNA, 103 bp, Artificial Sequence
  Synthetic Polynucleotide
taatacgactcactatagggccctgtttaaggcttctatggtcctctctaaacagaggagatagagaatgccatagaagaacctggcggcagcgcaaaagatg

SEQ ID NO: 15018 - DNA, 103 bp, Artificial Sequence
  Synthetic Polynucleotide
taatacgactcactatagggtgcctccctgtttaaggcttctatggtcctaacagaggagaaggaccatggaagccttaaacctggcggcagcgcaaaagatg

SEQ ID NO: 15019 - DNA, 103 bp, Artificial Sequence
  Synthetic Polynucleotide
taatacgactcactatagggttcactgcctccctgtttaaggcttctatgaacagaggagacatagaatgcttaaacagaacctggcggcagcgcaaaagatg

SEQ ID NO: 15020 - DNA, 103 bp, Artificial Sequence
  Synthetic Polynucleotide
taatacgactcactataggggatggttcactgcctccctgtttaaggcttaacagaggagaaagcctatgacagggaggaacctggcggcagcgcaaaagatg

SEQ ID NO: 15021 - DNA, 103 bp, Artificial Sequence
  Synthetic Polynucleotide
taatacgactcactataggggggcagatggttcactgcctccctgtttaaaacagaggagattaaacatggaggcagtgaacctggcggcagcgcaaaagatg

SEQ ID NO: 15022 - DNA, 103 bp, Artificial Sequence
  Synthetic Polynucleotide
taatacgactcactatagggtgccaatctggtattatcccttcctcttttaacagaggagaaaaagaatgagggataataacctggcggcagcgcaaaagatg

SEQ ID NO: 15023 - DNA, 103 bp, Artificial Sequence
  Synthetic Polynucleotide
taatacgactcactatagggcaggctctacctgctagtgctggagagaacaacagaggagagttctcatgagcactagcaacctggcggcagcgcaaaagatg

SEQ ID NO: 15024 - DNA, 103 bp, Artificial Sequence
  Synthetic Polynucleotide
taatacgactcactatagggtctcggggcagatggttcactgcctccctgaacagaggagacagggaatgagtgaaccaaacctggcggcagcgcaaaagatg

SEQ ID NO: 15025 - DNA, 103 bp, Artificial Sequence
  Synthetic Polynucleotide
taatacgactcactatagggtgagctctcggggcagatggttcactgcctaacagaggagaaggcagatgaccatctgcaacctggcggcagcgcaaaagatg

SEQ ID NO: 15026 - DNA, 103 bp, Artificial Sequence
  Synthetic Polynucleotide
taatacgactcactataggggaaaatgagctctcggggcagatggttcacaacagaggagagtgaacatgctgccccgaaacctggcggcagcgcaaaagatg

SEQ ID NO: 15027 - DNA, 103 bp, Artificial Sequence
  Synthetic Polynucleotide
taatacgactcactatagggacctggaaaatgagctctcggggcagatggaacagaggagaccatctatgccgagagctaacctggcggcagcgcaaaagatg

SEQ ID NO: 15028 - DNA, 103 bp, Artificial Sequence
  Synthetic Polynucleotide
taatacgactcactataggggccacacctggaaaatgagctctcggggcaaacagaggagatgccccatgagctcatttaacctggcggcagcgcaaaagatg

SEQ ID NO: 15029 - DNA, 103 bp, Artificial Sequence
  Synthetic Polynucleotide
taatacgactcactatagggcctttgccacacctggaaaatgagctctcgaacagaggagacgagagatgattttccagaacctggcggcagcgcaaaagatg

SEQ ID NO: 15030 - DNA, 103 bp, Artificial Sequence
  Synthetic Polynucleotide
taatacgactcactatagggcaggacctttgccacacctggaaaatgagcaacagaggagagctcatatgccaggtgtgaacctggcggcagcgcaaaagatg

SEQ ID NO: 15031 - DNA, 103 bp, Artificial Sequence
  Synthetic Polynucleotide
taatacgactcactatagggatctccaggacctttgccacacctggaaaaaacagaggagattttccatgtgtggcaaaaacctggcggcagcgcaaaagatg

SEQ ID NO: 15032 - DNA, 103 bp, Artificial Sequence
  Synthetic Polynucleotide
taatacgactcactatagggccaatatctccaggacctttgccacacctgaacagaggagacaggtgatgcaaaggtccaacctggcggcagcgcaaaagatg

SEQ ID NO: 15033 - DNA, 103 bp, Artificial Sequence
  Synthetic Polynucleotide
taatacgactcactatagggtcatgccaatatctccaggacctttgccacaacagaggagagtggcaatggtcctggagaacctggcggcagcgcaaaagatg

SEQ ID NO: 15034 - DNA, 103 bp, Artificial Sequence
  Synthetic Polynucleotide
taatacgactcactatagggacacccaggctctacctgctagtgctggagaacagaggagactccagatgtagcaggtaaacctggcggcagcgcaaaagatg

SEQ ID NO: 15035 - DNA, 103 bp, Artificial Sequence
  Synthetic Polynucleotide
taatacgactcactataggggttcatcatgccaatatctccaggacctttaacagaggagaaaaggtatgggagatattaacctggcggcagcgcaaaagatg

SEQ ID NO: 15036 - DNA, 103 bp, Artificial Sequence
  Synthetic Polynucleotide
taatacgactcactatagggcccttgttcatcatgccaatatctccaggaaacagaggagatcctggatgtattggcataacctggcggcagcgcaaaagatg

SEQ ID NO: 15037 - DNA, 103 bp, Artificial Sequence
  Synthetic Polynucleotide
taatacgactcactataggggacatcccttgttcatcatgccaatatctcaacagaggagagagataatggcatgatgaaacctggcggcagcgcaaaagatg

SEQ ID NO: 15038 - DNA, 103 bp, Artificial Sequence
  Synthetic Polynucleotide
taatacgactcactatagggttgctgacatcccttgttcatcatgccaataacagaggagaattggcatgatgaacaagaacctggcggcagcgcaaaagatg

SEQ ID NO: 15039 - DNA, 103 bp, Artificial Sequence
  Synthetic Polynucleotide
taatacgactcactataggggtagcttgctgacatcccttgttcatcatgaacagaggagacatgatatgcaagggatgaacctggcggcagcgcaaaagatg

SEQ ID NO: 15040 - DNA, 103 bp, Artificial Sequence
  Synthetic Polynucleotide
taatacgactcactatagggtttgtgtagcttgctgacatcccttgttcaaacagaggagatgaacaatggatgtcagcaacctggcggcagcgcaaaagatg

SEQ ID NO: 15041 - DNA, 103 bp, Artificial Sequence
  Synthetic Polynucleotide
taatacgactcactatagggtatactttgtgtagcttgctgacatcccttaacagaggagaaagggaatgcagcaagctaacctggcggcagcgcaaaagatg

SEQ ID NO: 15042 - DNA, 103 bp, Artificial Sequence
  Synthetic Polynucleotide
taatacgactcactatagggatatctatactttgtgtagcttgctgacataacagaggagaatgtcaatgagctacacaaacctggcggcagcgcaaaagatg

SEQ ID NO: 15043 - DNA, 103 bp, Artificial Sequence
  Synthetic Polynucleotide
taatacgactcactatagggcacaaatatctatactttgtgtagcttgctaacagaggagaagcaagatgcacaaagtaaacctggcggcagcgcaaaagatg

SEQ ID NO: 15044 - DNA, 103 bp, Artificial Sequence
  Synthetic Polynucleotide
taatacgactcactatagggttaggcacaaatatctatactttgtgtagcaacagaggagagctacaatgagtatagataacctggcggcagcgcaaaagatg

SEQ ID NO: 15045 - DNA, 103 bp, Artificial Sequence
  Synthetic Polynucleotide
taatacgactcactatagggagggaacacccaggctctacctgctagtgcaacagaggagagcactaatgggtagagccaacctggcggcagcgcaaaagatg

SEQ ID NO: 15046 - DNA, 103 bp, Artificial Sequence
  Synthetic Polynucleotide
taatacgactcactatagggttgcattaggcacaaatatctatactttgtaacagaggagaacaaagatgagatatttgaacctggcggcagcgcaaaagatg

SEQ ID NO: 15047 - DNA, 103 bp, Artificial Sequence
  Synthetic Polynucleotide
taatacgactcactataggggctttttgcattaggcacaaatatctatacaacagaggagagtatagatgtttgtgcctaacctggcggcagcgcaaaagatg

SEQ ID NO: 15048 - DNA, 103 bp, Artificial Sequence
  Synthetic Polynucleotide
taatacgactcactatagggatatagctttttgcattaggcacaaatatcaacagaggagagatattatggcctaatgcaacctggcggcagcgcaaaagatg

SEQ ID NO: 15049 - DNA, 103 bp, Artificial Sequence
  Synthetic Polynucleotide
taatacgactcactatagggtgtaaatatagctttttgcattaggcacaaaacagaggagattgtgcatgatgcaaaaaaacctggcggcagcgcaaaagatg

SEQ ID NO: 15050 - DNA, 103 bp, Artificial Sequence
  Synthetic Polynucleotide
taatacgactcactatagggaaatgtgtaaatatagctttttgcattaggaacagaggagacctaatatgaaaagctataacctggcggcagcgcaaaagatg

SEQ ID NO: 15051 - DNA, 103 bp, Artificial Sequence
  Synthetic Polynucleotide
taatacgactcactatagggtcttgaaatgtgtaaatatagctttttgcaaacagaggagatgcaaaatgctatatttaaacctggcggcagcgcaaaagatg

SEQ ID NO: 15052 - DNA, 103 bp, Artificial Sequence
  Synthetic Polynucleotide
taatacgactcactatagggccctctcttgaaatgtgtaaatatagctttaacagaggagaaaagctatgtttacacataacctggcggcagcgcaaaagatg

SEQ ID NO: 15053 - DNA, 103 bp, Artificial Sequence
  Synthetic Polynucleotide
taatacgactcactataggggtgcaccctctcttgaaatgtgtaaatataaacagaggagatatattatgacatttcaaaacctggcggcagcgcaaaagatg

SEQ ID NO: 15054 - DNA, 103 bp, Artificial Sequence
  Synthetic Polynucleotide
taatacgactcactatagggagcaagtgcaccctctcttgaaatgtgtaaaacagaggagattacacatgtcaagagagaacctggcggcagcgcaaaagatg

SEQ ID NO: 15055 - DNA, 103 bp, Artificial Sequence
  Synthetic Polynucleotide
taatacgactcactatagggcccccagcaagtgcaccctctcttgaaatgaacagaggagacatttcatgagagggtgcaacctggcggcagcgcaaaagatg

SEQ ID NO: 15056 - DNA, 103 bp, Artificial Sequence
  Synthetic Polynucleotide
taatacgactcactatagggccagcagggaacacccaggctctacctgctaacagaggagaagcaggatgagcctgggtaacctggcggcagcgcaaaagatg

SEQ ID NO: 15057 - DNA, 103 bp, Artificial Sequence
  Synthetic Polynucleotide
taatacgactcactatagggtcctccccccagcaagtgcaccctctcttgaacagaggagacaagagatggtgcacttgaacctggcggcagcgcaaaagatg

SEQ ID NO: 15058 - DNA, 103 bp, Artificial Sequence
  Synthetic Polynucleotide
taatacgactcactatagggccatgtcctccccccagcaagtgcaccctcaacagaggagagagggtatgcttgctgggaacctggcggcagcgcaaaagatg

SEQ ID NO: 15059 - DNA, 103 bp, Artificial Sequence
  Synthetic Polynucleotide
taatacgactcactatagggccggcccatgtcctccccccagcaagtgcaaacagaggagatgcactatgtggggggagaacctggcggcagcgcaaaagatg

SEQ ID NO: 15060 - DNA, 103 bp, Artificial Sequence
  Synthetic Polynucleotide
taatacgactcactatagggccttcccggcccatgtcctccccccagcaaaacagaggagattgctgatgggaggacataacctggcggcagcgcaaaagatg

SEQ ID NO: 15061 - DNA, 103 bp, Artificial Sequence
  Synthetic Polynucleotide
taatacgactcactatagggccaatccttcccggcccatgtcctccccccaacagaggagaggggggatgacatgggccaacctggcggcagcgcaaaagatg

SEQ ID NO: 15062 - DNA, 103 bp, Artificial Sequence
  Synthetic Polynucleotide
taatacgactcactataggggtcttccaatccttcccggcccatgtcctcaacagaggagagaggacatgggccgggaaaacctggcggcagcgcaaaagatg

SEQ ID NO: 15063 - DNA, 103 bp, Artificial Sequence
  Synthetic Polynucleotide
taatacgactcactatagggccttggtcttccaatccttcccggcccatgaacagaggagacatgggatgggaaggattaacctggcggcagcgcaaaagatg

SEQ ID NO: 15064 - DNA, 103 bp, Artificial Sequence
  Synthetic Polynucleotide
taatacgactcactataggggaggtccttggtcttccaatccttcccggcaacagaggagagccgggatggattggaagaacctggcggcagcgcaaaagatg

SEQ ID NO: 15065 - DNA, 103 bp, Artificial Sequence
  Synthetic Polynucleotide
taatacgactcactatagggagggggaggtccttggtcttccaatccttcaacagaggagagaaggaatggaagaccaaaacctggcggcagcgcaaaagatg

SEQ ID NO: 15066 - DNA, 103 bp, Artificial Sequence
  Synthetic Polynucleotide
taatacgactcactatagggggaggagggggaggtccttggtcttccaataacagaggagaattggaatgccaaggaccaacctggcggcagcgcaaaagatg

SEQ ID NO: 15067 - DNA, 103 bp, Artificial Sequence
  Synthetic Polynucleotide
taatacgactcactatagggagagtccagcagggaacacccaggctctacaacagaggagagtagagatggggtgttccaacctggcggcagcgcaaaagatg

SEQ ID NO: 15068 - DNA, 103 bp, Artificial Sequence
  Synthetic Polynucleotide
taatacgactcactataggggagggggaggagggggaggtccttggtcttaacagaggagaaagaccatggacctccccaacctggcggcagcgcaaaagatg

SEQ ID NO: 15069 - DNA, 103 bp, Artificial Sequence
  Synthetic Polynucleotide
taatacgactcactatagggacctggagggggaggagggggaggtccttgaacagaggagacaaggaatgccccctcctaacctggcggcagcgcaaaagatg

SEQ ID NO: 15070 - DNA, 103 bp, Artificial Sequence
  Synthetic Polynucleotide
taatacgactcactatagggactagacctggagggggaggagggggaggtaacagaggagaacctccatgtcctcccccaacctggcggcagcgcaaaagatg

SEQ ID NO: 15071 - DNA, 103 bp, Artificial Sequence
  Synthetic Polynucleotide
taatacgactcactatagggattagactagacctggagggggaggaggggaacagaggagacccctcatgcccctccagaacctggcggcagcgcaaaagatg

SEQ ID NO: 15072 - DNA, 103 bp, Artificial Sequence
  Synthetic Polynucleotide
taatacgactcactatagggcagtcattagactagacctggagggggaggaacagaggagacctcccatgccaggtctaaacctggcggcagcgcaaaagatg

SEQ ID NO: 15073 - DNA, 103 bp, Artificial Sequence
  Synthetic Polynucleotide
taatacgactcactatagggtgcttcagtcattagactagacctggagggaacagaggagaccctccatgtctagtctaaacctggcggcagcgcaaaagatg

SEQ ID NO: 15074 - DNA, 103 bp, Artificial Sequence
  Synthetic Polynucleotide
taatacgactcactataggggttggtgcttcagtcattagactagacctgaacagaggagacaggtcatgtctaatgacaacctggcggcagcgcaaaagatg

SEQ ID NO: 15075 - DNA, 103 bp, Artificial Sequence
  Synthetic Polynucleotide
taatacgactcactatagggactctgttggtgcttcagtcattagactagaacagaggagactagtcatgtgactgaagaacctggcggcagcgcaaaagatg

SEQ ID NO: 15076 - DNA, 103 bp, Artificial Sequence
  Synthetic Polynucleotide
taatacgactcactataggggggaaactctgttggtgcttcagtcattagaacagaggagactaatgatggaagcaccaaacctggcggcagcgcaaaagatg

SEQ ID NO: 15077 - DNA, 103 bp, Artificial Sequence
  Synthetic Polynucleotide
taatacgactcactatagggtctgggggaaactctgttggtgcttcagtcaacagaggagagactgaatgaccaacagaaacctggcggcagcgcaaaagatg

SEQ ID NO: 15078 - DNA, 103 bp, Artificial Sequence
  Synthetic Polynucleotide
taatacgactcactatagggtggtgagagtccagcagggaacacccaggcaacagaggagagcctggatgttccctgctaacctggcggcagcgcaaaagatg

SEQ ID NO: 15079 - DNA, 103 bp, Artificial Sequence
  Synthetic Polynucleotide
taatacgactcactatagggcatcttctgggggaaactctgttggtgcttaacagaggagaaagcacatgcagagtttcaacctggcggcagcgcaaaagatg

SEQ ID NO: 15080 - DNA, 103 bp, Artificial Sequence
  Synthetic Polynucleotide
taatacgactcactatagggggtcccatcttctgggggaaactctgttggaacagaggagaccaacaatgtttcccccaaacctggcggcagcgcaaaagatg

SEQ ID NO: 15081 - DNA, 103 bp, Artificial Sequence
  Synthetic Polynucleotide
taatacgactcactatagggcgtggggtcccatcttctgggggaaactctaacagaggagaagagttatgcccagaagaaacctggcggcagcgcaaaagatg

SEQ ID NO: 15082 - DNA, 103 bp, Artificial Sequence
  Synthetic Polynucleotide
taatacgactcactatagggccctccgtggggtcccatcttctgggggaaaacagaggagattccccatgaagatgggaaacctggcggcagcgcaaaagatg

SEQ ID NO: 15083 - DNA, 103 bp, Artificial Sequence
  Synthetic Polynucleotide
taatacgactcactatagggtaagtccctccgtggggtcccatcttctggaacagaggagaccagaaatggggaccccaaacctggcggcagcgcaaaagatg

SEQ ID NO: 15084 - DNA, 103 bp, Artificial Sequence
  Synthetic Polynucleotide
taatacgactcactatagggctccctaagtccctccgtggggtcccatctaacagaggagaagatggatgcccacggagaacctggcggcagcgcaaaagatg

SEQ ID NO: 15085 - DNA, 103 bp, Artificial Sequence
  Synthetic Polynucleotide
taatacgactcactatagggagtcactccctaagtccctccgtggggtccaacagaggagaggacccatgggagggactaacctggcggcagcgcaaaagatg

SEQ ID NO: 15086 - DNA, 103 bp, Artificial Sequence
  Synthetic Polynucleotide
taatacgactcactatagggtacccagtcactccctaagtccctccgtggaacagaggagaccacggatggacttagggaacctggcggcagcgcaaaagatg

SEQ ID NO: 15087 - DNA, 103 bp, Artificial Sequence
  Synthetic Polynucleotide
taatacgactcactatagggtctattacccagtcactccctaagtccctcaacagaggagagagggaatgagggagtgaaacctggcggcagcgcaaaagatg

SEQ ID NO: 15088 - DNA, 103 bp, Artificial Sequence
  Synthetic Polynucleotide
taatacgactcactataggggagtttctattacccagtcactccctaagtaacagaggagaacttagatggtgactgggaacctggcggcagcgcaaaagatg

SEQ ID NO: 15089 - DNA, 103 bp, Artificial Sequence
  Synthetic Polynucleotide
taatacgactcactatagggagtactggtgagagtccagcagggaacaccaacagaggagaggtgttatgtgctggactaacctggcggcagcgcaaaagatg

SEQ ID NO: 15090 - DNA, 103 bp, Artificial Sequence
  Synthetic Polynucleotide
taatacgactcactatagggcctcagagtttctattacccagtcactcccaacagaggagagggagtatgtgggtaataaacctggcggcagcgcaaaagatg

SEQ ID NO: 15091 - DNA, 103 bp, Artificial Sequence
  Synthetic Polynucleotide
taatacgactcactatagggatttccctcagagtttctattacccagtcaaacagaggagatgactgatgaatagaaacaacctggcggcagcgcaaaagatg

SEQ ID NO: 15092 - DNA, 103 bp, Artificial Sequence
  Synthetic Polynucleotide
taatacgactcactatagggcctttatttccctcagagtttctattacccaacagaggagagggtaaatgaaactctgaaacctggcggcagcgcaaaagatg

SEQ ID NO: 15093 - DNA, 103 bp, Artificial Sequence
  Synthetic Polynucleotide
taatacgactcactatagggttcttcctttatttccctcagagtttctataacagaggagaatagaaatgctgagggaaaacctggcggcagcgcaaaagatg

SEQ ID NO: 15094 - DNA, 103 bp, Artificial Sequence
  Synthetic Polynucleotide
taatacgactcactatagggaaggcttcttcctttatttccctcagagttaacagaggagaaactctatgggaaataaaaacctggcggcagcgcaaaagatg

SEQ ID NO: 15095 - DNA, 103 bp, Artificial Sequence
  Synthetic Polynucleotide
taatacgactcactataggggtcttaaggcttcttcctttatttccctcaaacagaggagatgagggatgtaaaggaagaacctggcggcagcgcaaaagatg

SEQ ID NO: 15096 - DNA, 103 bp, Artificial Sequence
  Synthetic Polynucleotide
taatacgactcactatagggaaaatgtcttaaggcttcttcctttatttcaacagaggagagaaataatggaagaagccaacctggcggcagcgcaaaagatg

SEQ ID NO: 15097 - DNA, 103 bp, Artificial Sequence
  Synthetic Polynucleotide
taatacgactcactatagggggatcaaaatgtcttaaggcttcttcctttaacagaggagaaaaggaatgagccttaagaacctggcggcagcgcaaaagatg

SEQ ID NO: 15098 - DNA, 103 bp, Artificial Sequence
  Synthetic Polynucleotide
taatacgactcactatagggagcggggatcaaaatgtcttaaggcttcttaacagaggagaaagaagatgtaagacattaacctggcggcagcgcaaaagatg

SEQ ID NO: 15099 - DNA, 103 bp, Artificial Sequence
  Synthetic Polynucleotide
taatacgactcactatagggtagcaagcggggatcaaaatgtcttaaggcaacagaggagagccttaatgcattttgataacctggcggcagcgcaaaagatg

SEQ ID NO: 15100 - DNA, 103 bp, Artificial Sequence
  Synthetic Polynucleotide
taatacgactcactatagggggccaagtactggtgagagtccagcagggaaacagaggagatccctgatggactctcacaacctggcggcagcgcaaaagatg

SEQ ID NO: 15101 - DNA, 103 bp, Artificial Sequence
  Synthetic Polynucleotide
taatacgactcactataggggcaattagcaagcggggatcaaaatgtcttaacagaggagaaagacaatgtgatccccgaacctggcggcagcgcaaaagatg

SEQ ID NO: 15102 - DNA, 103 bp, Artificial Sequence
  Synthetic Polynucleotide
taatacgactcactatagggcaagagcaattagcaagcggggatcaaaataacagaggagaattttgatgcccgcttgcaacctggcggcagcgcaaaagatg

SEQ ID NO: 15103 - DNA, 103 bp, Artificial Sequence
  Synthetic Polynucleotide
taatacgactcactataggggtagccaagagcaattagcaagcggggatcaacagaggagagatcccatgttgctaattaacctggcggcagcgcaaaagatg

SEQ ID NO: 15104 - DNA, 103 bp, Artificial Sequence
  Synthetic Polynucleotide
taatacgactcactatagggatatagtagccaagagcaattagcaagcggaacagaggagaccgcttatgaattgctctaacctggcggcagcgcaaaagatg

SEQ ID NO: 15105 - DNA, 103 bp, Artificial Sequence
  Synthetic Polynucleotide
taatacgactcactatagggtatggatatagtagccaagagcaattagcaaacagaggagatgctaaatgctcttggctaacctggcggcagcgcaaaagatg

SEQ ID NO: 15106 - DNA, 103 bp, Artificial Sequence
  Synthetic Polynucleotide
taatacgactcactatagggtctattatggatatagtagccaagagcaataacagaggagaattgctatgggctactataacctggcggcagcgcaaaagatg

SEQ ID NO: 15107 - DNA, 103 bp, Artificial Sequence
  Synthetic Polynucleotide
taatacgactcactatagggccatgtctattatggatatagtagccaagaaacagaggagatcttggatgctatatccaaacctggcggcagcgcaaaagatg

SEQ ID NO: 15108 - DNA, 103 bp, Artificial Sequence
  Synthetic Polynucleotide
taatacgactcactatagggtgtctccatgtctattatggatatagtagcaacagaggagagctactatgtccataataaacctggcggcagcgcaaaagatg

SEQ ID NO: 15109 - DNA, 103 bp, Artificial Sequence
  Synthetic Polynucleotide
taatacgactcactatagggaagggtgtctccatgtctattatggatataaacagaggagatatatcatgaatagacataacctggcggcagcgcaaaagatg

SEQ ID NO: 15110 - DNA, 103 bp, Artificial Sequence
  Synthetic Polynucleotide
taatacgactcactatagggccttcaagggtgtctccatgtctattatggaacagaggagaccataaatgacatggagaaacctggcggcagcgcaaaagatg

SEQ ID NO: 15111 - DNA, 103 bp, Artificial Sequence
  Synthetic Polynucleotide
taatacgactcactataggggtaccggccaagtactggtgagagtccagcaacagaggagagctggaatgtcaccagtaaacctggcggcagcgcaaaagatg

SEQ ID NO: 15112 - DNA, 103 bp, Artificial Sequence
  Synthetic Polynucleotide
taatacgactcactatagggtggcgccttcaagggtgtctccatgtctataacagaggagaatagacatggagacacccaacctggcggcagcgcaaaagatg

SEQ ID NO: 15113 - DNA, 103 bp, Artificial Sequence
  Synthetic Polynucleotide
taatacgactcactatagggctctctggcgccttcaagggtgtctccatgaacagaggagacatggaatgacccttgaaaacctggcggcagcgcaaaagatg

SEQ ID NO: 15114 - DNA, 103 bp, Artificial Sequence
  Synthetic Polynucleotide
taatacgactcactatagggatgagctctctggcgccttcaagggtgtctaacagaggagaagacacatgtgaaggcgcaacctggcggcagcgcaaaagatg

SEQ ID NO: 15115 - DNA, 103 bp, Artificial Sequence
  Synthetic Polynucleotide
taatacgactcactatagggttttaatgagctctctggcgccttcaagggaacagaggagacccttgatggcgccagagaacctggcggcagcgcaaaagatg

SEQ ID NO: 15116 - DNA, 103 bp, Artificial Sequence
  Synthetic Polynucleotide
taatacgactcactatagggtagggttttaatgagctctctggcgccttcaacagaggagagaaggcatgagagagctcaacctggcggcagcgcaaaagatg

SEQ ID NO: 15117 - DNA, 103 bp, Artificial Sequence
  Synthetic Polynucleotide
taatacgactcactatagggcgttgtagggttttaatgagctctctggcgaacagaggagacgccagatggctcattaaaacctggcggcagcgcaaaagatg

SEQ ID NO: 15118 - DNA, 103 bp, Artificial Sequence
  Synthetic Polynucleotide
taatacgactcactataggggggctcgttgtagggttttaatgagctctcaacagaggagagagagcatgttaaaacccaacctggcggcagcgcaaaagatg

SEQ ID NO: 15119 - DNA, 103 bp, Artificial Sequence
  Synthetic Polynucleotide
taatacgactcactataggggaagagggctcgttgtagggttttaatgagaacagaggagactcattatgaccctacaaaacctggcggcagcgcaaaagatg

SEQ ID NO: 15120 - DNA, 103 bp, Artificial Sequence
  Synthetic Polynucleotide
taatacgactcactatagggtgcacgaagagggctcgttgtagggttttaaacagaggagataaaacatgacaacgagcaacctggcggcagcgcaaaagatg

SEQ ID NO: 15121 - DNA, 103 bp, Artificial Sequence
  Synthetic Polynucleotide
taatacgactcactatagggtgaagtgcacgaagagggctcgttgtagggaacagaggagaccctacatggagccctctaacctggcggcagcgcaaaagatg

SEQ ID NO: 15122 - DNA, 103 bp, Artificial Sequence
  Synthetic Polynucleotide
taatacgactcactataggggcccagtaccggccaagtactggtgagagtaacagaggagaactctcatgagtacttggaacctggcggcagcgcaaaagatg

SEQ ID NO: 15123 - DNA, 103 bp, Artificial Sequence
  Synthetic Polynucleotide
taatacgactcactatagggcgctctgaagtgcacgaagagggctcgttgaacagaggagacaacgaatgctcttcgtgaacctggcggcagcgcaaaagatg

SEQ ID NO: 15124 - DNA, 103 bp, Artificial Sequence
  Synthetic Polynucleotide
taatacgactcactatagggcatcccgctctgaagtgcacgaagagggctaacagaggagaagccctatgcgtgcacttaacctggcggcagcgcaaaagatg

SEQ ID NO: 15125 - DNA, 103 bp, Artificial Sequence
  Synthetic Polynucleotide
taatacgactcactatagggggttacatcccgctctgaagtgcacgaagaaacagaggagatcttcgatgacttcagagaacctggcggcagcgcaaaagatg

SEQ ID NO: 15126 - DNA, 103 bp, Artificial Sequence
  Synthetic Polynucleotide
taatacgactcactatagggtgagcggttacatcccgctctgaagtgcacaacagaggagagtgcacatgagagcgggaaacctggcggcagcgcaaaagatg

SEQ ID NO: 15127 - DNA, 103 bp, Artificial Sequence
  Synthetic Polynucleotide
taatacgactcactatagggattcttgagcggttacatcccgctctgaagaacagaggagacttcagatggggatgtaaaacctggcggcagcgcaaaagatg

SEQ ID NO: 15128 - DNA, 103 bp, Artificial Sequence
  Synthetic Polynucleotide
taatacgactcactatagggagccaattcttgagcggttacatcccgctcaacagaggagagagcggatggtaaccgctaacctggcggcagcgcaaaagatg

SEQ ID NO: 15129 - DNA, 103 bp, Artificial Sequence
  Synthetic Polynucleotide
taatacgactcactatagggtgtttagccaattcttgagcggttacatccaacagaggagaggatgtatgcgctcaagaaacctggcggcagcgcaaaagatg

SEQ ID NO: 15130 - DNA, 103 bp, Artificial Sequence
  Synthetic Polynucleotide
taatacgactcactatagggctccttgtttagccaattcttgagcggttaaacagaggagataaccgatgaagaattggaacctggcggcagcgcaaaagatg

SEQ ID NO: 15131 - DNA, 103 bp, Artificial Sequence
  Synthetic Polynucleotide
taatacgactcactatagggttcttctccttgtttagccaattcttgagcaacagaggagagctcaaatgttggctaaaaacctggcggcagcgcaaaagatg

SEQ ID NO: 15132 - DNA, 103 bp, Artificial Sequence
  Synthetic Polynucleotide
taatacgactcactatagggaggagttcttctccttgtttagccaattctaacagaggagaagaattatgtaaacaaggaacctggcggcagcgcaaaagatg

SEQ ID NO: 15133 - DNA, 103 bp, Artificial Sequence
  Synthetic Polynucleotide
taatacgactcactatagggaattctgccaatctggtattatcccttcctaacagaggagaaggaagatgtaataccagaacctggcggcagcgcaaaagatg

SEQ ID NO: 15134 - DNA, 103 bp, Artificial Sequence
  Synthetic Polynucleotide
taatacgactcactatagggcgtctgcccagtaccggccaagtactggtgaacagaggagacaccagatgttggccggtaacctggcggcagcgcaaaagatg

SEQ ID NO: 15135 - DNA, 103 bp, Artificial Sequence
  Synthetic Polynucleotide
taatacgactcactataggggggcaaggagttcttctccttgtttagccaaacagaggagatggctaatgaaggagaagaacctggcggcagcgcaaaagatg

SEQ ID NO: 15136 - DNA, 103 bp, Artificial Sequence
  Synthetic Polynucleotide
taatacgactcactatagggcagctgggcaaggagttcttctccttgtttaacagaggagaaaacaaatggaagaactcaacctggcggcagcgcaaaagatg

SEQ ID NO: 15137 - DNA, 103 bp, Artificial Sequence
  Synthetic Polynucleotide
taatacgactcactatagggcggtgcagctgggcaaggagttcttctcctaacagaggagaaggagaatgactccttgcaacctggcggcagcgcaaaagatg

SEQ ID NO: 15138 - DNA, 103 bp, Artificial Sequence
  Synthetic Polynucleotide
taatacgactcactatagggggggtcggtgcagctgggcaaggagttcttaacagaggagaaagaacatgttgcccagcaacctggcggcagcgcaaaagatg

SEQ ID NO: 15139 - DNA, 103 bp, Artificial Sequence
  Synthetic Polynucleotide
taatacgactcactatagggctctaggggtcggtgcagctgggcaaggagaacagaggagactccttatgcagctgcacaacctggcggcagcgcaaaagatg

SEQ ID NO: 15140 - DNA, 103 bp, Artificial Sequence
  Synthetic Polynucleotide
taatacgactcactatagggcatggctctaggggtcggtgcagctgggcaaacagaggagatgcccaatggcaccgaccaacctggcggcagcgcaaaagatg

SEQ ID NO: 15141 - DNA, 103 bp, Artificial Sequence
  Synthetic Polynucleotide
taatacgactcactatagggtagtgcatggctctaggggtcggtgcagctaacagaggagaagctgcatggacccctagaacctggcggcagcgcaaaagatg

SEQ ID NO: 15142 - DNA, 103 bp, Artificial Sequence
  Synthetic Polynucleotide
taatacgactcactatagggtttgttagtgcatggctctaggggtcggtgaacagaggagacaccgaatgctagagccaaacctggcggcagcgcaaaagatg

SEQ ID NO: 15143 - DNA, 103 bp, Artificial Sequence
  Synthetic Polynucleotide
taatacgactcactatagggtagcatttgttagtgcatggctctaggggtaacagaggagaacccctatggccatgcacaacctggcggcagcgcaaaagatg

SEQ ID NO: 15144 - DNA, 103 bp, Artificial Sequence
  Synthetic Polynucleotide
taatacgactcactatagggtacaatagcatttgttagtgcatggctctaaacagaggagatagagcatggcactaacaaacctggcggcagcgcaaaagatg

SEQ ID NO: 15145 - DNA, 103 bp, Artificial Sequence
  Synthetic Polynucleotide
taatacgactcactatagggggagccgtctgcccagtaccggccaagtacaacagaggagagtacttatgcggtactggaacctggcggcagcgcaaaagatg

SEQ ID NO: 15146 - DNA, 103 bp, Artificial Sequence
  Synthetic Polynucleotide
taatacgactcactatagggtcgcttacaatagcatttgttagtgcatggaacagaggagaccatgcatgaacaaatgcaacctggcggcagcgcaaaagatg

SEQ ID NO: 15147 - DNA, 103 bp, Artificial Sequence
  Synthetic Polynucleotide
taatacgactcactatagggctgcatcgcttacaatagcatttgttagtgaacagaggagacactaaatgatgctattgaacctggcggcagcgcaaaagatg

SEQ ID NO: 15148 - DNA, 103 bp, Artificial Sequence
  Synthetic Polynucleotide
taatacgactcactatagggggaaactgcatcgcttacaatagcatttgtaacagaggagaacaaatatgattgtaagcaacctggcggcagcgcaaaagatg

SEQ ID NO: 15149 - DNA, 103 bp, Artificial Sequence
  Synthetic Polynucleotide
taatacgactcactataggggcaatggaaactgcatcgcttacaatagcaaacagaggagatgctatatgaagcgatgcaacctggcggcagcgcaaaagatg

SEQ ID NO: 15150 - DNA, 103 bp, Artificial Sequence
  Synthetic Polynucleotide
taatacgactcactatagggagctggcaatggaaactgcatcgcttacaaaacagaggagattgtaaatgatgcagtttaacctggcggcagcgcaaaagatg

SEQ ID NO: 15151 - DNA, 103 bp, Artificial Sequence
  Synthetic Polynucleotide
taatacgactcactatagggaacacagctggcaatggaaactgcatcgctaacagaggagaagcgatatggtttccattaacctggcggcagcgcaaaagatg

SEQ ID NO: 15152 - DNA, 103 bp, Artificial Sequence
  Synthetic Polynucleotide
taatacgactcactatagggcgagaaacacagctggcaatggaaactgcaaacagaggagatgcagtatgcattgccagaacctggcggcagcgcaaaagatg

SEQ ID NO: 15153 - DNA, 103 bp, Artificial Sequence
  Synthetic Polynucleotide
taatacgactcactatagggtttttcgagaaacacagctggcaatggaaaaacagaggagatttccaatgccagctgtgaacctggcggcagcgcaaaagatg

SEQ ID NO: 15154 - DNA, 103 bp, Artificial Sequence
  Synthetic Polynucleotide
taatacgactcactataggggcccctttttcgagaaacacagctggcaataacagaggagaattgccatgtgtgtttctaacctggcggcagcgcaaaagatg

SEQ ID NO: 15155 - DNA, 103 bp, Artificial Sequence
  Synthetic Polynucleotide
taatacgactcactatagggtccgagcccctttttcgagaaacacagctgaacagaggagacagctgatgttctcgaaaaacctggcggcagcgcaaaagatg

SEQ ID NO: 15156 - DNA, 103 bp, Artificial Sequence
  Synthetic Polynucleotide
taatacgactcactatagggagcgtggagccgtctgcccagtaccggccaaacagaggagatggccgatgctgggcagaaacctggcggcagcgcaaaagatg

SEQ ID NO: 15157 - DNA, 103 bp, Artificial Sequence
  Synthetic Polynucleotide
taatacgactcactataggggatattccgagcccctttttcgagaaacacaacagaggagagtgtttatggaaaaagggaacctggcggcagcgcaaaagatg

SEQ ID NO: 15158 - DNA, 103 bp, Artificial Sequence
  Synthetic Polynucleotide
taatacgactcactatagggcatatgatattccgagcccctttttcgagaaacagaggagatctcgaatgaggggctcgaacctggcggcagcgcaaaagatg

SEQ ID NO: 15159 - DNA, 103 bp, Artificial Sequence
  Synthetic Polynucleotide
taatacgactcactatagggtcgctcatatgatattccgagcccctttttaacagaggagaaaaaagatgctcggaataaacctggcggcagcgcaaaagatg

SEQ ID NO: 15160 - DNA, 103 bp, Artificial Sequence
  Synthetic Polynucleotide
taatacgactcactatagggccctttcgctcatatgatattccgagccccaacagaggagaggggctatgaatatcataaacctggcggcagcgcaaaagatg

SEQ ID NO: 15161 - DNA, 103 bp, Artificial Sequence
  Synthetic Polynucleotide
taatacgactcactataggggtctgccctttcgctcatatgatattccgaaacagaggagatcggaaatgcatatgagcaacctggcggcagcgcaaaagatg

SEQ ID NO: 15162 - DNA, 103 bp, Artificial Sequence
  Synthetic Polynucleotide
taatacgactcactatagggtcttcgtctgccctttcgctcatatgatataacagaggagaatatcaatggagcgaaagaacctggcggcagcgcaaaagatg

SEQ ID NO: 15163 - DNA, 103 bp, Artificial Sequence
  Synthetic Polynucleotide
taatacgactcactataggggtccttcttcgtctgccctttcgctcatataacagaggagaatatgaatgaaagggcagaacctggcggcagcgcaaaagatg

SEQ ID NO: 15164 - DNA, 103 bp, Artificial Sequence
  Synthetic Polynucleotide
taatacgactcactatagggttggagtccttcttcgtctgccctttcgctaacagaggagaagcgaaatggcagacgaaaacctggcggcagcgcaaaagatg

SEQ ID NO: 15165 - DNA, 103 bp, Artificial Sequence
  Synthetic Polynucleotide
taatacgactcactatagggtttccttggagtccttcttcgtctgcccttaacagaggagaaagggcatgcgaagaaggaacctggcggcagcgcaaaagatg

SEQ ID NO: 15166 - DNA, 103 bp, Artificial Sequence
  Synthetic Polynucleotide
taatacgactcactatagggttagttttccttggagtccttcttcgtctgaacagaggagacagacgatgaaggactccaacctggcggcagcgcaaaagatg

SEQ ID NO: 15167 - DNA, 103 bp, Artificial Sequence
  Synthetic Polynucleotide
taatacgactcactatagggaagcaagcgtggagccgtctgcccagtaccaacagaggagaggtactatgcagacggctaacctggcggcagcgcaaaagatg

SEQ ID NO: 15168 - DNA, 103 bp, Artificial Sequence
  Synthetic Polynucleotide
taatacgactcactataggggagtcttagttttccttggagtccttcttcaacagaggagagaagaaatgctccaaggaaacctggcggcagcgcaaaagatg

SEQ ID NO: 15169 - DNA, 103 bp, Artificial Sequence
  Synthetic Polynucleotide
taatacgactcactatagggcgaaggagtcttagttttccttggagtcctaacagaggagaaggactatgaggaaaactaacctggcggcagcgcaaaagatg

SEQ ID NO: 15170 - DNA, 103 bp, Artificial Sequence
  Synthetic Polynucleotide
taatacgactcactataggggaaggcgaaggagtcttagttttccttggaaacagaggagatccaagatgaactaagacaacctggcggcagcgcaaaagatg

SEQ ID NO: 15171 - DNA, 103 bp, Artificial Sequence
  Synthetic Polynucleotide
taatacgactcactataggggtgcagaaggcgaaggagtcttagttttccaacagaggagaggaaaaatgagactccttaacctggcggcagcgcaaaagatg

SEQ ID NO: 15172 - DNA, 103 bp, Artificial Sequence
  Synthetic Polynucleotide
taatacgactcactataggggtctggtgcagaaggcgaaggagtcttagtaacagaggagaactaagatgccttcgcctaacctggcggcagcgcaaaagatg

SEQ ID NO: 15173 - DNA, 103 bp, Artificial Sequence
  Synthetic Polynucleotide
taatacgactcactatagggcacttgtctggtgcagaaggcgaaggagtcaacagaggagagactccatggccttctgcaacctggcggcagcgcaaaagatg

SEQ ID NO: 15174 - DNA, 103 bp, Artificial Sequence
  Synthetic Polynucleotide
taatacgactcactatagggatactcacttgtctggtgcagaaggcgaagaacagaggagacttcgcatgctgcaccagaacctggcggcagcgcaaaagatg

SEQ ID NO: 15175 - DNA, 103 bp, Artificial Sequence
  Synthetic Polynucleotide
taatacgactcactataggggctccatactcacttgtctggtgcagaaggaacagaggagaccttctatgccagacaagaacctggcggcagcgcaaaagatg

SEQ ID NO: 15176 - DNA, 103 bp, Artificial Sequence
  Synthetic Polynucleotide
taatacgactcactatagggaccaggctccatactcacttgtctggtgcaaacagaggagatgcaccatgcaagtgagtaacctggcggcagcgcaaaagatg

SEQ ID NO: 15177 - DNA, 103 bp, Artificial Sequence
  Synthetic Polynucleotide
taatacgactcactatagggttcctaccaggctccatactcacttgtctgaacagaggagacagacaatggagtatggaaacctggcggcagcgcaaaagatg

SEQ ID NO: 15178 - DNA, 103 bp, Artificial Sequence
  Synthetic Polynucleotide
taatacgactcactatagggtaagcaagcaagcgtggagccgtctgcccaaacagaggagatgggcaatgggctccacgaacctggcggcagcgcaaaagatg

SEQ ID NO: 15179 - DNA, 103 bp, Artificial Sequence
  Synthetic Polynucleotide
taatacgactcactataggggctgattcctaccaggctccatactcacttaacagaggagaaagtgaatgtggagcctgaacctggcggcagcgcaaaagatg

SEQ ID NO: 15180 - DNA, 103 bp, Artificial Sequence
  Synthetic Polynucleotide
taatacgactcactatagggaaacagctgattcctaccaggctccatactaacagaggagaagtatgatgcctggtaggaacctggcggcagcgcaaaagatg

SEQ ID NO: 15181 - DNA, 103 bp, Artificial Sequence
  Synthetic Polynucleotide
taatacgactcactatagggacaacaaacagctgattcctaccaggctccaacagaggagaggagccatgtaggaatcaaacctggcggcagcgcaaaagatg

SEQ ID NO: 15182 - DNA, 103 bp, Artificial Sequence
  Synthetic Polynucleotide
taatacgactcactatagggaaatgacaacaaacagctgattcctaccagaacagaggagactggtaatgatcagctgtaacctggcggcagcgcaaaagatg

SEQ ID NO: 15183 - DNA, 103 bp, Artificial Sequence
  Synthetic Polynucleotide
taatacgactcactatagggtagtaaaatgacaacaaacagctgattcctaacagaggagaaggaatatgctgtttgttaacctggcggcagcgcaaaagatg

SEQ ID NO: 15184 - DNA, 103 bp, Artificial Sequence
  Synthetic Polynucleotide
taatacgactcactatagggcttgttagtaaaatgacaacaaacagctgaaacagaggagatcagctatgtgttgtcataacctggcggcagcgcaaaagatg

SEQ ID NO: 15185 - DNA, 103 bp, Artificial Sequence
  Synthetic Polynucleotide
taatacgactcactatagggaagcacttgttagtaaaatgacaacaaacaaacagaggagatgtttgatgtcattttacaacctggcggcagcgcaaaagatg

SEQ ID NO: 15186 - DNA, 103 bp, Artificial Sequence
  Synthetic Polynucleotide
taatacgactcactatagggtaagcaagcacttgttagtaaaatgacaacaacagaggagagttgtcatgttactaacaaacctggcggcagcgcaaaagatg

SEQ ID NO: 15187 - DNA, 103 bp, Artificial Sequence
  Synthetic Polynucleotide
taatacgactcactatagggtatactaagcaagcacttgttagtaaaatgaacagaggagacattttatgaacaagtgcaacctggcggcagcgcaaaagatg

SEQ ID NO: 15188 - DNA, 103 bp, Artificial Sequence
  Synthetic Polynucleotide
taatacgactcactatagggtacaatatactaagcaagcacttgttagtaaacagaggagatactaaatggtgcttgctaacctggcggcagcgcaaaagatg

SEQ ID NO: 15189 - DNA, 103 bp, Artificial Sequence
  Synthetic Polynucleotide
taatacgactcactataggggtctttaagcaagcaagcgtggagccgtctaacagaggagaagacggatgcacgcttgcaacctggcggcagcgcaaaagatg

SEQ ID NO: 15190 - DNA, 103 bp, Artificial Sequence
  Synthetic Polynucleotide
taatacgactcactatagggctggctacaatatactaagcaagcacttgtaacagaggagaacaagtatgtgcttagtaaacctggcggcagcgcaaaagatg

SEQ ID NO: 15191 - DNA, 103 bp, Artificial Sequence
  Synthetic Polynucleotide
taatacgactcactatagggacatactggctacaatatactaagcaagcaaacagaggagatgcttgatgagtatattgaacctggcggcagcgcaaaagatg

SEQ ID NO: 15192 - DNA, 103 bp, Artificial Sequence
  Synthetic Polynucleotide
taatacgactcactatagggcagtcacatactggctacaatatactaagcaacagaggagagcttagatgattgtagccaacctggcggcagcgcaaaagatg

SEQ ID NO: 15193 - DNA, 103 bp, Artificial Sequence
  Synthetic Polynucleotide
taatacgactcactataggggaaaacagtcacatactggctacaatatacaacagaggagagtatatatgagccagtataacctggcggcagcgcaaaagatg

SEQ ID NO: 15194 - DNA, 103 bp, Artificial Sequence
  Synthetic Polynucleotide
taatacgactcactatagggccatagaaaacagtcacatactggctacaaaacagaggagattgtagatggtatgtgacaacctggcggcagcgcaaaagatg

SEQ ID NO: 15195 - DNA, 103 bp, Artificial Sequence
  Synthetic Polynucleotide
taatacgactcactataggggtatgccatagaaaacagtcacatactggcaacagaggagagccagtatgtgactgtttaacctggcggcagcgcaaaagatg

SEQ ID NO: 15196 - DNA, 103 bp, Artificial Sequence
  Synthetic Polynucleotide
taatacgactcactatagggcgcgggtatgccatagaaaacagtcacataaacagaggagatatgtgatggttttctataacctggcggcagcgcaaaagatg

SEQ ID NO: 15197 - DNA, 103 bp, Artificial Sequence
  Synthetic Polynucleotide
taatacgactcactatagggttccacgcgggtatgccatagaaaacagtcaacagaggagagactgtatgctatggcataacctggcggcagcgcaaaagatg

SEQ ID NO: 15198 - DNA, 103 bp, Artificial Sequence
  Synthetic Polynucleotide
taatacgactcactatagggcatttttccacgcgggtatgccatagaaaaaacagaggagattttctatggcatacccgaacctggcggcagcgcaaaagatg

SEQ ID NO: 15199 - DNA, 103 bp, Artificial Sequence
  Synthetic Polynucleotide
taatacgactcactatagggagatgcatttttccacgcgggtatgccataaacagaggagatatggcatgcccgcgtggaacctggcggcagcgcaaaagatg

SEQ ID NO: 15200 - DNA, 103 bp, Artificial Sequence
  Synthetic Polynucleotide
taatacgactcactatagggaagaggtctttaagcaagcaagcgtggagcaacagaggagagctccaatgttgcttgctaacctggcggcagcgcaaaagatg

SEQ ID NO: 15201 - DNA, 103 bp, Artificial Sequence
  Synthetic Polynucleotide
taatacgactcactatagggggaatagatgcatttttccacgcgggtatgaacagaggagacataccatggtggaaaaaaacctggcggcagcgcaaaagatg

SEQ ID NO: 15202 - DNA, 103 bp, Artificial Sequence
  Synthetic Polynucleotide
taatacgactcactatagggataagggaatagatgcatttttccacgcggaacagaggagaccgcgtatgaaaatgcataacctggcggcagcgcaaaagatg

SEQ ID NO: 15203 - DNA, 103 bp, Artificial Sequence
  Synthetic Polynucleotide
taatacgactcactatagggacaaaataagggaatagatgcatttttccaaacagaggagatggaaaatggcatctattaacctggcggcagcgcaaaagatg

SEQ ID NO: 15204 - DNA, 103 bp, Artificial Sequence
  Synthetic Polynucleotide
taatacgactcactataggggttgcacaaaataagggaatagatgcatttaacagaggagaaaatgcatgtattcccttaacctggcggcagcgcaaaagatg

SEQ ID NO: 15205 - DNA, 103 bp, Artificial Sequence
  Synthetic Polynucleotide
taatacgactcactatagggttttagttgcacaaaataagggaatagatgaacagaggagacatctaatgccttattttaacctggcggcagcgcaaaagatg

SEQ ID NO: 15206 - DNA, 103 bp, Artificial Sequence
  Synthetic Polynucleotide
taatacgactcactatagggtctatttttagttgcacaaaataagggaataacagaggagaattcccatgttttgtgcaaacctggcggcagcgcaaaagatg

SEQ ID NO: 15207 - DNA, 103 bp, Artificial Sequence
  Synthetic Polynucleotide
taatacgactcactataggggtgtctctatttttagttgcacaaaataagaacagaggagacttattatgtgcaactaaaacctggcggcagcgcaaaagatg

SEQ ID NO: 15208 - DNA, 103 bp, Artificial Sequence
  Synthetic Polynucleotide
taatacgactcactatagggcccaagtgtctctatttttagttgcacaaaaacagaggagatttgtgatgctaaaaataaacctggcggcagcgcaaaagatg

SEQ ID NO: 15209 - DNA, 103 bp, Artificial Sequence
  Synthetic Polynucleotide
taatacgactcactatagggggtcccccaagtgtctctatttttagttgcaacagaggagagcaactatgaatagagacaacctggcggcagcgcaaaagatg

SEQ ID NO: 15210 - DNA, 103 bp, Artificial Sequence
  Synthetic Polynucleotide
taatacgactcactatagggtgtatggtcccccaagtgtctctatttttaaacagaggagataaaaaatgagacacttgaacctggcggcagcgcaaaagatg

SEQ ID NO: 15211 - DNA, 103 bp, Artificial Sequence
  Synthetic Polynucleotide
taatacgactcactatagggtattgaagaggtctttaagcaagcaagcgtaacagaggagaacgcttatgtgcttaaagaacctggcggcagcgcaaaagatg

SEQ ID NO: 15212 - DNA, 103 bp, Artificial Sequence
  Synthetic Polynucleotide
taatacgactcactatagggagcactgtatggtcccccaagtgtctctataacagaggagaatagagatgcttgggggaaacctggcggcagcgcaaaagatg

SEQ ID NO: 15213 - DNA, 103 bp, Artificial Sequence
  Synthetic Polynucleotide
taatacgactcactatagggtggcaagcactgtatggtcccccaagtgtcaacagaggagagacactatggggaccataaacctggcggcagcgcaaaagatg

SEQ ID NO: 15214 - DNA, 103 bp, Artificial Sequence
  Synthetic Polynucleotide
taatacgactcactatagggttgtctggcaagcactgtatggtcccccaaaacagaggagattggggatgcatacagtgaacctggcggcagcgcaaaagatg

SEQ ID NO: 15215 - DNA, 103 bp, Artificial Sequence
  Synthetic Polynucleotide
taatacgactcactatagggcatcattgtctggcaagcactgtatggtccaacagaggagaggaccaatgagtgcttgcaacctggcggcagcgcaaaagatg

SEQ ID NO: 15216 - DNA, 103 bp, Artificial Sequence
  Synthetic Polynucleotide
taatacgactcactatagggataatcatcattgtctggcaagcactgtataacagaggagaatacagatgttgccagacaacctggcggcagcgcaaaagatg

SEQ ID NO: 15217 - DNA, 103 bp, Artificial Sequence
  Synthetic Polynucleotide
taatacgactcactatagggtcctgataatcatcattgtctggcaagcacaacagaggagagtgcttatgagacaatgaaacctggcggcagcgcaaaagatg

SEQ ID NO: 15218 - DNA, 103 bp, Artificial Sequence
  Synthetic Polynucleotide
taatacgactcactatagggttatttcctgataatcatcattgtctggcaaacagaggagatgccagatgatgatgattaacctggcggcagcgcaaaagatg

SEQ ID NO: 15219 - DNA, 103 bp, Artificial Sequence
  Synthetic Polynucleotide
taatacgactcactatagggtaaaattatttcctgataatcatcattgtcaacagaggagagacaatatggattatcagaacctggcggcagcgcaaaagatg

SEQ ID NO: 15220 - DNA, 103 bp, Artificial Sequence
  Synthetic Polynucleotide
taatacgactcactatagggacatttaaaattatttcctgataatcatcaaacagaggagatgatgaatgtcaggaaataacctggcggcagcgcaaaagatg

SEQ ID NO: 15221 - DNA, 103 bp, Artificial Sequence
  Synthetic Polynucleotide
taatacgactcactatagggctgtcacatttaaaattatttcctgataataacagaggagaattatcatgaaataatttaacctggcggcagcgcaaaagatg

SEQ ID NO: 15222 - DNA, 103 bp, Artificial Sequence
  Synthetic Polynucleotide
taatacgactcactatagggagctttattgaagaggtctttaagcaagcaaacagaggagatgcttgatgaaagacctcaacctggcggcagcgcaaaagatg

SEQ ID NO: 15223 - DNA, 103 bp, Artificial Sequence
  Synthetic Polynucleotide
taatacgactcactatagggagcctctgtcacatttaaaattatttcctgaacagaggagacaggaaatgattttaaataacctggcggcagcgcaaaagatg

SEQ ID NO: 15224 - DNA, 103 bp, Artificial Sequence
  Synthetic Polynucleotide
taatacgactcactatagggtcaaaagcctctgtcacatttaaaattattaacagaggagaaataatatgaaatgtgacaacctggcggcagcgcaaaagatg

SEQ ID NO: 15225 - DNA, 103 bp, Artificial Sequence
  Synthetic Polynucleotide
taatacgactcactatagggatgcatcaaaagcctctgtcacatttaaaaaacagaggagattttaaatgtgacagaggaacctggcggcagcgcaaaagatg

SEQ ID NO: 15226 - DNA, 103 bp, Artificial Sequence
  Synthetic Polynucleotide
taatacgactcactatagggattccatgcatcaaaagcctctgtcacattaacagaggagaaatgtgatggaggcttttaacctggcggcagcgcaaaagatg

SEQ ID NO: 15227 - DNA, 103 bp, Artificial Sequence
  Synthetic Polynucleotide
taatacgactcactataggggtattattccatgcatcaaaagcctctgtcaacagaggagagacagaatgttttgatgcaacctggcggcagcgcaaaagatg

SEQ ID NO: 15228 - DNA, 103 bp, Artificial Sequence
  Synthetic Polynucleotide
taatacgactcactatagggtcactgtattattccatgcatcaaaagcctaacagaggagaaggcttatgatgcatggaaacctggcggcagcgcaaaagatg

SEQ ID NO: 15229 - DNA, 103 bp, Artificial Sequence
  Synthetic Polynucleotide
taatacgactcactatagggttctgtcactgtattattccatgcatcaaaaacagaggagatttgatatgtggaataataacctggcggcagcgcaaaagatg

SEQ ID NO: 15230 - DNA, 103 bp, Artificial Sequence
  Synthetic Polynucleotide
taatacgactcactataggggcttgttctgtcactgtattattccatgcaaacagaggagatgcatgatgtaatacagtaacctggcggcagcgcaaaagatg

SEQ ID NO: 15231 - DNA, 103 bp, Artificial Sequence
  Synthetic Polynucleotide
taatacgactcactatagggctactgcttgttctgtcactgtattattccaacagaggagaggaataatgcagtgacagaacctggcggcagcgcaaaagatg

SEQ ID NO: 15232 - DNA, 103 bp, Artificial Sequence
  Synthetic Polynucleotide
taatacgactcactatagggatcttctactgcttgttctgtcactgtattaacagaggagaaatacaatgacagaacaaaacctggcggcagcgcaaaagatg

SEQ ID NO: 15233 - DNA, 103 bp, Artificial Sequence
  Synthetic Polynucleotide
taatacgactcactatagggctggcagctttattgaagaggtctttaagcaacagaggagagcttaaatgcctcttcaaaacctggcggcagcgcaaaagatg

SEQ ID NO: 15234 - DNA, 103 bp, Artificial Sequence
  Synthetic Polynucleotide
taatacgactcactatagggcagacatcttctactgcttgttctgtcactaacagaggagaagtgacatgacaagcagtaacctggcggcagcgcaaaagatg

SEQ ID NO: 15235 - DNA, 103 bp, Artificial Sequence
  Synthetic Polynucleotide
taatacgactcactataggggatgccagacatcttctactgcttgttctgaacagaggagacagaacatgcagtagaagaacctggcggcagcgcaaaagatg

SEQ ID NO: 15236 - DNA, 103 bp, Artificial Sequence
  Synthetic Polynucleotide
taatacgactcactatagggaaatagatgccagacatcttctactgcttgaacagaggagacaagcaatggaagatgtcaacctggcggcagcgcaaaagatg

SEQ ID NO: 15237 - DNA, 103 bp, Artificial Sequence
  Synthetic Polynucleotide
taatacgactcactataggggtctcaaatagatgccagacatcttctactaacagaggagaagtagaatgtgtctggcaaacctggcggcagcgcaaaagatg

SEQ ID NO: 15238 - DNA, 103 bp, Artificial Sequence
  Synthetic Polynucleotide
taatacgactcactatagggttgatgtctcaaatagatgccagacatcttaacagaggagaaagatgatgggcatctataacctggcggcagcgcaaaagatg

SEQ ID NO: 15239 - DNA, 103 bp, Artificial Sequence
  Synthetic Polynucleotide
taatacgactcactatagggttttattgatgtctcaaatagatgccagacaacagaggagagtctggatgctatttgagaacctggcggcagcgcaaaagatg

SEQ ID NO: 15240 - DNA, 103 bp, Artificial Sequence
  Synthetic Polynucleotide
taatacgactcactatagggcatggttttattgatgtctcaaatagatgcaacagaggagagcatctatgtgagacatcaacctggcggcagcgcaaaagatg

SEQ ID NO: 15241 - DNA, 103 bp, Artificial Sequence
  Synthetic Polynucleotide
taatacgactcactatagggtgacacatggttttattgatgtctcaaataaacagaggagatatttgatgcatcaataaaacctggcggcagcgcaaaagatg

SEQ ID NO: 15242 - DNA, 103 bp, Artificial Sequence
  Synthetic Polynucleotide
taatacgactcactatagggtagcttgacacatggttttattgatgtctcaacagaggagagagacaatgataaaaccaaacctggcggcagcgcaaaagatg

SEQ ID NO: 15243 - DNA, 103 bp, Artificial Sequence
  Synthetic Polynucleotide
taatacgactcactatagggggtgttagcttgacacatggttttattgataacagaggagaatcaatatgaccatgtgtaacctggcggcagcgcaaaagatg

SEQ ID NO: 15244 - DNA, 103 bp, Artificial Sequence
  Synthetic Polynucleotide
taatacgactcactatagggagtataattctgccaatctggtattatcccaacagaggagagggataatgccagattggaacctggcggcagcgcaaaagatg

SEQ ID NO: 15245 - DNA, 103 bp, Artificial Sequence
  Synthetic Polynucleotide
taatacgactcactatagggtctaactggcagctttattgaagaggtcttaacagaggagaaagaccatgtcaataaagaacctggcggcagcgcaaaagatg

SEQ ID NO: 15246 - DNA, 103 bp, Artificial Sequence
  Synthetic Polynucleotide
taatacgactcactatagggatagaggtgttagcttgacacatggttttaaacagaggagataaaacatggtgtcaagcaacctggcggcagcgcaaaagatg

SEQ ID NO: 15247 - DNA, 103 bp, Artificial Sequence
  Synthetic Polynucleotide
taatacgactcactatagggcacacatagaggtgttagcttgacacatggaacagaggagaccatgtatgaagctaacaaacctggcggcagcgcaaaagatg

SEQ ID NO: 15248 - DNA, 103 bp, Artificial Sequence
  Synthetic Polynucleotide
taatacgactcactatagggattgccacacatagaggtgttagcttgacaaacagaggagatgtcaaatgaacacctctaacctggcggcagcgcaaaagatg

SEQ ID NO: 15249 - DNA, 103 bp, Artificial Sequence
  Synthetic Polynucleotide
taatacgactcactatagggaattcattgccacacatagaggtgttagctaacagaggagaagctaaatgctctatgtgaacctggcggcagcgcaaaagatg

SEQ ID NO: 15250 - DNA, 103 bp, Artificial Sequence
  Synthetic Polynucleotide
taatacgactcactataggggctacaattcattgccacacatagaggtgtaacagaggagaacacctatgtgtgtggcaaacctggcggcagcgcaaaagatg

SEQ ID NO: 15251 - DNA, 103 bp, Artificial Sequence
  Synthetic Polynucleotide
taatacgactcactatagggaccctgctacaattcattgccacacatagaaacagaggagatctatgatgggcaatgaaaacctggcggcagcgcaaaagatg

SEQ ID NO: 15252 - DNA, 103 bp, Artificial Sequence
  Synthetic Polynucleotide
taatacgactcactatagggcttgaaccctgctacaattcattgccacacaacagaggagagtgtggatgtgaattgtaaacctggcggcagcgcaaaagatg

SEQ ID NO: 15253 - DNA, 103 bp, Artificial Sequence
  Synthetic Polynucleotide
taatacgactcactatagggattcccttgaaccctgctacaattcattgcaacagaggagagcaatgatgtgtagcaggaacctggcggcagcgcaaaagatg

SEQ ID NO: 15254 - DNA, 103 bp, Artificial Sequence
  Synthetic Polynucleotide
taatacgactcactataggggtggtattcccttgaaccctgctacaattcaacagaggagagaattgatgcagggttcaaacctggcggcagcgcaaaagatg

SEQ ID NO: 15255 - DNA, 103 bp, Artificial Sequence
  Synthetic Polynucleotide
taatacgactcactataggggggtcgtggtattcccttgaaccctgctacaacagaggagagtagcaatgttcaagggaaacctggcggcagcgcaaaagatg

SEQ ID NO: 15256 - DNA, 103 bp, Artificial Sequence
  Synthetic Polynucleotide
taatacgactcactatagggttgcttctaactggcagctttattgaagagaacagaggagactcttcatgaaagctgccaacctggcggcagcgcaaaagatg

SEQ ID NO: 15257 - DNA, 103 bp, Artificial Sequence
  Synthetic Polynucleotide
taatacgactcactatagggattcggggtcgtggtattcccttgaaccctaacagaggagaagggttatggggaataccaacctggcggcagcgcaaaagatg

SEQ ID NO: 15258 - DNA, 103 bp, Artificial Sequence
  Synthetic Polynucleotide
taatacgactcactatagggctgggattcggggtcgtggtattcccttgaaacagaggagatcaaggatgtaccacgacaacctggcggcagcgcaaaagatg

SEQ ID NO: 15259 - DNA, 103 bp, Artificial Sequence
  Synthetic Polynucleotide
taatacgactcactatagggaggtcctgggattcggggtcgtggtattccaacagaggagaggaataatgcgaccccgaaacctggcggcagcgcaaaagatg

SEQ ID NO: 15260 - DNA, 103 bp, Artificial Sequence
  Synthetic Polynucleotide
taatacgactcactatagggactcgaggtcctgggattcggggtcgtggtaacagaggagaaccacgatgccgaatcccaacctggcggcagcgcaaaagatg

SEQ ID NO: 15261 - DNA, 103 bp, Artificial Sequence
  Synthetic Polynucleotide
taatacgactcactataggggtggaactcgaggtcctgggattcggggtcaacagaggagagaccccatgtcccaggacaacctggcggcagcgcaaaagatg

SEQ ID NO: 15262 - DNA, 103 bp, Artificial Sequence
  Synthetic Polynucleotide
taatacgactcactatagggaggttgtggaactcgaggtcctgggattcgaacagaggagacgaatcatgggacctcgaaacctggcggcagcgcaaaagatg

SEQ ID NO: 15263 - DNA, 103 bp, Artificial Sequence
  Synthetic Polynucleotide
taatacgactcactatagggtctcgaggttgtggaactcgaggtcctgggaacagaggagacccaggatgtcgagttccaacctggcggcagcgcaaaagatg

SEQ ID NO: 15264 - DNA, 103 bp, Artificial Sequence
  Synthetic Polynucleotide
taatacgactcactatagggggtggtctcgaggttgtggaactcgaggtcaacagaggagagacctcatgttccacaacaacctggcggcagcgcaaaagatg

SEQ ID NO: 15265 - DNA, 103 bp, Artificial Sequence
  Synthetic Polynucleotide
taatacgactcactatagggatgtgggtggtctcgaggttgtggaactcgaacagaggagacgagttatgcaacctcgaaacctggcggcagcgcaaaagatg

SEQ ID NO: 15266 - DNA, 103 bp, Artificial Sequence
  Synthetic Polynucleotide
taatacgactcactatagggtgcggatgtgggtggtctcgaggttgtggaaacagaggagatccacaatgtcgagaccaaacctggcggcagcgcaaaagatg

SEQ ID NO: 15267 - DNA, 103 bp, Artificial Sequence
  Synthetic Polynucleotide
taatacgactcactatagggttaacttgcttctaactggcagctttattgaacagaggagacaataaatgtgccagttaaacctggcggcagcgcaaaagatg

SEQ ID NO: 15268 - DNA, 103 bp, Artificial Sequence
  Synthetic Polynucleotide
taatacgactcactataggggaggctgcggatgtgggtggtctcgaggttaacagaggagaaacctcatgaccacccacaacctggcggcagcgcaaaagatg

SEQ ID NO: 15269 - DNA, 103 bp, Artificial Sequence
  Synthetic Polynucleotide
taatacgactcactatagggttatggaggctgcggatgtgggtggtctcgaacagaggagacgagacatgccacatccgaacctggcggcagcgcaaaagatg

SEQ ID NO: 15270 - DNA, 103 bp, Artificial Sequence
  Synthetic Polynucleotide
taatacgactcactatagggatttattatggaggctgcggatgtgggtggaacagaggagaccacccatgtccgcagccaacctggcggcagcgcaaaagatg

SEQ ID NO: 15271 - DNA, 103 bp, Artificial Sequence
  Synthetic Polynucleotide
taatacgactcactataggggtttcatttattatggaggctgcggatgtgaacagaggagacacatcatgagcctccataacctggcggcagcgcaaaagatg

SEQ ID NO: 15272 - DNA, 103 bp, Artificial Sequence
  Synthetic Polynucleotide
taatacgactcactatagggtagaagtttcatttattatggaggctgcggaacagaggagaccgcagatgccataataaaacctggcggcagcgcaaaagatg

SEQ ID NO: 15273 - DNA, 103 bp, Artificial Sequence
  Synthetic Polynucleotide
taatacgactcactataggggcagttagaagtttcatttattatggaggcaacagaggagagcctccatgataaatgaaaacctggcggcagcgcaaaagatg

SEQ ID NO: 15274 - DNA, 103 bp, Artificial Sequence
  Synthetic Polynucleotide
taatacgactcactatagggtctatgcagttagaagtttcatttattatgaacagaggagacataatatgtgaaacttcaacctggcggcagcgcaaaagatg

SEQ ID NO: 15275 - DNA, 103 bp, Artificial Sequence
  Synthetic Polynucleotide
taatacgactcactatagggtgttttctatgcagttagaagtttcatttaaacagaggagataaatgatgcttctaactaacctggcggcagcgcaaaagatg

SEQ ID NO: 15276 - DNA, 103 bp, Artificial Sequence
  Synthetic Polynucleotide
taatacgactcactatagggtgtgttgttttctatgcagttagaagtttcaacagaggagagaaactatgaactgcataaacctggcggcagcgcaaaagatg

SEQ ID NO: 15277 - DNA, 103 bp, Artificial Sequence
  Synthetic Polynucleotide
taatacgactcactataggggcgcatgtgttgttttctatgcagttagaaaacagaggagattctaaatgcatagaaaaaacctggcggcagcgcaaaagatg

SEQ ID NO: 15278 - DNA, 103 bp, Artificial Sequence
  Synthetic Polynucleotide
taatacgactcactatagggcacacttaacttgcttctaactggcagcttaacagaggagaaagctgatggttagaagcaacctggcggcagcgcaaaagatg

SEQ ID NO: 15279 - DNA, 103 bp, Artificial Sequence
  Synthetic Polynucleotide
taatacgactcactatagggatcctgcgcatgtgttgttttctatgcagtaacagaggagaactgcaatgaaaacaacaaacctggcggcagcgcaaaagatg

SEQ ID NO: 15280 - DNA, 103 bp, Artificial Sequence
  Synthetic Polynucleotide
taatacgactcactatagggccctaatcctgcgcatgtgttgttttctataacagaggagaatagaaatgaacacatgcaacctggcggcagcgcaaaagatg

SEQ ID NO: 15281 - DNA, 103 bp, Artificial Sequence
  Synthetic Polynucleotide
taatacgactcactatagggtcataccctaatcctgcgcatgtgttgtttaacagaggagaaaacaaatgatgcgcaggaacctggcggcagcgcaaaagatg

SEQ ID NO: 15282 - DNA, 103 bp, Artificial Sequence
  Synthetic Polynucleotide
taatacgactcactatagggtctcctcataccctaatcctgcgcatgtgtaacagaggagaacacatatgcaggattagaacctggcggcagcgcaaaagatg

SEQ ID NO: 15283 - DNA, 103 bp, Artificial Sequence
  Synthetic Polynucleotide
taatacgactcactatagggcatcatctcctcataccctaatcctgcgcaaacagaggagatgcgcaatgttagggtataacctggcggcagcgcaaaagatg

SEQ ID NO: 15284 - DNA, 103 bp, Artificial Sequence
  Synthetic Polynucleotide
taatacgactcactatagggcattgcatcatctcctcataccctaatcctaacagaggagaaggattatggtatgaggaaacctggcggcagcgcaaaagatg

SEQ ID NO: 15285 - DNA, 103 bp, Artificial Sequence
  Synthetic Polynucleotide
taatacgactcactatagggactcacattgcatcatctcctcataccctaaacagaggagatagggtatgaggagatgaaacctggcggcagcgcaaaagatg

SEQ ID NO: 15286 - DNA, 103 bp, Artificial Sequence
  Synthetic Polynucleotide
taatacgactcactatagggattgaactcacattgcatcatctcctcataaacagaggagatatgagatgatgatgcaaaacctggcggcagcgcaaaagatg

SEQ ID NO: 15287 - DNA, 103 bp, Artificial Sequence
  Synthetic Polynucleotide
taatacgactcactatagggttcatattgaactcacattgcatcatctccaacagaggagaggagatatggcaatgtgaaacctggcggcagcgcaaaagatg

SEQ ID NO: 15288 - DNA, 103 bp, Artificial Sequence
  Synthetic Polynucleotide
taatacgactcactatagggaccccttcatattgaactcacattgcatcaaacagaggagatgatgcatggtgagttcaaacctggcggcagcgcaaaagatg

SEQ ID NO: 15289 - DNA, 103 bp, Artificial Sequence
  Synthetic Polynucleotide
taatacgactcactataggggaacacacacttaacttgcttctaactggcaacagaggagagccagtatgaagcaagttaacctggcggcagcgcaaaagatg

SEQ ID NO: 15290 - DNA, 103 bp, Artificial Sequence
  Synthetic Polynucleotide
taatacgactcactatagggttctaaccccttcatattgaactcacattgaacagaggagacaatgtatgttcaatatgaacctggcggcagcgcaaaagatg

SEQ ID NO: 15291 - DNA, 103 bp, Artificial Sequence
  Synthetic Polynucleotide
taatacgactcactatagggtcttgttctaaccccttcatattgaactcaaacagaggagatgagttatgtatgaagggaacctggcggcagcgcaaaagatg

SEQ ID NO: 15292 - DNA, 103 bp, Artificial Sequence
  Synthetic Polynucleotide
taatacgactcactatagggtcttatcttgttctaaccccttcatattgaaacagaggagatcaataatgaggggttagaacctggcggcagcgcaaaagatg

SEQ ID NO: 15293 - DNA, 103 bp, Artificial Sequence
  Synthetic Polynucleotide
taatacgactcactatagggccttttcttatcttgttctaaccccttcataacagaggagaatgaagatgttagaacaaaacctggcggcagcgcaaaagatg

SEQ ID NO: 15294 - DNA, 103 bp, Artificial Sequence
  Synthetic Polynucleotide
taatacgactcactatagggtacctccttttcttatcttgttctaaccccaacagaggagaggggttatgacaagataaaacctggcggcagcgcaaaagatg

SEQ ID NO: 15295 - DNA, 103 bp, Artificial Sequence
  Synthetic Polynucleotide
taatacgactcactatagggccttatacctccttttcttatcttgttctaaacagaggagatagaacatgataagaaaaaacctggcggcagcgcaaaagatg

SEQ ID NO: 15296 - DNA, 103 bp, Artificial Sequence
  Synthetic Polynucleotide
taatacgactcactatagggtgtgtccttatacctccttttcttatcttgaacagaggagacaagatatgaaaaggaggaacctggcggcagcgcaaaagatg

SEQ ID NO: 15297 - DNA, 103 bp, Artificial Sequence
  Synthetic Polynucleotide
taatacgactcactatagggtaccatgtgtccttatacctccttttcttaaacagaggagataagaaatggaggtataaaacctggcggcagcgcaaaagatg

SEQ ID NO: 15298 - DNA, 103 bp, Artificial Sequence
  Synthetic Polynucleotide
taatacgactcactatagggctaaataccatgtgtccttatacctcctttaacagaggagaaaaggaatgataaggacaaacctggcggcagcgcaaaagatg

SEQ ID NO: 15299 - DNA, 103 bp, Artificial Sequence
  Synthetic Polynucleotide
taatacgactcactatagggatcttctaaataccatgtgtccttatacctaacagaggagaaggtatatggacacatggaacctggcggcagcgcaaaagatg

SEQ ID NO: 15300 - DNA, 103 bp, Artificial Sequence
  Synthetic Polynucleotide
taatacgactcactataggggatgggaacacacacttaacttgcttctaaaacagaggagattagaaatgagttaagtgaacctggcggcagcgcaaaagatg

SEQ ID NO: 15301 - DNA, 103 bp, Artificial Sequence
  Synthetic Polynucleotide
taatacgactcactatagggaccacatcttctaaataccatgtgtccttaaacagaggagataaggaatgatggtatttaacctggcggcagcgcaaaagatg

SEQ ID NO: 15302 - DNA, 103 bp, Artificial Sequence
  Synthetic Polynucleotide
taatacgactcactatagggcacaaaccacatcttctaaataccatgtgtaacagaggagaacacatatgatttagaagaacctggcggcagcgcaaaagatg

SEQ ID NO: 15303 - DNA, 103 bp, Artificial Sequence
  Synthetic Polynucleotide
taatacgactcactataggggttgtcacaaaccacatcttctaaataccaaacagaggagatggtatatggaagatgtgaacctggcggcagcgcaaaagatg

SEQ ID NO: 15304 - DNA, 103 bp, Artificial Sequence
  Synthetic Polynucleotide
taatacgactcactataggggttgtgttgtcacaaaccacatcttctaaaaacagaggagatttagaatgtgtggtttgaacctggcggcagcgcaaaagatg

SEQ ID NO: 15305 - DNA, 103 bp, Artificial Sequence
  Synthetic Polynucleotide
taatacgactcactatagggcagctgttgtgttgtcacaaaccacatcttaacagaggagaaagatgatgtttgtgacaaacctggcggcagcgcaaaagatg

SEQ ID NO: 15306 - DNA, 103 bp, Artificial Sequence
  Synthetic Polynucleotide
taatacgactcactatagggtgtgccagctgttgtgttgtcacaaaccacaacagaggagagtggttatggacaacacaaacctggcggcagcgcaaaagatg

SEQ ID NO: 15307 - DNA, 103 bp, Artificial Sequence
  Synthetic Polynucleotide
taatacgactcactatagggtaacatgtgccagctgttgtgttgtcacaaaacagaggagattgtgaatgcacaacagcaacctggcggcagcgcaaaagatg

SEQ ID NO: 15308 - DNA, 103 bp, Artificial Sequence
  Synthetic Polynucleotide
taatacgactcactatagggtcatgtaacatgtgccagctgttgtgttgtaacagaggagaacaacaatgcagctggcaaacctggcggcagcgcaaaagatg

SEQ ID NO: 15309 - DNA, 103 bp, Artificial Sequence
  Synthetic Polynucleotide
taatacgactcactatagggatgtctcatgtaacatgtgccagctgttgtaacagaggagaacaacaatgggcacatgtaacctggcggcagcgcaaaagatg

SEQ ID NO: 15310 - DNA, 103 bp, Artificial Sequence
  Synthetic Polynucleotide
taatacgactcactatagggttgcaatgtctcatgtaacatgtgccagctaacagaggagaagctggatgatgttacataacctggcggcagcgcaaaagatg

SEQ ID NO: 15311 - DNA, 103 bp, Artificial Sequence
  Synthetic Polynucleotide
taatacgactcactatagggggagagatgggaacacacacttaacttgctaacagaggagaagcaagatgagtgtgtgtaacctggcggcagcgcaaaagatg

SEQ ID NO: 15312 - DNA, 103 bp, Artificial Sequence
  Synthetic Polynucleotide
taatacgactcactatagggatgtgttgcaatgtctcatgtaacatgtgcaacagaggagagcacatatgacatgagacaacctggcggcagcgcaaaagatg

SEQ ID NO: 15313 - DNA, 103 bp, Artificial Sequence
  Synthetic Polynucleotide
taatacgactcactataggggattgatgtgttgcaatgtctcatgtaacaaacagaggagatgttacatgagacattgcaacctggcggcagcgcaaaagatg

SEQ ID NO: 15314 - DNA, 103 bp, Artificial Sequence
  Synthetic Polynucleotide
taatacgactcactatagggttgatgattgatgtgttgcaatgtctcatgaacagaggagacatgagatgttgcaacacaacctggcggcagcgcaaaagatg

SEQ ID NO: 15315 - DNA, 103 bp, Artificial Sequence
  Synthetic Polynucleotide
taatacgactcactatagggactctttgatgattgatgtgttgcaatgtcaacagaggagagacattatgacacatcaaaacctggcggcagcgcaaaagatg

SEQ ID NO: 15316 - DNA, 103 bp, Artificial Sequence
  Synthetic Polynucleotide
taatacgactcactatagggacatgactctttgatgattgatgtgttgcaaacagaggagatgcaacatgtcaatcatcaacctggcggcagcgcaaaagatg

SEQ ID NO: 15317 - DNA, 103 bp, Artificial Sequence
  Synthetic Polynucleotide
taatacgactcactatagggttatcacatgactctttgatgattgatgtgaacagaggagacacatcatgcatcaaagaaacctggcggcagcgcaaaagatg

SEQ ID NO: 15318 - DNA, 103 bp, Artificial Sequence
  Synthetic Polynucleotide
taatacgactcactatagggagtgcttatcacatgactctttgatgattgaacagaggagacaatcaatgaagagtcataacctggcggcagcgcaaaagatg

SEQ ID NO: 15319 - DNA, 103 bp, Artificial Sequence
  Synthetic Polynucleotide
taatacgactcactatagggccaatagtgcttatcacatgactctttgataacagaggagaatcaaaatgtcatgtgataacctggcggcagcgcaaaagatg

SEQ ID NO: 15320 - DNA, 103 bp, Artificial Sequence
  Synthetic Polynucleotide
taatacgactcactataggggcatcccaatagtgcttatcacatgactctaacagaggagaagagtcatgtgataagcaaacctggcggcagcgcaaaagatg

SEQ ID NO: 15321 - DNA, 103 bp, Artificial Sequence
  Synthetic Polynucleotide
taatacgactcactatagggtcatagcatcccaatagtgcttatcacatgaacagaggagacatgtgatgagcactattaacctggcggcagcgcaaaagatg

SEQ ID NO: 15322 - DNA, 103 bp, Artificial Sequence
  Synthetic Polynucleotide
taatacgactcactataggggactaggagagatgggaacacacacttaacaacagaggagagttaagatggtgttcccaaacctggcggcagcgcaaaagatg

SEQ ID NO: 15323 - DNA, 103 bp, Artificial Sequence
  Synthetic Polynucleotide
taatacgactcactatagggaaacctcatagcatcccaatagtgcttatcaacagaggagagataagatgtattgggataacctggcggcagcgcaaaagatg

SEQ ID NO: 15324 - DNA, 103 bp, Artificial Sequence
  Synthetic Polynucleotide
taatacgactcactatagggtatctaaacctcatagcatcccaatagtgcaacagaggagagcactaatgggatgctataacctggcggcagcgcaaaagatg

SEQ ID NO: 15325 - DNA, 103 bp, Artificial Sequence
  Synthetic Polynucleotide
taatacgactcactatagggcacagtatctaaacctcatagcatcccaataacagaggagaattgggatgctatgaggtaacctggcggcagcgcaaaagatg

SEQ ID NO: 15326 - DNA, 103 bp, Artificial Sequence
  Synthetic Polynucleotide
taatacgactcactatagggtggtgcacagtatctaaacctcatagcatcaacagaggagagatgctatgaggtttagaaacctggcggcagcgcaaaagatg

SEQ ID NO: 15327 - DNA, 103 bp, Artificial Sequence
  Synthetic Polynucleotide
taatacgactcactatagggcccggtggtgcacagtatctaaacctcataaacagaggagatatgagatgtagatactgaacctggcggcagcgcaaaagatg

SEQ ID NO: 15328 - DNA, 103 bp, Artificial Sequence
  Synthetic Polynucleotide
taatacgactcactatagggcaaagcccggtggtgcacagtatctaaaccaacagaggagaggtttaatgactgtgcacaacctggcggcagcgcaaaagatg

SEQ ID NO: 15329 - DNA, 103 bp, Artificial Sequence
  Synthetic Polynucleotide
taatacgactcactatagggtagggcaaagcccggtggtgcacagtatctaacagaggagaagatacatggcaccaccgaacctggcggcagcgcaaaagatg

SEQ ID NO: 15330 - DNA, 103 bp, Artificial Sequence
  Synthetic Polynucleotide
taatacgactcactatagggcttaatagggcaaagcccggtggtgcacagaacagaggagactgtgcatgaccgggcttaacctggcggcagcgcaaaagatg

SEQ ID NO: 15331 - DNA, 103 bp, Artificial Sequence
  Synthetic Polynucleotide
taatacgactcactatagggtacatcttaatagggcaaagcccggtggtgaacagaggagacaccacatggctttgcccaacctggcggcagcgcaaaagatg

SEQ ID NO: 15332 - DNA, 103 bp, Artificial Sequence
  Synthetic Polynucleotide
taatacgactcactatagggatcattacatcttaatagggcaaagcccggaacagaggagaccgggcatggccctattaaacctggcggcagcgcaaaagatg

SEQ ID NO: 15333 - DNA, 103 bp, Artificial Sequence
  Synthetic Polynucleotide
taatacgactcactataggggcggcgactaggagagatgggaacacacacaacagaggagagtgtgtatgcccatctctaacctggcggcagcgcaaaagatg

SEQ ID NO: 15334 - DNA, 103 bp, Artificial Sequence
  Synthetic Polynucleotide
taatacgactcactatagggttggtatcattacatcttaatagggcaaagaacagaggagactttgcatgattaagatgaacctggcggcagcgcaaaagatg

SEQ ID NO: 15335 - DNA, 103 bp, Artificial Sequence
  Synthetic Polynucleotide
taatacgactcactatagggaatagttggtatcattacatcttaatagggaacagaggagaccctatatggatgtaatgaacctggcggcagcgcaaaagatg

SEQ ID NO: 15336 - DNA, 103 bp, Artificial Sequence
  Synthetic Polynucleotide
taatacgactcactataggggcctgaatagttggtatcattacatcttaaaacagaggagattaagaatgaatgataccaacctggcggcagcgcaaaagatg

SEQ ID NO: 15337 - DNA, 103 bp, Artificial Sequence
  Synthetic Polynucleotide
taatacgactcactatagggtcaaagcctgaatagttggtatcattacataacagaggagaatgtaaatgtaccaactaaacctggcggcagcgcaaaagatg

SEQ ID NO: 15338 - DNA, 103 bp, Artificial Sequence
  Synthetic Polynucleotide
taatacgactcactatagggtaggttcaaagcctgaatagttggtatcataacagaggagaatgataatgactattcagaacctggcggcagcgcaaaagatg

SEQ ID NO: 15339 - DNA, 103 bp, Artificial Sequence
  Synthetic Polynucleotide
taatacgactcactataggggcacttaggttcaaagcctgaatagttggtaacagaggagaaccaacatgtcaggctttaacctggcggcagcgcaaaagatg

SEQ ID NO: 15340 - DNA, 103 bp, Artificial Sequence
  Synthetic Polynucleotide
taatacgactcactatagggttagtgcacttaggttcaaagcctgaatagaacagaggagactattcatgctttgaaccaacctggcggcagcgcaaaagatg

SEQ ID NO: 15341 - DNA, 103 bp, Artificial Sequence
  Synthetic Polynucleotide
taatacgactcactatagggctactttagtgcacttaggttcaaagcctgaacagaggagacaggctatgaacctaagtaacctggcggcagcgcaaaagatg

SEQ ID NO: 15342 - DNA, 103 bp, Artificial Sequence
  Synthetic Polynucleotide
taatacgactcactatagggagctactactttagtgcacttaggttcaaaaacagaggagatttgaaatgaagtgcactaacctggcggcagcgcaaaagatg

SEQ ID NO: 15343 - DNA, 103 bp, Artificial Sequence
  Synthetic Polynucleotide
taatacgactcactataggggaagcagctactactttagtgcacttaggtaacagaggagaacctaaatgcactaaagtaacctggcggcagcgcaaaagatg

SEQ ID NO: 15344 - DNA, 103 bp, Artificial Sequence
  Synthetic Polynucleotide
taatacgactcactatagggaccaggcggcgactaggagagatgggaacaaacagaggagatgttccatgctctcctagaacctggcggcagcgcaaaagatg

SEQ ID NO: 15345 - DNA, 103 bp, Artificial Sequence
  Synthetic Polynucleotide
taatacgactcactatagggtgcatgaagcagctactactttagtgcactaacagaggagaagtgcaatgaagtagtagaacctggcggcagcgcaaaagatg

SEQ ID NO: 15346 - DNA, 103 bp, Artificial Sequence
  Synthetic Polynucleotide
taatacgactcactatagggccttgtgcatgaagcagctactactttagtaacagaggagaactaaaatggtagctgctaacctggcggcagcgcaaaagatg

SEQ ID NO: 15347 - DNA, 103 bp, Artificial Sequence
  Synthetic Polynucleotide
taatacgactcactatagggatcatccttgtgcatgaagcagctactactaacagaggagaagtagtatgtgcttcatgaacctggcggcagcgcaaaagatg

SEQ ID NO: 15348 - DNA, 103 bp, Artificial Sequence
  Synthetic Polynucleotide
taatacgactcactatagggtttccatcatccttgtgcatgaagcagctaaacagaggagatagctgatgcatgcacaaaacctggcggcagcgcaaaagatg

SEQ ID NO: 15349 - DNA, 103 bp, Artificial Sequence
  Synthetic Polynucleotide
taatacgactcactatagggttgcgtttccatcatccttgtgcatgaagcaacagaggagagcttcaatgacaaggatgaacctggcggcagcgcaaaagatg

SEQ ID NO: 15350 - DNA, 103 bp, Artificial Sequence
  Synthetic Polynucleotide
taatacgactcactataggggaagtttgcgtttccatcatccttgtgcataacagaggagaatgcacatggatgatggaaacctggcggcagcgcaaaagatg

SEQ ID NO: 15351 - DNA, 103 bp, Artificial Sequence
  Synthetic Polynucleotide
taatacgactcactatagggaagtagaagtttgcgtttccatcatccttgaacagaggagacaaggaatgtggaaacgcaacctggcggcagcgcaaaagatg

SEQ ID NO: 15352 - DNA, 103 bp, Artificial Sequence
  Synthetic Polynucleotide
taatacgactcactatagggaaaccaagtagaagtttgcgtttccatcataacagaggagaatgatgatgacgcaaactaacctggcggcagcgcaaaagatg

SEQ ID NO: 15353 - DNA, 103 bp, Artificial Sequence
  Synthetic Polynucleotide
taatacgactcactatagggaagccaaaccaagtagaagtttgcgtttccaacagaggagaggaaacatgaacttctacaacctggcggcagcgcaaaagatg

SEQ ID NO: 15354 - DNA, 103 bp, Artificial Sequence
  Synthetic Polynucleotide
taatacgactcactatagggcattaaagccaaaccaagtagaagtttgcgaacagaggagacgcaaaatgctacttggtaacctggcggcagcgcaaaagatg

SEQ ID NO: 15355 - DNA, 103 bp, Artificial Sequence
  Synthetic Polynucleotide
taatacgactcactatagggccatgagtataattctgccaatctggtattaacagaggagaaataccatgttggcagaaaacctggcggcagcgcaaaagatg

SEQ ID NO: 15356 - DNA, 103 bp, Artificial Sequence
  Synthetic Polynucleotide
taatacgactcactataggggaatgaccaggcggcgactaggagagatggaacagaggagaccatctatgctagtcgccaacctggcggcagcgcaaaagatg

SEQ ID NO: 15357 - DNA, 103 bp, Artificial Sequence
  Synthetic Polynucleotide
taatacgactcactatagggagtgccattaaagccaaaccaagtagaagtaacagaggagaacttctatgtggtttggcaacctggcggcagcgcaaaagatg

SEQ ID NO: 15358 - DNA, 103 bp, Artificial Sequence
  Synthetic Polynucleotide
taatacgactcactataggggctctagtgccattaaagccaaaccaagtaaacagaggagatacttgatgtggctttaaaacctggcggcagcgcaaaagatg

SEQ ID NO: 15359 - DNA, 103 bp, Artificial Sequence
  Synthetic Polynucleotide
taatacgactcactatagggtttctgctctagtgccattaaagccaaaccaacagaggagaggtttgatgttaatggcaaacctggcggcagcgcaaaagatg

SEQ ID NO: 15360 - DNA, 103 bp, Artificial Sequence
  Synthetic Polynucleotide
taatacgactcactatagggtctattttctgctctagtgccattaaagccaacagaggagaggctttatgggcactagaaacctggcggcagcgcaaaagatg

SEQ ID NO: 15361 - DNA, 103 bp, Artificial Sequence
  Synthetic Polynucleotide
taatacgactcactatagggtatgttctattttctgctctagtgccattaaacagaggagataatggatgtagagcagaaacctggcggcagcgcaaaagatg

SEQ ID NO: 15362 - DNA, 103 bp, Artificial Sequence
  Synthetic Polynucleotide
taatacgactcactatagggagatatatgttctattttctgctctagtgcaacagaggagagcactaatgcagaaaataaacctggcggcagcgcaaaagatg

SEQ ID NO: 15363 - DNA, 103 bp, Artificial Sequence
  Synthetic Polynucleotide
taatacgactcactatagggccaatagatatatgttctattttctgctctaacagaggagaagagcaatgaatagaacaaacctggcggcagcgcaaaagatg

SEQ ID NO: 15364 - DNA, 103 bp, Artificial Sequence
  Synthetic Polynucleotide
taatacgactcactatagggccatgccaatagatatatgttctattttctaacagaggagaagaaaaatgaacatatataacctggcggcagcgcaaaagatg

SEQ ID NO: 15365 - DNA, 103 bp, Artificial Sequence
  Synthetic Polynucleotide
taatacgactcactatagggctctgccatgccaatagatatatgttctataacagaggagaatagaaatgatatctattaacctggcggcagcgcaaaagatg

SEQ ID NO: 15366 - DNA, 103 bp, Artificial Sequence
  Synthetic Polynucleotide
taatacgactcactatagggattatctctgccatgccaatagatatatgtaacagaggagaacatatatgtattggcataacctggcggcagcgcaaaagatg

SEQ ID NO: 15367 - DNA, 103 bp, Artificial Sequence
  Synthetic Polynucleotide
taatacgactcactatagggacaccgaatgaccaggcggcgactaggagaaacagaggagatctcctatgcgccgcctgaacctggcggcagcgcaaaagatg

SEQ ID NO: 15368 - DNA, 103 bp, Artificial Sequence
  Synthetic Polynucleotide
taatacgactcactataggggtcctattatctctgccatgccaatagataaacagaggagatatctaatggcatggcagaacctggcggcagcgcaaaagatg

SEQ ID NO: 15369 - DNA, 103 bp, Artificial Sequence
  Synthetic Polynucleotide
taatacgactcactatagggtgatagtcctattatctctgccatgccaataacagaggagaattggcatggcagagataaacctggcggcagcgcaaaagatg

SEQ ID NO: 15370 - DNA, 103 bp, Artificial Sequence
  Synthetic Polynucleotide
taatacgactcactataggggctaatgatagtcctattatctctgccatgaacagaggagacatggcatggataataggaacctggcggcagcgcaaaagatg

SEQ ID NO: 15371 - DNA, 103 bp, Artificial Sequence
  Synthetic Polynucleotide
taatacgactcactatagggtttaagctaatgatagtcctattatctctgaacagaggagacagagaatgtaggactataacctggcggcagcgcaaaagatg

SEQ ID NO: 15372 - DNA, 103 bp, Artificial Sequence
  Synthetic Polynucleotide
taatacgactcactatagggacttgtttaagctaatgatagtcctattataacagaggagaataataatgctatcattaaacctggcggcagcgcaaaagatg

SEQ ID NO: 15373 - DNA, 103 bp, Artificial Sequence
  Synthetic Polynucleotide
taatacgactcactatagggataatacttgtttaagctaatgatagtcctaacagaggagaaggactatgattagcttaaacctggcggcagcgcaaaagatg

SEQ ID NO: 15374 - DNA, 103 bp, Artificial Sequence
  Synthetic Polynucleotide
taatacgactcactatagggagattataatacttgtttaagctaatgataaacagaggagatatcatatgcttaaacaaaacctggcggcagcgcaaaagatg

SEQ ID NO: 15375 - DNA, 103 bp, Artificial Sequence
  Synthetic Polynucleotide
taatacgactcactatagggttgtgagattataatacttgtttaagctaaaacagaggagattagctatgacaagtattaacctggcggcagcgcaaaagatg

SEQ ID NO: 15376 - DNA, 103 bp, Artificial Sequence
  Synthetic Polynucleotide
taatacgactcactatagggacgcattgtgagattataatacttgtttaaaacagaggagattaaacatgtattataataacctggcggcagcgcaaaagatg

SEQ ID NO: 15377 - DNA, 103 bp, Artificial Sequence
  Synthetic Polynucleotide
taatacgactcactatagggttacaacgcattgtgagattataatacttgaacagaggagacaagtaatgtaatctcacaacctggcggcagcgcaaaagatg

SEQ ID NO: 15378 - DNA, 103 bp, Artificial Sequence
  Synthetic Polynucleotide
taatacgactcactataggggatgaacaccgaatgaccaggcggcgactaaacagaggagatagtcgatgcctggtcataacctggcggcagcgcaaaagatg

SEQ ID NO: 15379 - DNA, 103 bp, Artificial Sequence
  Synthetic Polynucleotide
taatacgactcactataggggtctcttacaacgcattgtgagattataataacagaggagaattataatgtcacaatgcaacctggcggcagcgcaaaagatg

SEQ ID NO: 15380 - DNA, 103 bp, Artificial Sequence
  Synthetic Polynucleotide
taatacgactcactatagggtcctggtctcttacaacgcattgtgagattaacagaggagaaatctcatgatgcgttgtaacctggcggcagcgcaaaagatg

SEQ ID NO: 15381 - DNA, 103 bp, Artificial Sequence
  Synthetic Polynucleotide
taatacgactcactatagggttatttcctggtctcttacaacgcattgtgaacagaggagacacaatatgttgtaagagaacctggcggcagcgcaaaagatg

SEQ ID NO: 15382 - DNA, 103 bp, Artificial Sequence
  Synthetic Polynucleotide
taatacgactcactatagggctgtcttatttcctggtctcttacaacgcaaacagaggagatgcgttatgagagaccagaacctggcggcagcgcaaaagatg

SEQ ID NO: 15383 - DNA, 103 bp, Artificial Sequence
  Synthetic Polynucleotide
taatacgactcactatagggtaaaactgtcttatttcctggtctcttacaaacagaggagatgtaagatgccaggaaataacctggcggcagcgcaaaagatg

SEQ ID NO: 15384 - DNA, 103 bp, Artificial Sequence
  Synthetic Polynucleotide
taatacgactcactatagggattggtaaaactgtcttatttcctggtctcaacagaggagagagaccatgaaataagacaacctggcggcagcgcaaaagatg

SEQ ID NO: 15385 - DNA, 103 bp, Artificial Sequence
  Synthetic Polynucleotide
taatacgactcactataggggtgttattggtaaaactgtcttatttcctgaacagaggagacaggaaatgagacagtttaacctggcggcagcgcaaaagatg

SEQ ID NO: 15386 - DNA, 103 bp, Artificial Sequence
  Synthetic Polynucleotide
taatacgactcactatagggcataagtgttattggtaaaactgtcttattaacagaggagaaataagatggttttaccaaacctggcggcagcgcaaaagatg

SEQ ID NO: 15387 - DNA, 103 bp, Artificial Sequence
  Synthetic Polynucleotide
taatacgactcactatagggcctgacataagtgttattggtaaaactgtcaacagaggagagacagtatgaccaataacaacctggcggcagcgcaaaagatg

SEQ ID NO: 15388 - DNA, 103 bp, Artificial Sequence
  Synthetic Polynucleotide
taatacgactcactatagggctaatcctgacataagtgttattggtaaaaaacagaggagattttacatgtaacacttaaacctggcggcagcgcaaaagatg

SEQ ID NO: 15389 - DNA, 103 bp, Artificial Sequence
  Synthetic Polynucleotide
taatacgactcactatagggactcagatgaacaccgaatgaccaggcggcaacagaggagagccgccatgtcattcggtaacctggcggcagcgcaaaagatg

SEQ ID NO: 15390 - DNA, 103 bp, Artificial Sequence
  Synthetic Polynucleotide
taatacgactcactatagggaaacactaatcctgacataagtgttattggaacagaggagaccaataatgcttatgtcaaacctggcggcagcgcaaaagatg

SEQ ID NO: 15391 - DNA, 103 bp, Artificial Sequence
  Synthetic Polynucleotide
taatacgactcactataggggagtgaaacactaatcctgacataagtgttaacagaggagaaacactatggtcaggattaacctggcggcagcgcaaaagatg

SEQ ID NO: 15392 - DNA, 103 bp, Artificial Sequence
  Synthetic Polynucleotide
taatacgactcactataggggctgagagtgaaacactaatcctgacataaaacagaggagattatgtatggattagtgtaacctggcggcagcgcaaaagatg

SEQ ID NO: 15393 - DNA, 103 bp, Artificial Sequence
  Synthetic Polynucleotide
taatacgactcactataggggattggctgagagtgaaacactaatcctgaaacagaggagatcaggaatggtgtttcacaacctggcggcagcgcaaaagatg

SEQ ID NO: 15394 - DNA, 103 bp, Artificial Sequence
  Synthetic Polynucleotide
taatacgactcactataggggtgttgattggctgagagtgaaacactaataacagaggagaattagtatgtcactctcaaacctggcggcagcgcaaaagatg

SEQ ID NO: 15395 - DNA, 103 bp, Artificial Sequence
  Synthetic Polynucleotide
taatacgactcactataggggccttgtgttgattggctgagagtgaaacaaacagaggagatgtttcatgctcagccaaaacctggcggcagcgcaaaagatg

SEQ ID NO: 15396 - DNA, 103 bp, Artificial Sequence
  Synthetic Polynucleotide
taatacgactcactatagggcctaggccttgtgttgattggctgagagtgaacagaggagacactctatgccaatcaacaacctggcggcagcgcaaaagatg

SEQ ID NO: 15397 - DNA, 103 bp, Artificial Sequence
  Synthetic Polynucleotide
taatacgactcactataggggcctgcctaggccttgtgttgattggctgaaacagaggagatcagccatgcaacacaagaacctggcggcagcgcaaaagatg

SEQ ID NO: 15398 - DNA, 103 bp, Artificial Sequence
  Synthetic Polynucleotide
taatacgactcactatagggaccatgcctgcctaggccttgtgttgattgaacagaggagacaatcaatgcaaggcctaaacctggcggcagcgcaaaagatg

SEQ ID NO: 15399 - DNA, 103 bp, Artificial Sequence
  Synthetic Polynucleotide
taatacgactcactatagggccggcaccatgcctgcctaggccttgtgttaacagaggagaaacacaatgcctaggcagaacctggcggcagcgcaaaagatg

SEQ ID NO: 15400 - DNA, 103 bp, Artificial Sequence
  Synthetic Polynucleotide
taatacgactcactatagggttgttactcagatgaacaccgaatgaccagaacagaggagactggtcatgcggtgttcaaacctggcggcagcgcaaaagatg

SEQ ID NO: 15401 - DNA, 103 bp, Artificial Sequence
  Synthetic Polynucleotide
taatacgactcactatagggccaaaccggcaccatgcctgcctaggccttaacagaggagaaaggccatggcaggcatgaacctggcggcagcgcaaaagatg

SEQ ID NO: 15402 - DNA, 103 bp, Artificial Sequence
  Synthetic Polynucleotide
taatacgactcactatagggtgcctccaaaccggcaccatgcctgcctagaacagaggagactaggcatgcatggtgccaacctggcggcagcgcaaaagatg

SEQ ID NO: 15403 - DNA, 103 bp, Artificial Sequence
  Synthetic Polynucleotide
taatacgactcactatagggccatctgcctccaaaccggcaccatgcctgaacagaggagacaggcaatgtgccggtttaacctggcggcagcgcaaaagatg

SEQ ID NO: 15404 - DNA, 103 bp, Artificial Sequence
  Synthetic Polynucleotide
taatacgactcactatagggtccctccatctgcctccaaaccggcaccataacagaggagaatggtgatggtttggaggaacctggcggcagcgcaaaagatg

SEQ ID NO: 15405 - DNA, 103 bp, Artificial Sequence
  Synthetic Polynucleotide
taatacgactcactatagggtggcttccctccatctgcctccaaaccggcaacagaggagagccggtatggaggcagataacctggcggcagcgcaaaagatg

SEQ ID NO: 15406 - DNA, 103 bp, Artificial Sequence
  Synthetic Polynucleotide
taatacgactcactatagggctgcatggcttccctccatctgcctccaaaaacagaggagatttggaatgagatggaggaacctggcggcagcgcaaaagatg

SEQ ID NO: 15407 - DNA, 103 bp, Artificial Sequence
  Synthetic Polynucleotide
taatacgactcactatagggacctcctgcatggcttccctccatctgcctaacagaggagaaggcagatggagggaagcaacctggcggcagcgcaaaagatg

SEQ ID NO: 15408 - DNA, 103 bp, Artificial Sequence
  Synthetic Polynucleotide
taatacgactcactataggggcttcacctcctgcatggcttccctccatcaacagaggagagatggaatgaagccatgcaacctggcggcagcgcaaaagatg

SEQ ID NO: 15409 - DNA, 103 bp, Artificial Sequence
  Synthetic Polynucleotide
taatacgactcactatagggggtttgcttcacctcctgcatggcttccctaacagaggagaagggaaatgatgcaggagaacctggcggcagcgcaaaagatg

SEQ ID NO: 15410 - DNA, 103 bp, Artificial Sequence
  Synthetic Polynucleotide
taatacgactcactatagggacaagggtttgcttcacctcctgcatggctaacagaggagaagccatatgggaggtgaaaacctggcggcagcgcaaaagatg

SEQ ID NO: 15411 - DNA, 103 bp, Artificial Sequence
  Synthetic Polynucleotide
taatacgactcactataggggggtcttgttactcagatgaacaccgaatgaacagaggagacattcgatgttcatctgaaacctggcggcagcgcaaaagatg

SEQ ID NO: 15412 - DNA, 103 bp, Artificial Sequence
  Synthetic Polynucleotide
taatacgactcactataggggttgtacaagggtttgcttcacctcctgcaaacagaggagatgcaggatgtgaagcaaaaacctggcggcagcgcaaaagatg

SEQ ID NO: 15413 - DNA, 103 bp, Artificial Sequence
  Synthetic Polynucleotide
taatacgactcactataggggggatgttgtacaagggtttgcttcacctcaacagaggagagaggtgatgcaaacccttaacctggcggcagcgcaaaagatg

SEQ ID NO: 15414 - DNA, 103 bp, Artificial Sequence
  Synthetic Polynucleotide
taatacgactcactatagggtatctgggatgttgtacaagggtttgcttcaacagaggagagaagcaatgccttgtacaaacctggcggcagcgcaaaagatg

SEQ ID NO: 15415 - DNA, 103 bp, Artificial Sequence
  Synthetic Polynucleotide
taatacgactcactatagggctttgtatctgggatgttgtacaagggtttaacagaggagaaaacccatgtacaacatcaacctggcggcagcgcaaaagatg

SEQ ID NO: 15416 - DNA, 103 bp, Artificial Sequence
  Synthetic Polynucleotide
taatacgactcactataggggattcctttgtatctgggatgttgtacaagaacagaggagacttgtaatgcatcccagaaacctggcggcagcgcaaaagatg

SEQ ID NO: 15417 - DNA, 103 bp, Artificial Sequence
  Synthetic Polynucleotide
taatacgactcactatagggtcattgattcctttgtatctgggatgttgtaacagaggagaacaacaatgcagatacaaaacctggcggcagcgcaaaagatg

SEQ ID NO: 15418 - DNA, 103 bp, Artificial Sequence
  Synthetic Polynucleotide
taatacgactcactatagggctgtatcattgattcctttgtatctgggataacagaggagaatcccaatgacaaaggaaaacctggcggcagcgcaaaagatg

SEQ ID NO: 15419 - DNA, 103 bp, Artificial Sequence
  Synthetic Polynucleotide
taatacgactcactatagggtttccctgtatcattgattcctttgtatctaacagaggagaagatacatgggaatcaataacctggcggcagcgcaaaagatg

SEQ ID NO: 15420 - DNA, 103 bp, Artificial Sequence
  Synthetic Polynucleotide
taatacgactcactatagggttaattttccctgtatcattgattcctttgaacagaggagacaaaggatgcaatgatacaacctggcggcagcgcaaaagatg

SEQ ID NO: 15421 - DNA, 103 bp, Artificial Sequence
  Synthetic Polynucleotide
taatacgactcactatagggtaaagttaattttccctgtatcattgattcaacagaggagagaatcaatgatacagggaaacctggcggcagcgcaaaagatg

SEQ ID NO: 15422 - DNA, 103 bp, Artificial Sequence
  Synthetic Polynucleotide
taatacgactcactataggggaccagggtcttgttactcagatgaacaccaacagaggagaggtgttatgctgagtaacaacctggcggcagcgcaaaagatg

SEQ ID NO: 15423 - DNA, 103 bp, Artificial Sequence
  Synthetic Polynucleotide
taatacgactcactatagggtttcgtaaagttaattttccctgtatcattaacagaggagaaatgatatggggaaaattaacctggcggcagcgcaaaagatg

SEQ ID NO: 15424 - DNA, 103 bp, Artificial Sequence
  Synthetic Polynucleotide
taatacgactcactatagggcccggtttcgtaaagttaattttccctgtaaacagaggagatacaggatgaattaacttaacctggcggcagcgcaaaagatg

SEQ ID NO: 15425 - DNA, 103 bp, Artificial Sequence
  Synthetic Polynucleotide
taatacgactcactatagggctgctcccggtttcgtaaagttaattttccaacagaggagaggaaaaatgactttacgaaacctggcggcagcgcaaaagatg

SEQ ID NO: 15426 - DNA, 103 bp, Artificial Sequence
  Synthetic Polynucleotide
taatacgactcactatagggtgagcctgctcccggtttcgtaaagttaataacagaggagaattaacatgacgaaaccgaacctggcggcagcgcaaaagatg

SEQ ID NO: 15427 - DNA, 103 bp, Artificial Sequence
  Synthetic Polynucleotide
taatacgactcactataggggggtctgagcctgctcccggtttcgtaaagaacagaggagactttacatgaccgggagcaacctggcggcagcgcaaaagatg

SEQ ID NO: 15428 - DNA, 103 bp, Artificial Sequence
  Synthetic Polynucleotide
taatacgactcactatagggcttccgggtctgagcctgctcccggtttcgaacagaggagacgaaacatggagcaggctaacctggcggcagcgcaaaagatg

SEQ ID NO: 15429 - DNA, 103 bp, Artificial Sequence
  Synthetic Polynucleotide
taatacgactcactatagggtgccacttccgggtctgagcctgctcccggaacagaggagaccgggaatgggctcagacaacctggcggcagcgcaaaagatg

SEQ ID NO: 15430 - DNA, 103 bp, Artificial Sequence
  Synthetic Polynucleotide
taatacgactcactatagggataaatgccacttccgggtctgagcctgctaacagaggagaagcaggatgagacccggaaacctggcggcagcgcaaaagatg

SEQ ID NO: 15431 - DNA, 103 bp, Artificial Sequence
  Synthetic Polynucleotide
taatacgactcactatagggtccacataaatgccacttccgggtctgagcaacagaggagagctcagatgcggaagtggaacctggcggcagcgcaaaagatg

SEQ ID NO: 15432 - DNA, 103 bp, Artificial Sequence
  Synthetic Polynucleotide
taatacgactcactataggggttagtccacataaatgccacttccgggtcaacagaggagagacccgatggtggcatttaacctggcggcagcgcaaaagatg

SEQ ID NO: 15433 - DNA, 103 bp, Artificial Sequence
  Synthetic Polynucleotide
taatacgactcactatagggtaacagaccagggtcttgttactcagatgaaacagaggagatcatctatgtaacaagacaacctggcggcagcgcaaaagatg

SEQ ID NO: 15434 - DNA, 103 bp, Artificial Sequence
  Synthetic Polynucleotide
taatacgactcactatagggctgcagttagtccacataaatgccacttccaacagaggagaggaagtatgatttatgtgaacctggcggcagcgcaaaagatg

SEQ ID NO: 15435 - DNA, 103 bp, Artificial Sequence
  Synthetic Polynucleotide
taatacgactcactatagggctcctctgcagttagtccacataaatgccaaacagaggagatggcatatgtgtggactaaacctggcggcagcgcaaaagatg

SEQ ID NO: 15436 - DNA, 103 bp, Artificial Sequence
  Synthetic Polynucleotide
taatacgactcactatagggaaattctcctctgcagttagtccacataaaaacagaggagatttatgatgactaactgcaacctggcggcagcgcaaaagatg

SEQ ID NO: 15437 - DNA, 103 bp, Artificial Sequence
  Synthetic Polynucleotide
taatacgactcactatagggtagagaaattctcctctgcagttagtccacaacagaggagagtggacatgctgcagaggaacctggcggcagcgcaaaagatg

SEQ ID NO: 15438 - DNA, 103 bp, Artificial Sequence
  Synthetic Polynucleotide
taatacgactcactatagggtacagtagagaaattctcctctgcagttagaacagaggagactaactatggaggagaataacctggcggcagcgcaaaagatg

SEQ ID NO: 15439 - DNA, 103 bp, Artificial Sequence
  Synthetic Polynucleotide
taatacgactcactatagggcatgttacagtagagaaattctcctctgcaaacagaggagatgcagaatggaatttctcaacctggcggcagcgcaaaagatg

SEQ ID NO: 15440 - DNA, 103 bp, Artificial Sequence
  Synthetic Polynucleotide
taatacgactcactatagggcaagtcatgttacagtagagaaattctcctaacagaggagaaggagaatgtctctactgaacctggcggcagcgcaaaagatg

SEQ ID NO: 15441 - DNA, 103 bp, Artificial Sequence
  Synthetic Polynucleotide
taatacgactcactatagggggaaccaagtcatgttacagtagagaaattaacagaggagaaatttcatgactgtaacaaacctggcggcagcgcaaaagatg

SEQ ID NO: 15442 - DNA, 103 bp, Artificial Sequence
  Synthetic Polynucleotide
taatacgactcactatagggattgaggaaccaagtcatgttacagtagagaacagaggagactctacatgaacatgactaacctggcggcagcgcaaaagatg

SEQ ID NO: 15443 - DNA, 103 bp, Artificial Sequence
  Synthetic Polynucleotide
taatacgactcactatagggacccaattgaggaaccaagtcatgttacagaacagaggagactgtaaatggacttggttaacctggcggcagcgcaaaagatg

SEQ ID NO: 15444 - DNA, 103 bp, Artificial Sequence
  Synthetic Polynucleotide
taatacgactcactatagggggtcctaacagaccagggtcttgttactcaaacagaggagatgagtaatgagaccctggaacctggcggcagcgcaaaagatg

SEQ ID NO: 15445 - DNA, 103 bp, Artificial Sequence
  Synthetic Polynucleotide
taatacgactcactatagggcttctacccaattgaggaaccaagtcatgtaacagaggagaacatgaatgggttcctcaaacctggcggcagcgcaaaagatg

SEQ ID NO: 15446 - DNA, 103 bp, Artificial Sequence
  Synthetic Polynucleotide
taatacgactcactatagggcttgtcttctacccaattgaggaaccaagtaacagaggagaacttggatgctcaattggaacctggcggcagcgcaaaagatg

SEQ ID NO: 15447 - DNA, 103 bp, Artificial Sequence
  Synthetic Polynucleotide
taatacgactcactatagggtggttcttgtcttctacccaattgaggaacaacagaggagagttcctatgttgggtagaaacctggcggcagcgcaaaagatg

SEQ ID NO: 15448 - DNA, 103 bp, Artificial Sequence
  Synthetic Polynucleotide
taatacgactcactataggggtgtttggttcttgtcttctacccaattgaaacagaggagatcaattatgtagaagacaaacctggcggcagcgcaaaagatg

SEQ ID NO: 15449 - DNA, 103 bp, Artificial Sequence
  Synthetic Polynucleotide
taatacgactcactataggggcgccgtgtttggttcttgtcttctacccaaacagaggagatgggtaatggacaagaacaacctggcggcagcgcaaaagatg

SEQ ID NO: 15450 - DNA, 103 bp, Artificial Sequence
  Synthetic Polynucleotide
taatacgactcactatagggtagttgcgccgtgtttggttcttgtcttctaacagaggagaagaagaatggaaccaaacaacctggcggcagcgcaaaagatg

SEQ ID NO: 15451 - DNA, 103 bp, Artificial Sequence
  Synthetic Polynucleotide
taatacgactcactatagggggcaatagttgcgccgtgtttggttcttgtaacagaggagaacaagaatgaaacacggcaacctggcggcagcgcaaaagatg

SEQ ID NO: 15452 - DNA, 103 bp, Artificial Sequence
  Synthetic Polynucleotide
taatacgactcactatagggtatatggcaatagttgcgccgtgtttggttaacagaggagaaaccaaatgcggcgcaacaacctggcggcagcgcaaaagatg

SEQ ID NO: 15453 - DNA, 103 bp, Artificial Sequence
  Synthetic Polynucleotide
taatacgactcactatagggtgctttatatggcaatagttgcgccgtgttaacagaggagaaacacgatgcaactattgaacctggcggcagcgcaaaagatg

SEQ ID NO: 15454 - DNA, 103 bp, Artificial Sequence
  Synthetic Polynucleotide
taatacgactcactatagggttatctgctttatatggcaatagttgcgccaacagaggagaggcgcaatgattgccataaacctggcggcagcgcaaaagatg

SEQ ID NO: 15455 - DNA, 103 bp, Artificial Sequence
  Synthetic Polynucleotide
taatacgactcactatagggagaagggtcctaacagaccagggtcttgttaacagaggagaaacaagatgctggtctgtaacctggcggcagcgcaaaagatg

SEQ ID NO: 15456 - DNA, 103 bp, Artificial Sequence
  Synthetic Polynucleotide
taatacgactcactatagggattaattatctgctttatatggcaatagttaacagaggagaaactatatgcatataaagaacctggcggcagcgcaaaagatg

SEQ ID NO: 15457 - DNA, 103 bp, Artificial Sequence
  Synthetic Polynucleotide
taatacgactcactatagggcaggtattaattatctgctttatatggcaaaacagaggagattgccaatgaaagcagataacctggcggcagcgcaaaagatg

SEQ ID NO: 15458 - DNA, 103 bp, Artificial Sequence
  Synthetic Polynucleotide
taatacgactcactatagggtatgccaggtattaattatctgctttatataacagaggagaatataaatgagataattaaacctggcggcagcgcaaaagatg

SEQ ID NO: 15459 - DNA, 103 bp, Artificial Sequence
  Synthetic Polynucleotide
taatacgactcactatagggtactttatgccaggtattaattatctgcttaacagaggagaaagcagatgattaataccaacctggcggcagcgcaaaagatg

SEQ ID NO: 15460 - DNA, 103 bp, Artificial Sequence
  Synthetic Polynucleotide
taatacgactcactatagggttccctactttatgccaggtattaattatcaacagaggagagataatatgtacctggcaaacctggcggcagcgcaaaagatg

SEQ ID NO: 15461 - DNA, 103 bp, Artificial Sequence
  Synthetic Polynucleotide
taatacgactcactatagggcatttttccctactttatgccaggtattaaaacagaggagattaataatgggcataaagaacctggcggcagcgcaaaagatg

SEQ ID NO: 15462 - DNA, 103 bp, Artificial Sequence
  Synthetic Polynucleotide
taatacgactcactatagggatatacatttttccctactttatgccaggtaacagaggagaacctggatgaaagtagggaacctggcggcagcgcaaaagatg

SEQ ID NO: 15463 - DNA, 103 bp, Artificial Sequence
  Synthetic Polynucleotide
taatacgactcactatagggggcaaatatacatttttccctactttatgcaacagaggagagcataaatgagggaaaaaaacctggcggcagcgcaaaagatg

SEQ ID NO: 15464 - DNA, 103 bp, Artificial Sequence
  Synthetic Polynucleotide
taatacgactcactatagggtaggaggcaaatatacatttttccctacttaacagaggagaaagtagatgaaaatgtataacctggcggcagcgcaaaagatg

SEQ ID NO: 15465 - DNA, 103 bp, Artificial Sequence
  Synthetic Polynucleotide
taatacgactcactatagggttccctaggaggcaaatatacatttttcccaacagaggagagggaaaatggtatatttgaacctggcggcagcgcaaaagatg

SEQ ID NO: 15466 - DNA, 103 bp, Artificial Sequence
  Synthetic Polynucleotide
taatacgactcactatagggctggcccatgagtataattctgccaatctgaacagaggagacagattatgagaattataaacctggcggcagcgcaaaagatg

SEQ ID NO: 15467 - DNA, 103 bp, Artificial Sequence
  Synthetic Polynucleotide
taatacgactcactatagggaagcgagaagggtcctaacagaccagggtcaacagaggagagaccctatgctgttaggaaacctggcggcagcgcaaaagatg

SEQ ID NO: 15468 - DNA, 103 bp, Artificial Sequence
  Synthetic Polynucleotide
taatacgactcactatagggtccccttccctaggaggcaaatatacatttaacagaggagaaaatgtatgtttgcctccaacctggcggcagcgcaaaagatg

SEQ ID NO: 15469 - DNA, 103 bp, Artificial Sequence
  Synthetic Polynucleotide
taatacgactcactatagggccaactccccttccctaggaggcaaatataaacagaggagatatattatgctcctagggaacctggcggcagcgcaaaagatg

SEQ ID NO: 15470 - DNA, 103 bp, Artificial Sequence
  Synthetic Polynucleotide
taatacgactcactatagggacaggccaactccccttccctaggaggcaaaacagaggagattgcctatgagggaagggaacctggcggcagcgcaaaagatg

SEQ ID NO: 15471 - DNA, 103 bp, Artificial Sequence
  Synthetic Polynucleotide
taatacgactcactataggggattcacaggccaactccccttccctaggaaacagaggagatcctagatgaggggagttaacctggcggcagcgcaaaagatg

SEQ ID NO: 15472 - DNA, 103 bp, Artificial Sequence
  Synthetic Polynucleotide
taatacgactcactatagggctgttgattcacaggccaactccccttcccaacagaggagagggaagatgagttggcctaacctggcggcagcgcaaaagatg

SEQ ID NO: 15473 - DNA, 103 bp, Artificial Sequence
  Synthetic Polynucleotide
taatacgactcactatagggggttactgttgattcacaggccaactccccaacagaggagaggggagatggcctgtgaaaacctggcggcagcgcaaaagatg

SEQ ID NO: 15474 - DNA, 103 bp, Artificial Sequence
  Synthetic Polynucleotide
taatacgactcactatagggatgctggttactgttgattcacaggccaacaacagaggagagttggcatgtgaatcaacaacctggcggcagcgcaaaagatg

SEQ ID NO: 15475 - DNA, 103 bp, Artificial Sequence
  Synthetic Polynucleotide
taatacgactcactatagggcaattatgctggttactgttgattcacaggaacagaggagacctgtgatgcaacagtaaaacctggcggcagcgcaaaagatg

SEQ ID NO: 15476 - DNA, 103 bp, Artificial Sequence
  Synthetic Polynucleotide
taatacgactcactataggggttagcaattatgctggttactgttgattcaacagaggagagaatcaatggtaaccagcaacctggcggcagcgcaaaagatg

SEQ ID NO: 15477 - DNA, 103 bp, Artificial Sequence
  Synthetic Polynucleotide
taatacgactcactatagggtcaatgttagcaattatgctggttactgttaacagaggagaaacagtatgcagcataataacctggcggcagcgcaaaagatg

SEQ ID NO: 15478 - DNA, 103 bp, Artificial Sequence
  Synthetic Polynucleotide
taatacgactcactatagggtcccaaagcgagaagggtcctaacagaccaaacagaggagatggtctatgaggacccttaacctggcggcagcgcaaaagatg

SEQ ID NO: 15479 - DNA, 103 bp, Artificial Sequence
  Synthetic Polynucleotide
taatacgactcactatagggctatgtcaatgttagcaattatgctggttaaacagaggagataaccaatgtaattgctaaacctggcggcagcgcaaaagatg

SEQ ID NO: 15480 - DNA, 103 bp, Artificial Sequence
  Synthetic Polynucleotide
taatacgactcactatagggtttatctatgtcaatgttagcaattatgctaacagaggagaagcataatggctaacattaacctggcggcagcgcaaaagatg

SEQ ID NO: 15481 - DNA, 103 bp, Artificial Sequence
  Synthetic Polynucleotide
taatacgactcactatagggcgatttttatctatgtcaatgttagcaattaacagaggagaaattgcatgcattgacataacctggcggcagcgcaaaagatg

SEQ ID NO: 15482 - DNA, 103 bp, Artificial Sequence
  Synthetic Polynucleotide
taatacgactcactataggggagtccgatttttatctatgtcaatgttagaacagaggagactaacaatgacatagataaacctggcggcagcgcaaaagatg

SEQ ID NO: 15483 - DNA, 103 bp, Artificial Sequence
  Synthetic Polynucleotide
taatacgactcactatagggggtatgagtccgatttttatctatgtcaataacagaggagaattgacatggataaaaataacctggcggcagcgcaaaagatg

SEQ ID NO: 15484 - DNA, 103 bp, Artificial Sequence
  Synthetic Polynucleotide
taatacgactcactatagggatgttggtatgagtccgatttttatctatgaacagaggagacatagaatgaaatcggacaacctggcggcagcgcaaaagatg

SEQ ID NO: 15485 - DNA, 103 bp, Artificial Sequence
  Synthetic Polynucleotide
taatacgactcactatagggaggtaatgttggtatgagtccgatttttataacagaggagaataaaaatgggactcataaacctggcggcagcgcaaaagatg

SEQ ID NO: 15486 - DNA, 103 bp, Artificial Sequence
  Synthetic Polynucleotide
taatacgactcactatagggactaaaggtaatgttggtatgagtccgattaacagaggagaaatcggatgcataccaacaacctggcggcagcgcaaaagatg

SEQ ID NO: 15487 - DNA, 103 bp, Artificial Sequence
  Synthetic Polynucleotide
taatacgactcactatagggtctgcactaaaggtaatgttggtatgagtcaacagaggagagactcaatgcaacattacaacctggcggcagcgcaaaagatg

SEQ ID NO: 15488 - DNA, 103 bp, Artificial Sequence
  Synthetic Polynucleotide
taatacgactcactatagggccacttctgcactaaaggtaatgttggtataacagaggagaataccaatgttacctttaaacctggcggcagcgcaaaagatg

SEQ ID NO: 15489 - DNA, 103 bp, Artificial Sequence
  Synthetic Polynucleotide
taatacgactcactatagggtggattcccaaagcgagaagggtcctaacaaacagaggagatgttagatgccttctcgcaacctggcggcagcgcaaaagatg

SEQ ID NO: 15490 - DNA, 103 bp, Artificial Sequence
  Synthetic Polynucleotide
taatacgactcactatagggttctgccacttctgcactaaaggtaatgttaacagaggagaaacattatgtttagtgcaaacctggcggcagcgcaaaagatg

SEQ ID NO: 15491 - DNA, 103 bp, Artificial Sequence
  Synthetic Polynucleotide
taatacgactcactatagggtacagttctgccacttctgcactaaaggtaaacagaggagataccttatgtgcagaagtaacctggcggcagcgcaaaagatg

SEQ ID NO: 15492 - DNA, 103 bp, Artificial Sequence
  Synthetic Polynucleotide
taatacgactcactatagggatcggtacagttctgccacttctgcactaaaacagaggagattagtgatgaagtggcagaacctggcggcagcgcaaaagatg

SEQ ID NO: 15493 - DNA, 103 bp, Artificial Sequence
  Synthetic Polynucleotide
taatacgactcactatagggttctaatcggtacagttctgccacttctgcaacagaggagagcagaaatggcagaactgaacctggcggcagcgcaaaagatg

SEQ ID NO: 15494 - DNA, 103 bp, Artificial Sequence
  Synthetic Polynucleotide
taatacgactcactatagggcccagttctaatcggtacagttctgccactaacagaggagaagtggcatgactgtaccgaacctggcggcagcgcaaaagatg

SEQ ID NO: 15495 - DNA, 103 bp, Artificial Sequence
  Synthetic Polynucleotide
taatacgactcactatagggagtctcccagttctaatcggtacagttctgaacagaggagacagaacatgaccgattagaacctggcggcagcgcaaaagatg

SEQ ID NO: 15496 - DNA, 103 bp, Artificial Sequence
  Synthetic Polynucleotide
taatacgactcactatagggtttgtagtctcccagttctaatcggtacagaacagaggagactgtacatgttagaactgaacctggcggcagcgcaaaagatg

SEQ ID NO: 15497 - DNA, 103 bp, Artificial Sequence
  Synthetic Polynucleotide
taatacgactcactatagggattaatttgtagtctcccagttctaatcggaacagaggagaccgattatgactgggagaaacctggcggcagcgcaaaagatg

SEQ ID NO: 15498 - DNA, 103 bp, Artificial Sequence
  Synthetic Polynucleotide
taatacgactcactatagggtttctattaatttgtagtctcccagttctaaacagaggagatagaacatggagactacaaacctggcggcagcgcaaaagatg

SEQ ID NO: 15499 - DNA, 103 bp, Artificial Sequence
  Synthetic Polynucleotide
taatacgactcactatagggtgttatttctattaatttgtagtctcccagaacagaggagactgggaatgtacaaattaaacctggcggcagcgcaaaagatg

SEQ ID NO: 15500 - DNA, 103 bp, Artificial Sequence
  Synthetic Polynucleotide
taatacgactcactatagggtgccttggattcccaaagcgagaagggtccaacagaggagaggacccatgtcgctttggaacctggcggcagcgcaaaagatg

SEQ ID NO: 15501 - DNA, 103 bp, Artificial Sequence
  Synthetic Polynucleotide
taatacgactcactatagggattggtgttatttctattaatttgtagtctaacagaggagaagactaatgattaatagaaacctggcggcagcgcaaaagatg

SEQ ID NO: 15502 - DNA, 103 bp, Artificial Sequence
  Synthetic Polynucleotide
taatacgactcactatagggagccaattggtgttatttctattaatttgtaacagaggagaacaaatatgtagaaataaaacctggcggcagcgcaaaagatg

SEQ ID NO: 15503 - DNA, 103 bp, Artificial Sequence
  Synthetic Polynucleotide
taatacgactcactatagggtgcgaagccaattggtgttatttctattaaaacagaggagattaataatgataacaccaaacctggcggcagcgcaaaagatg

SEQ ID NO: 15504 - DNA, 103 bp, Artificial Sequence
  Synthetic Polynucleotide
taatacgactcactataggggtaggtgcgaagccaattggtgttatttctaacagaggagaagaaatatgaccaattggaacctggcggcagcgcaaaagatg

SEQ ID NO: 15505 - DNA, 103 bp, Artificial Sequence
  Synthetic Polynucleotide
taatacgactcactataggggatctgtaggtgcgaagccaattggtgttaaacagaggagataacacatgttggcttcgaacctggcggcagcgcaaaagatg

SEQ ID NO: 15506 - DNA, 103 bp, Artificial Sequence
  Synthetic Polynucleotide
taatacgactcactatagggtctctgatctgtaggtgcgaagccaattggaacagaggagaccaattatgttcgcacctaacctggcggcagcgcaaaagatg

SEQ ID NO: 15507 - DNA, 103 bp, Artificial Sequence
  Synthetic Polynucleotide
taatacgactcactatagggtaccttctctgatctgtaggtgcgaagccaaacagaggagatggcttatgacctacagaaacctggcggcagcgcaaaagatg

SEQ ID NO: 15508 - DNA, 103 bp, Artificial Sequence
  Synthetic Polynucleotide
taatacgactcactatagggaggagtaccttctctgatctgtaggtgcgaaacagaggagatcgcacatgcagatcagaaacctggcggcagcgcaaaagatg

SEQ ID NO: 15509 - DNA, 103 bp, Artificial Sequence
  Synthetic Polynucleotide
taatacgactcactatagggagttgaggagtaccttctctgatctgtaggaacagaggagacctacaatgcagagaaggaacctggcggcagcgcaaaagatg

SEQ ID NO: 15510 - DNA, 103 bp, Artificial Sequence
  Synthetic Polynucleotide
taatacgactcactatagggactggagttgaggagtaccttctctgatctaacagaggagaagatcaatgaaggtactcaacctggcggcagcgcaaaagatg

SEQ ID NO: 15511 - DNA, 103 bp, Artificial Sequence
  Synthetic Polynucleotide
taatacgactcactatagggtttcctgccttggattcccaaagcgagaagaacagaggagacttctcatgttgggaatcaacctggcggcagcgcaaaagatg

SEQ ID NO: 15512 - DNA, 103 bp, Artificial Sequence
  Synthetic Polynucleotide
taatacgactcactatagggtcctcactggagttgaggagtaccttctctaacagaggagaagagaaatgactcctcaaaacctggcggcagcgcaaaagatg

SEQ ID NO: 15513 - DNA, 103 bp, Artificial Sequence
  Synthetic Polynucleotide
taatacgactcactatagggtttgttcctcactggagttgaggagtacctaacagaggagaaggtacatgtcaactccaaacctggcggcagcgcaaaagatg

SEQ ID NO: 15514 - DNA, 103 bp, Artificial Sequence
  Synthetic Polynucleotide
taatacgactcactatagggcctcttttgttcctcactggagttgaggagaacagaggagactcctcatgtccagtgagaacctggcggcagcgcaaaagatg

SEQ ID NO: 15515 - DNA, 103 bp, Artificial Sequence
  Synthetic Polynucleotide
taatacgactcactatagggacacacctcttttgttcctcactggagttgaacagaggagacaactcatgtgaggaacaaacctggcggcagcgcaaaagatg

SEQ ID NO: 15516 - DNA, 103 bp, Artificial Sequence
  Synthetic Polynucleotide
taatacgactcactatagggcacgaacacacctcttttgttcctcactggaacagaggagaccagtgatgaacaaaagaaacctggcggcagcgcaaaagatg

SEQ ID NO: 15517 - DNA, 103 bp, Artificial Sequence
  Synthetic Polynucleotide
taatacgactcactatagggcctagcacgaacacacctcttttgttcctcaacagaggagagaggaaatgaagaggtgtaacctggcggcagcgcaaaagatg

SEQ ID NO: 15518 - DNA, 103 bp, Artificial Sequence
  Synthetic Polynucleotide
taatacgactcactatagggagaaccctagcacgaacacacctcttttgtaacagaggagaacaaaaatggtgtgttcgaacctggcggcagcgcaaaagatg

SEQ ID NO: 15519 - DNA, 103 bp, Artificial Sequence
  Synthetic Polynucleotide
taatacgactcactatagggacccaagaaccctagcacgaacacacctctaacagaggagaagaggtatgttcgtgctaaacctggcggcagcgcaaaagatg

SEQ ID NO: 15520 - DNA, 103 bp, Artificial Sequence
  Synthetic Polynucleotide
taatacgactcactatagggagaaaacccaagaaccctagcacgaacacaaacagaggagatgtgttatggctagggttaacctggcggcagcgcaaaagatg

SEQ ID NO: 15521 - DNA, 103 bp, Artificial Sequence
  Synthetic Polynucleotide
taatacgactcactatagggtcgcgagaaaacccaagaaccctagcacgaaacagaggagatcgtgcatgggttcttggaacctggcggcagcgcaaaagatg

SEQ ID NO: 15522 - DNA, 103 bp, Artificial Sequence
  Synthetic Polynucleotide
taatacgactcactataggggggattttcctgccttggattcccaaagcgaacagaggagacgctttatgaatccaaggaacctggcggcagcgcaaaagatg

SEQ ID NO: 15523 - DNA, 103 bp, Artificial Sequence
  Synthetic Polynucleotide
taatacgactcactatagggtgctgtcgcgagaaaacccaagaaccctagaacagaggagactagggatgttgggttttaacctggcggcagcgcaaaagatg

SEQ ID NO: 15524 - DNA, 103 bp, Artificial Sequence
  Synthetic Polynucleotide
taatacgactcactataggggaacctgctgtcgcgagaaaacccaagaacaacagaggagagttcttatgttttctcgcaacctggcggcagcgcaaaagatg

SEQ ID NO: 15525 - DNA, 103 bp, Artificial Sequence
  Synthetic Polynucleotide
taatacgactcactatagggttgcagaacctgctgtcgcgagaaaacccaaacagaggagatgggttatgtcgcgacagaacctggcggcagcgcaaaagatg

SEQ ID NO: 15526 - DNA, 103 bp, Artificial Sequence
  Synthetic Polynucleotide
taatacgactcactataggggcccattgcagaacctgctgtcgcgagaaaaacagaggagatttctcatgacagcaggtaacctggcggcagcgcaaaagatg

SEQ ID NO: 15527 - DNA, 103 bp, Artificial Sequence
  Synthetic Polynucleotide
taatacgactcactatagggcgcgcgcccattgcagaacctgctgtcgcgaacagaggagacgcgacatgaggttctgcaacctggcggcagcgcaaaagatg

SEQ ID NO: 15528 - DNA, 103 bp, Artificial Sequence
  Synthetic Polynucleotide
taatacgactcactataggggggaccgcgcgcccattgcagaacctgctgaacagaggagacagcagatgctgcaatggaacctggcggcagcgcaaaagatg

SEQ ID NO: 15529 - DNA, 103 bp, Artificial Sequence
  Synthetic Polynucleotide
taatacgactcactatagggcgtcagggaccgcgcgcccattgcagaaccaacagaggagaggttctatgatgggcgcgaacctggcggcagcgcaaaagatg

SEQ ID NO: 15530 - DNA, 103 bp, Artificial Sequence
  Synthetic Polynucleotide
taatacgactcactataggggacagcgtcagggaccgcgcgcccattgcaaacagaggagatgcaatatgcgcgcggtcaacctggcggcagcgcaaaagatg

SEQ ID NO: 15531 - DNA, 103 bp, Artificial Sequence
  Synthetic Polynucleotide
taatacgactcactataggggggctgacagcgtcagggaccgcgcgcccaaacagaggagatgggcgatgggtccctgaaacctggcggcagcgcaaaagatg

SEQ ID NO: 15532 - DNA, 103 bp, Artificial Sequence
  Synthetic Polynucleotide
taatacgactcactatagggggactgggctgacagcgtcagggaccgcgcaacagaggagagcgcggatgctgacgctgaacctggcggcagcgcaaaagatg

SEQ ID NO: 15533 - DNA, 103 bp, Artificial Sequence
  Synthetic Polynucleotide
taatacgactcactatagggtgctagggattttcctgccttggattcccaaacagaggagatgggaaatgaaggcaggaaacctggcggcagcgcaaaagatg

SEQ ID NO: 15534 - DNA, 103 bp, Artificial Sequence
  Synthetic Polynucleotide
taatacgactcactataggggtccgggactgggctgacagcgtcagggacaacagaggagagtccctatggctgtcagcaacctggcggcagcgcaaaagatg

SEQ ID NO: 15535 - DNA, 103 bp, Artificial Sequence
  Synthetic Polynucleotide
taatacgactcactataggggtaaagtccgggactgggctgacagcgtcaaacagaggagatgacgcatgcagcccagtaacctggcggcagcgcaaaagatg

SEQ ID NO: 15536 - DNA, 103 bp, Artificial Sequence
  Synthetic Polynucleotide
taatacgactcactatagggggccagtaaagtccgggactgggctgacagaacagaggagactgtcaatgcagtcccggaacctggcggcagcgcaaaagatg

SEQ ID NO: 15537 - DNA, 103 bp, Artificial Sequence
  Synthetic Polynucleotide
taatacgactcactatagggatcccggccagtaaagtccgggactgggctaacagaggagaagcccaatgccggactttaacctggcggcagcgcaaaagatg

SEQ ID NO: 15538 - DNA, 103 bp, Artificial Sequence
  Synthetic Polynucleotide
taatacgactcactataggggcactatcccggccagtaaagtccgggactaacagaggagaagtcccatgctttactggaacctggcggcagcgcaaaagatg

SEQ ID NO: 15539 - DNA, 103 bp, Artificial Sequence
  Synthetic Polynucleotide
taatacgactcactatagggttgctgcactatcccggccagtaaagtccgaacagaggagacggactatgctggccgggaacctggcggcagcgcaaaagatg

SEQ ID NO: 15540 - DNA, 103 bp, Artificial Sequence
  Synthetic Polynucleotide
taatacgactcactatagggtgctgttgctgcactatcccggccagtaaaaacagaggagatttactatgcgggatagtaacctggcggcagcgcaaaagatg

SEQ ID NO: 15541 - DNA, 103 bp, Artificial Sequence
  Synthetic Polynucleotide
taatacgactcactataggggctgttgctgttgctgcactatcccggccaaacagaggagatggccgatgtagtgcagcaacctggcggcagcgcaaaagatg

SEQ ID NO: 15542 - DNA, 103 bp, Artificial Sequence
  Synthetic Polynucleotide
taatacgactcactatagggcaacagctgttgctgttgctgcactatcccaacagaggagagggataatgcagcaacagaacctggcggcagcgcaaaagatg

SEQ ID NO: 15543 - DNA, 103 bp, Artificial Sequence
  Synthetic Polynucleotide
taatacgactcactatagggacgtccaacagctgttgctgttgctgcactaacagaggagaagtgcaatgacagcaacaaacctggcggcagcgcaaaagatg

SEQ ID NO: 15544 - DNA, 103 bp, Artificial Sequence
  Synthetic Polynucleotide
taatacgactcactatagggcaacctgctagggattttcctgccttggataacagaggagaatccaaatgaggaaaatcaacctggcggcagcgcaaaagatg

SEQ ID NO: 15545 - DNA, 103 bp, Artificial Sequence
  Synthetic Polynucleotide
taatacgactcactatagggtgactacgtccaacagctgttgctgttgctaacagaggagaagcaacatgaacagctgtaacctggcggcagcgcaaaagatg

SEQ ID NO: 15546 - DNA, 103 bp, Artificial Sequence
  Synthetic Polynucleotide
taatacgactcactatagggtctcttgactacgtccaacagctgttgctgaacagaggagacagcaaatgctgttggacaacctggcggcagcgcaaaagatg

SEQ ID NO: 15547 - DNA, 103 bp, Artificial Sequence
  Synthetic Polynucleotide
taatacgactcactatagggtgttgtctcttgactacgtccaacagctgtaacagaggagaacagctatgggacgtagtaacctggcggcagcgcaaaagatg

SEQ ID NO: 15548 - DNA, 103 bp, Artificial Sequence
  Synthetic Polynucleotide
taatacgactcactatagggtttcttgttgtctcttgactacgtccaacaaacagaggagatgttggatgtagtcaagaaacctggcggcagcgcaaaagatg

SEQ ID NO: 15549 - DNA, 103 bp, Artificial Sequence
  Synthetic Polynucleotide
taatacgactcactatagggcaacatttcttgttgtctcttgactacgtcaacagaggagagacgtaatgaagagacaaaacctggcggcagcgcaaaagatg

SEQ ID NO: 15550 - DNA, 103 bp, Artificial Sequence
  Synthetic Polynucleotide
taatacgactcactatagggagtcgcaacatttcttgttgtctcttgactaacagaggagaagtcaaatgacaacaagaaacctggcggcagcgcaaaagatg

SEQ ID NO: 15551 - DNA, 103 bp, Artificial Sequence
  Synthetic Polynucleotide
taatacgactcactatagggcggtcagtcgcaacatttcttgttgtctctaacagaggagaagagacatgaagaaatgtaacctggcggcagcgcaaaagatg

SEQ ID NO: 15552 - DNA, 103 bp, Artificial Sequence
  Synthetic Polynucleotide
taatacgactcactatagggccagacggtcagtcgcaacatttcttgttgaacagaggagacaacaaatgatgttgcgaaacctggcggcagcgcaaaagatg

SEQ ID NO: 15553 - DNA, 103 bp, Artificial Sequence
  Synthetic Polynucleotide
taatacgactcactataggggttccccagacggtcagtcgcaacatttctaacagaggagaagaaatatggcgactgacaacctggcggcagcgcaaaagatg

SEQ ID NO: 15554 - DNA, 103 bp, Artificial Sequence
  Synthetic Polynucleotide
taatacgactcactatagggttttcgttccccagacggtcagtcgcaacaaacagaggagatgttgcatgtgaccgtctaacctggcggcagcgcaaaagatg

SEQ ID NO: 15555 - DNA, 103 bp, Artificial Sequence
  Synthetic Polynucleotide
taatacgactcactatagggggcgccaacctgctagggattttcctgcctaacagaggagaaggcagatgaatccctagaacctggcggcagcgcaaaagatg

SEQ ID NO: 15556 - DNA, 103 bp, Artificial Sequence
  Synthetic Polynucleotide
taatacgactcactataggggaggtttttcgttccccagacggtcagtcgaacagaggagacgactgatggtctggggaaacctggcggcagcgcaaaagatg

SEQ ID NO: 15557 - DNA, 103 bp, Artificial Sequence
  Synthetic Polynucleotide
taatacgactcactataggggcctggaggtttttcgttccccagacggtcaacagaggagagaccgtatggggaacgaaaacctggcggcagcgcaaaagatg

SEQ ID NO: 15558 - DNA, 103 bp, Artificial Sequence
  Synthetic Polynucleotide
taatacgactcactatagggctcttgcctggaggtttttcgttccccagaaacagaggagatctgggatgcgaaaaaccaacctggcggcagcgcaaaagatg

SEQ ID NO: 15559 - DNA, 103 bp, Artificial Sequence
  Synthetic Polynucleotide
taatacgactcactatagggagtgactcttgcctggaggtttttcgttccaacagaggagaggaacgatgaacctccagaacctggcggcagcgcaaaagatg

SEQ ID NO: 15560 - DNA, 103 bp, Artificial Sequence
  Synthetic Polynucleotide
taatacgactcactatagggatagcagtgactcttgcctggaggtttttcaacagaggagagaaaaaatgccaggcaagaacctggcggcagcgcaaaagatg

SEQ ID NO: 15561 - DNA, 103 bp, Artificial Sequence
  Synthetic Polynucleotide
taatacgactcactatagggtctcgatagcagtgactcttgcctggaggtaacagaggagaacctccatgcaagagtcaaacctggcggcagcgcaaaagatg

SEQ ID NO: 15562 - DNA, 103 bp, Artificial Sequence
  Synthetic Polynucleotide
taatacgactcactataggggtacttctcgatagcagtgactcttgcctgaacagaggagacaggcaatggtcactgctaacctggcggcagcgcaaaagatg

SEQ ID NO: 15563 - DNA, 103 bp, Artificial Sequence
  Synthetic Polynucleotide
taatacgactcactatagggtttaggtacttctcgatagcagtgactcttaacagaggagaaagagtatgtgctatcgaaacctggcggcagcgcaaaagatg

SEQ ID NO: 15564 - DNA, 103 bp, Artificial Sequence
  Synthetic Polynucleotide
taatacgactcactataggggatgctttaggtacttctcgatagcagtgaaacagaggagatcactgatgtcgagaagtaacctggcggcagcgcaaaagatg

SEQ ID NO: 15565 - DNA, 103 bp, Artificial Sequence
  Synthetic Polynucleotide
taatacgactcactatagggtgcctgatgctttaggtacttctcgatagcaacagaggagagctatcatgaagtacctaaacctggcggcagcgcaaaagatg

SEQ ID NO: 15566 - DNA, 103 bp, Artificial Sequence
  Synthetic Polynucleotide
taatacgactcactataggggttcgggcgccaacctgctagggattttccaacagaggagaggaaaaatgctagcaggtaacctggcggcagcgcaaaagatg

SEQ ID NO: 15567 - DNA, 103 bp, Artificial Sequence
  Synthetic Polynucleotide
taatacgactcactatagggagctgtgcctgatgctttaggtacttctcgaacagaggagacgagaaatgcctaaagcaaacctggcggcagcgcaaaagatg

SEQ ID NO: 15568 - DNA, 103 bp, Artificial Sequence
  Synthetic Polynucleotide
taatacgactcactatagggaatttagctgtgcctgatgctttaggtactaacagaggagaagtaccatgagcatcaggaacctggcggcagcgcaaaagatg

SEQ ID NO: 15569 - DNA, 103 bp, Artificial Sequence
  Synthetic Polynucleotide
taatacgactcactatagggccatgaatttagctgtgcctgatgctttagaacagaggagactaaagatgcaggcacagaacctggcggcagcgcaaaagatg

SEQ ID NO: 15570 - DNA, 103 bp, Artificial Sequence
  Synthetic Polynucleotide
taatacgactcactatagggcatccccatgaatttagctgtgcctgatgcaacagaggagagcatcaatgacagctaaaaacctggcggcagcgcaaaagatg

SEQ ID NO: 15571 - DNA, 103 bp, Artificial Sequence
  Synthetic Polynucleotide
taatacgactcactatagggacgcacatccccatgaatttagctgtgcctaacagaggagaaggcacatgtaaattcataacctggcggcagcgcaaaagatg

SEQ ID NO: 15572 - DNA, 103 bp, Artificial Sequence
  Synthetic Polynucleotide
taatacgactcactatagggtctaaacgcacatccccatgaatttagctgaacagaggagacagctaatgtcatggggaaacctggcggcagcgcaaaagatg

SEQ ID NO: 15573 - DNA, 103 bp, Artificial Sequence
  Synthetic Polynucleotide
taatacgactcactatagggacctgtctaaacgcacatccccatgaatttaacagaggagaaaattcatggggatgtgcaacctggcggcagcgcaaaagatg

SEQ ID NO: 15574 - DNA, 103 bp, Artificial Sequence
  Synthetic Polynucleotide
taatacgactcactatagggggcagacctgtctaaacgcacatccccatgaacagaggagacatgggatggtgcgtttaaacctggcggcagcgcaaaagatg

SEQ ID NO: 15575 - DNA, 103 bp, Artificial Sequence
  Synthetic Polynucleotide
taatacgactcactatagggagtgtggcagacctgtctaaacgcacatccaacagaggagaggatgtatgtttagacagaacctggcggcagcgcaaaagatg

SEQ ID NO: 15576 - DNA, 103 bp, Artificial Sequence
  Synthetic Polynucleotide
taatacgactcactatagggacagtagtgtggcagacctgtctaaacgcaaacagaggagatgcgttatgacaggtctgaacctggcggcagcgcaaaagatg

SEQ ID NO: 15577 - DNA, 103 bp, Artificial Sequence
  Synthetic Polynucleotide
taatacgactcactatagggtactcctggcccatgagtataattctgccaaacagaggagatggcagatgtatactcataacctggcggcagcgcaaaagatg

SEQ ID NO: 15578 - DNA, 103 bp, Artificial Sequence
  Synthetic Polynucleotide
taatacgactcactatagggtccctgttcgggcgccaacctgctagggataacagaggagaatccctatgaggttggcgaacctggcggcagcgcaaaagatg

SEQ ID NO: 15579 - DNA, 103 bp, Artificial Sequence
  Synthetic Polynucleotide
taatacgactcactatagggacggtacagtagtgtggcagacctgtctaaaacagaggagattagacatgtctgccacaaacctggcggcagcgcaaaagatg

SEQ ID NO: 15580 - DNA, 103 bp, Artificial Sequence
  Synthetic Polynucleotide
taatacgactcactatagggtacccacggtacagtagtgtggcagacctgaacagaggagacaggtcatgcacactactaacctggcggcagcgcaaaagatg

SEQ ID NO: 15581 - DNA, 103 bp, Artificial Sequence
  Synthetic Polynucleotide
taatacgactcactatagggtcatttacccacggtacagtagtgtggcagaacagaggagactgccaatgtactgtaccaacctggcggcagcgcaaaagatg

SEQ ID NO: 15582 - DNA, 103 bp, Artificial Sequence
  Synthetic Polynucleotide
taatacgactcactatagggaagagtcatttacccacggtacagtagtgtaacagaggagaacactaatgtaccgtgggaacctggcggcagcgcaaaagatg

SEQ ID NO: 15583 - DNA, 103 bp, Artificial Sequence
  Synthetic Polynucleotide
taatacgactcactatagggcgataaagagtcatttacccacggtacagtaacagaggagaactgtaatgtgggtaaataacctggcggcagcgcaaaagatg

SEQ ID NO: 15584 - DNA, 103 bp, Artificial Sequence
  Synthetic Polynucleotide
taatacgactcactatagggtcaggcgataaagagtcatttacccacggtaacagaggagaaccgtgatgaaatgactcaacctggcggcagcgcaaaagatg

SEQ ID NO: 15585 - DNA, 103 bp, Artificial Sequence
  Synthetic Polynucleotide
taatacgactcactatagggtccagtcaggcgataaagagtcatttacccaacagaggagagggtaaatgactctttataacctggcggcagcgcaaaagatg

SEQ ID NO: 15586 - DNA, 103 bp, Artificial Sequence
  Synthetic Polynucleotide
taatacgactcactatagggatttttccagtcaggcgataaagagtcattaacagaggagaaatgacatgttatcgcctaacctggcggcagcgcaaaagatg

SEQ ID NO: 15587 - DNA, 103 bp, Artificial Sequence
  Synthetic Polynucleotide
taatacgactcactataggggtcatatttttccagtcaggcgataaagagaacagaggagactctttatggcctgactgaacctggcggcagcgcaaaagatg

SEQ ID NO: 15588 - DNA, 103 bp, Artificial Sequence
  Synthetic Polynucleotide
taatacgactcactataggggccatgtcatatttttccagtcaggcgataaacagaggagatatcgcatgactggaaaaaacctggcggcagcgcaaaagatg

SEQ ID NO: 15589 - DNA, 103 bp, Artificial Sequence
  Synthetic Polynucleotide
taatacgactcactatagggtcaagtccctgttcgggcgccaacctgctaaacagaggagatagcagatgggcgcccgaaacctggcggcagcgcaaaagatg

SEQ ID NO: 15590 - DNA, 103 bp, Artificial Sequence
  Synthetic Polynucleotide
taatacgactcactatagggctcctgccatgtcatatttttccagtcaggaacagaggagacctgacatgaaaaatatgaacctggcggcagcgcaaaagatg

SEQ ID NO: 15591 - DNA, 103 bp, Artificial Sequence
  Synthetic Polynucleotide
taatacgactcactatagggtcccactcctgccatgtcatatttttccagaacagaggagactggaaatgtatgacatgaacctggcggcagcgcaaaagatg

SEQ ID NO: 15592 - DNA, 103 bp, Artificial Sequence
  Synthetic Polynucleotide
taatacgactcactataggggtttctcccactcctgccatgtcatattttaacagaggagaaaaataatgcatggcaggaacctggcggcagcgcaaaagatg

SEQ ID NO: 15593 - DNA, 103 bp, Artificial Sequence
  Synthetic Polynucleotide
taatacgactcactataggggacttgtttctcccactcctgccatgtcataacagaggagaatgacaatgcaggagtggaacctggcggcagcgcaaaagatg

SEQ ID NO: 15594 - DNA, 103 bp, Artificial Sequence
  Synthetic Polynucleotide
taatacgactcactatagggtagcggacttgtttctcccactcctgccataacagaggagaatggcaatggtgggagaaaacctggcggcagcgcaaaagatg

SEQ ID NO: 15595 - DNA, 103 bp, Artificial Sequence
  Synthetic Polynucleotide
taatacgactcactatagggctaggtagcggacttgtttctcccactcctaacagaggagaaggagtatgagaaacaagaacctggcggcagcgcaaaagatg

SEQ ID NO: 15596 - DNA, 103 bp, Artificial Sequence
  Synthetic Polynucleotide
taatacgactcactatagggtgcctctaggtagcggacttgtttctcccaaacagaggagatgggagatgcaagtccgcaacctggcggcagcgcaaaagatg

SEQ ID NO: 15597 - DNA, 103 bp, Artificial Sequence
  Synthetic Polynucleotide
taatacgactcactatagggatatttgcctctaggtagcggacttgtttcaacagaggagagaaacaatgccgctacctaacctggcggcagcgcaaaagatg

SEQ ID NO: 15598 - DNA, 103 bp, Artificial Sequence
  Synthetic Polynucleotide
taatacgactcactataggggactgatatttgcctctaggtagcggacttaacagaggagaaagtccatgacctagaggaacctggcggcagcgcaaaagatg

SEQ ID NO: 15599 - DNA, 103 bp, Artificial Sequence
  Synthetic Polynucleotide
taatacgactcactatagggactttgactgatatttgcctctaggtagcgaacagaggagacgctacatggaggcaaataacctggcggcagcgcaaaagatg

SEQ ID NO: 15600 - DNA, 103 bp, Artificial Sequence
  Synthetic Polynucleotide
taatacgactcactatagggcctcttcaagtccctgttcgggcgccaaccaacagaggagaggttggatgccgaacaggaacctggcggcagcgcaaaagatg

SEQ ID NO: 15601 - DNA, 103 bp, Artificial Sequence
  Synthetic Polynucleotide
taatacgactcactatagggtctaaactttgactgatatttgcctctaggaacagaggagacctagaatgaaatatcagaacctggcggcagcgcaaaagatg

SEQ ID NO: 15602 - DNA, 103 bp, Artificial Sequence
  Synthetic Polynucleotide
taatacgactcactatagggcttcttctaaactttgactgatatttgcctaacagaggagaaggcaaatgtcagtcaaaaacctggcggcagcgcaaaagatg

SEQ ID NO: 15603 - DNA, 103 bp, Artificial Sequence
  Synthetic Polynucleotide
taatacgactcactatagggttgggcttcttctaaactttgactgatattaacagaggagaaatatcatgcaaagtttaaacctggcggcagcgcaaaagatg

SEQ ID NO: 15604 - DNA, 103 bp, Artificial Sequence
  Synthetic Polynucleotide
taatacgactcactatagggtgaatttgggcttcttctaaactttgactgaacagaggagacagtcaatgtttagaagaaacctggcggcagcgcaaaagatg

SEQ ID NO: 15605 - DNA, 103 bp, Artificial Sequence
  Synthetic Polynucleotide
taatacgactcactatagggcttgttgaatttgggcttcttctaaactttaacagaggagaaaagttatgaagaagcccaacctggcggcagcgcaaaagatg

SEQ ID NO: 15606 - DNA, 103 bp, Artificial Sequence
  Synthetic Polynucleotide
taatacgactcactatagggcttttcttgttgaatttgggcttcttctaaaacagaggagattagaaatggcccaaattaacctggcggcagcgcaaaagatg

SEQ ID NO: 15607 - DNA, 103 bp, Artificial Sequence
  Synthetic Polynucleotide
taatacgactcactatagggatattcttttcttgttgaatttgggcttctaacagaggagaagaagcatgaattcaacaaacctggcggcagcgcaaaagatg

SEQ ID NO: 15608 - DNA, 103 bp, Artificial Sequence
  Synthetic Polynucleotide
taatacgactcactatagggcatacatattcttttcttgttgaatttgggaacagaggagacccaaaatgaacaagaaaaacctggcggcagcgcaaaagatg

SEQ ID NO: 15609 - DNA, 103 bp, Artificial Sequence
  Synthetic Polynucleotide
taatacgactcactatagggtaattcatacatattcttttcttgttgaataacagaggagaattcaaatggaaaagaataacctggcggcagcgcaaaagatg

SEQ ID NO: 15610 - DNA, 103 bp, Artificial Sequence
  Synthetic Polynucleotide
taatacgactcactatagggttttgtaattcatacatattcttttcttgtaacagaggagaacaagaatggaatatgtaaacctggcggcagcgcaaaagatg

SEQ ID NO: 15611 - DNA, 103 bp, Artificial Sequence
  Synthetic Polynucleotide
taatacgactcactatagggtcagtcctcttcaagtccctgttcgggcgcaacagaggagagcgcccatgcagggacttaacctggcggcagcgcaaaagatg

SEQ ID NO: 15612 - DNA, 103 bp, Artificial Sequence
  Synthetic Polynucleotide
taatacgactcactatagggttaatttttgtaattcatacatattcttttaacagaggagaaaaagaatgtgtatgaataacctggcggcagcgcaaaagatg

SEQ ID NO: 15613 - DNA, 103 bp, Artificial Sequence
  Synthetic Polynucleotide
taatacgactcactataggggctatttaatttttgtaattcatacatattaacagaggagaaatatgatggaattacaaaacctggcggcagcgcaaaagatg

SEQ ID NO: 15614 - DNA, 103 bp, Artificial Sequence
  Synthetic Polynucleotide
taatacgactcactatagggtcccagctatttaatttttgtaattcatacaacagaggagagtatgaatgacaaaaattaacctggcggcagcgcaaaagatg

SEQ ID NO: 15615 - DNA, 103 bp, Artificial Sequence
  Synthetic Polynucleotide
taatacgactcactataggggaatatcccagctatttaatttttgtaattaacagaggagaaattacatgaattaaataaacctggcggcagcgcaaaagatg

SEQ ID NO: 15616 - DNA, 103 bp, Artificial Sequence
  Synthetic Polynucleotide
taatacgactcactataggggccaagaatatcccagctatttaatttttgaacagaggagacaaaaaatgaatagctggaacctggcggcagcgcaaaagatg

SEQ ID NO: 15617 - DNA, 103 bp, Artificial Sequence
  Synthetic Polynucleotide
taatacgactcactatagggcagttgccaagaatatcccagctatttaataacagaggagaattaaaatgctgggatataacctggcggcagcgcaaaagatg

SEQ ID NO: 15618 - DNA, 103 bp, Artificial Sequence
  Synthetic Polynucleotide
taatacgactcactatagggcaaaccagttgccaagaatatcccagctataacagaggagaatagctatgatattcttgaacctggcggcagcgcaaaagatg

SEQ ID NO: 15619 - DNA, 103 bp, Artificial Sequence
  Synthetic Polynucleotide
taatacgactcactatagggtaagtcaaaccagttgccaagaatatcccaaacagaggagatgggatatgcttggcaacaacctggcggcagcgcaaaagatg

SEQ ID NO: 15620 - DNA, 103 bp, Artificial Sequence
  Synthetic Polynucleotide
taatacgactcactataggggaggttaagtcaaaccagttgccaagaataaacagaggagatattctatgcaactggttaacctggcggcagcgcaaaagatg

SEQ ID NO: 15621 - DNA, 103 bp, Artificial Sequence
  Synthetic Polynucleotide
taatacgactcactatagggcccaggaggttaagtcaaaccagttgccaaaacagaggagattggcaatgggtttgactaacctggcggcagcgcaaaagatg

SEQ ID NO: 15622 - DNA, 103 bp, Artificial Sequence
  Synthetic Polynucleotide
taatacgactcactataggggcttctcagtcctcttcaagtccctgttcgaacagaggagacgaacaatgacttgaagaaacctggcggcagcgcaaaagatg

SEQ ID NO: 15623 - DNA, 103 bp, Artificial Sequence
  Synthetic Polynucleotide
taatacgactcactatagggcttgacccaggaggttaagtcaaaccagttaacagaggagaaactggatggacttaaccaacctggcggcagcgcaaaagatg

SEQ ID NO: 15624 - DNA, 103 bp, Artificial Sequence
  Synthetic Polynucleotide
taatacgactcactatagggatatacttgacccaggaggttaagtcaaacaacagaggagagtttgaatgaacctcctgaacctggcggcagcgcaaaagatg

SEQ ID NO: 15625 - DNA, 103 bp, Artificial Sequence
  Synthetic Polynucleotide
taatacgactcactatagggattgaatatacttgacccaggaggttaagtaacagaggagaacttaaatgcctgggtcaaacctggcggcagcgcaaaagatg

SEQ ID NO: 15626 - DNA, 103 bp, Artificial Sequence
  Synthetic Polynucleotide
taatacgactcactatagggtccatattgaatatacttgacccaggaggtaacagaggagaacctccatggtcaagtataacctggcggcagcgcaaaagatg

SEQ ID NO: 15627 - DNA, 103 bp, Artificial Sequence
  Synthetic Polynucleotide
taatacgactcactatagggtgcactccatattgaatatacttgacccagaacagaggagactgggtatggtatattcaaacctggcggcagcgcaaaagatg

SEQ ID NO: 15628 - DNA, 103 bp, Artificial Sequence
  Synthetic Polynucleotide
taatacgactcactatagggctatatgcactccatattgaatatacttgaaacagaggagatcaagtatgttcaatatgaacctggcggcagcgcaaaagatg

SEQ ID NO: 15629 - DNA, 103 bp, Artificial Sequence
  Synthetic Polynucleotide
taatacgactcactatagggcactactatatgcactccatattgaatataaacagaggagatatattatgtatggagtgaacctggcggcagcgcaaaagatg

SEQ ID NO: 15630 - DNA, 103 bp, Artificial Sequence
  Synthetic Polynucleotide
taatacgactcactatagggattcccactactatatgcactccatattgaaacagaggagatcaataatgagtgcatataacctggcggcagcgcaaaagatg

SEQ ID NO: 15631 - DNA, 103 bp, Artificial Sequence
  Synthetic Polynucleotide
taatacgactcactatagggctattattcccactactatatgcactccataacagaggagaatggagatgatatagtagaacctggcggcagcgcaaaagatg

SEQ ID NO: 15632 - DNA, 103 bp, Artificial Sequence
  Synthetic Polynucleotide
taatacgactcactatagggtaaagctattattcccactactatatgcacaacagaggagagtgcatatggtagtgggaaacctggcggcagcgcaaaagatg

SEQ ID NO: 15633 - DNA, 103 bp, Artificial Sequence
  Synthetic Polynucleotide
taatacgactcactatagggccagggcttctcagtcctcttcaagtccctaacagaggagaagggacatgaagaggactaacctggcggcagcgcaaaagatg

SEQ ID NO: 15634 - DNA, 103 bp, Artificial Sequence
  Synthetic Polynucleotide
taatacgactcactatagggattcttaaagctattattcccactactataaacagaggagatatagtatggggaataataacctggcggcagcgcaaaagatg

SEQ ID NO: 15635 - DNA, 103 bp, Artificial Sequence
  Synthetic Polynucleotide
taatacgactcactatagggttgctattcttaaagctattattcccactaaacagaggagatagtggatgtaatagcttaacctggcggcagcgcaaaagatg

SEQ ID NO: 15636 - DNA, 103 bp, Artificial Sequence
  Synthetic Polynucleotide
taatacgactcactatagggatagattgctattcttaaagctattattccaacagaggagaggaataatggctttaagaaacctggcggcagcgcaaaagatg

SEQ ID NO: 15637 - DNA, 103 bp, Artificial Sequence
  Synthetic Polynucleotide
taatacgactcactatagggactacatagattgctattcttaaagctattaacagaggagaaatagcatgaagaatagcaacctggcggcagcgcaaaagatg

SEQ ID NO: 15638 - DNA, 103 bp, Artificial Sequence
  Synthetic Polynucleotide
taatacgactcactatagggattgcactacatagattgctattcttaaagaacagaggagactttaaatgtagcaatctaacctggcggcagcgcaaaagatg

SEQ ID NO: 15639 - DNA, 103 bp, Artificial Sequence
  Synthetic Polynucleotide
taatacgactcactatagggtaacaattgcactacatagattgctattctaacagaggagaagaataatgatctatgtaaacctggcggcagcgcaaaagatg

SEQ ID NO: 15640 - DNA, 103 bp, Artificial Sequence
  Synthetic Polynucleotide
taatacgactcactatagggctacttaacaattgcactacatagattgctaacagaggagaagcaatatgtgtagtgcaaacctggcggcagcgcaaaagatg

(The sequence listing continues in the following parts.)

What is claimed is:

1. A toehold riboregulator having:
 (a) a nucleic acid sequence comprising any one of SEQ ID NOs: 43841, 9602, 62866, 19367, 164989, 111698, and 236638, or
 (b) nucleotides 21-103 of any one of SEQ ID NOs: 43841, 9602, 62866, 19367, 164989, 111698, and 236638, or
 (c) nucleotides 21-100 of any one of SEQ ID NOs: 43841, 9602, 62866, 19367, 164989, 111698, and 236638, or
 (d) RNA versions of (a), (b) or (c).

2. The toehold riboregulator of claim 1, comprising any one of SEQ ID NOs: 43841, 9602, 62866, and 19367, or RNA versions thereof.

3. The toehold riboregulator of claim 1, having;
 (a) a nucleic acid sequence comprising SEQ ID NO: 9602, or
 (b) nucleotides 21-103 of SEQ ID NO: 9602, or
 (c) nucleotides 21-100 of SEQ ID NO: 9602, or
 (d) RNA versions of (a), (b) or (c).

4. The toehold riboregulator of claim 1, having:
 (a) a nucleic acid sequence comprising SEQ ID NO: 19367, or
 (b) nucleotides 21-103 of SEQ ID NO: 19367, or
 (c) nucleotides 21-100 of SEQ ID NO: 19367, or
 (d) RNA versions of (a), (b) or (c).

5. The toehold riboregulator of claim 1, having:
 (a) a nucleic acid sequence comprising SEQ ID NO: 164989, or
 (b) nucleotides 21-103 of SEQ ID NO: 164989, or
 (c) nucleotides 21-100 of SEQ ID NO: 164989, or
 (d) RNA versions of (a), (b) or (c).

6. The toehold riboregulator of claim 1, having:
 (a) a nucleic acid sequence comprising SEQ ID NO: 111698, or
 (b) nucleotides 21-103 of SEQ ID NO: 111698, or
 (c) nucleotides 21-100 of SEQ ID NO: 111698, or
 (d) RNA versions of (a), (b) or (c).

7. The toehold riboregulator of claim 1, having:
 (a) a nucleic acid sequence comprising SEQ ID NO: 236638, or
 (b) nucleotides 21-103 of SEQ ID NO: 236638, or
 (c) nucleotides 21-100 of SEQ ID NO: 236638, or
 (d) RNA versions of (a), (b) or (c).

8. The toehold riboregulator of claim 1 covalently attached, at its 3' end, to a nucleic acid encoding a reporter protein or reporter RNA.

9. The toehold riboregulator of claim 1, wherein the toehold riboregulator is specific for dengue virus, human rhino virus, or smallpox virus.

10. The toehold riboregulator of claim 1, wherein the toehold riboregulator is specific for a human mRNA encoding a transcription factor selected from E2F3, NCOR1, or ZNF175.

11. A method comprising:
 contacting a sample with a toehold riboregulator of claim 1, covalently attached, at its 3' end, to a nucleic acid encoding a reporter protein or reporter RNA, under conditions sufficient to allow the toehold riboregulator to hybridize to its respective trigger nucleic acid, and detecting and optionally measuring expression of the reporter protein or reporter RNA,
 wherein the toehold riboregulator is an RNA.

12. The method of claim 11, wherein the sample is obtained from a human subject.

13. The method of claim 12, wherein the subject is suspected of having cancer.

14. The method of claim 12, wherein the subject is suspected of having a viral infection.

15. The method of claim 11, wherein the toehold riboregulator comprises an RNA version of any one of SEQ ID NOs: 43841, 9602, 62866, and 19367.

16. The method of claim 11, wherein the toehold riboregulator is a plurality of toehold riboregulators comprising RNA versions of SEQ ID NO: 43841 and SEQ ID NO: 62866.

17. The method of claim 11, wherein the subject is suspected of having a smallpox virus infection or having been exposed to smallpox virus.

18. The method of claim 11, wherein the subject is suspected of having dengue virus infection or having been exposed to dengue virus.

19. The method of claim 11, wherein the subject is suspected of having human rhino virus infection or having been exposed to human rhino virus.

20. The method of claim 11, wherein the sample has been treated to amplify RNA prior to contact with the toehold riboregulator.

21. The method of claim 20, wherein the sample has been treated to amplify RNA isothermally prior to contact with the toehold riboregulator.

22. A plurality of toehold riboregulators comprising a toehold riboregulator comprising SEQ ID NO: 43841 and a toehold riboregulator comprising SEQ ID NO: 62866, or RNA versions thereof.

23. A plurality of toehold riboregulators, each comprising:
   (a) a nucleic acid sequence comprising SEQ ID NO: 43841 or SEQ ID NO: 62866, or
   (b) nucleotides 21-103 of SEQ ID NO: 43841 or SEQ ID NO: 62866, or
   (c) nucleotides 21-100 of SEQ ID NO: 43841 or SEQ ID NO: 62866, or
   (d) RNA versions of (a), (b) or (c).

* * * * *